United States Patent 7,750,207 (ZEA MAYS RIBULOSE BISPHOSPHATE CARBOXYLASE ACTIVASE PROMOTER) - sequence listing, part 4

SEQ ID NO: 4296 - DNA, 2919 bp, Zea mays
gcttttagttgggccgtccatacgcgtgccgcacttaagtgcggcccaccacacgggacacaaactactacagtcaatcagcgcatctcccgcgccttccgaattctgacagtttgttgccttgcgctggttgcggaatgcggattgtctcttcttatcccccttcgactattccaccccaccacatccacatccattcaatcaagaccagcacactgccgcgctccgcaggtcttctctcctacaaaacaaaaaaaccagagagaaagacaacacggccatcacgcgcaaagcgagactacctggagctatgccactccgcttggcggcctgccgcgtcttcctgctcctcgccgcggccgcggccgccgccacctctccgtctccggtggcaacggccacgtccaacggctccgcgaactgcaccctccgcgacggagaaatcgtccgcgcggcgttcaggcaggtcgccaacttccccttgccgctgcccggccgccgccgcgcgtgccgccacgtcaggcggctccgcttcccgtcgcgcaacctcacgggcgccgtggactgggacgagctaggcaacctgagcggcctcctcaccgtcgacctctccggcaactcgctccacggccgcgtcggcagctcgttctggcgcgcgccgtcgctccgggccgtggacgtctcctgcaaccgcctcgaaggcgccctccggttcggcggccacccaggcacgcgcctagccacgctcaacgtgtccggcaaccggttcacctccgtcgagaacgtggccgggctctccggcttggtcggcctcgacgtgtccaggaacgccatcggagcggtgccggaggggctgcggggcctgacgctggtgcgccagctcaacctgtcgtggaacaacatggccgggacgttccccaccgacttgccgcctctcgccggcctccaggtcctggacatctcgcacaacgacttctccggcgcggttgacgccgacaccatccgtaagttcggcagttcctccttcgtccaagccggcgacgcgttgcgggtggtcgaggacctcgcgccggcgccggcgccggcgtctagtggcggcagacacaaacgcagacgtgcggtcaccatggcgctggtctcagtcggcgcagcggtgacgctggtgttcttggccgcgtgcgtggcgtgcgccatgacgcgtcggtggaataagaagaagaaggacaaggacaaggaccggaagacagcggcgtgggaggacgacgaggtggccgtgggggcgttgaagctggccgccgccgcgccggtggtggtgctcgagcggccgctgatggagctgactctggcggacctggccgcggccacgtccgggttcgggcgcgagtcgcagctcgcggacacgggcggccgcagcggggccgcgtaccgcgccgtgctccccggggaccttcacgtcgtcgtgcgcgtcgtggagggcgccgtggccggagttggggaggacgccgacgccgccgccaccgaggctgccttccgggagcttgcccggctcagacatccaaacattctcccgctccttggttactgcatcgcaggtcagctttaccattctcttttattcttatcaaacaaacatcgtttttagtatcaaattaagaacagcatgaaagtgacagcaggtgccaccgcaaccggggcaagttgcatttgtcatttataaactggcttctggaaacaagaatgtctgaacaaaaaagtaaccacgctgattagcagatggagctgaacatatattattatatactttggtccttattacgatcttaatcctgaaaatttggatttttaggggaccaaaagcttgtgctctacgagtacatggagaagggcgacctccaccggtggctgcacgagctgccagtgggcagcatggacacggaggacatatgcatcgacgcaatggaagccatgacggaagacagccgaaagcccgcgggcgactggcccacgcgctaccgcatcatcctaggcgtcgcgcgagggctggcgttcctgcaccagggatgggccggggccggggccgggcggcggccgatcgtgcacgggcgcctggtcccgaccaatgtcctgctcggcgacgacatggagccgcggatctcggacttcctcccgcaccccggcggcggcggcggcgccgagacggcggagggcgacgtgtaccgcttcggcgcgctggtgttcgaggtggtgacggggcaggcgcggtggggcgacgcggcgaccacaagctgggcgcgcggcgtggtccgcaaccgcaagggcctcaacctcgtggacgagcggctgcgtgacgagacggcggggacgggcgcggagagggagctgctcgagtgcctgcaggtggggttcctctgcacggccgccgcgccggagaagcggcccaccatgcagcaggtggtcgggctgctcaaggacgtccgaccggccgccaccgctggaggtggcgtgccgccgccgccgctcaggtcgctggccgaatgatgcggtcgtgagctatagcgcacgcgcgccaggacgtggtggcggtagctggagagagaggacagaggagagtagcgaggcacggtgctcgcatcgcagcacgggcacggcaggctgctgcttttcgcacggtagctcccaaatccaagaagattcgtagtgatttctggcctggggcagcccgaaatacgcctccgtgctctgcttttttggtggtccccgcttttggtttggtgtgcagtggtgttccttcctgtctagttttcgtagaaggtaggatggcatttttattggttggtacgctacgtactactccatcagctttgcacctttgtcattggacacgaggtgcctggagtgagagttcgttttgattgcacc

SEQ ID NO: 4297 - DNA, 1978 bp, Zea mays
tgggaccctcgaggccggccgggaccctcgaggccggccggcaattgctttataaataacataacatacaatataaaattgtatcgtctcctctccttcctgacattggcactggcagctgcactcaccggcagccatggaagacttgctctactactccctcaccatagccatctgcatcgcagtcatcgccctcctctccatccttcgttcgttcaccgctaccggaccgccgccggcgctcccgcccggcccgtcgctgctgtcgctgatcaccccgctcctcttcctcggccgaacgaacttcggcatcgagcggatcctctccgccgcgcggtcccgctacggccccgtcttcacgctctacctgctcccgtcccgcccggccatcttcatcgccgaccacgccgtggcgcaccgcgtgctggtgcagggcggcgccgccttcgccgacaggccgccggccagcctccccttccgcctcttctccagtggccagcgcaacatcacatccggcgcctacggcccggtctggcgcgcgctccgtcacaacctcacgggcaacgtgttccacccgtcgcgcatgggccggttcgccgccgcccgccgccgcgcgctgcgggggctcgtcgccggcgtcgcgcgcgacgccggcagcggggccgtcgtcgtcgaggggctcctgcaccgggccatgttccacgtcctcgtcaccatgtgcttcggcgagcgcctcgccaccgacgccgtcgtcgcgtccgtggaggcgctgcagcgggagttcctcacgtcggtgctcggcttccaggtgttcgacgtgtgccccgcgctcaccagcctcctgttccggcgccggtggaagcagatgctgtccctccgccgccggcaggaggagctcttcgcccctctcatacgggcgtgccgcgcgcaacgaggctccgacgccaacgccggcgcggacacgtacgtggacacgctgctcgacctccggatcccccgaggacgggggcaggaacctcacggagggcgagatggtgagcttgtgcgccgagttcgtggccgtcggcaccgacaacacggcgaccgaggcgcaatggatcatggccaacctcgtggcgcatccggagatccaagcaaggctccgggccgagatccaccaggtcaccggcggcgcgggcgtccaggagcaggacctgccgcggatgccgtaccttcgcgcagtggtcctggaggggctccgccgccacccgccgggccacttcgcgatcccgcacgccgcgaccggcatccaagacgacggcggcggcggcgaccacgcgaccatcgaaggcttccgcgtgccgcggcgcgcgtccctcaacttcacgctcgtcgcgctggggctcgacgaggcggtgtggcccgacccgctgcggttccggccggagcggttcctgcccggcggcgagggcgcggacgttgacctcaccggcgcgaaggaggtcaagatgataccgttcggcgccgggcggcggatctgccccgggatggcgctcgctctgctgcacctcgagttcttcgtggccagtctcgtcgccgagttcgagtggctccaggtccccggtgagccggtggagttcgccgagaagcaggagctgtccgtcgtgatgcgccggccgctccgtgccaccgtcgtccggtgcacaaggaacgccaactgaccacacgggttgtcgttgtcgaaccgaacgtctgcacttttctgctcttgtttgttgctgcatgcatgtgcttttctttcagtgaagttcagcgaatttcgtaaaaaattcgctaccaactttcctgtggacttgtggagtcatgttgttagcatgccctgctcttgttggctagaggctttcatgtatttgcactgcactgctctgattgtcctaaaagttataatattaataaaaaaatcagtttttctttagaaaaaaaacaaaaaaaaccttag

SEQ ID NO: 4298 - DNA, 768 bp, Zea mays
cattgggaccctcgggccctcccagcccgcacttatccactcgacaggctttacttgcttcctggcttgacgaacttagcaagctaccagcggtcggtgaggtcgagcgctggggcatcgccatggccgaggacggcaagtccaatgatcaaatcctcagtgagctcgacgcactcagccacacgctctaccaggcgcacaccaagcgccgcaccacctcgctcgcgctccgtcgctctgccgtcgacgaaaatgcaggcggcgctgacgctgtcgctgtccgcaccgcggcgcgcccgctctcccgccgcatgtccatgtcgccgttccggtcgaggcctaagctggacaataacttgaacgacgacgacgacgaagacgacgacgcgggcgtggcgctgccgtccaagagccagagcttcgctgcggtgacaacgtcgccgaccgtggtcggggagaaaaagggcattcggggatggaagccgatgcgcgcgttgtcgcgcatcggcatgcatcggatgggctgcctcttctccgtggaggtggtggccgcgcagggccttcccacgtccatgaatgggctgcgcctcgcggtggccgttcgcaagaaggagacgcgcgacggcggcgtgcagaccatgccgtcgcgcgtgcagcagggtgcggccgacttcgaggagacgctcttcgtccggtgcaacctctactgcagccgggccggcgccacgggtaaaccactcaagttcgagccccggccgttcctcgtgt

SEQ ID NO: 4299 - DNA, 3247 bp, Zea mays
tgcagcttggttcaacattttttaggcgacttgcgtggtcaccttgtggccacttcattactacgactcatggcttccagaaacctaggcattcagcccctgtgcttgaaagaggcgagtggtctgctacatttgactttctaggacataacgcacctatcgtggtggttaagtttaataactcaatgttccgtaagagtttctccaatggtcaagacacaaaagctgcaccagctggatgggccaatgggacatcaaagatatcatcaaaagaacagcaaccatataatgttattgctattggaagtcaggacagaacaattactgtttggacaacagcgagtgcacggccattgttcgttgctaagcattttttctctcaaagcgtggttgatttatcttggtaaggcatctcgattactcctctatagttaataattaccctagctcatggtgataatgtgcttttcacctgacaggagccctgatggttattcactttttgcatgctccttggatggatctgttgccaacttccactttgaagcaaaggagcttggatacaagttaagtgattctgatctggatgaattgaagaggagcagatatggtgatgttagaggacggcaatcaaatctggctgaaagccctgcacagttactgctagaagaagcatcagcaaagcaatcggctagcaaaaaagggactccgattgtccagcaatttcaagcaccccaaaaactttctgcagatgtgcttaacccagctcctgttgtgcaaaatcagaaagctcctgaagctttacctgaagatgagaagaaatcatcagatcctgctgctgatggtatgaataaagttactcggttatctagtccagtgaagcagagagaataccggcgtcctgatggcaggaaaagaataatcccagaggctgttggatttccatccaaccaggataacatacccagccgttctcagaaccacgttatagatttttcatccttagatcagcgaatgaatgggataagaccatcttattgtagtagcagtaactgtaacaactctggagttaaggactgctctggtgtcacagcaagggctaacattacagaaagtcttgttattcaaaaagcttcaaccaatgctagcagtgatggaaggctgactgtagaacgcactggatctgttgttccaggctctttgaactgccctgcactttctatacatgtattagataagaaagacaatgaggattccttgccagtctgccttgaggcaaatcctgtagaacacgctgcaggtgatatgaatggtgtcggtggtgccttttcaacaaaaggaacagaaataaggtgtacaagaggaacagaaactctttggttggatcgtatatctgcaaaggttactgccttggcaggcaatacaaatttctgggctgttggctgtgaagatggttacctgcaggtttacacaaaatgtggaagacgagccatgccggcaatgatgatgggatctgcagctgtttttatagactgtgatgactgctggaaattgcttcttgtcacaagaagaggtttaatgtatatatgggacctccataacaggacctgcattttgcaggactcattggctgctttgggtgcatctccagatgagtcatcagcaaatcatgcaggtgcagtaaaggttatatctgctaaattctcaagatgtggttttcccttagttgtccttgccagccgtcatgcttttctttttgacatgagcatgaagtgctggttaaggattgctgatgattgttttccggcatcaaattttgccagctcatttattttcccccaagctggagagctaggcaagttgcagattgatgtaggcaagtttatggctagaaagcctatatggagcagggttacagatgatggtttgcagacacgtgcccatttagagacccagttggcagcttctttggctcgcgagccaccactgcggtaccgccaatgcctcctatcctacatacggtttctggcaagagaagcagatgaatcccgtctacgtgaggtttgtgagagcttcctaggtcctcccatgggcatgcttggatctgagtcatctacggatcccaaaagtccagcgtgggattctgatgttctcgggatgaagaagcaccaactcctcagggaagacatacttccatcgatggcatctaaccggaaagtccagcgtctgctcaacgagtttatggatctcctatcagagtatgaagctgctaagagcaaagttgacccaatggatatcacaccggcgctaccacaacaagcaccagaagccaatgccaacgtggtcacctcgtagctgcaccagttccgttgatagttccgttgctggcgacttactgacctctcggtaagtatgataggatagcaatcttggtaagtccttatatgaaccaatcaattagttgtgcttgtaactggtagattgtttagcgagggaggcgacctcaggcaaacattgatattgaacccgttagctgtaacgctgtgtaacagtagaagaaagaagctgaggtcgccaggtaatttattgttaaactgtaggaggccgggtaaactcatgcccttcttgttccaagctaccgtatgcagtggtggcccactggccgtgtgtattttggcgaaaacctgcgtcgtcaaaaactggcattgacatcttttagaggaacaggaacaatgagcatttcggcggtgatgattgagcgggcacgccataaacatgtgatttggataattctttatgtagagcggcttttatatgtgtaaacagaaacagaaaatggtggcttaatccaatcgtcagttggagaggacccggtggatcttgggcctgaaagtctcggcctgtgtgccattgcaagttgtgtcgttgtccttgtcggcggcagcgtagtagtagtcgttgtccttcctccggaccacatacacactgtacggctgcaatagtgtctatgatataccacaaaaaaagaaatagttgatcgatcattcaccacaaaaaaagggtccacatgccagcctagtgcacatgtgagcccatcatctttgatctaaccgtcaactgacaattttgcaaagagacctttccgtccgctcagccgtacccgtagcgcagcacccggccactcctccagtctgtcagacctggcggaggctgatggccctattgactgcaatgacacacactgcag

SEQ ID NO: 4300 - DNA, 1157 bp, Zea mays
  misc_feature (7)..(7): n is a, c, g, or t
gccgggnaaaaatatcggggccgacgcatccgcggccggacgctgagaccgagagcctccagaaacccacgcgacgcgaccgaccaccatggccgcctccgcgctcctcctctcgccgcggctcgtgtctttcccgcctcacccgagcctcgccccactcttcaccaagagaccaccgccctaccccctcggcggcgccggcgcgaggctccgggccgtcggggacgggcccggcgcggggctgccacccgagcaggccacggtctacgacggcgcctacggtccctggaccctggaggactccgacgtgcgcgaggtcctgctgtaccggtcggggctggtgacggcggcggcgtccttcgtggcggcgtcctccgcggcgttcctgccggaagggaaccccgccgcctccgccgtcaccggcgccgccgacctcctgtacgccgccggcgccgcggggctggggctgtcgctggtcctcatccacatctacgtcaccccgataaagcgcttcctccaggcgctgtgggcggccggggcgctcggctccgtcgggacctacctcgtcgccgcccgcccgctggatgagggcctcgtgcagtacgtgctggaccaccccgccgcgctgtggttcgtcggccccacgttcgccgcgctcactggcctcgtcttcaaggaaggtctctgctatgggaaactggaagctggcatcttgacgtttcttatccctgggcttcttcttgggcatttgtctggtttaatggataacagcacaaaggcaggtcttttaggactgtggatgcttcttttcacaatcttcgccgctagaaaattccagcagcccatcaaggatgacgttggagacaaatctgttttcatgttcaacgctctccccgaagaggaaaagaaggcttggatccagaaactcgagaggcaaaagggacaagagttgtttgagtagaaaagagtagcttgtcttggtgcagccaatagttcgtccgtgaatgtttgtagctcatgtattatggctccagaaatttgacaaatacgttccaatagagatgtaattacaaatctgttagatcacaggtaagatgtaactaaataaagcactttcaattttgttgttatagtcgttgataaaaaaaaaaaaaaaa

SEQ ID NO: 4301 - DNA, 1592 bp, Zea mays
cccacgcgtccgcccacgcgtccgcccacgcgtccgccacgcgacgcgaccgaccaccatggccgccgccgcgctcctcctctcgccgcggctcgtgtctttcccgcctcacccgagcctcgccccactcttcaccaagagaccaccgccctaccccctcggcggcgccggcgcgaggctccgggccgtcggggacgggcccggcgcggggctgccacccgagcaggccacggtctacgacggcgcctacggtccctggaccctggaggactccgacgtgcgcgaggtcctgctgtaccggtcggggctggtgacggctgcggcgtccttcgtggcggcggcctccgcggcgttcctgccggaggggaaccccgccgcctccgccgtcaccggcgccgccgacctcctgtacgccgccggcgccgcggggctgggcctgtcgctggtcctcatccacatctacgtcaccccgataaagcgcttcctccaggcgctgtgggcggccggggcgctcggctccgtcgggacctacctcgtcgccgcccgcccgctggatgagggcctcgtgcagtacgtgctggaccaccccgccgcgctgtggttcgtcggccccacgttcgccgcgctcactggcctcgtcttcaaggaaggtctctgctatgggaaactggaagctggcatcttgacgtttcttatccctgggcttcttcttgggcatttgtctggtttaatggataacagcacaaaggcaggtcttttaggactgtggatgcttcttttcacaatcttcgccgctagaaaattccagcagcccatcaaggatgacgtcggagacaaatctgttttcatgttcaacgctctccctgaagaggaaaagaaggcgtggatccagaaactcgagaggcaaaaggggcaagagttgtttgagtagaaaagagtagcttgtcttggtgcagccaatagttcgtccgtgaatgtttgtagcccatgtatatgattatggctccagaaatttgacaaatacacccaagacatgaagatgagaatacgttccaatagagatgtaattacaaatctgttagatcacaggtaagatgtaactaaataaagcagttttgttgttatagtcgttgacaataaaaaagtttattgctcccatgccttaaccacgtaaatgcaaaattcactacttgattggaaggtggagaaaacaaaaaaattatctatgaacgtacatatcatgagcaaacagataatggtaacagaaacagaagaccacattcgcttgcatgataatggtccatccaccgagttcagtctaaaactaccaaacttaatcaccacccaaagggtgcaagcaattccttaatagttctcacatacaatacaactccggtacatataagcctcggaatgccttaaacaattgatagatccccaagacattggctgctacttggtagcaccgaatcgcacggtataccatgtagactgttctggtaatctactactactctgtaaggacgtaacgtggacgtccacagttacgacatgccctcgccctggaaatctcaccgccctcgcgaatcgtc

SEQ ID NO: 4302 - DNA, 1610 bp, Zea mays
  misc_feature (830)..(830): n is a, c, g, or t
gcgcgtcaccattacctagaacatcctaatccacgcaaccagatagcaccagcagtctgcgcgcactccgcagtcggtcgtggagctctcgagcaaaagcgcgcgacatcgtcggagctagctacgcgtgcgcgctccggccggcggatcggatcgggtcggatggcgtcgtcgaaggcgctcctcctgttggctgccgccgccgtcgctgcggcgtgcctggtcggcgccgcggacgccaagttcggccggctgggccggctcgtcatcaccggcgtcgtgccctgcaacaccggcagcctcatcgacatcgccagctcccccgccttcccgaacgcggacgtggagctgcggtgcgcgggcagggtggtggcgggcgcgacgaccaacaccaacggcaccttctccatggagctggacatgaccaacgcgctggccgcgttcatcggcggctgcacgctggtggtggacacgccgctcgtcaagtgcaacgccgacctcaccgacgtcggcagcctcgtctcctacctgcagggcccgctcacgcgcctgctcggcggcatcttccacctcttccccgccggcttctccttccacgcccgacgagcctgacgtcgtatctagctagagctttgtacgtacgtactactggacaacacaatcaaactttaaacatgctgctgagagctatatatatatatatagctacaactacaaatgtaaaatgtttctagacatgtgtaatgctacgtacaaactgaaacgaagttgaaccaaaataaacagttgggaggcaaaaaaaaaaaaaaaatggatgggtgcttgctgtnagctaataagacatctttttacatgtctactgctattaactttggacaccaaatttaacttgccatcataatgatttaaggtccgtttggtttatggctaactatgctacacactttaactaagattagtcgttcgaattgaataactaatcttagacagaaaaggtagataaagtgtggcaaattagtcagcaaaccagatagacccttactctttgctgcccaaagcgcatcatcgatcgatccaactatatatgaccactaacaacagtgtatggcttaattaggtcctagaagtcaaataaaggatcaactaacacaattattttcaatccaagttatcattgcctctccaccaccaccaccattttaccttttgatttatagaaagatggctctactcgatctagctcaacataacaaatagtcctgaatgatttacttttctttatttgcttatataattccaaaaggtgggggcctttcttatcttctccttagtaaagaagaaatttggacttgctcgtgcttggcttgctataaagagaatctctactaagtggcccgtcgctagtggtttaaacactgagtgagctgtgaccctttagctgacaccgttttttttttaattcctgaacaacgactcgtgagtcgtgactcatcacttgcgctggaaacaaagccggacggaccgacctttagtggtttttctaaagaaaggctaaagatatcataaataaagacaaaataaagaagacaaagactactgtttaaatatat

SEQ ID NO: 4303 - DNA, 1654 bp, Zea mays
gcagaccgctccaaagcaaccgagaccaagaccaccagcaggactcgcgaggagagcgcgcccggaaagaaaaaaaaaccctagccccgcccgggcctccgcctcgcgatgtcttgcacggtggccatcccgagctcgccagtcttctcgccctcacgccgcccactctcctgcaaggccgcctccgcctcaccggagcccaccgtccccgcctctaccgcggcgcccgcgcccgccgccgccgccggctcgccgctccgccccttcgcgctccgcgcgctgctgcgggaggaggtctccccgtctccgccgccccagccgacctccgccgcagcggtggctttggtaccgagcggggccgcgctgaagcggcggcgaccgacgccgcttgtcgtgccggcgtccggcgccgcggcagctgctgctgcggcggcggcggtggccgctgtggaggcggatccgaggaacgaggtggaggaggaaggggaggagttcgcagcgtactgccggaggggaaagggaaggagaagggtggaaatggaggaccggcatgtggccaaggtcgctctcggcggggacccccaagtggcactgtttggtgtgttcgatggccacggcgggaaaaacgcggcagagttcgccgcggagaacatgcccaagtttatggccgaggagttgacgaaggtaaacggcggagagatcgaaggagcggtgaagaggggttacctcaagacggacgaggagttcctcaagagggacgagagcgggggcgcgtgctgcgtcacagccgtcctccaaaagggtggactggtcgtctccaacgctggagactgccgtgcggtgctcagccgagcagggaaggcagaggcgctcacctctgaccaccgggcgtccagggaggacgagaaggaaaggattgagaatttgggtggatttgtggtgaattaccgtggaacatggcgagtccagggctccctggcagtgtctaggggcattggggatggacacctaaagcagtgggttgtggctgacccagacaccacgacgctcctggttgaccagcagtgcgagttcttgatacttgcttctgatggcctctgggataagatcgacaatcaggaggcggtagaccttgcacgacctctctgcatcaacaatgacaagacctctcgcatggctgcctgcaggatgctcaccgagacatcgatttccaggggctcgactgatgatatcagtgtcgtgatcgtgcagttgcagaaattttcaagctcgtaacctagttggagaagctggaacaaaactctagccagtagcactaacagactggtgataggtagacatgatatgttacttcgctggcgaaagttttcatgagtcagcgctatttggaggggattttaacattcattctttggtgtagagccattcgtcttattattacatcatttaattcattcttggtaagtactgaaataaggggtgatatctcgcttcatgatattttttcactgttagggctagttttggaacactgttttcctaagcgattcggtgaattgcctctgtatattatattcatagattaaaacttaccgtgccgtttgtatttattgtcgacgccgcccgcaagaaagaatactagtagctttgcgcc

SEQ ID NO: 4304 - DNA, 1526 bp, Zea mays
caaaagaaatcagaaaccagtcctctacttgctaggaagtggttacacacccgaaaacctacccccgccgccttggcctcacgtcacgatgtcttgcacggtgaccatcccgaactcgccagtcttctcgccttcacgccgcccgctgtcctgcaaggccgctcccgcgtcgccggagcccgccgtcgccgtctccgcctcttccgcggcgcccgcgcccgccgccgccggttcgccgctccgccccttcgcgctccgcgcgctgctccgggaggaggtatttccgtctccatcgccccagctggcctctgccgcagcggtggcctcggtaccaagcggggccgtgctgaagcggcggcgacctgcgccgctccttgtgccggcgtccggcgcggctgctgctgctccggtggccgccgtggaggcagatccgaggaacgaggtggaggaggagggggaggagttcgcagcgtattgccggagggggaaggggagaagggtggaaatggaggaccggcatgtggccaaggtcgctctcggcggagatccccaagtggcgctctttggtgtattcgatggtcacgggggcaaaaatgcggcagagttcgctgcggagaacatgcccaagtttttggccgaggagttcaagaaggtgaacggcggaggagagatcgaaggagttgtcaagaggggttacctcaagacggacgaggagttcctcaagagggacgagagcgggggcgcgtgctgcgtcacagccgttctccaaaagggtggtctggtcgtctccaatgctggagactgccgtgcggtgctcagccgagcagggaaggcagaggtgctcacctctgaccaccgggcctcccgggaggatgagaaggagagaattgaaaaattgggtggatttgtggtgaattaccatgggacatggcgagtccagggttccctggcagtgtctaggggcattggggatggacaactaaagcagtgggttgtggctaacccagacactaggacgctcctcgtcgaccaccagtgcgagttcttgatacttgcttctgatggcctatgggataaggtcgataatcaggaggcagtagaccttgcacgtcctctatgcattagcaatgacaagacctctcgcctggctgcctgcaggatgctcactgagacgtcgatttccaggggctcaactgatgatatcagtgttatgatcgtgcaattgcagaagttttcaagttcctaacttaattggagaaacttgaccaaaactctaggcattagcaccaacagactggcggaaggcaggactttgctggctaaagttttcatgagtcagcgctatttttggctgtttaacgttcattcattcattctttgtcatagaaccatttttattattattagatgtaattagatctatttgattcattctttgacaatatttatcaaaaaaaaaaaaaaaaatctctctcttcatgatcgattgactgtaaaaggcgatttgcctatgtaaatacaatgat

SEQ ID NO: 4305 - DNA, 1033 bp, Zea mays
accttgttcttctttgtacatctactccagatgatctgtttggaggtgctgctcagtggggtgcacaaaagctcgggcgcgtgggattacagctgcttgtagtgggtttttagtcggcttaatcacagctactcgctttatcaaaggcggaggttttcagaatgtcttagtagttggtgcagatgctctttcaaaatacgtggattggacagacagaggcaggattgaggctgtttcatcctcctctgctgcgggatgggtggggtcgtcaccgtggcgtcactcgtggcgtatcgtgcagtagggacgacaacggggagctgtcaagatgggttacctcaagacggatgagttcctcaagaggggcgagagcgggggcacgtgctgtgtcatagcccttctccgaaagggtagactggttgtctccaatattggagactgtcatgtggtgctcagccgagcagggaaggcagaggtgctcacctctgaccatcgggcctcccaggaggatgagaagcagagaattgagaatttgggtggatttgtggtgaattaccatgggacatggcgagtccagggctccctagcagtgtctaggggcaatggggatggacatctaaagcagtgggttgtggctgaccgagagactaggacgctcctcgtcgaccaccagtgcgagttcttgatacttgcttctgatggcctatggggtaagattgataatcaggatgcagttgaccaaaaatctaggcattagcactaacagagaccggtggaaggcaggactttgctgcctaaagtttccatgagtcagcgctatttttgggtgtttaacattcattctttgtcatagaaccatttgttatattattagatgtaattagatctatttgattcattcttcggaaatatttattgagataatgcggggtgatctctcgcttcatgatccattgactgtaaaaggcgatttgcctatgttaatacaatgatatattctattcaaaaaaaaaaaaaaaagttttcgttttgt

SEQ ID NO: 4306 - DNA, 2521 bp, Zea mays
  misc_feature (329)..(329): n is a, c, g, or t
tatcgttagaaccggtctaacaacaactctaaaggggtgtttcgttcacatctcctaaactttagttagtcacttttaattcctaaactattaagcggtgtgactaaggaagtgtttgaatgcactagaactaatagttagttagctaaaaattgttagtggaattagctagctaacaaataactacctaactattaaataatttaccataaatacctaaaaactattagatagggtgtttggatgtctaaataaattttagtcactgactattagctctagtgcattcaaacatcccctaaataaagtcttccaaatatatttttttnaactgaagtttaggagagtgacaagaggaataacacccatgagttaagtggtgtttttactgggcagcagcaagatttcactgttgatgacatcatttgtttttactgtgtcagcctgccacggaccaggactgaacgctccgccccgccaccccccgcggcaaaggacgcttaaaaaggaaaaataaaattaaaatccaagtcttacgcgagtccccttcccgatccgccggccgatccacccaccgccgccatgccggcgttcaaggccccggcgccgggcttcgccgtgcgcttcagccccttccacgagaaccgcctcctcgccgccacgtcccagcacttcggtctcgtgggtaacggtcacctcatcgtcctcgacctagccggcggcgggcctggggccgccccggcgccggtcttctccttcccgacctccgatgcgctcttcgactgcgcgtggtccgagtcccacgactccctctgcgccgccgcctccggggacggctccgtgcgccttttcgacgccgctctcccgccggcgcagaaccccgtgcggctcctccgggagcacgcacgggaggtgcacggcctcgactggaaccccgtccgccgggacgccttcatctccgcctcctgggacgacacgctcaagctctggtcccccgaccgcccagcctccgtccgcaccttccggggccacgagtactgcgtgtacgccgccgcctggtccgcgcgccacccggacgtcttcgcgtcggcctccggggaccgaaccgcgcgcgtctgggacgtccgggatcccgcgcccacgctcatcctgcccgcgcacgaccacgaggtgctctcgctcgactgggacaagtacgacccctccatcctcgccaccgcctccgtcgacaagtccatccgcgtctgggacgtgcgcgcgccgcgggcgcccatcgcgcagctcgccggacacagctacgccgttaagcgggtccgtttctcgccgcaccgccagggcatgctcatgtcatgctcctacgacatgactgtctgcatgtgggactaccgcgccgaggatgctctgctcgccaggtacaatcaccacacggagttcgttgccggcatcgacatgagcgtcctcgtcgacggcttgctcgctagcaccggatgggacgagatggtctacatctggccatttgggacggatccaagagccatgtagcacgcagatgcaatagaccaggtgatttgtactattggttttcagctttgcattgggcggtggtaatactaattacatgctcctacatgttcagttactatctcttcaaatgagttgaagaagttggaataatgtcaaaaaattgttcagttactatctcattgagctctagcctctcttatactagtaagaaggaaatggttcgcatgctcataacacctgctgataaccataggccacgatatcttgatagtccaataacataacttgcctttctagaagggaaaatctagtgcggtggtgagagctatcttacttgtgtttgtgtcaccaggtcatatgttcaaagctgcttctccatatttgcgagaggaaggcttaccttggtttatcccttctctagaacctactcatgtggctgtcttcggcactaggtctgtcccctttttttcataataatgagttccaatttaaaaatgcagagaacctaccaataaacattaaacaagtgggtttctactttctagcttatcttgaaaaagctggtggaatgagttccaatgaccataggctagccatacacctcttttaaaggataccaccagttaagattttgttacaaaacaatagaaaagcaaaaagattgcatttctcttcactgttggtcatcacatctgttcatccacatcagtttttccttgaactattatcagttccagtgatttggattggttcacaattgaaactgttggcacgaattgaggtccgttgtgttttggtgtagttggacattctataatggggactatagatgaatgaagttatcttacctgtctactatgttgatcttggttttgtgcccagtggtttcgtgtactccatccatggcaatttataacatgttgcctttttatctaagtgcacatcaaaagccatgtatctagaaaaaccaaaatatcttataatttagagcagagag

SEQ ID NO: 4307 - DNA, 1911 bp, Zea mays
ttgggtaccctcgaggccggccggggtggtcaattgttgaatcacctcccaattccccaaaacgttagacggtgtgacacctaacccacgatccacctttctctctctcgaccttgttccctctcgctataaagaggtgggtacctcgaggccggccgggagcccggatcggaggtggagggtgggctttgtgcagaggccattccctcgctctctatactggagtagatagcagcaggaggaagataacatctcctcaaaaatagatatagcttcttcctctttggttctcttcgttcttttctttcttcttcgatctaaacacgccttcgatccatcctagtatccttgctgttttttcttccccaaggattttgctagctctcctgttgcagatttcctctcaaactaatacgagttctctcagctcctaaccacctgaattctttttagggagcgcttccttttccattcagcaatcaatatcgaaaacctgtctttcttgagcaaaacagcgcaaatactacctaatcaagaagcttttgttctatagatcgacaaaagcaagatggaaaacgttctcctggatcgatcatctagaagccttgagttcccgaagcgatccctaattggtcgcggccggcgggggccagctggcgcgaggacggcggtgccgccgttcggctcgtacagctcgttcacgacgtggcaatcacacaaccacctgcacaaaggtggcgcatgggcctccgctcccgcgcttccatacgcgaggcctccggtgatatactcgtcgccgtctcttcctctcctgccgtcccaccaaccgccgctcctgccgctcccaccgaccgctgcaaagtacgccactttccccgccctaccagcagctccgcccccgccggcgtcggcgccacgcgccggcagggcagcagcgggaagcaccacagtatcagtttcggcagcagtgccgccagcccctgcgccgccgcgccagagggacaggaggaggaggccggcaaggccgcctccgccgacgatggagaggtccgcagcgcagaagaagaagccgctggagcgcgcgacgcctctgccgcccgcgccagtggtgacggaggcactggacgacctcgagcaggaggtggccagggacttcgttcaggacctgctgcacgtgctggcgccgccgccaagcagcctgccgctgcccagcttctccctcgtcgtgaaagcgtcctcccctaccaaggacaccagagtggtgatgccggccgcgccgtcctgcaacgtggaggccgccaccgccgatggcatccgcggcctcctccgtctgtaggacagcagggagaaggcccatctgccagtctgtcgtgcttggtattccataatatttccccgccaatattatttttttggttgggaaaattaaatgcgtagaaaaatattgcaagaaaagatgtgatgcttgagctctggtcggtcgagttgtccgcagcgtgactgtgatgttgccgttggatggatgctacctctggcggtgcaaaagcgagaggaagacgacgatgtcagctaaggttagtttgtgcgagacgtcggtgtggtagatatctagggttttacgttagtgtctactgccgtactccactagtactgctttttcttgattgggtgatgggttttttgaattaccttgtatcaagatcactgcatatatacgatgtaatgtatgcaagtgcgtgtgactttacatatatattatatatttgaaacattgtattcttgttggatttaatccgcatgtatgcattacatgtgcgtcatgaaatcagcattgatttccttgagtacatatcctatttggcaatgttgggggtggtggagtacaagtacttggattcaataatctccttc

SEQ ID NO: 4308 - DNA, 2356 bp, Zea mays
tcgaggccggccggggcggccacctcacactggccgctgctgagcagagctgacttttgctccgcttgccttgccccaaacctcatattcccctcctccttgctgtagctatagctgtagctttcaccccactccctccacggcaccgcgcctccctcccccccttccccaaatcctcctcccctccccaattgggccaatagcccgctccgcttccagtcgcggcgtcggtcggggaagaagcttcgctcccgtgccgcagatcgggagaggagctccccgctcccgcctcgtcgtccgcttccccgccgccggtctctccgggaggcgtctccgtcgccggcgatgagctgcttcgtctgcttcgggtcggcggcgcaggacgaggagcctaggaagcccgctgccgcgggcgccggcaaggacgccgcgccggatcgcgcagtggctcgcgtcggatcagataaatcaagatcacagggtggaccagactctaagaaggatctaattatccataaggatgggaatagtcaaaatattgcagcacagactttcacttttcgtgagctcgctgcagccactaagaacttcaggcaagattgccttttaggagagggaggttttggtcgtgtatataaaggacgcttggagaatgggcaggctgttgctgtgaaacaacttgatcgtaatggtctccaaggaaacagggaatttctggttgaggttctcatgctcagtctcttacatcacactaacctggtcaatctaattggctactgtgctgatggtgaccaacgccttcttgtttatgagtttatgccattggggtcactagaagatcatctgcatgatctgccaccagataaagagcctcttgattggaacacacggatgaagatagctgcaggtgcagctaagggcttagaacaccttcatgacaaggcgagtcctcctgtgatttaccgggattttaagtcatcaaacattcttcttggagaaggatttcatccgaagctatcggactttggccttgcaaaacttggtccggttggtgacaagacccatgtttcaacacgtgtgatgggtacatatggctactgtgccccagaatatgcaatgactgggcagctgacggttaaatccgatgtgtatagctttggtgttgtgttccttgaacttatcacggggcgtaaagcaattgacaatactaagacccaaggggagcaaaatttagtggcatgggctcgtccactgttcaaggaccgaaggaaattccctaaaatggctgatccaatgcttcagggccgcttccctatgaggggtctataccaggccttagccgttgctgccatgtgcttgcaagagcaagctgctacacgtcctcacatcggggatgtcgtcactgctctctcatatcttgcttctcaggcatatgacccaaatgcccctgttcaacacgtccggagcaattcatccacccccagggccagaaaccctgctgggtggaacggcgaccagcgcagcgtgcgctcgcctaaccatcattctccagacccgcggcgcagagacgccgcgggggcatccaagtatggagcagaggttagcaggactagctctaccagcgactctggccggcgatcaggcctggatgacatggacctgaccgggtcgcaagtgggaagcccagcgcagaccggaagaagaagagaagctccaaggggcaccgacagacagcgtgctgtcgcagaggccaggacatggggggagaattcaagggagcgaacaaatggccatggcagcttcgacagcacccatgagtgaagccgtcaggttctgttccagtcatcattccagaacccccaccatgggttgagtccactcattcatcagcaccagtcagatccgatcttgggacatggcgtcggtccaagtgtctgtgaataaggcttttcttgccctcctgtggcgaatgcaattctcctggcgcccattccttgccaatgcgacctgtgtgtgtcatgcctctggcgactgggagcctcaggaggagcctgtaggattcagtcagaggtagacaggtcagtgaagaaagaggaggggcgcgcagtcacattggcgagtgttttgttttttttggcggctaaatgctgagtatgttcagctgcatgtgtcctttttgtgtatgtgtacgtgtaagacgtgtaatagcaaccgtgtcaggtttggctacctgagaggcctttgaagcttctgctgctgcttccttccccttgggaattgggagttcagagttgaaatgtaggataggcgatgttgttgagtacagcaactgtttttaccaaaaaaaaaaaaaaaa

SEQ ID NO: 4309 - DNA, 3085 bp, Zea mays
ctgcagccactaagaacttcaggcaagattgcctttccgcccggccgggttttggtcgtgtatataaaggacgcttggagaatgggcaggttagtatctcttaaacatgatgcatcgccattttatctgtgaagctaaatccttccaaatttggcctctgggttgaaacattaagtaaaatattggttggaaatgctaacataacgattatacttaagccctggattagtcctggatactaacagagttttacttcccaggctgttgctgtgaaacaacttgatcgtaatggtctccaaggaaacagggaatttctggttgaggttctcatgctcagtctcttacatcacactaacctggtcaatctaattggctactgtgctgatggtgaccaacgccttcttgtttatgagtttatgccattggggtcactagaagatcatctgcatggtctgtgtatctcctctttgtcatatactcttccgaatattccatgagtgcctgtagcaatgtaatgaagcattgtcttattctataggaatgacatgcttcatctgattgttaaatctattttatgtctagcgtgactgtaactgtgtgcttaggttgatagatcataattcttgattcagcttaaactgatcagcatgcgtgttgttctactattggatgtaccttataggtagggtgctaatttttttgtatcgtgtgcctggccatgtaatttttcatatgctatctatacttaaaacaaaacaaagttgaccagagggagagatacccccccctgattttgtttataagaagtttgtgccacccttccaacctgaactggtgattagaggtttcttcaacctccagacttcaattgctaagtagtgtaactcaggaggagttggcttttcaattttcataggatccggcccgtccctcgcggtttgcctggggcttcgtttgtatttagccagacctttggatgaagcttgctgtatatggacaatttcttctgactagagttggtatcctttgttttttgctcttccaattctttgcagtcagttcatgggtcttgtaactgaacagtgtttatttgtatagatctgccaccagataaagagcctcttgattggaacacacggatgaagatagctgcaggtgcagctaagggcttagaacaccttcacgacaaggcgagtcctcctgtgatttaccgggattttaagtcatcaaacattcttcttggagaaggatttcatccgaagctatcggactttggccttgcaaaacttggtccggttggtgacaagacccatgtttcaacacgtgtgatgggtacatatggctactgtgccccagaatatgcaatgactgggcagctgacggttaaatccgatgtgtatagctttggtgttgtgttccttcatcgggtcccgcggcgccggccgggtgacaatactaagacccaaggggagcaaaatttagtggcatgggctcgtccactgttcaaggaccgaaggaaattccctaaaatggctgatccaatgcttcagggccgcttccctatgaggggtctataccaggccttagccgttgctgccatgtgcttgcaagagcaagctgctacacgtcctcacatcggggatgtcgtcactgctctctcatatcttgcttctcaggcatatgacccaaatgcccctgttcaacacgtccggagcaattcatccacccccagggccagaaaccctgctgggtggaacggcgaccagcgcagcgtgcgctcgcctaaccatcattctccagacccgcggcgcagagacgctgcgggggcatccaagtatggagcagaggttagcaggactagctctaccagcgactctggccggcgatcaggcctggatgacatggacctgaccgggtcgcaagtgggaagcccagcgcagaccggaagaagaagagaagctccaaggggcaccgacagacagcgtgctgtcgcagaggccaggacatggggggagaattcaagggagcgaacaaatggccatggcagcttcgacagcacccatgagtgaagccgtcaggttctgttccagtcatcattccagaacccccaccatgggttgagtccactcattcatcagcaccagtcagatccgatcttgggacatggcgtcggtccaagtgtctgtgaataaggcttttcttgccctcctgtggcgaatgcaattctcctggcgcccattccttgccaatgcgacctgtgtgtgtcatgcctctggcgactgggagcctcaggaggagcctgtaggattcagtcagaggtagacaggtcagtgaagaaagaggaggggcgcggagtcacattggcgagtgttttgttttttttggcggctaaatgctgagtatgttcagctgcatgtgtcctttttgtgtatgtgtacgtgtaagacgtgtaatagcaaccgtgtcaggtttggctacctgagaggcctttgaagcttctgctgctgcttccttccccttgggaattgggagttcagagttgaaatgtaggataggcgatgttgttgagtacatcaactgtttttacccttccatgttgtacggcgacgcttccctgaacaatatgaccatgatgtgcccccctgtccgccaatggccaatccgtgtaggtgcagacgactggtctctgcacgcgtcaagacacccggaggcggccgccggcatcgcaccatccccgaacatgggtggcggccgcggcggcgattcagcgctgaccataccacagatcgggagcatctgaacaattgtgaacgaaagaagaagaagaggccaccatactgatgaccagtcgatcacggcagaatctcgccaagatccgaaatcactggctggtgagcggcagcagagcccagacgtcaggtatgtttgacccgcgtaccctactacccaccccgtcgcggcggctgtctgtgcggggcccggcgcgtgtgggtccaccgcgtttttttttgaaaggtcacgaaggggtaggtgagcgcaccgcacaccaacgcgatctgtgcagccctgcaggtcgactatagag

SEQ ID NO: 4310 - DNA, 2073 bp, Zea mays
cctcgaggccggccgggatcccccgcttccgcggcgcttccccctcccccgctccctccacaattaggccagtagcccgcttgcagctgcggcgtcggtcgggaagaggccttgctccagtcccgcagatcgggggaggcgctcccccccgcccccgcctcgtcagctcggccgcttccccgccgccggtccctcccggaggcgccagcgtcgccgatgagctgcttcgtctgcttcgggtcggcggcgcacgacggggagtccaggaagccccccgccgcgggcgccggcaaagacgtcccgccggatcgcgcggtggtccgcgtcggatcagacaaatcaagatcacagggtggaccagaatctaagaaggacctgattatacatagggatgggaatagtcaaaatattgcagcacatactttcacttttcgtgaacttgctgcagccactaagaatttcaggcaagattgccttttaggggagggaggttttggtcgtgtatataaaggacgcttggagaatggacagatctgccaccagataaagaacctctagactggaacacacggatgaagatagctgcaggtgcagctaagggcttagagtaccttcacgacaaggcgagtcctcctgttatttaccgggattttaagtcgtcaaacattcttcttggagaaggatttcatccgaagctatcagactttggccttgcaaaacttggcccggttggtgacaagacccatgtttcaacacgtgtgatgggtacatatggctactgtgccccagaatatgcaatgactgggcagctcacagttaaatccgatgtgtatagctttggagtcgtgttccttgaacttatcacagcccgccgggccggtgacaacaccaagacccaaggggagcagaacctagtggcatgggctcgtccactgttcaaggaccgcaggaaattccctaaaatggctgatccaatgcttcagggccgcttccctatgaggggtctatatcaggccttagctgttgctgccatgtgcttgcaagagcaagctgctacacgccctcacatcggggatgttgtcactgctctctcatatctcgcttctcaggcttatgacccaaacgcccctgttcaacacagccggagcaacgcatctacccccaggtccagaaaccctgctgcatggaacggtgatcagcgcagtgtgcgctcgcctaatcatcaccattctccagacccgcggcggagggaccctgccagggcatccaagtatggagcagaggttagcaggactagctctgccagcgattctggccggcggtcaggtctggatgacatggacccgaccgggtcgcaagtgggaagcccagctcaaaccggaagaagaagagaagctccaagggccaccgacagacagcgcgctgtcggagaggccaggatgtggggggagaactcaagggagcgaacgaatggccatggtagcttcgacagcacgcatgagtgaagccgtcaggttccactccaggcatcatttcagacgaacgatgggtttgagcccactcatcggcaccggtcggatctgatcttgggacatggcgtggtgccgcccggtccgggtgtctgtgaataaggctctctctcttgccctcatgtggcgaatgcaattctcctcatgtccatcccttccgaaggcgatgcttccggcgacggggagcctgaggagcctcctgtaggattcagtcagaggtagacaggtcagtgaagaaaaaggatgcgcggagtcacattggcgagtgtgtgtttttggtggctagagctgagtatgttcagctgcatgtatccttttttgtgtatgggtaagagcaaccgtgtcaggtttggctacctgagagacctttgaagctagccagctgctgttgctgctgcttctgcttcttcctccccccttttgggagttcagagctggaatgtaggtaggataggcgatgatgttgagtacagcaactgttttacaccaaaaaaaaaaaaaaaaaaaaggaaaaaaaaaaaaaaaaaaccattccgttctagag

SEQ ID NO: 4311 - DNA, 1902 bp, Zea mays
attcgaatccgaaggtacctgttcatgtattacaactccggaaacgttgttaaatcatgtttttaaggacctttagaagacgaaggcccccaacagatcctgaactgcactcattcattcagtcttcctgctctttcgttcatttgtcccgttcattccgttagactggcaagggaaccttttctttcaggtaatcagccacgccaaaaaaaaaacagcctatcactgaccctctcacaagacagcaaatcagcatcattaccaccttgtgatcgtcagaaaaaaagatgagggaactcggaccctctcgtgtctgcacttgctgctgcttgaagcaagcatggctgttaggctgttccacctgggcaggggcagctcacctcacctcaccgtttggtgccctgtaactgtaagactcacccccaccaccttctcttacagctcactcctctccacccacctgcacgagaccattagctagcccctcgggcccgccggacaccgatcctcccagctgcatctgcattgcattgcatgcacaggtcgcgcccaccatcagtagcggtcgccgccatgcagagactcgtgcgcgtcctcgtggtgctgggcgtggccgccgcggcgtcggcgcaaggcccgacggcggcgccaacgacgcccacgcccacgccggcaacccccgcggcgcccgcgcccacgacggcgtccagcaacatcacgggcgtgctggccaaggccgggcagttcaacaccttcatccggctgctcaagtccacgggcgtggcgtcgcagatcgacaaccaggtcgccaacggcgggaacggggtcacggtgttcgcgcccacggacaacgcgttccagtcgctgccctcgggcacgctcaactcgctgtcggaccaggacaagaacgcgctggtgcagtaccacgtggtgtccgccgccatccccatgtcgcagttcgacaccgtcagcaacccgctccgcacgcaggccggcagcgcctcgccgggggagttcccactcaacgtcacctcctccgagggccagcaggtcaacgtcaccacgggcgtcgtcaccgccaccgtcgacaactccctctactcgggcgacagcctcgtcgtctaccaggtcaacaaggtgctgctccccatgaagctcttcggcgccgcggatgcgcccgcgcccgcgccgctcgcgccggccaagaagaagggcaagacgccggcggccgtcgccgactcgcccgacgcggcggaggcgtccccggacgccacgaccacgtcgctcgcgcccgcgaggctgacgcggggtggcctcgccacggctcttgcgctcgccgtcgtgtggtgggggctgtagtcacggcgaggagtgtctcgtgaggtctctccggtggccgtgacatctatacattttttttttcgttcgcgggtcttgtttgtcttttcgtttttactttattgcccatttttggatgaattgttcttccctgtcattcaaattgctaggagtatgtcatgtcatgtaacgtccttgtcccatttttatgtaatgttaactaaataaatatgagttgtgtatatttcagtaaaaaaagaaaaaaaaaaaaaaaattatacgcacacaaacatgataccacgagtttatcagattgggcttagttccattttttttatagaaaaaatcactctgacaatgttgaagcagatacatacgtacagtctgacgtgcatgacgaaaacaacgaaaatgcaaacaattatctttacgagagcctgcaataatggagaaaaggaatatgtagttctacaacctgtaagaactaaggtggtgtttggttcaccaaaatgtaccgcaaacagattacatgcggtaatagatgcataacttttattgggttga

SEQ ID NO: 4312 - DNA, 2866 bp, Zea mays
cagaagcaccagcagcacgttgcatctgtggtccaaaggttagctcgtgaaaaggataagtggttgagctccagtccggatgcaatgaaaatcaacatggaattcttgcagcgctgcatattcccacgatgtgtttttagtatgcaagatgcagtgtattgtgctacatttgtccaaacactacactcccttgggactcccttctttaacacagtcaatcatatcgatgttcttgtctgtaaaaccctacagccaatgatatgctgttgcacagaatttgaagctggcaggcttggaagattttttcatgatacgttgaagatggcctactattggaagagtgatgaatctgtctatgagcgtgaatgtgcgaacaaacctggttttgcagtgtacttcagatacccaaacagccagcgtgtgtcctacagtcagtttgttcgggttcattggaagtggagttcaagaatcaccaaagcacttaatcaatgtatggaatcaaaagaatacatggaaattcgaaatgcccttattgtccttacgaagatttctagtgtcttcccggtgattcgtaaaagtggtgtcaatcttgagaaacgggtggctaaactaaaaggggatgaaagagaagatcttaaagttctagccactggtgtagctgctgctttagctgctcgcaagagttcttggctatctgaagaagagtttggcgggggtcacattgatctgaagccagcaacagcaagatctgtgcttggaaaccagtcagcagatctctcgatggcaaaagatcaaaatgcccgtgcaaagtctgtagagaataggcatgaaaggtcagagggtgctatgaagcctgacgttcagcaaaagaagagcactgtggcttcaaatggatctgatattctaatacaatcttcctccgtacaagggaaatcttcagtggttgcacgtgcaatggatgagcctccaaaacctgtgtctgatgagggggttaaagtttctacaaaatctacttcagaatttgagacaagggcaacacaaaagcgtgctggcaatgctgggaaggtaatgaagcatgatgttgcaaaggaagatgcaaaagctgggaaacctacaagctggaatgtaaatcaacaagtctccactgttgatagagaagtgtctcatgcagctgatgctgcccaagaaaccagtaccactattagcaatggtaacttgcatccagcgccgcataaggtttcatcatcttctcaaagaaatgcagttacacataatggagcagccaatccctctgttgagtctactgatatgattgactctcctgtgagacagcaaaaaagaccgccggttgaggagcaagatagatcaggtaaacggaggaagggagaaaatgaacccgatttgagtgaacaccatgtagacaaggaaaagagtttggactcacgtggtggagataagtttcgttcagtggatcatgagaagagtgctaatgaggaacaaaatttaagagcgggcaaaataaaagaaaaatctgatgataaatatgacagagatcctagggaaaaattagatcggggtgaaaggcgtcgtggggaagatgccattgagagatcaacagatagattgtcggacaggagagaacgttccattgaaaggatgcaagagagaggtacagataaagcccttgaaaaaggtagagaggatagaaataaggatgagaggaataaagttaaatatgctgaaccttcggtggaccggacacattcttctgatgaacgattccgagggcaaagtttgccaccgcccccacctattcccgcaagttttgtaccccaatcagttggcgccaaccgacgtgaagaagatgctgaccgaaggggtgggagctccaggcatgttcaaaggtcatctcctaggcacgatgagaaagaaaggaggcagtcagaggagaatatttcgtcatttcaggatgatgggaagcacagaagagaggaagatattcgtgatagaaagcgtgaggacagggatactttatcaaacaaggtagatgacagggatagggaaaaggggacttctttgaaagaagacagtgatcctagtaatgtttctaaacggagaaagatcaagcgagaacagactttagaagctggggaatatgcaccttctgttccacagcctccctcccatggatctggcagctcacaattgtctgacatacgagaaagagaaaggaaaggggtaatttcacagcatcgtatttcacacgctgatgaccttcctaggacacatggcaaggacatgacaagcaagtcaagtcgtcgagagtctgaccaaatgcacgagagggaatgggaagaggaaaagcgaccaagaactgaaacgaaaaggaagcaccgaaaatagctgatcaatgttgacatggattcagttgagcctcataatttttctccaagcacagtagtggatgcacttgaatttcatgctttcgtgttgtgaggaaacatacttcagcatatagctaagcagatcgtttattagtgtactgtgccagttgcgggatgtggcctttcctgtcgagctcaccaatgcgaatttaacagatgggagatgagtcatgtttagcttcatacattttgtgctgtaaacaatgtacaatgtgtcataatgatttgtactgtgaacatagatggatggctcaccatccgggtattatgtattttattactaactgctaagttgtttggtgtaggaagcatcaccatttttttttgcattgtgtaggaataatgttagggatgcagcataattgaaatgtacatattttggccagaatttttgccaagctatttaacttttcgggttcatt

SEQ ID NO: 4313 - DNA, 1313 bp, Zea mays
cgtctattaaaaaccttgaagctacaatgtattggtactggggatgacgccctagatgctattggttcattctgtcctcttttagagatcttgtcactcaacaacttcgaacgatttacagacaggagccttacttcaattgcaaaagggtgcaagaatctcacagatcttgttctcactgattgccagttactaactgatagaagccttgaatttgtagctcgtaactgcaaaaagttagcacgtttgaagatcaatggttgtcagagcatggaatctgttgcactggagcacattgggcgatggtgtccgcgccttttggagctctctctaattttctgccccaggatcgagaacagtgcattcctggagattggtagcggctgctcccttcttaggactcttcatttgattgactgctcaagaataactgatgacgccttgtgccacatagctcaaggctgcaagaacttaacagaactttctattcggcgtggttatgaggttggagacagggcattggtgtctatcgccgagaactgtaaatcgctcagagagttaacgctccagttctgtgagagggtatccgatgcagggctatctgcaatcgcggaaaactgccctctgcataggctaaacttgtgcgggtgccacctaatcaccgataccgggctgacggcagttgccagaggatgccctgatctagtcttcctggatatgagcgtccttcggatcgtaggtgacatagcgcttgcggagataggcgacggctgtccgaagctgagagagatcgcgctctcccactgccctgaggtcaccaacgtcggcctgggccaccttgtgcgagggtgcctgcagctggagtcctgccagatggtctactgccggcggatcaccagctccggggtggcgaccgtcgtctcgggctgcgggaggctgaagaaggtcctcgtggaggagtggaaggtgagcgagaggacccggcggagggcggggcccgtcctgtcgttcctctgcaccgggctctagtaagtagggttcgcaagaaagggcaatgaatctgcccagcgtcagacttgctcaagtctttggatgaacagagcttgtcttgcgctggtgctgtgttgtgtcgtataccatagttccatagcatcgttcgttgcctcaaacaaaaggtgttgtgtgaactgttttaatttactcacaatgtgttgcacagatcgaaaatgttgtaccagatgttgtatcagaagtgatgaccaaataaagacgagacgaaggaagtggcaagagcttcaaaaaaaaaaaaaaaa

SEQ ID NO: 4314 - DNA, 887 bp, Zea mays
aatcccgataccgggctgacggcagttgccagaggatgccctgatctagtcttcctggatatgagcgttcttcggatcgtaggtgacatagcgcttgcggagataggcgacggctgtccgaagctgagagagatcgcgctctcccactgccctgaagtcaccaacgtcggcctgggccaccttgtgcgagggtgcctgcagctggagtcctgccagatggtctactgccggcggatcaccagctccggggtggcgaccgtcgtctcgggctgcgggaggctgaagaaggtcctcgtggaggagtggaaggtgagcgagaggacccggcggagggcagggcccgtcctgtcgttcctctgcaccggactctagtaagtagggttgccaagaaagggcaatgaatctgggcagcgtcagacttgctctttggatgaacagagcttgtattgcgctgttgctgtgttgtgtcgtataccgtaggtccatagcatcgttcgttgcctcaaacaaaaggtgttgtgtgaactgttttaatttactcacaatgtgttgcacagatcgaaaatgttgtaccagatgttgtatcagaagtgatgaccaaataaagacgtgacgaaggaagtggcaaccgcctcatccaatgctgtaccaaattgctgttactcgtcttgtacctcgagtgcttcttcgatttctatgccacgtgttcacgtcctcaagtcaggcatgtgagatataggaaagaattgtattatcatcaaactttaaaatgttgtgtggactgttttaatttactcacaatgtgttgcacagatcgaaaatgttgtaccagatgttgtatcagaagtgatgaccaaataaagacgagacgaagtggcaagagcttc

SEQ ID NO: 4315 - DNA, 1139 bp, Zea mays
ccctcgaggccggccggcacctaccggccatcctccacccacagacaggcttctgtgaatttgtccaattccaatccaaaccctaacaaccaacaacaccgtcgatcatgatcgtcgacaagtttgaggaagttttgcagacggcagcgcttccagctgctgcctctgttgcacccatcccctccgtcattcctggaagcgagcctatctaccaggttgccggtgatgctggacaaaaggtcctctgggttgtctttgccatcatgttggttgcctctggtgctttcactctcatgtcatggaatgtccccttgaacaagcgtctctaccatgtcgttactaccatcatcaccctgactgctgccctctcatacttcgccatggctaccgcccacggtgtttccctgacaaagattgttgagcgtgagcagcacgaccacgttcctgacaccttcaccaccacctaccgtgaggtctactgggcccgttacgtcgactggaccatcaccactcctctcctgctcctcgatctcggtctccttgctggcatggccggtggacacctgatcatgatgattgttgccgatatcttcatggttctgaccggtctcttcgctgctttcggctccgaggacactcctcagaagtggggctggtacaccatctcctgcatttccttcatctttgtcttctggcacttgggtctcaacggtggagccaacgccaatgcccagggtgagaagcttcgcggcttctttgtctccatctccgtctacactgccattctctggactgcctaccccattgtctggggtattgccgacggtgcccgcaaggtcagcgttgacactgagatcattgcctacgccattctcgacgttctcgccaaggctgtcttcggtgcctggctcctcattgtccactccaacatgcgcgagagcgatgctgagctcaacggcttctgggccaacggcctcagccgcgatggtgctatccgcatcggtgaggacgacggtgcctaagcgcattctgtcaatgctagatacttcaagcaagtttcatacgattgccttagacaagcgtggttcgcctcaagtgcaagctcatggagacccgaaacaggttcgatgatccaaaaa

SEQ ID NO: 4316 - DNA, 1566 bp, Zea mays
aattcggcacgagggtctcgtccaaacggtaaaacagcaagcgctaactgatccaaaacatcaaaagcgccgcgcaggcagaagcagcaggtaaaagaaccggaagccaaccaggagcgcattcccactcatcagccagcagagctcagatataagctcaccagccgcccgcggggcgggcctctcccactccctcctccctccccctcgtccagtccactcccattgggcgagaagccgagaaggacagggagggagcgagagctagccaggccgtcccgtccagagccgctatgtccggcggcgcgcccctcctggccctgctgctgctggcggcggcggccatgatcgccccgtcgccggccaatgccgccgtgtcgtacgaccacagggccgtggtcatcaacgggcagcgccgcatcctcatctcggggtccatccactacccgcgcagcacgccggagatgtggccggggctgctgcagaaggccaaggacggcgggctggacgtggtccagacgtacgtgttctggaacgggcacgagccggtgcgtgggcagtactacttcggcgaccgctacgacctcgtccgcttcgtcaagctcgccaagcaggccggcctctacgtccacctccgcatcgggccctacgtctgcgccgagtggaacttcggcggcttccccgtgtggctcaagtacgtccccggcatcagcttccgcaccgacaacggccccttcaaggcggcgatgcaggcgttcgtggagaagatcgtgtccatgatgaagtcggaggggctgttcgagtggcagggcgggcccatcatcctggcgcaggtggagaacgagtacgggcccatggagtccgtcatgggcgccggcgccaagccctacgccaactgggcagccaagatggccgtcgccaccggcgccggcgtgccctgggtcatgtgcaagcaggacgacgccccggaccccgtgatcaacacctgcaacggcttctactgcgactacttcagccccaactccaacagcaagccgaccatgtggaccgaggcctggaccggctggttcacggcgttcggtggcgcggtgccgcaccggccggtggaggacatggccttcgccgtggcgcgcttcatccagaagggcggctccttcgtcaattactacatgtaccatggaggcaccaacttcgaccgcacctccggtgggccgttcatcgccaccagctacgacacgacaccgattctttcttcctcgtgaagtatctatagatacggcgtacatacggacacaatttgtgcccactatacgtacgtacaaaaaagattagtactagagtttaccgtagatctgttcttggagttggccgacgccggcacggctgcaggaactgcggctcacggccggctggtaatggtactagtagcgtggtttttgctctgcactccgcatgaatctcacggcgcacgcaggcttaattttcttagcgcaaatttgcgaaactgagttgtaaatgaggttatttattcctacgattaagtatgatacaagacgaataattatt

SEQ ID NO: 4317 - DNA, 1231 bp, Zea mays
  misc_feature (881)..(881): n is a, c, g, or t
  misc_feature (938)..(938): n is a, c, g, or t
  misc_feature (1028)..(1028): n is a, c, g, or t
  misc_feature (1123)..(1123): n is a, c, g, or t
gccggccgggttggctctcccactccctcgtccctccccctcgtccagttcactcccattgggcgaccgctacgacctcgtccgcttcgtcaagctcgccaagcaggccggcctctacgtccacctccgcatcgggccatacgtctgcgccgagtggaacttcggcggtttccccgtgtggctcaagtacgtccccggcatcagcttccgcaccgacaacggccccttcaaggcggcgatgcaggcgttcgtggagaagatcgtgtccatgatgaagtcggaggggctgttcgagtggcagggcgggcccatcatcctggcgcaggtggagaacgagtacgggcccatggagtccgtcatgggcgccggcgccaagccctacgccaactgggcagccaagatggccgtcgccaccggcgccggcgtgccctgggtcatgtgcaagcaggacgacgccccggaccccgtgatcaacacctgcaacggcttctactgcgactacttcagccccaactccaacagcaagccgaccatgtggaccgaggcctggacgggctggttcacggcgttcggtggcgcggtgccgcaccggccggtggaggacatggccttcgccgtggcgcgcttcatccagaagggcggctccttcgtcaattactacatgtaccatggaggcaccaacttcgaccgcacctccggcgggccgttcatcgccaccagctacgactacgacgcgccgatcgacgaatacggtctgctgaggcagccgaaatgggggcacctgagggacctgcacaaggccatcaagcaagccgagccggcgctggtctccggcgacccgacgatccagtcccctcgggaactacgagaaggcgtacgtngttcaagtcgagcggcggcgcctgcgcggcgttcctgtccaactaccacaccagcgncgccggcgcggggtggtgttcaacgggcggcgctacgacctcccggcctggtccatcagcgtgctgcccgactgcaagggccgccgtgtntcaacacggcgacggtgagcgagccgtcggcgcccggcgcgattgaagccccgcgggcggcttttttcgtggcagtcgtacagcgaggccaccanctcgctggacggccgcgctttcacaaggaacgggctggtggagcagctcaacatgacgtggggacaagtcggactacctgtggtacaccacctacgtgacatcactcg

SEQ ID NO: 4318 - DNA, 3165 bp, Zea mays
  misc_feature (3007)..(3007): n is a, c, g, or t
  misc_feature (3013)..(3013): n is a, c, g, or t
  misc_feature (3024)..(3024): n is a, c, g, or t
  misc_feature (3036)..(3036): n is a, c, g, or t
  misc_feature (3069)..(3069): n is a, c, g, or t
catcaatccaccgcccttctcccatctcttggctcttgcttgcgcactcgtccaaacggtaaaacagcaagcgctaactgatccaaaacatcaaaagcgccgcgcaggcagaagcagcaggtaaagaaccggaagcccaccaggagcgcattcccactcatcagccagcagagctcagatataagctcaccagcactaccccttcccatcctctcccactccctcctccctccccctcgtccagtccactcccattgggcgagaagccgagaaggacagggagggagcgagagctagccaggccgtcccgtccagagccgctatgtccggcggcgcgcccctcctggccctgctgctgctggcggcggcggccatgatcgccccgtcgccggccaatgccgccgtgtcgtacgaccacagggccgtggtcatcaacgggcagcgccgcatcctcatctcggggtccatccactacccgcgcagcacgccggagatgtggccgggcctgctgcagaaggccaaggacggcgggctggacgtggtccagacgtacgtgttctggaacgggcacgagccggtgcgtgggcagtactacttcggcgaccgctacgacctcgtccgcttccattggtaccccgggccggcctctacgtccacctccgcatcgggccctacgtctgcgccgagtggaacttcggcggcttccccgtgtggctcaagtacgtccccggcatcagcttccgcaccgacaacggccccttcaaggcggcgatgcaggcgttcgtggagaagatcgtgtccatgatgaagtccgaggggctgttcgagtggcagggcgggcccatcatcctggcgcaggtggagaacgagtacgggcccatggagtccgtcatgggcgccggcgccaagccctacgccaactgggcagccaagatggccgtcgccaccggcgccggcgtgccctgggtcatgtgcaagcaggacgacgccccggaccccgtgatcaacacctgcaacggcttctactgcgactacttcagccccaactccaacagcaagccgaccatgtggaccgaggcctggaccggctggttcacggcgttcggtggcgcggtgccgcaccggccggtggaggacatggccttcgccgtggcgcgcttcatccagaagggcggctccttcgtcaattactacatgtaccatggaggcaccaacttcgaccgcacctccggtgggccgttcatcgccaccagctacgactacgacgcgccgatcgacgaatacggtctgctgaggcagccgaaatgggggcacctgagggacctgcacaaggccatcaagcaagccgagccggcgctggtctccggcgacccgacgatccagtccctcgggaactacgagaaggcgtacgtgttcaagtcgagcggcggcgcctgcgcggcgttcctgtccaactaccacaccagcgccgcggcgcgggtagtgttcaacgggcggcgctacgacctcccggcctggtccatcagcgtgctgcccgactgcaaggccgccgtgttcaacacggcgacggtgagcgagccgtcggcgccggcgcggatgagccccgcgggcggcttctcgtggcagtcgtacagcgaggccaccaactcgctggacggccgcgccttcaccaaggacgggctggtggagcagctcagcatgacgtgggacaagtcggactacctgtggtacaccacctacgtgaacatcaactcgaacgagcagttcttgaagtccggacagtggccgcagctgaccgtctactctgccggccactccctgcaggtgttcgtcaacggccagtcctacggcgccgtgtatggcggctacgacagccccaagctgacatacagcggctacgtgaagatgtggcaggggagcaacaagatctccatcctcagcgcagcagtcggcctccctaaccagggcacccactacgagacgtggaacgtcggagtgctcggtccggtcacgctgtccggcctcaacgaggggaagcgggacctcagcaaccagaagtggacctaccagatcggcctccacggcgagtcgctgggcgtgcagtccgtcgccgggagctcgtccgtcgagtggggcagcgcggcagggaagcaacccttgacatggcacaaggcctacttcagcgcgccgtccggcgacgcgccggtggccctggacatgggcagcatgggcaagggccaggcgtgggtgaacggccgccacatcgggcggtactggtcgtacaaggcctcctccggcggctgcggcggctgcagctacgcggggacgtacagcgagaccaagtgccagaccggctgcggcgacgtctcccagaggtactaccacgtcccgcgctcctggctcaaccccagcggcaacctgctggtgatgctcgaggagttcggcggcgacctgtccggcgtgaagctggtgaccaggacggcgtgaccaggaatggagaggggagggcatgccgcacgcacacaggatgtgaataatttgctgggaagagaagcgagctgagggcagggcgcgcgcgcgcgcagacacgacacgacacgacaccgattctttcttcctcgtgaagtatctatagatacggcgtacatacggacacaatttgtgcccactatacgtacgtacaaaaaagattagtactagagtttaccgtagatctgttcttggagttggccgacgccggcacggctgcaggaactgcggctcacggccggctggtaatggtactagtagcgtggtttttgctctgcactccgcatgaatctcacggcgcacgcaggcttaattttcttagcgcaaatttgcgaaactgagttgtaaatgaggttatttattcctacgattaagtatgatacaagacgaataattattatgtgagttctttttacggtggttggtgaagcccttttctcttccctaaaaaaaaaaaaaaaaaaaaaaaaaaaaaaanaaaaanaaaaaaaaaanaaaaaaaaaaanaaaaaaaaaaaaaaaaaaaaaaaaaaaaaaaanaaaaaaaaaaaaaaaaaaaaaaaggggggggccgcttttaaaggaccaaattttacttccccgggcttgcaaagtataactttttttttggggccc

SEQ ID NO: 4319 - DNA, 1160 bp, Zea mays
cattgggtacctcgaggccggccgggaacaaaggcccatcaacgaggcatccggcgcccgcgcattgcactagctcccccaggctccaccggagccgccgccgtttctgggtctcttgacggcgagcagcgactcgtccggtcgtccctcagcactgggcttggcggacgcgggacaagacacaggatgagggctgtggtgcagcgcgtcctctcggccagtgtcgaggtcgaggggcgaatagtgtctgcgatcggccctggactcctcgtcctcgtcggcgtccacgaggcggacacggactccgacgccaactacatttgtcggaaggtcctgaacatgaggctgttttcaaatgacaagactggaaaagcatgggatcaaagtgttatgcagcgtaactttgaagtgctattggtcagtcagttcaccttatacggcatcctgaagggtaataagccagattttcacgtggctatgtcacctgcaaaagcgaaaccattctatgcttctctagttgagaaatttcaaagttcatactcggctgattcagtgaaagatggtgtttttggagcgatgatgaaggtttctttggtgaatgatggccccgtgacaatgcaaatcgactcaccctcactgcaaggtgctgctcagtcaagcaatggttatgatgatttggttgcggatggtgaagcaagagtagctaaagagacgtgttaaaattctgggtctcctgctgacctagttggatctgaaagccctcctgctgtgcacttggtatgaactttgcgtctatctggtaggctggtccaaagaaaatatcagaattgaagttggtattagtcatgtgatttgccgttaatttttttaaacagttctagcgctttgtcattgccagtcagttacagcactgcttcagtctgcggagacataagccttttgcgcaaatgacagaaccagacacattctctagactatatttgtcatcttattcatttttctactgcggataatactcttatcaatatgggagctatacatgagcttgtggctgctcaacaatgtaatatctagggtcttattactgaattagcaatcttcagtacatctaaaaaaaaaaaaaaaatctgatctatatatcagctgaactgtctttgtct

SEQ ID NO: 4320 - DNA, 736 bp, Zea mays
ttttttttttttttttcgaatgcagaacagacatccattacgatgttgattgcacgatttcttcgacacatggacaccatgtactactgtatgtatgtacaatgacaatacaatgtaagctaaaaaaaacatgagttccacttccacttccagctgccgcccaaatgataacagtaagggctagtttgggaggatagccttgtaagctaaaaaaaatcaaagaacatgagttccagctgccgccccaatgataacagcaattgtagcgaggatagccgctgcaacacatgcgacataacctggtttctccctgtaatcaactctggaacagcacagcagaaaggctccaacgtaccagggaatggcaccaaggaagaaaccgactatgaacaggaaccatccaaaaccaatgccacaacagggaagtcgatcatggctacgtccccgcacacctgcctcgtaatctcgagcgggaacggcctggtagtcgccgcggtggtgggcggagaggctcggcggcgggcgcgggggcgggtagctgggcggcccctggaaggtgccgtagtgtacaccgcctccttggggcttggagccgtcggcctcctccccgctcatcctgctgcgcgcccaactcctctggctctaccctctctcctctcccggaggccggagcacgcagtttggtccggtagcctgacaacaagtgacaacgccacactttggacgggaacaggag

SEQ ID NO: 4321 - DNA, 1104 bp, Zea mays
gctcattgcactagctccccccaggctctaccagaaccgccgccgcttctggatctctcgacggcgagcagcgactcgtccggtcgtccctcagcactgtgcttggcggacgcaggacaagacacaggatgagggctgtggtgcagcgcgtcctctcggccagtgtcgaggtcgaggggcgaatagtgtctgcgatcggccctggactcctcgttctcgtcggcgtccacgaggcggacacggactccgacgccgactacatttgtcggaaggtcctgaacatgaggctgttttcaaatgacaagactggaaaagcatgggatcaaagtgttatgcagcgtaactttgaagtgctattggtcagtcagttcaccttatacggcatcctgaagggtaataagccagattttcacgtggctatgtcacctgcaaaagcgaaaccattctatgcttctctagttgagaaatttcaaaggtcatactcggctgattcagtgaaagatggtgtttttggagcgatgatgaaggtttctttggtgaatgatggccccgtgacaatgcaaatcgactcaccctcactgcaaggtgctgctcagtcaagcaatggttatgatgatttggttgcggatggtgaagcaagagtagctaaagagacgtgttaaaattctgggtctcttgctgacctagggtttagggttctccatcacatctttctcattcagatttttttggtgcagttggatctgaaagccctcctgctgtgcacttggtatgaactttgcgtctatctggtaggctggtcacaaagaaaatatcagaattgaagttggtattagtcatgtgatttgccgttaattttttttaaacagttctagcgctttgtcattgccagtcagttacagcactgcttcagtctgcggaggcatagccttttgcgcaaatgacagaaccagacacattctctagactatatttgtcatcttattcatttttctactgcggataatactcttatcaatatgggagctacacatgagcttgcggcttcccaacaatgtagtatctagggtctagaaaaaaaaaaaaaaaaaaaaaaaagggcgg

SEQ ID NO: 4322 - DNA, 875 bp, Zea mays
gccggccggtctgggggtagcggcgagacgagccgtttaaaaaggtgtcaagtggaagtgcagtgatgtatgcagctgaggcatccttgcgtgccgcccggccggggtcaccagcactcagcttccatcaccactacaacatctaataaccactcttcaactctccaccttaatctaatcaccaaaccacccaaaaccatcaccatgaagttcttctccgccgtctccgccgccgttctcggcttctccagcatggcttccgccatcactgtcagctacgaccccggttacgatgatgccggccgctccatgaacgttgtctcctgctctgacggagccaacggtctggccgctcgcttccccacccagggcagccttcctcgcttccctctcatcggtggttaccaaggcattgctggctggaacagccctcagtgcggtacctgctacggtctcacctacaacggcaagaccatctacgtccttgccatggaccatactggcgccggcttcaacattgcccaggctgccatgaaccagctcaccaacggccaggctgctgccctcggccgcatcgacgctcagtaccagcaggtcgctgtcagcaactgcggtctttaaatcatgagcgttgtgcaccattacacaaaaagaatagacaagatggagagatgacggcgacgaatatgcgataatgtttatattggctttgaatacttggcatagcgcttgcttcatacagcatacgatggcgtttactgtatatacacactccttggtaccataattgaaatagtaatataattactcacgaaaaaaaaaaaccaaaagcgggcctcgagctccagcggaaaaaaaaaaaaaaaaaagcggcc

SEQ ID NO: 4323 - DNA, 2001 bp, Zea mays
gaaaaaaagtttcactcctccatccccattcccgaagtcataaacctccactcgcggacttgccatgacgtccgtaccgctaccacccctctccgccgccctcgcccaatatcgcccctccgcggccgccacccttcgcttccgcaccccctcttccgcgcccggcgtttcggcttcttcgtctacccgggcgcgcaggttctcggttatcgcgtcggcgcgcgagatgccgtggccgcacgtgctgacggtggccggctccgactccagcgccggcgcgggcatccaggcggacatcaaggcgtgcgcggccctaggagcctactgctcctccgtaatcactgctgtcaccgcgcagaacaccgtcggcgtccaggggatccatgctgtgccggagaagttcgtgggagagcagctcaggtcggttctctcggacatgtcggtggacgtggtgaaaacagggatgctcccttcagctggagtagtcaaagttctgtgtgagagtcttaggaagtttccagtcaaagctctagtggtggatccggtcatggtgtccaccagcggtgatactctttcaggaccatctactctcgctacatatagggatgaactattttctatggctgatatagtcactccaaatgtgaaagaagcatctaagttacttggtgatgtatcattgcatacaatttctgacatgtgcaatgcagctgaatccatttataaacttggtcccaaatatgtgcttgtgaaaggcggggatatgccagattcatcagatgcaattgatgtgttatttgatggtaaggagttcactgagcttcgtggtctgcgtataaagacccgtaacacacatggaactggttgcacattagcttcatgtattgctgctgaattagcaaaaggcgcaacgatgctgcatgctgtccaggctgcgaagaaatttgtggaatctgctctttatcacagcaaagatcttgtgattggaaatggacctcagggcccttttgaccaccacttcgagctcaagtctccatcatacaagatgggatcactgcaaaagttcaatccagatgacctcttcctgtacgcagtgacagactctgggatgaacaagaagtggggtcgttcgataaaagatgccgtgaaagctgccattgaaggtggcgctaccattgtccaactgagagaaaaagacgccgagacacgggagttcttggaagctgccaaggcctgtgtggaaatctgcaagtccagtggagtgccgctactgatcaatgaccgcgtagatgttgctctggcatgcgacgcagatggcgtccacgttggccaatcagacatgccagcatgggaagtacgacggctcctaggacctggaaaaatcatcggcgtctcatgtaaaaccccggcccaggccgagcaggcatggaaggatggcgcagactacatcggctgtggcggtgtcttcccgaccacgacgaaggcaaacaaccctaccttagggttcgagggcttgaggactgtgtgcttagcttcgaagctacctgtggtggccatcggcggcatcaatgctggaaatgcaggctcggtgatggagcttgggctcccaaatctgaaaggtgtggctgtggtctctgctctgtttgaccgggaacgtgtcgcggctgagacaagaaacctcagatccatcctgatgaagaatgcttactcaaggtcttagagcaagttgggatatgccgcctgttcatttactttctttgtttaggcccgaaataagtttgtaatcaatcactttgtcataaggagaaaccaaacaggcgctgcaatcttcaataaaccggagtcattatttctctggaaaagaacaattctgtgacatttccgaagtgtgatacatttcaaaggcactgaactgtgtaataagaaatcaataatgtaccagaactatatttgatgcaagtactaacttggcaataccccacgggctgaaatgggctaacc

SEQ ID NO: 4324 - DNA, 1949 bp, Zea mays
ttcaccgattcatgagtaaattatatgcatatagttttatttttttgaaatgtgataggtcgtttgacatcacgaactggctcgttaacaaaccaagttaggatgttagcttatgctttgctattagttaggatatggttctgggtgatcaaaaggaagaaaaaacacgaaaaatttaatgaggttcttggatgacccgagtcaaccaacttggttggagcgttcttcttccctgatcgttcgcagtcgccgctctcccctcacggctgacgtcctcacctctcctcgtccacgcgaaccagacgtacggtagctgttttcacatttctaaattactacgtactgaactcgctgtggtgttaccacctctcgcattgctaatttactggatacgctcttagcttggacacaaattggacctgcaacggactgatgaattgcaaagtttatttttccatttggaaggtaaagctgaaacgagttcctccgtcagacattcttatattttgaaccgcgagagttcaaatccccagcccaagctgaaaggtcagagcctgaaattttcgtgctgggatgacgttcgcccttacgtcgcgcgctgcaaactgaaacgagttcccatgcccaaataaacttgagaaaagtgctgtcttgttcagctatgcccgcatatagatcgatatggtgaggtcactgcttatgccaggcacatgactcaatatagctccatatcttaggcgaattaatcaacatctctctgaccgatcttgggctctcctataaatatataggaacgtacgtaaagtttctccaagcagatagcagcaagctaagcaagtgccaaccaacgagtagcaggaaacatgtctccgcccgtcaagatcctcggccactacgcgagcccgtactcgcaccgcgtcgaggccgctctgcggctcaagggcgtgccgtacgagctggtccaggaagacctgggcaacaagagcgagctgctgctcgccaagaaccctgtccacaagaaggtgcccgtgctcctccatggcgacagggccgtctgcgagtccctcctcatcgtcgagtacgtcgacgaggccttcgacgggccgtccatcctgccggccgacccccacgaccgtgccgtcgcccgtttctgggcgaacttcttggacaccagggtacgtacgctgctgctgctggccacaggcccctcacccgttcttgtgatttcctgaacgttcttacaacctgcacgcagttctcccagccgttctggctggcgtactgggcggagggcgaggcgcagaaggccgtggtgaaggaggccaaggagaacctggcgctcctggaggcgcagctcggcgggaagaggttcttcggcggcgacacgcccgggtacctcgacatagccgcgtgcacgttgggtccttggatcggcgtgctcgaggaggtgactggagtggccttgctggacgccgacgagttccccgctctatgccagtgggccagggactacagctccagtgaagcgctcaggccatgcctgccggacagggaccgactcgttgcctacttcaccgagaacaaggagaagtacaagacatttgccaaggcaacgttgcatcagtagctgctagttgggtgcaaaccgcttgtttatctctgtgtggaataatgtatacgtacgtgctccctcgatatcaaataaatcagctaccggagttgactgtagtcaaattgctataagtatagacttataggtttacaagaaaagcattgatatttatggcaccagaataatatcatgagcttagatacattatataatacttccccaattctaaaattaaattcaagagctaaaacaactaatattttgagacgacagagatagacataactagcaaggctcgactcaccggacgccattgatgggccatatacaaaagaca

SEQ ID NO: 4325 - DNA, 1008 bp, Zea mays
acattctctctgaccgatcttgggctctcctataaatccattgggaccctcgaggccggccgggaagcagatagcagcaagctaagcaagtgccaaccaacgagtagcaggaaacatgtctccgcccgtcaagatcctcggccactacgcgagcccgtactcgcaccgcgtcgaggccgctctgcggctcaagggcgtgccgtacgagctggtccaggaagacctgggcaacaagagcgagctgctgctcgccaagaaccctgtccacaagaaggtgcccgtgctcctccatggcgacagggccgtctgcgagtccctcctcatcgtcgagtacgtcgacgaggccttcgacgggccgtccatcctgccggccgacccccacgaccgtgccgtcgcccgtttctgggcgaacttcttggacaccaagttctcccagccgttctggctggcgtactgggcggagggcgaggcgcagaaggccgtggtgaaggaggccaaggagaacctggcgctcctggaggcgcagctcggcgggaagagcttcttcggcggcgacacgcccgggtacctcgacatagccgcgtgcgcgttgggtccttggatcggcgtgctcgaggaggtgactggagtggccttgctggacgccgacgagttccccgctctatgccagtgggccagggactacagctccagtgaagcgctcaggccatgcctgccggacagggaccgactcgttgcctacttcaccgagaacaaggagaagtacaagacatttgccaaggcaacgttgcatcagtagctgctagttgggtgcaaaccgcttgtttatctctgtgtggaataatgtatacgtacgtgctccctcgatatcaaataaatcagctaccggagttgactgtagtcaaaaaaaaaaaaaaaaaaaaaaaaaaagtccccagaaaagcattgatatttatggcaccagaataaaaaaaaaaaaaaaaaactcgagactagttctcctcgtgc

SEQ ID NO: 4326 - DNA, 863 bp, Zea mays
  misc_feature (770)..(771): n is a, c, g, or t
  misc_feature (813)..(813): n is a, c, g, or t
  misc_feature (815)..(815): n is a, c, g, or t
  misc_feature (817)..(819): n is a, c, g, or t
  misc_feature (821)..(822): n is a, c, g, or t
  misc_feature (828)..(828): n is a, c, g, or t
cacacgatctctcctcgacggctaacccggattgccgtctcaggctcgggatccgggcgctcgcggtgatggacggcggcggcggcgctggcggcgcggagggggagctcacggcgcaggagacagcgctctacgaccgccagatccgcgtctggggcgtcgatgcccagaagagactaagtaaggcgcacgtgcttgtgtgtggcatgaacggaaccaccatcgagttctgcaagaatattgttctagctggagttggtggtggtgccgttcggcgggctggagtggctcacccgcgtcaccttcaaggaccccgcaagggacatggacgtctcgtacatggagtacaacgtgtcgctggaggagagctcgctcagggacctctacccggaggaccacttttacctgaagcacccctacgacgtgcacaagaaggggtgggacgccatcaagacggtgtacctggacaagcagaacgtcaggctcaacctcactaggttcaccaggacgctggagcaggcgcgagatctcttgccgacgccatgactgatgatgaccccccctctttcctctgctctgctgcaggtttcattcacttcagatcagctgctcacctcacttcacgccgtgtctctcttttttttttctgttggtgttctatacatatacttgtttcctcttctcctttcccctctctctctagtctctccctctccactcttgtggcggcaagattcatttctttcattgttttgtttttttgttgttgnntgggaaggataggaacaaaaacaaggtattgtcgtgtctaananannnannaaaaanaaaaaaaaaagtactctggcgttgttaccactgct

SEQ ID NO: 4327 - DNA, 441 bp, Zea mays
ctggacaagcagaacgtcaggctcaacctcactaggttcaccaggacgctggagcaggcgcgagatctcttgccgacgccatgactgatgatgaccccccctctttcctctgctctgctgcaggtttcattcacttcagatcagctgctcacctcacttcacgccgtgtctctctttttttttctgttgttgttctatacatatacttgtttcctcttctcctttcccctctctctctagtctctccctctccactcttgtggcggcaagattcatttctttcattgttttgtttttttgttgttgttgaggaaggataggaacaaaaacaaggtattgtcgtgtccaaggttaatctacacaaacacacactgtaaatgaacaaaaaaaaaaaaaaaaaaaaaaaaaaaaaagcttgtacctgcccgggcggccgctcga

SEQ ID NO: 4328 - DNA, 1664 bp, Zea mays
aaagtcaaaagggcaagagggggcaaaaagggagaaatttcctctcacaaaaccctcgccagcttatcccccttcctccctcacacgatctctcctcgacggctaacccggattgccgtctcaggctcgggatccgggcgctcgcggcgatggacggcggcggcggcgctggcggcgcggagggggagctcacggcgcaggagacagcgctctacgaccgccagatccgcgtctggggcgtcgatgcccagaagagactaagtaaggcgcacgtgcttgtgtgtggcatgaacggaaccaccatcgagttctgcaagaatattgttctagctggagttggaagtttatccttgatggatgataatgtagtcacagaggaggatctgaatgcaaatttcctaattcctcctgatgagagcatatatggtggtagatctcgagcccaagtttgctgcgagtctttgatagatttcaatcctatggttcgagtttctgttgaaaagggtgatccatcattaattgatggagaattccttgacaagtttgacattgttgtacttagccgtgcatctcttaaaacaaagttgttgattaatgaaaactgtcgaaagagaagcaaacacattgcattttatactatagattgcaaggattcatgtggtgaaatatttgttgacttacagaagcatagctatgttcagaaaaagcctggaggagcaactgaacaacaggagttgacatattctagtcttcaggaagctatctctgtgccttggaatagtctaccgaagaagacggcaaaattatactttgctatgagagtactggaggattatgaattatctgaagggcgcagccctggcgaaacaacactttctgacatagatgcagttctggctcgaaggaaggatatgtgtgataaaatgtctttgaatgagtctcgtattcctactactctcgtggaacgactgctagcagctggaaagaaggagcatcctcctgtatgtgctatccttggtggtattcttggtcaggaggtgatcaaatcgatatcctgcaagggcgatccagtcaagaatttcttctatttcgatgtggctgacggtaaaggtgtcatcgaggatatcccaccaccaccacctgcaaaataaagcactcagctgcgtaactctcgactcgacttggttcactaatcgttttctgtacccactcagcttcgaacatgtagcaacttttagatctagagccatgtgaaaaaaggcaagtttgactttaacccagatgtttagggattgttcgagcagcaaactgtgacagtatgtatgcatcgacaatttaaagctgaagtctggacggtttccatgcttttgggggcggatttcctttgttgtccctttacccatttgtcaaatttggtagcggtggttggggggagtggggaatgaagtgagaaggctatgtttataactgtgaaccgacggttgcagctatacatatcgtcatgcctgtgcaaaaaaaaaaaaaaaatcatgcttgattacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcc

SEQ ID NO: 4329 - DNA, 1027 bp, Zea mays
  misc_feature (995)..(995): n is a, c, g, or t
ctcacaaaaccctcgccagcttatcccccttccctccctcacacgatctctcctcgacggctaacccggattgccgtctcaggctcgggatccgggcgctcgcggcgatggacggcggcggcggcgctggcggcgcggagggggagctcacggcgcaggagacagcgctctacgaccgccagatccgcgtctggggcgtcgatgcccagaagagttctgcaagaatattgttctagctggagttggaagtttatccttgatggatgataatgtagtcacagaggaggatctgaatgcaaatttcttaattcctcctgatgagagcatatatggtggtagatctcgagcccaagtttgctgcgagtctttgatagatttcaatcctatggttagagtttctgttgaaaagggtgatccatcattaattgatggagaattccttgacaagttcgacattgttgtacttagccgtgcatctcttaaaacaaagttgttgattaatgaaaactgtcgaaagagaagcaaacatattgcattttatactatagattgcaaggattcatgtggtgaaatatttgttcgtttacagaagcatagctatgttcagaaaaagcctggaggagcaactgaacaacaggagtggacatattctacccttcacgaagctgtctctgcgccttgcaatagtctaccgaagaagacgggaaaattatactttgctatgagagtactggaggattatgaattatctgaagggcgcagccctggcgaaacaacactttctgacatagatgcagttctggctcgaaggaaggatatgtgtgataaaatggtattgaagttctttttgtcttaatttagctcatattccttctgattttacatattattgctaactgcagactgtgaatgaatctcgtattcctactactctcgtggaacgactgctagcagctggaaagaaggagcatcctcctgtatgagctatccttggnggtattcgttgatcaggaggtgatccaatcga

SEQ ID NO: 4330 - DNA, 1844 bp, Zea mays
ccccgcgtccgcggacgcgtgggcgtcgcttccagatccagcgggcggaggagggggtgcggtgcggccgtgaccatgaagcagccgaggggccggcaggagccgcgccgggtgggcaacgccgccatggtcgtcaccatggtcgtctccctctgcgtcctcacgtacatcaaggcgcgatactgctccaaccctttccccaaggcggtggcggaggtggaggtggacgaggactacgacagcacgcggtacaagctgacgggccccgtgggcgaggaggacttcgacccgtcccgccccacctgctacaacaccagcaagcggtcggagcggtgcgccgccgtgggcgacatccgcgtggacggcaaccactcgcggatctacatcagcccgctgtcccgcgagtggcggaccaagccgtacgcgcggcggcacgacgccgtggccatggacgacgtgcgcgagttcacgctggtccccttcggcggccccaacgacacggccgtgccgccgctctgcacgcgcacccactccgtcccgggcttcctcttctccagcggcgggttcgcgggcaacctgtaccacgactacgccgacgtgctggtgccgctcttcgccagcaccaaccacctgggcggggaggtccagttcctgctggccgacatcaaggactggtgggccgacaagttccgcccggtcttccgccagctctcccgctacgacgtcatcgacgtgaacaacgaccgcgaggtgcactgcttcccgcggatcatcatcggctccaccttccaccgcgccatgggcatcgacccctcgcgctcgcccggcggcgtcacggtggccgacttcaagcgcctgctccgccgcgcgttccggctggagcgcgccgtcgcgtcgcggtcgggggcgccccggcgccgggaccggccccgcctcctcatcatctcgcgcaagagctcgcgccgcttcgtcaacgagcgcgccatggcgcgcgccgcggcggccgcccggttcgacgtgcggatcgccgagcccgacaaccacacggacatgcccaacttcgcgaggctggtgaactcggcggacgtgatgatgggcgtgcacggcgccgggctcaccaacatggtgttcctgcccagccgcgccgtgctggtgcaggtggtgccgttcggcgggctggagtggctcacccgcgtcaccttcaaggaccccgcaagggacatggacgtcacgtacatggagtacaacgtgtcgctggaggagagctcgctcagggacctctacccggaggaccacttctacctgaagcacccctacgacgtgcacaagaaggggtgggacgccatcaagacggtgtacctggacaagcagaacgtcaggctcaacctcaccaggttcaccaggacgctggagcaggcgcgagatctcttgccgacgccatgactgatgatgaccccccctctctttcctctgctctgctgcaggtttcattcacttcagatcagctgctcacctcacttcacgccgtgtctctctctctttttttttctgttgttgttctatacatatacttgtttcctcttctcctttcccctctctctctagtctctccctctccactcttgtggcggcaagattcatttctttcattgttttgtttttttgttgttgttgaggaaggataggaacaaaaacaaggtattgtcgtgtccaaggttaatctacacaaacacacactgtaaatgatcgattgattgctgtcagtagaggcgaacacaaggaataggtaaaaaaaaaaaaaaaaaaaaaaaaaaaaaaaaaaaaaaagaaaaaaaaaaaaaaaa

SEQ ID NO: 4331 - DNA, 4060 bp, Zea mays
  misc_feature (193)..(193): n is a, c, g, or t
gggccgtgttggatagatagctcgagcgacggcccttcaaggcttcttggcgtcccctgatatcagtggcgggcctgtttgtttgctttgaatgagaaaggccggacaaagcatccgtcagtcgggcattcaggcttgtcacaccggcggcatatgacagagtcgtcgaatcagcccccccaccccccccccncccccccacacacacacacacacacaacggccgccatcgcacgcacgtcactgccgctaccgcaccccgttgggccgtggcccataggcgacagccacgtccgcgtccgagtggcccatagacatgaggtctgagtgtccgacacctcccaaacgcccaaacgtcgcaccgttgtaggggggcatgaggtgcctaatttttagatgattcctgatccaaccaattgacataagtaaatggatactttttatgatttatgtttatatcataacaagttaaaattgtatccttatatgacttcataattaattattaattatctttgtgtcaactagggatgttagtacggaattccaggatcagggatggccattccacaccattcgtgcggagagaaaaattatccgccccgctaaccggagagctttttataaattttatctccataaaaaaacccttccctagctattataaaatacaatttttggaggtaaaaataaattgactatattaatttaatttaatttaaacaaacacagtttaaaattaaagagatgtctactttagagtttaacatgtcaagagattaatttaaagtatagaaattcgtgggacgggtacgtggggaaccaggacgggatagttccctatttccgttctcgtgaactatgagcagcatccgtccatcaggttcgtcacgcgccggcggcatatgacagaggcaaataagcagcgaatcggcaccctcaacggccgccgccgatgcacgcacgtcacagccgctacatggctacatcacgccgcacccggcccaacggcacccgtagggccggccgtggcccataggcggcagccacgttcgcgtccgggccggtccgcggccacaactaattcccggaatcccgggtcccgcgcgcgctagctctctctatctctccaccacctcacctgccgccatgacaccaccccgcgcgcacgctgccgcagcgacaccggcgcgctcacaccgccacagcccacaccccctccgtctatatattccgctcccctgcggcgctcgaccccgcggcccggccgatagccttatagccacatcccggccagccgcagcaagtgcccagaaggccagaaccagaaccaggtagcccgtgcaacctcatatcatcccctgccacgcacctccgtccgccgcgccatggaatcgaggaggagggccgtgcccaccgtgacggcggttgcggtggcgacgctgctgctgctgctgatgtcgtcgggcgtgggcggcgacttcgcggcggaccgggcggagtgctcggagcagctggcggggctggcgacgtgcctgacgtacgtgcaggagcaggcgacggcgacggcgccgacgcccgactgctgcgcgggcctgaaggcggtgctgcagagcagccgcaagtgcctgtgcgtgctggtcaaggaccgggacgaccccaacctaggcctcaagctcaacgtcgacaaggcgctcggcctccccgccgtctgccacgcgcccgccaacatctccgactgccccagtacgtagtctgtttgtatccatccacagtctctagcctcccttattttagttgctagtaagtgtagtgctgtgagatatttttttttatttttttctagctcgtctagttggataagctagtttaattcatacaaactcttatactaatcattatttattttagtttttgttaattatttgagtaagaggaggaggatcgggaaggagtgaatgaggaaagataatctaaataatatagtctattatatttaagtggagataattttaacaatctaaactgtttggttttaaaagtgttacatgcgtgtgggttgcaattaatttattagattagcgtagtatactagtagatcagagcaaagcccgacccgacagatcatttcagacgtcacgacagtttttgggcaccacccgatgtcacctcgtacgacgaggaacacaacgccgcgttacgacagcgcctagaaggacgtctcgaacagcagcagcacatgtcacatgaattccgtgtctagtaggaaactgaaacagtgccacttctgtctccaaaataaatatcatgcgccggtttattttgtttacaaaaaaaattaagtagatttataaaaaaatcattaacgatatttatatctttaagtaagtttggtagtataatatattcagcaatctattttgcgagaaggctccaaacgcacggggtttcttgcgcgcgcacggcacggcacggcaggccaccccgtgatctgcgagcgtgatcgatgccggttcggtgtgctgtcctgtcgtcacgcgcggtcgtgttgacgtgttgtatcatgcgcctgccctcatcattctgcccacttgacttgggctagcagaagaggggagacctggtctgacactgacagggactagtgtttttgtgctgggatgctatgatgctgcgatctgcaactgacgtgctgctgttccgtggcgacggcgcgcacagggctgctggacctgccggccggctccaaggacgcacaggtgttcgagcagtacgcgaagcagcaggctgcggcggcggcgcagggcggcgcacccaccagtgagtttctccacccgtccgtctcgctactcgtttcttcgctcgtctcatttgcattgcgtgaagggaattgcatctatctatctatctggaagcaattaatccgccgagagctagtgtctagctcagcgcaactgctgcaccgataccggatcacagtgcctcggccgacgccgacggcgtttaagcctgaatcggacaggacaactgatcgtcctgtagcctgccagtgcaagagcacagctgctgaacagcgtacgtgcggtgcgtgcttcctctgctgaacacagagcagtacaacgccggtagaacagctgagcagccctggccagcctcttgctgtctgccactcgtggcgcgcggccggcctggcgggcatcttctggacctccacttcgcactagctctagtgccactgcaatcatcgcctgcctttacgtgtgcctgtctaacgcacgcggcctgaacatgtggtgctctctccaggtggacgcagcagcgcggcggcgagcacgaccgcgggcgcgcagaagagcggagcccccccccccgcgcggtggttgggagtggggagggtcggtggtgctggtggcggcgcacgcgcggtggcgccgctcgccgtgcctttcctgctcctgctcgggtagataataatcactttacgcgcggccaacggcccgagtcccggcggtttggttggcgccgcgcgttgccgacttgtggtgtgcttcgggtgcgtgcgtgtgtggtggggtacttttcacactatattggaaaaagaagctattatctttggatgaaaaaaagtgtcgttgtataattatctttttttcgtgtccgtgtatgcaactcctcctctcatagacccatagcgccaaatagtcatccaatgaatattctatctgactctttatatacctctctcttagtttaaacgggctatctattctttactctataaatattctagactaatatacaaaacgacgaaaaaaatctaccgtgtattgtaggggggagatgtggttcaacttgttgagcccgtttttgtttttttaaaagcaaaagctaaatcaaagaggtttagcttttctacaactactttgaataatataattaacatttatatagtacaaatatgaaagcaatttagaccacgcttttactacttatcaagttcgttatattaataaacatacgtgccaaacagaaactaaaatagaactacaaatagttaagt

SEQ ID NO: 4332 - DNA, 1091 bp, Zea mays
actcctatgggccattgggaccctcggcgcgtcgcggtagccttatagccacatcccggccagccgcagcaagtgcccagaaggccagaaccagaaccaggtagcccgtgcaacctcatatcatcccctgccacgcacctccgtccgccgcgccatggaatcgaggaggagggccgtgcccaccgtgacggcggttgcggtggcgacgctgctgctgctgctgatgtcgtcgggcgtgggcggcgacttcgcggcggaccgggcggagtgctcggagcagctggcggggctggcgacgtgcctgacgtacgtgcaggagcaggcgacggcgacggcgccgacgcccgactgctgcgcgggcctgaaggcggtgctgcagagcagccgcaagtgcctgtgcgtgctggtcaaggaccgggacgaccccaacctaggcctcaagctcaacgtcgacaaggcgctcggcctccccgccgtctgccacgcgcccgccaacatctccgactgccccaggctgctggacctgccggccggctccaaggacgcgcaggtgttcgagcagtacgcgaagcagcaggcggcggcggcggcgcagggcggcggcgcacccaccagtggacgcagcagcgcggcggcgagcacgaccgcgggcgcgcagaagagcggagcctcagccgccggtcggtggttgggagtggggagggtcggtggtgctggtggcggcgcacgcgcggtggcgccgctcgccgtgcctttcctgctcctgctcgggtagataataataataactttacgcgcgcggccaacggccggagtcccggcggtttggttggcgccgcgcgttgccgacttgtgtgcttcgggtgcgtgcgtgtgtggtggggtacttttcacactatattggaaaaagaagctattatatatctttgactgaaaaaaagtgtcgttgtataattatctttttttcgtgtccgtgtatgcaacccctcctctcatagacccatagcgccaaatagtcatccaatgaatattctatctgactctttgtatacctctctcttagtttaaacgggctatctattctttactct

SEQ ID NO: 4333 - DNA, 1189 bp, Zea mays
cgggatctctcaccacctcacctgccgccatgacaccaccccgcgcgcacgctgccgcagcggcaccggcgcgctcacacgcccacacctgacaccccctccgtctatatattccgcaccccgcccgccccggccgggaggcttatagccaccacatcccggccagccgcagcaagtgcccagaaggccagaaccagaaccaagcagcccgttgcaacctcatatcatcccctgccacgcacctccgtccgccgcgccatggaatcgaggaggagggccgtgcccaccgtgacggcggttgcggtggcgacgctgctgctgacgatgatgacgtcgtcgggcgtgggcggcgacttcgcggcggaccgggcggagtgctcggagcagctggcggggctggcgacgtgcctgacgtacgtgcaggagcaggcgacggcgacggcgccgacgcccgactgctgcgcgggcctcaaggcggtgctgcagagcagccgcaagtgcctgtgcgtgctggtcaaggaccgggacgaccccaatctaggcctcaagctcaacgtcgacaaggcgctcggcctccccgccgtctgccacgcgcccgccaacatctccgactgccccaggctgctggacctgccggccggctccaaggacgcacaggtgttcgagcagtacgcgaagcagcaggctgcggcggcggcgcagggcggcgcacccaccagtggacgcagcagcgcggcggcgagcacgaccgcgggcgcgcagaagagcggagcctcagccgccggtcggtggttgggagtggggagggtcggtggtgctggtggcggcgcacgcgcggtggcgccgctcgccgtgcctttcctgctcctgctcgggtagataataatcactttacgcgcggccaacggcccgagtcccggcggtttggttggcgccgcgcgttgccgacttgtggtgtgcttcgggtgcgtgcgtgtgtggtggggtacttttcacactatattggaaaaagaagctattatctttggatgaaaaaaagtgtcgttgtataattagccttttcccccctccgtgtatgcaactcctcctctcatagacccatagcgccaaatagtcatccaatgaatattctatctgactctttatatacctctctcttagtttaaaaaaaaaaaaaaaaaaatggacg

SEQ ID NO: 4334 - DNA, 2249 bp, Zea mays
gccggccgggtcatccgagacagacacacccccaccccacgctcccctccctcggatccagattatcaccgcacctccctcattttgggtcccgggcgcccggcggggccgggagcagatccaccggcacgagaccgaccccgtttcctcgctccttcgtctctcgctgacactgtttgacccctgtcctccaggctcggctccagctaaggtcgagcggcgaggcgacagccctagtgtagcgcggcgcggtaccatagatggggagacgaatggaggccccctcctcgccggcgtccctcgtcgtcgtcctcctcctcggctcgctgctcctgcaggcacgcgccgatgacccctacaggttctacacctggaacgtcacctttggcgacatctacccgctcggcgtcaagcaggaggggatactgatcaacggccagttcccggggccgcagatcgacgccgtcaccaacgacaacatcatcgtcaacgtcttcaacaacctgccggtccccttcctcctctcctggcagggaattcagcagcggaggagctcatggcaggacggcgtgtacggcaccaactgcccgatccctccgggcggcaatttcacttacaacatgcagttcaaggaccagatcgggagctactactacttcccttcccttctgtttcacaaggcagctggcggttacggtgccatcagggttctcagccggccgaggatccctgtcccgtttgacccgcctgccggggatttcaccatattggcgggtgactggttcaagctcaaccacaccgacctgaaaggcattctggacagtggcaatgacctgccgtttcctgacggccttcttatcaatggccaaggttggaatggcaacagattcacggtggaccaagggaaaacgtatcggttccgggtgtcgaacgtgggaatcgcgacctcggtgaacataaggatccaaggccattccatgctgctggtcgaggtggaggggtctcacaccatgcagagcacttacacgtccatcgacgtccatctaggccaatcatactcgttccttgttactgctgatcagccacctgcagactactccatagttgtctccacacgctttaccacccctgtcctcaccaccgctgccatcctccactacagcagctcaaatggtgctgcaagtgtgccgcctcccccggcgcctaccgttgagatcgatttctctctcaaccaggctagatccatccggtggaacctgacagcgagtggaccaaggccaaaccctcagggttcctaccactacggtctcgtcaacaccacaagaaccatcaggctcgccaactcgcgggcaaccatcaacggcaagctgagatacgcagtgaacggcatctccttcgtcccggccgacactcctctcaaggttgctgatttctacagcatcccgggagttttcacgctgggcagcatgcccgacaacccgacgggcggcggcgcttacctccagacgtctgtgatggcggccaacatgcgggactatgttgaggtcgtctttgaaaacgcggagaacttggtgcagtcgtggcacatcgacggctacgcgttctgggtcgtcgggatggatggaggacagtggacaccggctagtcgtcagggctacaacctcagggacgccattgctcggtacacattgcaggtgtaccctcagtcatggacggctatctacatgccgctggacaacgtggggatgtggaacgtgaggtccgagagctgggccaggcagtacctcggccagcagttctacctccgcgtctactcgccggcgaactcgtggcgggacgagaacccgatccccaagaacgcgctgctctgcggccgggcctctggacgccggaccaggcctctctgaagctgaatccctgagcccaagaagaccatgtttgttcggccacgaaggggtggccggaacttgcggggatcaattgaagttgagggaagagatgattggagtgttcagattgctgaactgagttccattttgtggcgctgatgatcgttcagctcatatattatttagcaattgtagctaaaacattaattcccggtcgatttgttgtatgtgaagcttcctcgcttcctcgctcacatcattgatgatgataatattcatagtaaccagattttcctttttcaaaaaaaatcaaaatacacatcgatctgaatgagtccaagaaaaaaaaaaaaaaaaaaa

SEQ ID NO: 4335 - DNA, 4093 bp, Zea mays
actgctctctgcctcaatgcccgccccagcctcccaccctctcactccagtcagtccctcccagcggctcgccagccacctgctcctccagtcctctctccatccctctccggctctccgcctctccccctcgtgaggaggtgaggagaggagaagcaacagagggggccgcggcgaccgaccgaccgaccgacgtgtcctgagtcctggtgctggtggtgggtgcttctcgttcctggcgggtccatacacggcggggtgctagctaagggagaggtgccggcgtcggcgtcggctgcgaggagcaggagcagcaggccaccgacggattcggagatctcgccggagaagatgaagagatctgcatctctgtttcaagtccttctggttttcacagccgtgattgagatccaatggtccactgtatccagcatttactgcaaggacatgccgccgaacgtgtatcggcctcacagtgccacaataactgaatttggtgccgttggggatggtgtcaccctcaatacaaaggcattccagaatgcaatcttctatctcaattcatttgcggacaagggtggcgcgcagcttttcgtgcctgcgggaaggtggttgacggggagttttcatcttatcagccatctcactttatcactggacaaggatgcaataataattggatctccggtaagatgatttgcagagtttgcactatgataatctgtactccaatatattctttggatcgtatgcttgttatgttatgcccatgaactagtcaaacttatattgctgaatcatgttatcaatctagctttcttctaggaaacaatacaaagccaactgcatatgttatatctattactaaaaggacagatccagtgctgacagctcccacacttgtggtctgggaaagggataacctagtcaaaccttgctcctgcattttgcggagaggctgcatcgaacccaagacctttttagctcagtgggaagtctttagatgctaaaaaaaccacattccttaaaggttcaaaacccttttgtttttccgcgttgatcctggttatacttccatggtaatgccttgaatgcatcctgcaggattcatctcattggccagttatcgatcctcttccatcctatggtcgaggtagagaccttcctggaaaaagacatcagagtctgatttttggattaaatctgacggatgtaattataactggttagtaaatactatagctgtgtcgcccccatcttcttcaagtatcatttagttagcttgttagtattctaaatgttgctactcttgggcaggtgctaatggttcaattgatggtcaaggagctatttggtggggctggttccacaaccacacattgaattatactagaccacatcttgtggagttgatgtattctaccaatgtcgtcatatctaatctaaccttcaagaactcgccgttttggaatatccaccctgtgtactgcaggttggttttctagatagccacttgctttctgttcaaacataaaaaaaaattcattcacaatacaaatatattatctggagtgcttttgctacataaacagccaagtgcttgtccggcatgtcacaatcctagcgcctttgaattcgccaaacaccgacggcgttactccaggtaagatgccacttttaattattcgagatttctaagctttcttaatgttttacatgcttgctcctttcccgcccgtgggttctgcactagggaacttttgttattaaacacactagggaaacattggggctgatataatttggcatgttttccctccaagaatttttactctttgtgctttccagattcatttacttttgatttgtgtagtgtagctgaaatatctgaaatatgcaatgcaagcaattcttttgtgaggtgacggcatacttttaggtttccgattgctgttacgcaatgttaaaaatagtaataacataagcatgaactatcataagatgtgactggtctttgcttgaaatgtgaccttatcccagtcctccaaatctatggtacaccaatagttaagaggttcattgaaaaacatgtttgttttttttaacttatgttggaattgcatagccatcaatcatatttgcatctatggtgctaatacaactccaaacccatccagactcttccacgaatgtgtgtatcaatcattgctatgtaagaaatggcggtgatgttattgtcattaaaagtggctgggatgaatatggcatttcatttgctcaaccaagctccaatatcagcataagcgacatcacaggggagacaaggggtggttcagggattgcctttggaagtgagatgtcaggtggcatatcggaagtacgggctgtgggcctccgcattgtcaactcccttcacgggatcagaatcaagacggccccggggcgcggagggtacgtggagaatgtgtacatagcagatgtgagcatggacaatgtttcgatggccatcaggatcactggaaactatggtgaacatcctgatgacaaatatgacagcactgctctccctgtgataagcaatattacaatcaaggatgttgttggcgttaacattggggttgctggtatattggaaggcattcagggggacaatttcagcaacatttgtctgtccaatgtttccctcagtgtgcaatctgcacatccatggaattgttcacttattgaagggtattcgaactcggtgatcccagaatcatgcgaacagctcagaagcaattgtagacagacatccatttgctacgatggaagcagttcttcagtaatgagtgtgcagcaaccaagacatacatcgcccaccagccggttgctagatctttttactggagttggcttcattttagtgtaggtagagctgtgcttgttcttgctgcaaagggggcttgcttcatgtagtgagagccctattagtcatgtatatctgattcttgcaattatttgtgattagagtgccacttgcttcatgtatatagctgttgagatgactgtcggtgtatctttgcctgttttgttccaatttttggtatgtgaatgcaatctgcataactttatggttttgaacacactccctctgtttcttatcatctgtcattctcatttcctaagaagtcaaatatatttaactttgattaaacatatgtatataatgttaatatttatagtatataataatattattaaatagatcgttggatctaattttataataaaattatttgggatataaatgttgcccatatttttttataaacatagcaatttttttaaaaaaatatcaacacgactacctgatgacacttaaatagggatgaagggagtagtttttctttttaataaaagatacaataaattaatttcctgctagagttatccttccacagcccaatatgtaactatgcagtaagttattgcatttgcaccttaagggggtgtttgtctggaattataatttacccagattatataattcaataacttttgaactaagcgttacttcaaaagttgttggactatatgatctggacatattataatttcaaacaaacaccccctaaattggcgtcgatcattcatgaatcatacaatattatggaaatgatcaagctgtactttctttagattccggtctagagtatgttcccattcactggttaagaaaatggctatcaagaacgaattaaccctttattctttttttaagtacacccctcctgaggaaagaagagtaggacaaaagatatggaatacaataaaaaaatgatctttatttattctttccttcctttatccctattcatatagaattcctcgtgaactaatgccaatttctttccatttattaattgctataacgagtgatttattccaatattaagttattaccgaacaaagaaaaattatattatataaagatgagatcaattcggaagcgttttttttttgttattctagcagacgtaattgctttggtctaattttgggctttcccaataaattttatcttatctaatatttcctccgagttcaccacagc

SEQ ID NO: 4336 - DNA, 1994 bp, Zea mays
  misc_feature (1971)..(1971): n is a, c, g, or t
cagtccctcccagcggctcgctttccacctgctcctccagccctctctccctccctctccggctctccccctcgcgaggaggtgaggagaggagaagcaacagagggggccgcggcgaccgaccgaccgaccgacgtgtcgtgagtcctggtgctggtggcgggtccatacacggcggggtgctagctaagggagaggtgtcggcgtcggctgcgaggaggaggagcaggagcagcaggccaccgacggattcggagatctcgccggggacctcgaggccggccgcgtccctgtttcaagtccttctggttttcacagccgtgattgagatccaatggtccactgtatccagcatttactgcaaggacatgccgccgaacgtgtatcggcctcacagtgtcacaataactgaatttggtgccgttggggatggtgtcaccctcaatacaaaggcattccagaatgcaatcttctatctcaattcatttgcggacaagggtggcgcgcagcttttcgtgcctgcgggaaggtggttgacggggagttttcatcttatcagccatctcactttatcactggacaaggatgcaataataattggatctccggattcatctcattggccagttatcgatcctcttccatcctatggtcgaggtagagaccttcctggaaaaagacatcagagtctgatttttggattaaatctgacggatgtaattataactggtgctaatggttcaattgatggtcaaggagctatttggtggggctggttccacaaccacacattgaattatactagaccacatcttgtggagttgatgtattctaccaatgtcgtcatatctaatctaaccttcaagaactcgccgttttggaatatccaccctgtgtactgcagccaagtgcttgtccggcatgtcacaatcctagcgcctttgaattcgccaaacaccgacggcgttactccagactcttccacgaatgtgtgtatcaatcattgctatgtaagaaatggcggtgatgttattgtcattaaaagtggctgggatgaatatggcatttcatttgctcaaccaagctccaatatcagcataagcgacatcacaggggagacaaggggtggttcagggattgcctttggaagtgagatgtcaggtggcatatcggaagtacgggctgtgggcctccgcattgtcaactcccttcacgggatcagaatcaagacggccccggggcgcggagggtacgtggagaatgtgtacatagcagatgtgagcatggacaatgtttcgatggccatcaggatcactggaaactatggtgaacatcctgatgacaaatatgacagcactgctctccctgtgataagcaatattacaatcaaggatgttgttggcgttaacattggggttgctggtatattggaaggcattcagggggacaatttcagcaacatttgtctgtccaatgtttccctcagtgtgcaatctgcacatccatggaattgttcacttattgaagggtattcgaactcggtgatcccagaatcatgcgaacagctcagaagcaattgtagacagacatccatttgctacgatggaagcagttcttcagtaatgagtgtgcagcaaccaagacatacatcgcccaccagccggttgctagatctttttactggagttggcttcattttagtgtaggtagagctgtgcttgttcttgctgcaaagggggcttgcttcatgtagtgagagccctattagtcatgtatatctgattcttgcaattatttgtgattagagtgccacttgcttcatgtatatagctgttgagatgactgtcggtgtatctttgcctgttttgttccaatttttggtatgtgaatgcaatctgcataactttatggttttgaacacaaaaaaaaaaaaaaaaaactcgagggggggggaaaaaaaaaaaaattatnaaatttctttttatctttatatc

SEQ ID NO: 4337 - DNA, 1016 bp, Zea mays
cccacgcttccgcccacgcgtccggggcgcgtgggcccacgcgcccccccccgcgcccgcgagagaaatgtgcggcaaactggaattctagcctacattccaagatttgctgtccttgcatcacgtatggaacaatatatccaagggcagtccagggatttaattgataaagcatacacaaagctagttagcacaatgttcgcaactttggagaaaattgcacagagtgatcctaaaactgctgatattgtgctgattgagaattatgctgctttccagaacagtctttatgacttggctaatgttgtgccaacgcttgcaaagttctaccatcaagccagtgaatcatatgaactagcttgcactcgccatatcagctcactcatttatctgcaatttgagaggttatttcaattcaaccggaaagttgacgaattgacttacactattgctgctgaggagataccgtttcagctgggattatcaaaaactgacctaaggagggtactgaaatccagcttatctgggattgataagtcgattagcgccatgtacaggaggttgcagaagacactgacctccgatgagttgtttccttcgctgtgggacaagtgcaagaaggagtttttggacaaatacgagagctttgttcagatggtgacacggatatatgggaatgagccgatcatgtcagtcaacgaaatgaaagacgtccttgctggtttttagatacaagtacacagcaccatgtatgatttcagagaaatagctatgtattccattcattccattgaattctgcacccacttgcgttactgtgttaggcgccctttttgggttatgtgtgtgtatgtggatgtcctctgtatagaagtgaacgcggcatgcttcccctaatgatgttcctgtgtcgcatcgagccgtcagtgacaatgcaaactgcaaacccggagtaccggaaggaacatgttcatgtttatgacgtcaaaaaaaaaattgccggcccattcacggtc

SEQ ID NO: 4338 - DNA, 893 bp, Zea mays
gagagctcactagtccccccccccccattattctgcatttcagcatctaggtggtttcatttctcgcactggattgtttccttttcactggtgttgcagttcttacagttgtttaagcaccacatgtaaagtttttttaaaaaaattatatttcttttaccagataaacttggttagcttttacggagtgattttgtattgtttgtaagattgtaaatattgtttgatcactaactgaaacaccaaccatggaatgatttttcaggcatgtggacctctctggttctttttatacgtcgttagagatttacagttgtttattttttgtttaccgaccgcagcaaataattatgatcataaatacatggacttattgattagtttctagcagtctggcaaattatgttcaatgtttggaacggacgacggttcctctgctacagtacagatgagacaatgtcctatgagtttaattgtaaaaaattcttacttaaatatttccctttcccatttggagatggacctacagagtttactcaaagatgcttacaatatttatcccactttgtgggtgaggttgctcctttcttttcattaaatgtagctatgtgactacctttgtttttatgcgatagacaaactaatagctattacatttgcagagttccttttttgcatattttatgtgccttgaagtacaggcacttgttccagctggttctcctaatgctaataagagtaaatccagaggaaatgacccggatgatgatctgtgtcttatggatccagatggcaacaatctgaaacctggaaacttttcttgtgctcactaatatcccgtcgccatggcgtcctggctgacgtcgtggatgccaagcccatgcctgcgttga

SEQ ID NO: 4339 - DNA, 3280 bp, Zea mays
agacgacgccaccgtcaccccccgcctccgccaacctatcccccaccgcgtcacgcgcctccacctccccagatcggcggcgaaccggggggcccggacaggcggcggagagctcgaggcgtcatggcgaagtcgagcgcggacgacgccgagctgcggcgcgcgtgcgccgcggccgtggcggcgtcaggcgcgcgcggggaggaggtggccttctccatccgcgtcgccaagggccgcggcatcttcgagaagctcggcaggctcgccaagccccgtgtcctcgctctcaccgttaaacaatcatcaagaggcgaggcgaacaaagcttttcttcgagtattaaaatattcatctggggcagtgctcgagccagccaaactttacaagctgaaacatctaacaaaggttgaggttatttccaatgatcccagtggttgtacatttgttctgggatttgataaccttaggagtcagagtgttgccccgccacaatggacaatgcgtaacattgatgacagaaatcgtctacttttttgtattctgaatatgtgcaaggagatactcagttatcttccaaaagttgttggaattgatattgtggagctagctctttgtgcaaaggaaaacacactgaccatagataatcaagtgagtacccaagatggccaagaaacatcagttgctactcaaaccgagaggaaagtaacagtaactgttgaaaatgatctcgtgtcccaagcaaaagaggaggaagaagacatggaggcacttcttgacacgtatgttatgggaataggtgaagcagatgcattctctgagagattgaagcaggaacttgtggctttggaggctgcaaacgtatatcaattactggaaagcgagcctttaatagaagaggtcttgcagggtctggatgctgctagtgcaactgtagatgatatggatgagtggttacggattttcaatctgaagctgaggcgacagcagcgaagatattgcatcgattgaatcacgtaacaatggcttggagatgcagtctgtaaacaacaaagggcttatggaagagctagataaattgcttgagcgtctgcggattccacaggagtttgcagcatcattaactggaggctcatttgaagagtcacggatgctgaaaaatgttgaggcatgtgaatggttgacaggggccattcgcagtcttgaagttcctaatttggacccatgctatgtcaacatgcgcgctgttagagagaaaaaggcagagctggagaaactgaaaacaacttttgttcgacgagcatcagagtttttgcggaactacttctccagtttggtagacttcatgatcagtgacaaaagctacttttcacagcgtggacaattgaagcggcctgatcatgcagaccttaggtataaatgcaggacatatgcccgacttctgcagcacttaaagagtctggacaagagctgcttaggtcccttaaggaaggcatactgtcattcccttaatttactactacgacgagaggcacgcgaatttgccaatgaacttcgtgcaagtacaaaagcaccgaagaatcctgctgtttggcttgaaggttctggcggctctggtcataatggaagcagttctgatacttcacaggtctcagatgcatactcaaagatgcttacaatatttatcccgcttcttgtggacgagagttccttttttgcacattttatgtgctttgaagtacctgcacttgttccagctggttctcctaatgctaataagagcaaatccggaggaaatgacccggatgatgatctgggtcttatggatccagatggcaacgatctgaaacctgacagtacctctgctgaactgggtacattgaatgaagctcttcaagaattactcgatggaatccaggaagacttctatgcggtcgtagattgggcttataaaattgaccccttgcgttgcatctcaatgcatgggattacagagcgttacctttctggacagaaagctgatgctgcaggatttgttcgcaaactacttgatgacttggaatcaagaatatcagtacagttcagccggtttattgatgaagcatgccatcaaattgagcgtaacgaaagaaatgtgcggcaaactggaattctagcctacattccaagatttgctgtccttgcatcactgtaaaaactggcaataagcagcaagactccggtgctcttatccttggcactggtgattatatgatttaagttctgcttcaagataaaaagagcactatggagaaattgtgcttattgcagggtgtactgtgacaagtttttttgttgtcttagagattcttttctgaagtggcaaacatagaccaagatctgactttgtttcatatagatttgctgtccttgcatcacgtatggaacaatatatccaaggacaatccagggatttaattgataaagcatacacaaagctagttagcacaatgttcgcaactttggagaaaatttgcacagagtgatcctaaaactgctgatattgtgttgattgagaattatgctgctttccagaacagtctttatgacttggctaatgttgtgccaacgcttgcaaagttctaccatcaagccagtgaatcatatgaactagcttgcactcgccatatcagctcactcatttatctgcaatttgagaggttatttcaattcaaccggaaagttgacgaattgacttacactattgctgctgaggagataccgtttcagctgggattatcaaaaactgacctaaggagggtactgaaatccagcttatctgggattgataagtcaattagcgccatgtacaggaggttgcaaaagacactgacctccgacgagttgtttccttcgctgtgggacaagtgcaagaaggagtttttggacaaatacgagagctttgttcagatggtaacacggatatatgggaatgagccgatcatgtcagtcaacgaaatgaaagacgtccttgctggtttttagatacaagtacacagcaccatgtatgatttcagagaaatagctatgtattccattcattccattgaattctgccgccacttgcgttactgtgttaggcgccctttttgggttatatgtgtgtgtgtatgtggatgtcctctgtatagaagtgaacgcggcatgcttcccctaatgatgttcctgtgtcgcatcgagccgtcagtgacaatgcaaactgcaaacccggagtaccggaaggaacatgttcatgtttatg

SEQ ID NO: 4340 - DNA, 1123 bp, Zea mays
cctgggcacgtgaatttgccaatgaacttggggcaagtttcaaaagcaccgggggttcctgctgcatggcttgaaggttctggcggctctggtcataatggaagcagttctgatacttcacaggtctcagatgcatactcaaagatgcttccgccgcgtggcccgcttcttgtggatgagagttccttttttgcacattttatgtgctttggagtacctgcacttgttccagctggttctcctaatgctaataagagcaaatccggaggaaatgacccggatgatgatctgggtcttatggatccagatggcaacgatctgaaacctgatagtacctctgctgaactgggtacattgaatgaagctcttcaagaattactcgatggaatccaggaagacttctatgcggtcgtagattgggcttataaaattgaccccttgcgttgcatctcaatgcatgggattacagagcgttacctttctgggcagaaagctgatgctgcaggatttgttcgcaaactacttgatgacttggaatcaagaatatcagtacagttcagccggtttattgatgaagcatgccatcaaattgagcgtaacgaaagaaatgtgcggcaaactggaattctagcctacattccaagatttgctgtccttgcatcacgtatggaacaatatatccaagggcagtccagggatttaattgataaagcatacacaaagctagttagcacaatgttcgcaactttggagaaaattgcacagagtgatcctaaaactgctgatattgtgctgattgagaattatgctgctttccagaacagtctttatgacttggctaatgttgtgccaacgcttgcaaagttctaccatcaagccagtgaatcatatgaactagcttgcactcgccatatcagctcactcatttatctgcaatttgagaggttatttcaattcaaccggaaagttgacgaattgacttacactattgctgctgaggagataccgtttcagctgggattatcaaaaactgacctaaggagggtaccggcccccggcccgcccgggattgataagtcaattagcgccatgtacaggaggttgcaaaagacactgacctccg

SEQ ID NO: 4341 - DNA, 1866 bp, Zea mays
  misc_feature (1849)..(1849): n is a, c, g, or t
ctcgaggccggccgggcgcgaagaggggcagagggcagcaagcagccgttcccccaaaaaaggccagagctcagcagagccccgcaggccgcacccaccagaaaccccagtcgatcggcggcggcgatgtcgctgtcctcggtgaagatcggcgaggaggtttggctcacatgcctctcccacgccctcactaccgagaccgaggaggtcatgggcctcctcctcggcgacatcgagctttccagcaagggcgccaccgcccttatatggggagcgtctccgcagatgaggtgcgagcggaagaaggaccgcgtcgaggtcaacccggagcttctcgccgccgcatccgcgcaagccgacaaaatgacggccaccatcaagaagactacgagggtgatcggatggtaccactcgcacccacatatcactgttctgccgtcccatgtagatgttcgtacccaagcgatgtttcagttgctggatacaggctttgtgggccttatattttcttgttttagtgaagatgctcaaaaggttggaaaaatccaagtgactgcctttcagtcagagggtggacaacagcatgcccttcctcttgccattgctccagttattgaccttgattcatcccttagttcatcagataatgcactcacttcacattctgcattggttgaaggcatggaacaggacacaggggattccagggcctcaaagcataacaaggcctggaaaagatctttggatttctactctcatcctgacacaaatcattccacgaattatcaacccaatgaaaacactctcgctctgtacaatcctgataacacacaagaagcgcctgttgatccatacgattcagatatgactcaaagcctccaggaggctttgcaccggtcaactatggacataagtggtgcagagtatagagggaaggaggtgccactttttgtgctcccgacaaggtatctcctcaagctggacaccacgatgacctcgtactgtgatatgcaacgagtcctgtttgaagaggagcaatcagcatataatcaagctatgcaacaaaatatttgtgatgggaaaattcaccctcttacatccattcactgtacgtctacatacaactcctctctatgcaaactaatggagtattgtttgagtccagctgttattacgcttcaggatcgcctgaaggaaaatgaacttcggctatctatgttaaaagaggagtgtaagcaacttgaggctgatacccaaggcatgagaaatggttctcctcgtcgcctcatgaatcacggagctggtggcagcggttcacctatggctcagagcaggcatcctttctccagccaagggagccctagaagcccgagcggcggcagccggaggagggcttgatgatgatcttgctccgcctgatgcgttgatgaactgtccgttgtggcttaaccagatgcttcctgaaaacccagatatttgacggacgaagtgcccagacaacagacactgtacctgtacatacccattgccgttcagcgctgtgctattgtggaactccaacggtctcattgtgtttttttgtagtattgggggcgttccttatcctgttgccggagctgtgccattatcctttccctggttcatggttggcatgagcttttatagcctgtacactgtagactctgtactagaggttttccagaaaggctgaactgccgctgctgggatgtgttgttccgggcatatgcaaagatgaaggctttctttgcttttgtaattgaaaaaaaaaccgacttcggtagcaatacattttcttgaaatgccaaaaaaaaaaaaaaaagccacgtgnccacaccttgcctggat

SEQ ID NO: 4342 - DNA, 2159 bp, Zea mays
  misc_feature (2107)..(2107): n is a, c, g, or t
gctgttgctgtagtgaatgtcatttccttgctgccttatgacatatctcatgagatcaagggtatttaagttcatcgtgtatgataagtctaagatgaaatgtcttaaaggtcctcatatttgataaatattcatggatggtttaccaaaggcagtgtggtttaatacagccatctattttctaatccagtctttttttgccaacagtggtgcagagtatagagggaaggaggtaccacttcttgtggtccctacaaggtatctcctcaagctggacaccacgatgatctcttactgtgatatgcagcgagtcctctttgaagaggagaaatcagcatataatcaagctatgcaacaaaatatttggtaactcaagtttcttcttgacaatactataacgccccgtttggatcactggagttgaattccattctaataatagtaatttaggcatatatcaattaagctaattcacttttatacaaaatatatttgtatactattattagcaagatgtcctagatatttatgtgctacatttttactatagaggagtagaacgaagagtgtcatgtaagttacagattagaaacaaattctaatcatgcataaaatcatttcctatcctccaccctatgaatttgagataaacttatatctgaactttggaaagtggtggaatgccaaattccaaattaaataagttactttatttagtgaattccaattcctttaaaatgaagggatccaaacgcctggtaagaaaaatcccagctttcttgtgtggtaaattgtttatgcatctgttgcagtgatgggaagattcaccctcttacatccattcaccatacatctacatacaactctctctgcaaactaatggagtactggtgagagcacagtctccttgtctcatttcagctaaattaatatactgcataatatcagttaatttatgtgattcacattttattctactgtttgagtccagctgttactacgctccaggatcgcctgaaggaaaatgaacttcgggtgaatagactagcctgcatcttttgacgactcttggccttgtaagtcactagcattgaacctgcatgtgtcagctatcaatgttacaagaggaggctaagcaacttgaggctgatacccaaaacatgagaaacggttctcctcgtcgcctcatgaatcatggagctggtggcaagagttcacctacggctcagagcaggcatcctttctccaaccaagggagccctagaagcccgagcggtggcagccggaggagggcttgttgatgatcctgttccgcctgatccattggcttgtggcttaaccagatgctccctgaatccccagatatatgatggatggacgaagtgccccggcaatagcactgtacctgtacatacccattgccgtccagcgctgtgctgttgtcgaatcccaacggtctcactttgctttgtagtattggcctattggggttccttatcctgttgtcggagttgtgccattatcctttccatggttgacctgagctttagcctgtacactgtagactctactagaggtttacctgaggctgaattcccgctgctaagatgtgatgttcccggccataagcaaagatgcaggttgtctttgctttgtaaagatgaaggttgtctttgttttgtaatcgaaaaaaaaaccctccgacttcgatagcaatccatttcttgaaacgatatagctataagctgcagccacaccttgcgttgatgaggcccctgctttctttcgagtgcgatgcatgcactggcctgttgagatcttatcaatatggcaaacagtaacctaacgtatatgactacatggtcttcatgcttttgagaggtgcctcataggaaacagtcaggccaatgattttagggaatacaatatatttttgctgttttttttttgcaaattgtccatattattacaaagaaaactaaacatgcccgaaggcaatagctttctagataaaaatgaataacggtccacttatatatgttggccagtaatcaattctgaagcctgacgaaccatgcatatattaacagtaggttaatggccgtgngtgaaaaaatttcaatacaacaagagatgaaaaaaaagagtgtcttagcaat

SEQ ID NO: 4343 - DNA, 1183 bp, Zea mays
gtctggaacagaaacgaagacgtttgtagcacatggtaggtcggccatcgatctgtcatcggacggctcacagaaaattggacgacgtggacatcctgcccgctccgttttgctcccgcggtttttttagagaataaatccttcccgatcgagcatgcattgcaaacaaagaaatcagcaagccagcatcaacagtttagacgactgacatcgatccgcatgacgatgctgccccgcggcgccgcggataaaatcatcagccacaccctggcaggcgcgatgctctcaggcctcggcctatggcacctcttcaaccacatgaggctcttggtctccctcgccccgaccccgtcgtcctcatcgtcgcgcgtcgtcgtcctcgcgccggcagcatggttcccggcgccacggggtgcgtcgcctcgagcccatcgccatgctggccgcgggagcgtacgggctggccacccagatgctcgcctactcgccgatgccgttccgcgccgacggctccatcccgcctgagcggctgccgaaccacgagcacgccatcatctacgcctcgctcctcgtctacaccagctccaacatatacctggacgacgacgacgaccgcgccacgcggcgccggcgccgacgacgctctccatgctcctcctggcagcgctcttcgcgcaggagctgttcgtgttccacgtccactcctccaccgaccacgccggcgtagttccagcggcagaggcctgcctggtccttgagcgcctccaccgcgccgacgctcatcgccaccatccacgacgccctcgctgccgccgccatgtccggattctcctaccgctcggatcttgggctcttgcttttgagttcggttgctgtgctggtcgctgattgactcgcagtagtgctcctctgaggttgtgttgatgctcctgtgctgtgtattggggcttgggagtgagctgggagaccggcgggtgggttatataccggagggaggccggcggaaacaggtggccgcggacgctggttttgctggacaccgggggctctcagtctccctgcttgtttacgctttctccagagctgtttcgctggataccaggggctctcactcaccactgtccgtgcttgtttacactttatccacagttctggagagaagaacgagattgctttctctgtt

SEQ ID NO: 4344 - DNA, 1211 bp, Zea mays
gcacgagaccattacctagaacatcctaatcaaaagcaaacaaagaaatcagcaagcagccagcagccagcatcagtttagacgactgacatcgatccgcatgacgatgctgcccccggcgccgcggataaaatcatcagccacaccctggcaggcgcgatgctctcaggcctcggcctatggcacctcttcaaccacatgaggctcttggtctccctcgccccgacggccccgtcggcctcatcgtcgcgcgtcgccgtcctcgcgccggcagcatggttcccggcgccacgggtgcgccgcctcgagcccatcgccatgctggccgcgggagcgtacgggctggccacccagatgctcgcctactcgccgatgccgttccgcgccgacggctccatcccgccggagcgcctgccgaaccacgagcacgccatcatctacgcatcgctcctcgtctacgccggctccgccatatacctggacgaccgccgtcgccagcgccacgcggcgccggcgccgccgacgctctgcatgctcctcctggcggcgctcttcgcgcaggagctgttcgtgttccacgtccactcctccaccgacgaccacgccggcgtcgaggcccgcctgcactggttcctgcaggcctccgccgccgcgtgcctcgccgccgcgctgctcggcgccgcccgcctccccgcggacctccagctcgccgccggcctcgtccgctccgcgtccctcgcgttccagggcctctggtgcgtcgtcatcggcgtcgcgtgggtccccgggatgcttcccgccggatgctacctcgacggcggcggcggcgtccacctgcgctgccgcggcgaggacagcctgcgccacgccattgccgtcgtcaacctgcagttcggatggtgcatggtcctcgtcacgctgctcgtcgtcgggatttacgtgtacgtgtgcaaaaggtatccggctggagcttggtctcatggggaggtatacggacggctgccggaagcagaagctgcagacgaggacgacgacagccaccaccacgacatggagacgccaaactgtaagcagctggcggcgcacgatgacgtgcatgagttcacgtcactggagatcgacgtctaaattaagggtccataaacatgattgctcacgacaaaaaaaaaaaaaaaatacgcattatattatataggtgatgattggcacgt

SEQ ID NO: 4345 - DNA, 1604 bp, Zea mays
gagaccattacctagaacatcctaatcgaaaaaccgattcccacgtgattgcggcgcggccgcgcgaggagtgctcgtagccctcccccccgcccgcccgcccagattcggtcgcccatggcgagggacccagcccgcaccgtcttcataggtaacttggacgaaaaggtatctgagagaatcttgtatgagattcttattcaggcaggccatgtagtagacctgcatgtacccagtgacaaggagagtaacagtctcaaaggttacgcttttgttgagtatgaaaccgaggaaatcgcacaatacgctgttaagcttttctcaggacttgttcggatcagtggtaaaacgcttaagttcatgattgctggttatgacaaaccgtcttcaaatgtcaatacctcagtaatgctcaatcctgtaccctcttcaaatggcaataatccacatatcaggtggtaaacgggaggattggaggttatgtcttttctctcactccttatccatatggttttcaagctttatcaggtggacaagtacacggccatggccagcctttgcacatcggacatacttgaaggcttgaagctgtcgtccttacagtctcatcgaccgatgccacagcgacacatgcacgaacaagagcacctgcccgactgagcgtgcacgacctcgcgccgatcagggccaagaactcacccccgtcgtgtgtgccgatggaggtggaggccgacgggatccaggaagccaccgcaggcgcaggagacggcggcggcgtggcacgcatgtcttcttctgcgtcgccgcgacgtccaggggcaacaagaacagcatctcctacttccacaccaacgcggtcggcgaggacgccgagtcggcgctcgcgctcgccgcgctctgcctcgaccacgcccccgaccaccaccggtggcaccaccacaccgtcgccggggcgaagacgttcgcgttcctctcggccgacgacggccgcacgtacttcgccgcggccgacccgagccccggcgccgccgaggtggtccggttcctggagcgcgtccgcgacgcgtgcgacgccgcgcccaggaagcgcctgcgcgacgaggcggtggcccccgtcgctcgccagttcgccaggacgctgcgggcggcggcggcgggcccgagctcaggcgcggagctaccggaggcctcgctgcaggcgaaggagccgtccacgccgctggcgccggtctgcgagaaagacgaggaggagcgccagagggccggagagcgacgtcgcgccttcttgcagccggaggaaagcgcaagcgcgcttccggggtggcgcccgtggtggcgccacgcgtcggtcgtgatcgtcgtggatgtggtgctgtgcctcgtgctgttcgccgtgtggatgggggtttgcaaaggcttcgggtgtctgcgatgaaaatcgcccgagagcatgcaattgtaaatttgtaatcacatccatgctgtgtgcatggttcgcgttctttatgttaatttgcttgtcagatatcacatctacaatttgaaggaaaaaaacggtttaagaaacgaagacgcatgccttcaatgcaaaaaaaaaaaaaaaa

SEQ ID NO: 4346 - DNA, 1177 bp, Zea mays
ccggccgggctgccaaccgccctcgcccctttccctccctcccacttaaaacgcaacccgcggcgcccgccggcccggcccgaaacgaaccaaccgccccgcccccaagcgcggagcggagtccagtcctccaagtccaggaaaggcgcgcgagatccaacgagcggtgaagtgaccctgatcttccaagatgctccgccgagcaagggttccctgcgccgcggcgcccgcgcccgcgcccgcggtcgtcgtggcggtggcgctcctggccctcagcgccgtggccgccgccgacttcttctcccctctcgcccccatcttctcccccgtcatcaactccatatgcagcacggtggcctgcgggcagggcaactgcacggtggcgccggacacgctgggctaccgctgcgactgccgcccgggctggacgcagctccacgtcggcgacagcctcaggttcctgccctgcgtcatcccaaactgctccatcgacagctcatgtttcaatggttcgccggcgccggcaccggcgctagcgctgacgcctttgccgccacctaaaaacttctcgctcgacccatgcgagctagcgtactgcggcgccggcggcacgtgcaggaagaacggctccggcatgagctaccactgcgagtgcaaggaggggtacagcaacctcctcaacatgaccgcgatgccttgcttccagaactgttccatcggcgcagactgcgcgagcataggtattcatccctcctcgaccagcaacagcccgcccgcgccacctggctccgagagcatttctaaccaaggcagtacagcggcaccaggatccatttcacagcggattctactgccactgctgctgatggtggtggtctcattggccgtcggttacgtgatgtaggtcgaggatggagcgtcccacggcaacactagactgttttttttttatccgcaggacagggtagagctgatagtttgttagggtggtgatacacttttggatgtgtattgtactgctgcgtggttacgttttggcgattggtttgtgtagatgttacccggccgggtcattttatgtcgatatggaataaagcgcctctgtgtattctactgggatgattaaactgactctgcattgggtaactgcgcttagctttgcttttttctgaacttc

SEQ ID NO: 4347 - DNA, 579 bp, Zea mays
  misc_feature (19)..(19): n is a, c, g, or t
aataagaagaaggtgctgngagcgaagcactggtcgttttaccgccatcatcggcggtgtgagtgcatgcagcgaggaagcatgcttgccatgccgtccgcccggagcttcggcgccgcgggctggtggcgtgtgagcagggatgcttcggcggtgcacaagaaagaaggcaagtcttatcggcaagggaaggctaagcctttcttccaggtctccctctctccatctaaatcattctatgtgttcggaggagggggcaatcgatcgttacttactggtctcctgacctagcggtcatgtctctgtgtgtgtgtgcgcgctccatccgtgttgatttccagctagaataatgaccagttcagagtgaatgtgtgagcgtgtgtgttcaagtgtcagactgtcagtgagtgaaccttgcgttgtattttgaccgtgtgagtccgtgtattttcagttgtctggtgtgttgggtgggagtactctctgaataagaatgtaaatgctatatgtgtgccgtggtaattaacttgagctgatctttaagttggtccggatatataagcgaaccctgcccaaaaa

SEQ ID NO: 4348 - DNA, 1674 bp, Zea mays
ttagcagctgatgctatgttaggttttcctttaattagtcatgttactcatgtatagtttttcggtctaaattccgttgtaaaacgggctatatattttccttaatttctttgctaagtgaatcgggcgtgagctcctagctctttttcgaaggttcttccaaaggaaaatacttagcacatgtagcaatggatcccaagatcgagatcttttgacactcatctcaatatctcataactatttcagaaactgtcgctgtcagtcatcgacaggtgtccactgattgtacctcagaggatccccactacgcataaaattaaaggcgatcgactcactgaaacctatctccctagtaggttaggcataacaaagtgttagcgccttaatggccacccacaaaaaggatcaaaagcatgagaatccagtggtcgtctggctcaaagataagtgggtgcagatatgcgagaatccacgacgcaaccaaagaatcctcccttcaccaattaacaatccctgcagcccaatcgctcgcacagacttgcgtgattcagttgacgagaagatgcctataaaagaaaggaagattggccaggcgccggcctgaggagtgttcccggcccactcacaccgaactcgtgaagcacagtttccatcgtatgatgtcgaggaagaggaaaaagaggggcaaagaagaagaaggtgctgtgagcgaagcactggtcgtcgcaccgccatcatcggcggtgtgagtgcatgcagcgaggaagcatgcttgccatgccgtccgcccggagcttcggcgccgcgggctggtggcgtgtgagcagggatgcttcggcggtgcacaagaaagaaggcaagtcttatcggcaagggaaggctaagcctttcttccaggtctccctctctccatctaaatcattctatgtgtttggaggagggggcaatcgatcgttacttactggtctcctgatccttagcggtcatgtctctgtgtgtgtgtgtgactgtgtgctccatctccgtgttgatttacagctagaataatgaccagttcagagtgaatgtgtgagcgtgtgtgttcaagtgtcagtgagtgaacctggcgttgtattttgaccgtgtgagtccgtgtcgtattttcagttgtctggtgtgttgtgtgtgtgagtatctctgaataagaatgtaatgctatatgtgtgccgtgttaattaacttgatcgagctgatctttaatttgttctcgatatatacgcgtttgtgcatatagtcatgtcgtatccgataatgtaatttggatacaagtatacctcgatcgagtaaggattttattaattctccgctgttagaccgagatgacgattgacgacacagtaaaaatgaattctcttttaacttctgcctgagcacaaagtctaaaaggaaaagacccacacgctcaatagctagccatcaattttaggagtagaacgttatctatgtgtaaaatgttgtagctaggtgctttcactaccaaacccggcccgtgcataaagacttggaggatattaaagcatgttcgaaaacaatgaattatcccaaaaaccatctctgacggcaatatataataaaggaataaaaggcgaacggtggcgatcctgaatctccccgtctttcttccatccaaaattc

SEQ ID NO: 4349 - DNA, 1275 bp, Zea mays
ccacgcgtccgggcgaggtcgccgctgcacttgcggctgcctccatcgtgttccgtgacaacgccgcctactccaagaagctcagccagggcgcggccaccgtgtacaagttcgcgcggcagtcggggcggcgcaccccctactcgctccggcagccggacatcgagtactactacaactccaccagctactgggacgagtacatgtggagcgcggggtggatgtactacgccactggcaacagcagctacatcaccttcgccaccgacccgcggctgcccaagaacgccaaggccttcttcagcatcctcgacttctccgtgttcagctgggacaacaagctcccgggcgcccagctgctgctgtcgcgcctgcgcatgttcctcaaccccggctacccgtacgaggagtcgctagccggctaccacaacgccaccagcctcaacatgtgcatgtacttcccgcgcttcgccgccttcaacttcaccaagggcgggatggcgctcttcaaccacggcagggggcagccgctgcagtacgtcgtcgccaactccttcatcgccgcgctctacgccgactacatggaggccgtcaacgtccccggctggtactgcggcccaaacttcatgaccaccaacgacctccgggagttcgccaggtctcaggtcaactacattctcggtgacaaccccaagaagatgagctacgtggttgggttcggcagcaagtacccgcggcacgtgcaccaccgtggcgcgtccacgccgcacaacggcgtcaagtactcgtgcaccggcggctacaagtggcgcgacagcaagaaggcggaccccaacctgctggcgggcgccatggtcggcgggcctgacaagaacgacggcttcaaggactcgcgcaacaccttcgggcagaacgagccgacgctggtgggcaacgccggcctcgtcgcggccctggtggctctcaccaacagcggtaggggagccggcgtcaccaccgtcgacaagaacaccatgttctccgccgtgccgccaatgttcccggccacgccgccgccgccgtcatcatggaagccgtgaccacatacgatttttggtacaatacaacgtcagcagtgaattcttgatgccacgttaacggtggcatccatcatgcgtcacctgtagatgtatgttttcatggatacaagtggattacagttaatgaacggatggatacataccttcgctatcaaaaaaaaaaaaaaacgcgcctcagggccccgcccctagggcc

SEQ ID NO: 4350 - DNA, 2151 bp, Zea mays
aaaagttttttttttttttttgctgaaacagctatagatgtgtattgataggcaccctaagctcatcgagatcaaagcagcatcacagacgagttcaaaagccacaatattctagggaaacaatcctttcttgtaggaacacagtctcataccttttctacaccatgagctgcgtgtactttaattccacaagtttgacataagtccagcagaaatgtactaataagtttacatgccaaagagttaatcaatgctgataaatcagcaatatctaagtattatcatcagcattttcttcagtatcttgcaacaaagctcctcgtactcttgccctccgaggcaaaggggccacgcgcttcgtacctttagcaggaggaactttgctaggtaaagccactggtgtttgctgctgtacagcaacaatcatttgatcagagcttggaggtgcacccgacacacttggaaacttatcagtcacaagctttggctttgtagcctttcttttgtcgaggaatgaaagggcttcaagttgcttttgcattacttcgtttttttctctttcagagtctagattttccatgagctgtgacactcgttcttgttctctggatgcatgttcctgcctggtcttgtaagattcatagagcgcaagggagaaatcagcaatgacatctttgagcgcagatgcggcaactctatcgagagagagagtgatgcgaggtagtccctttgccttggtagccacaagctcagcagtatcaggacctagggccgcggcagggaagaagagcctgacttggtcggaagacaaggaagaatagaggtagtcgaggaagtcggagcaggagccagcgatgccaacgtcatcttggaggtcgcggaggccgtcgaggtcgagggagcgatgccaagcgaaggagtggaggtcggtggcgacgacgcggaggccgccctgggattgggcgtggaagagcacgggtcggcgcaggagagcatcggcatcttcgttggatttgtccggcttggcctcgccaaagacggctgccatgctcgccatcggcgccggcaggaaggaagacgctgttcacgtacggattacgtgagttgcctttgaaagcgtaaagacgtggggggcgcctctccgcctgtctcttcctttctcgcggtgctccgagcccgggattaacgattctggtggggagggaaagggaacgggagcgggaggggaatccaattgcgatggcctccgactcgggcgatttcggtggggagaacaagtcgttggaaacggcgaggcggctgctggaggagaccttcacgagtgaggcagaggcggaggcgctaccgagcttgccctcggggttctacgacgccttcgtcctgaggggaatccgcgtcgtccaggccctccagcccggcacactcctctgccacttcaacgtgccctccagactactcaactcgggcggcttcctgcacggcggcgcaaccgcctccctcgtggatctggttgcctccgccgccttcgccactgccgggctacgcaccaggggctcaccccttgagatgaacatctcctaccttgatgctgcttttgctgatgaagagattgatatcgaggcgaaggttcttcgcgctggcaaggcagtaggggttgccgttgtggaactgaagaagaaatctggcaaaatcatcgcccaagctcgctactccaaatatcttggtgttagtaaactctgaatcatgatgctgcctcccatatatacggggatatggtagcagcaagcaagcagggtgtggtttggttcgacagcaagtgttgttactactctacattatatcttggtgttagtaaactctgaatcatgatgctgtattactgttactcaaccatcatctcagctacttattattcttgtgttatgagtcttcctcggattgcattaaactaaactacagtatacagcaaatacttgtatatatgtatgagcctgagcttcaggcattgcatgtggatgtgtggctttgtctggaactttttcttgtacataaaacaaaagacatggctgataaacatgtgtacctagctagttcttgccaaaaaaaaaaaaaaaaaaaaaaaaaaccacaaaaaaaaaaaaaagatcgcga

SEQ ID NO: 4351 - DNA, 2017 bp, Zea mays
caggatgacactgacaccgcctcgggctcggactacgtcaacggcaaagccggctccggatttttcggcaccacgcgtccgcccaactggatggcacgttgttccttactagaagcgtggacttgagaactctgctcggattgaccccagaccccgattcccagaccagagttgcttttgcaactcaatttcagcgctcattcatgaccctactacgcaatgctcagtttgaagaactctccgcacaagatctgctcttgacatatgccctaaataacgattacctgctcacgctgcccatttatgtcgactggaagaaggctgctcaatctaatgcaataatattcaggcgtggatacgcgactgagaggcagaaaggcctcctgttggttgagaaacttgattacttgcaatcaaaactcttgcagaatgtctttttcagcctctccaaacccttgaaaaagccagggaaatggcttaatgaggctttgaaaagatcaacagataaccagggatttcagatctggatagacaaactgagactatggcttaaagagcaaacttatgcagataattcactgctgttgatagaaagctcttcatgggacaagcttagttctgatcagttacctgatgcagatgttcctatttggatcgctgcacaaagggcagtctctcgttatgaaggaattttgtcacctgttggtcctcgtggaagactgttaagaagattgcttaaatggactggactaataccttctctgccagaagcaacgataaaatccaacaatgaaactaaacatcttgaaggacatgtgaggccaaactttctaccaagaattacccttgctaatatatgggaacctgcaagcagagaatcttgcaataacaatatctgggagatggtgaaagcttcttttcgtattctgtttgggaggtctactcttcaggaaccagcattccaggagttaatactactttacactgatgaagttgttccaagcgacaccaacggcgacagcgtcccgctgcaactgaaaatttatgagaggattccgatcccagatttgccagtagttttcccccacaagaaattgtccttccgcatcctagatacagtaaggctagatattgctactgtaataggtctattggcatatgtggtgaactacaaatttgagagtttagcctcatctccgtttgctggtactgcactcgtcatacttgttttccgtgtagcactgggctacaaacagacccgggataggtaccagcttctggtgaataaaaccctctatgagaagacattggcaagtgggttcggctcggtttacttccttctcgatgcttctgagcaacagcagtacaaagaagcacttttggcatatgccatgttgctctgcagaaagaagtatgaggtctcatctcgtgcaagcataagagatgcatgcgagcagtttatgcacgagaaattcgaggcaaagattgagatgccgatcgacaaggcaatggagacactgctgcggttggggctggtgattgagcttcccactgatggtgggtcgagcgtgattggtctcccatgctcggaggcatacaggatcctgaaaagccgttgggacggcttgctggaacaagatacagaacaaggctgattagaacgagacatgtacgttggtggcttggagtggagtgggatgggatgccgtgctggtacatactcgacgcgtcggcaaagctcactcttgtttgtatgtatacgtaccagttgttgcagcaagtgtatatgtgctagctacgtgcatgtataatcgtgatctagtttgttgtacacaaacgattgcagtgtatgtatatgggagcacatgtttttttcggaagactagccatgtgtctgtaagtttttctatttgtaagttggtttccatttataaatatagagcataaacactgttctgttaaaaaaaaaaaaaaaaaaaaaaaaaaaaaaaaaaaaaaaaaaaaactcgagggaggg

SEQ ID NO: 4352 - DNA, 3172 bp, Zea mays
agtggattgaagaagattagatacgattaaatgtcttttagttaaaattaaatagaaaatgatttagtgccactcaatcctctatccccccgcaaagatgcaaccgaacaaggtaggtctcgtgaagaagtgaaaaaaaactcacccgtcaccattccactctatagaaggacgctacctatctttatctctatatttaaactgtaatctgcgaacaaacagtgttttgcacgacgataagctgttcgatgcagtctaacaatttaaagctcatgttgtttgagatgattttcaaaattgtgcctgtacagtagtaatggatgattcatttttaggagaaaattgagcagcaatgctgagataaaagcgcagttttaaaaatcccccaaataatcagacagagggcagctgttgacatgagttggtggcatgagctgctgaagctgaaccaacctacacaggaccggacagcacaccacttggtggacgtcaaaagctgctgccaggtggccgtatcgaggcctgcaccgcaccagcagctgccgccacccatcatttttgccaacacggctccagtgtgtctgagctgcctgacttggaggagtcgcaggaaggcaaaaaaaaaaaaggggttttggtaattcatcattcacgtcgcctcgcgttatagcacgttcttgtgttcacaaaaaagctacgaggaactttcaactgcacacctcgttggtgtccccctcatgcatgaataaagccagcctgtccacgcggcggccagcggctgtggctgcggcacaaacaccgcgccagcacaacgcatacgcatacctcaccttcctttcctcctcccgtcctccatcaaaagaaggcagggaaagatctgatctggggggtgagagagcaggaggagaaagccaagccattgccctcccctcttgaaggcttggagcttggttctacatcctcttctcttcccctccgtctctctctctctctctctatttggtttgcttgcttgcctctactagactctagtcgtcgggtccggccatggccaccatcctggagaacatccagaaggcgaggttcctgccgaccaggccgctcaaggacgagctgcccaccttccagggcggcggcaagagcaaggaggagagccacctcatgggcctgaggaagcggctgtccagcttctccggcaagatccagcccatctcctccgcgtcggccgccgagtgggcgttccgccgctccaagtcggcgccctccctcggcgccgccttcgccgcggggggcggctccctgaggcagtggtggcagtggggcgtcggctggctcctgtccaagaagcccgggttcgcgggcgacctcgagatgaacgaggaggaggtcgccgcgctgggccgccagagcaggggcacctgggcccacatcctcttcaagatgcggtccggcgtccgccgcctcgtcgcgtccgcgcactcgctccccaccacgcacaagcagcagtccctgccgtcgtcgtcggcctcggcggcgcacagcgtccagtgcaagccggcggcgtcgttcgcctacgcgcagcggcagagcttccaccacaccggccacgccatggcgcactaggcagcgtctcgcggttgccggtgccgtctgcggccggtctcctccagatccagggatggagagcgctgagaggcgcgggaagaagaagattcaggttacaggtgcgtgagatcgacggtgaagatgtcgttgaattgatgatgaatgaaatggaatgtaggattaccgttctgtgatctgtgtagatctagtgcccctgtagaggtgaacaagtgttatactacatgcccgttctttctttatattattcttttgggttcgttctttggacgatgtaaatgtaaaatgttttgttgatcttgtactgttaaataaaactgatgcaaattgtgcccctctcggttcttgagtagtctcaggctctcagccagatctgatgtgtcttttcatcggctgccctgcccagcgaacctgtaacattctgccagcatgtatgggtgtcggtgcacgcgtttcctggaagcctgtactactcctggtcaatgcgacgcaaaaacagctggaaaaattcacaagatacctgtcaacttgggaagcaactattctcaaacgagagttgccgccggtagacggttcatggaatcaatggtcaccggccgtgagcggtattctttctttccagtgaagtgaatcgacgtgttatagtcgtctaaaaacgcaaattactcgtctccaatttcgtttctagaacgacgacaggacacatacgattctctcgtgttctgtctacggctaccagtagcaggagtagtaggaaacagcgaagcacaagagaaggtgaagcgtcacatgtgaacaggtaggcggtcaattgtgtcacgtacgctacaactacgagtccgatggacctgcagttgcaccacgagaaaatggatggttcgctagcgcggtccgatggaaggaatgggtaggtggtgcccgcgaaacagacgtgaattcggcggcggtccatggaatttggaagggaaagccaacccaaccttgctacttttcctcgtttaggacaccgacgttttcttaccagtgccactgggccaggcgaatgagtggacgcccggcccaatccagttatgccaatcttcttcgccgccttcgccaagttcagcccatggtctatccggaagcggccgccgcctcactctacaactgcctgcggtccaactccaggccgtcacgttttttaaaatggtcaggtcgtcagggctcactgttttttattttaaaccattttaaatagtatatataaaataatattgttgttttttaaaactaatccgtttagtcacattaatctctagcacagctaaattgttgtactgtattattccgtctcatgacatggtaagaaagacaaacatgaccactatgccacgtcaatttgattgacttagcaagcggtccctcttccctttcttatttttttccttttaggctgattttaaccattctctctatactgttgggggtcttcgtcctccgaaggtcctcaaaaacatgatttgacaatgttttccaagtggattatgtgaacaggtatcttcggactcag

SEQ ID NO: 4353 - DNA, 1176 bp, Zea mays
gggcaaagactgatctgcggggtgagagagcacgaggcagaaagccaagccattgccctcccctcttgaaggcttggagctcggtcctacatcctctcctcttgccctgcgactctctctctctctctctctcatatacggttggcttgcttgcctctactaaactctagtcggcgggaccggccagggccaccatcctggagaacatccagaaggcgaggttcctgccgaccaggccgctcaaggacgagctgcccaccttccagggcggcggccaagagcaaggaggagagccacctcatgggcctgaggaagcggctgtccagcttctccggcaagatccagcccatctcctccgcgtcggccgccgagtgggcgttccgccgctccaagtcggcgccctccctcggcgccgccttcgccgcggggggcggctccctgaggcagtggcggcagtggggcgtcggctggctcctgtccaagaagcccgggttcgcgggcgacctcgagatgaacgaggaggaggtcgccgcgctgggccgccagagcaggggcacctgggcccacatcctcttcaagatgcggtccggcgtccgccgcctcgtcgcgtccgcgcactcgctccccaccacgcacaagcagcagtccctgccgtcgtcgtcggccgcggcggcgcacagcgtccagtgcaagccggcggcgtcgttcgcctacgcgcagcggcagagcttccaccacaccggccacgccatggcgcactaggcagcgtctcgcggttgccggtgccgtctgcggccggtctcctccagatccacggatggagagcgctgagaggcgcgagaagaagaagaagaagaagatccaggttacaggtgcgtgagatcgacggtgaagatgtcgttgaattgatgatgaatgaaatggaatgtaggattaccgttctgtggtctgtgtagatctagtgcccctgtagaggtgaacacgtgttatactacatgctcgttctttctttatattattcttttgggttcgttcgttggacgatgtaaatgtaaaatgttttgttgatcttgtactgttaaataaaactgatgcaaattgtgcccaaaaaaaaacaaataaaaaaaataaaaaaaaaatataaaataataaataaataaatttaataatttaata

SEQ ID NO: 4354 - DNA, 525 bp, Zea mays
  misc_feature (501)..(506): n is a, c, g, or t
  misc_feature (512)..(514): n is a, c, g, or t
ggggcactggttccccaccaggcacaagcagcagtccctcccgtggtcgtcggccgcggcggcgcacagcgtccagtgcaagccggcggggttgtttgcctacgcgcagcggcagagcttccaccacacgggccacgccatggggcattaggcagcgtctcgcggttgccggtgccgtttgcggccggtctcctccagatccagggatggaaagcccttaaaggcgcgggaaaaaaaaaattcaggttacaggtgggtgagatcgacggtgaaaatgtcgttgaattgatgatgaatgaaatggaatgtaggattcccgttctgtgatctgtgtagatctagtgcccctgtaaaggtgaacaagtgttatactacatgcccgttctttctttaaattattcttttgggttcgttctttggccgatgtaaatgtaaaatgttttgttgatcttgtactgttaaataaaactgatgcaaattgtgcccaaaaaaaacaaattnnnnnntttttnnnaaaaaaataaa

SEQ ID NO: 4355 - DNA, 2766 bp, Zea mays
gctttaaattttcatacatatgtataatgtatttgttatgcccttaaatatcttacacttcctctgttctaaattagaatttgtttgactttttgtgctatcctattcaattttttttagaaaaatgtaaaattcaaagccatatttatatatattatatgttaaataatacggtagcaaaaattaacaataattctaaattttttaaaataagacgagtcgatgataaaaaaaagtcaaacggattataaataggaatgaagtttttagttttcattaatcgtttatctaaattataaaaatgcatatagcagagaaaagagggtctctctttaaatgagggataggagcatataaaaaagataatgttttgaaaatatagaatgtgtattcccatacgtgcccctaaaatggcgacagaccaccatccgtttctaggcttctacatgaacttcttctatttctgtacaagctgccaaccgtgaaagcagtctgtttttgtagtgcaccagtctgtttcagtcgatttcacgattgaccaataagcagcatgaccactgtgtacctcatatttctctttatatgcaccacgaaacacctccgttgtacactacgccaccaccaatgtctgcggccgtggcattggcggtcatcttggccgtctacgtcgtcctcaggtatatatcctctccgagaggcaggtctaagcctctgaaccttccacctggcccgcgaggatggccggtgatcggaagcctcggcgcactggcaggcgcgcttccgccgcaccgagcgctggccgcgctagcggcgcgccacggcccgctcatgcacctgcgcctcggctcctaccacgcggtggtggcctcgtcggcggacaccgcccggcttgtcctcaaggtccacgacctcgccttcgccgaccggccgcgcacggccgccggcgaggtcgcctcctacggctacctcggcatcgtgcacaccccgtacggcgcctactggcgcatggcgcgcaagctctgcgccaccgagctcttctccgcgcgccgcgtggactcgttcgagcgcgtccgcgcccaggagatgcgcgcgctcgcgcgcggcctgttcgagtgcgccggccgcggcgccgtcgcggtcagggagcacgtggcgggcgccacgctgcggaacatcctccgcatggcggtcggggagaagtggtcgggctgctacggtagccccgagggcgaggcgttccggcgcacgctggacgaggcgttcgcggtcaccggcgcggtcagcaacgtcggcgagtgggtcccgtggctgggctggctcgacctgcagggctgcgtccgccggatgaagcgcctccgcgcgcagtacgaccgcttcttcgagcagatcctcgacgaccacgaccacaagaagacgcggcgggagcgaggccgacccggcgccggcgactccgcggcggacgatgacctggtcgacgtgctgctgcggctggtcgaggaggacgaggacaggccggagacgacggaggccagcaggctcacgcgcgacggcgtgaaagcgttcgtccaggacatcgtcgccggcggcacggagagctcggcggtcacgatcgagtgggccatgtcggagctcctccgccggccggacgccttgcgggctgccaccgccgagctcgaccgcgtgattgggcacggccgctgggtcacagagcgcgacctcccggacctcccctacatcgacgccgtcgtgaaggagacgatgcggctgcacccggtcggcccgctcctcgtcccgcaccacgcccgcgagcacacggtggtggccggctacgacgtccccgccggtgcgcgcgtgctggtgaacgtgtgggccatcgctcgcgaccccgcgtcatggcctgacgcgcctgacgcgttccggccggagcggttcttgaacggcagctccggcgccagcgtcgacgtgcgcggcgcgcactttgagctgctgccgttcggggccgggcggcggatgtgccccgcgcacggcctcgcgatgaagctggtgaccgctggcgtggcgaacctggtgcacgggttcgcgtggcggctgccggacggtatggcgccggaggatgtgagcatggaggagctatttgggctttccacgcgccggaaggtcccgctcgtcgccgtcgcggagcccaggctgccggcgcacctctacactaatgtcacgccgccacagcaggtcgcgggctccacgattgcgaacttgtccaccaggccggagtacaagctcgtgttctgaatcattcaccgccactaaaaataaagcaggaaaaactacacttcctgcgtgctagacgtccgggcggaacacaacagtgcttgctcacgttcttctattggttgtactaaaaatatggactagcctgaactttctgaacctaattcacctgtctgcttggtttcaccatgttcaccaaacacaatcgatgcaacttatcaattgaacccaccagctgcaggttattcacttatcaattgaaacaactggtcttgtgctaaaacatggtgcatttggttctctaaacaactaaaacaaaactagttggttcaataaaacacgatgcatatggttctgaggttctctaattaaccaataaagcgtctgtcggttgtctcctcgttgttgaagcttgcatctgtaggtgtgcaaatgaccctataaataaaagaggccaggcaacagtactaatgccgggaatcaatacagcaagtgaaa

SEQ ID NO: 4356 - DNA, 1415 bp, Zea mays
acccgattcaaacggtttcaaaagcgcgaccccaccgcagcccgcagggtccacggctctcgtttccgcccgcgccacccgccatgtcgtccccgccgcgggggcagcccgccaccgccgccgtgccggcggtcgcggccgccacgtccccgcagttgcccgccgcgtcccacacgctcccccgcgcgttcctcgccacatcctctccccgtgccatagtggcagcaccggcgcccccgctattcaccggtcggccgctgaaccctaacccaccggcccacggctcctccgtgccccacggcatcctctaccccgtcctgaaatccgcctccacgtccaactccgcggccgcggccgtgacagcgcagctccgccgcgttcctcccatggccgtggggtaccctcggacccacgccgtcgccatccctattgcacagcagcagcagcccctggtgcacgcgcaaccccggtccttcgcggccgtgcctcgggcccttgtgactggcgtgtcgacggggtccgaacagcctccccgaggagttcctataggctcgcagcccaaggttaatccagtaccacctgttggcccatccaatgagcagagtaacccaaaagacagggaaaagagcagagaagaacctacagttgtggtgattaatgaccgcaaagttaacctgctggatagtgagtcgggatccttttatgctctctgtcgatcttgggttcgtaatggtgttccacatgaaagtcagccaagctttggaaatggtgaaccacttcttccaagacctttgcctgcttcagttgtagattctagaatatcagacaaggacgataatgatgttgcaggtgaagattcagatgaagagccacagaagaatgccaacggtgaatacaatacaagtgatttattgaagcagcatgtaaagcgtgcgaaaaggatacgtgctgggttgcaaaaggatcggcttcgtcggattgaaagatacaagcaacgccttgcacttcttttgtagaatcggcctgtgactgtataaagctgaaaccataggtgtttgtcttgcaggttttaacttccgtattggaatttgttaagatgttttattgactagcattgtatgttaggaccatctggatgttttattgccaacgttatctaataaaatgtgaaaaagcctttagctaagttggttggatgatctgagtagcactattaaagttttgagtatggtgccactgtgcatgggtgagacaaaggttcgaagttcgaaggttttctcgagctgcatgagaagatcttaaatgtaatgtaggtcttcttaaaggtaatgccgttgaggtggtcttaccatatatgtggattttttttatctagtgaaatgaaactgaaatcatagtcaaaaaaaaaaaaaaaa

SEQ ID NO: 4357 - DNA, 4054 bp, Zea mays
  misc_feature (247)..(247): n is a, c, g, or t
  misc_feature (252)..(252): n is a, c, g, or t
  misc_feature (255)..(255): n is a, c, g, or t
  misc_feature (3560)..(3560): n is a, c, g, or t
gcaagtgcacctcctcatgatgaagtggaggaacactccagcaacaaggatgtatctacaacaagcttgacatcactcctagctgagatagggtctaagaagtggtctagctttgaaatagaatggagagaagaagggaagaaagacgaaagagaagagaagaaagacaggagagaaaagaagaaaataaaaaaagaaaataagaaagaaggagaagagaagcagaaagagaataagagaagaaacnttatnctnctatattataaggctatatccaacagtttatccatcatcatacccatattcaaactacactctacgaacagtgcaatttaaagtgtaaaacagtgcaaaacagtgtttttaggtgaccatatggggtaaactgctggacattgtctaatggtggtaggatgtttaagtgttatatatatatatatatatatatatatatgacttacagttggatcatgatctaaaggtccatgaggtttccttgatgcttgcacttaagtcttggttacataacaatcgtttttgacactagtagctaccaaattctaagatcttgtttgacattttttcagaaatatttgaggtttatctcaaaatacactgtccaagggaactttttttaaaaaattgaataatggcacttggtagaaaagaacacctaattttgcaacatgtagtcatgtacaccattttttatattagcattaaatgttatttcagaatttatacatgtattactaaataataaattcacttcatattcttgtaccattgtgaaaactactttctattactgtgttttaatctctgagttggaataacacttttgcactcataaaatggtttgcaaaaagaaccatgtctagatggtagtagtcgtctttggggatttatgatggtggttgcacagtggcggtgaaatataaaaaatataacaggtgataaataaattattaaataggaaaaagttaaatgaatttaaaaagtctagaatttattatataaaattatttattaactttttaaatttctaaaaaaataatcaaattaacttgaattataaaaaatccataataaccctggtgtaatgtaacatatgaacttataatatacctgtaacaataacttgataccgctgccataaagccaaataaataaatcaattgaaacgacattccctaaatatccagaggcaaaaggaatcacaccgcacccgcagacagccagatacacatcagtgtcagcggaccacaacatcacgaccccacctgtcagcgggacaagtagagatacccgcactacaaaaggtccgcacccccaggcggggaagcaaagaaaacccaacgcaaaagcaacaaacaactcccaaggtccaaagcccacccgtactcatccgagatccccaaccatggccgtcggcgacgtggagacggcggcgccgctgctgcccccgccggcgtctgccctggcggacgagccctccgcgggcccgcccccagacgaccggctcggcatcggctacctcatcttcttcaccctgggcgccggcttcctgctcccctggaacgcgttcatcaccgccgtcgactacttcgacttcctctacccgggggcccccgtcgaccgcgtgttctccatatcctacatggtctccgccttactgcccctgctcgtcatcgtgctcttcttccccaagtccagcgcccccatccgcatcaacacggggctcactctcttcacgctcacgctcgtgctcgtgcccgcaatggacctcatctacgtcaaggggagggccgggctgtacggagcgttcgatgtgactgtcgccgccacggctctgtgcggggtcgccgacgcgctcgtgcagggaggcgtcatcggcttcgcgggggagctgcccgaacggtacatgcaggccgtcgtcgccggaaccgccgcctcaggtgtgcagtgttctctctctctcttaatttctctccccccccccttctgatctctcttctaatactccccatcgaagttacccacctcttcaattcttcctcaaaatcaccttcattttgaggaattggcaactgtagctacctggtttctgaattgttccttcacgatttctctcatcctgcttctagtcaaaatggtcaacctggccggcagtcgccagtaggtgtcgtcagaacatgaagcacagaatgtgtgttggagtggacttatcgtggttgttcaattgcttataattacggtggttgtgtgtatttggctaagtaatactcctatgtattggggattgggaattgaattgggggaaaaagaaaaatgagggcacgaaattgcagagcttataagaaagattacaatgcagctggtggctgtggtttctgtttgcaatttctcagtgcgtatgatgtttcaaggattgagttggtcggcagacagattctaacacctggtagtacacatttctgcatggacttcattctgcaggagtgcttgtctcggcactgagagtcttcaccaaggcactggtacccacaggacgcgaacgggctaaggcaaagcgcgatcctctacttcgtggccggcatagtcctcatggtcatctgcatcgtgtgctacaacgtggcggacaggctcccggtcgtgatatactacaagaacatgaagaagagggcgcagaaagcggaggtcggcggcggcatgacgggccccgcgtggaggtcgacgctgtggagcatcgtcgggaccgtgaagtggtacgggatcggagtggcgctcatctacgccgtcacgctctccatcttcccagggtacatcacggaggacgtgcactccgaggcgctcggggactggtaccccatcatcctcatcaccgcctacaacgtgttcgacctcgtcggcaaggccctgcccgctgtctacctcctccagaatggcagcgccgccatcgcggggtcctttgcgaggctcctgttctacccgctcttctacggctgcctgcacgggccgagctttttccgcaccgagatccccgtcaccgtgctgacgtgcctcctggggctcactaacgggtacctgacctccgtcctcatgatcctcgcgcccaaggctgtgcccatccaccactcggagactgccgggatcgtcatcgtgctgttcctcgttgttggccttgtcattggttccattgtggcttggttctgggtcatctgataccggggtacgttctctgtcacgtcgatgtatcatagcaccatgctcgtgttcttttgtgttcgatttgccacgcaatgacaacttgttagtgtatactgtaacccaggtgaaaagatttccgaaatgtgtaatttgcaactcttggaattggatttgaaggtgacctaatgtcaatgtgaagaatctcggctccttatcaaactcttcccatttcctcgttactgcaacatcgtacctgttgctcaactgtctatcgattcgggtgttgctaggttttatggaaaatttcaccgtcatcagtttcgtaaccctatacagcaagggcagctcangatctgtccatctgacgttctggggaagcctagtttttttcagcctaggtcggctataattcaacggatgttccgcgtgaggcgtcgcagtccggtgtaccagctgcgtaacggctagtggacatgtcagcgctgaccaatagtcgataggcacattggacagtttggtgcccccagaagcggaaaccagccaatcaggggattctttgctacgttttatgcgcgtactgttcactgtcgggtgcacatcggacagtccggtgcgtccacggacagaagacaataatggtcttccaaatagagctccaacggctcctagctgcactggggctataaaagggacccctaagcgcatggagcagaatactaagcctccattgaatcctaagacgtatagactccgcaagcacgcattcgattcattgtgtttgagatttgagcacttgtttaagctgtgaacttgctgcgatgtgttgtgtgctcggttctagact

SEQ ID NO: 4358 - DNA, 1596 bp, Zea mays
  misc_feature (1585)..(1587): n is a, c, g, or t
gcatcgggcccggcgggccggccgggaaagaaaacccaacgcaaaagcaacaaacaactcccaaggtccaaagcccacccgtactcatccgagatccccaaccatggccgtcggcgacgtggagacggcggcgccgctgctgcccccgccggcgtctgccctggcggacgagccctccgcgggcccgcccccagacgaccggctcggcatcggctacctcatcttcttcaccctgggcgccggcttcctgctcccctggaacgcgttcatcaccgccgtcgactacttcgacttcctctacccgggggcccccgtcgaccgcgtgttctccatatcctacatggtctccgccttactgcccctgctcgtcatcgtgctcttcttccccaagtccagcgcccccatccgcatcaacacggggctcactctcttcacgctcacgctcgtgctcgtgcccgcaatggacctcatctacgtcaaggggagggccgggctgtacggagcgttcgatgtgactgtcgccgccacggctctgtgcggggtcgccgacgcgctcgtgcagggaggcgtcatcggcttcgcgggggagctgcccgaacggtacatgcaggccgtcgtcgccggaaccgccgcctcaggagtgcttgtctcggcactgagagtcttcaccaaggcactgtacccacaggacgcgaacgggctaaggcaaagcgcgatcctctacttcgtggccggcatagtcctcatggtcatctgcatcgtgtgctacaacgtggcggacaggctcccggtcgtgatatactacaagaacatgaagaagagggcgcagaaagcggaggtcggcggcggcatgacgggccccgcgtggaggtcgacgctgtggagcatcgtcgggaccgtgaagtggtacgggatcggagtggcgctcatctacgccgtcacgctctccatcttcccagggtacatcacggaggacgtgcactccgaggcgctcggggactggtaccccatcatcctcatcaccgcctacaacgtgttcgacctcgtcggcaaggccctgcccgctgtctacctcctccagaatggcagcgccgccatcgcggggtcctttgcgaggctcctgttctacccgctcttctacggctgcctgcacgggccgagctttttccgcaccgagatccccgtcaccgtgctgacgtgcctcctggggctcactaacgggtacctgacctccgtcctcatgatcctcgcgcccaaggctgttcccatccaccactcggagactgccgggatcgtcatcgtgctgttcctcgttgttggccttgtcattggttccattgtggcttggttctgggtcatctgataccggggtacgttctctgtcacgtcgatgtatcatagcaccatgctcgtgttcttttgtgttcgatttgccacgcaatgacaacttgttagtgtatactgtaacccaggtgaaaagatttccgaaatgtgtaatttgcaactcttggaattggatttgaaggtgacctaatgtcaatgtgaagaatctcggctccttagcggccctcgacctcctttgaannnaaaaaaaaa

SEQ ID NO: 4359 - DNA, 1284 bp, Zea mays
cctccagttccaacttttctgtgttcatcttccacctggctcgtgtccttccacaggatggattctggcttgtaatttcaggagatggtgaccatgggagggaattggagctaattgacgatggcaagaatgaagaaatgcctctgtcagttcttcaggtaaatgctatgagaaagttggggtcggtggaagaggtgcctgtcccgctcttcccgtccaagggtcttcggttgaagcaaaagattaaggactggttggaagggttccagaggctcccttatgtatctccatatgagaatttcagccacatcaatccgggtagtgatgtttcagagaagcgggcagtcggggtgctccatgagctgcttagtctgtttgtgacatgctctgctgagaggcgacggttacgctgcctccggcagcacctagggctgccacagaagtttcatcttgtgttcgagcggcaccctcatgtgttctacttattgttaaaggagaagacatgctttgttgtcctcaaagaggcctacatagctggagaagacactgcaattgaggcgcaccccatgttggaagtgttcaagaagtatgttgagttgatggagcagtcacgggaaatcataagatgtcgacggagcgggaagcctattgaactagagtccaaggcatgcggggatagctgagaagaaggatgggaatacatgtgcaaatatgacctctataacaagaatgtggatatgtactcttggtaggagctagtttatttctcattatttgtagagaaatatttctcattatttgtagagaaatacatcaagtgctgaaacaggttggtgactatgatatttaatctgcattcttaaaaaaaaaaaaaaaaattaaaaaataaaaaaaaaaaaaaaagctatcgatacggccaacctcaagggggggcccgaacccaattcgcccaataggaaccgaattacgcgggctcttgcccggctttttaaacggtcggatgggaaaaccttggggtaaccaatttaatcccttgggaaaaatcccctttccccatgtggggaaaaagaaaaggcccccccaaatcccccttcccaaggggggccccccaagaggggaaggaaatttaacggggaaaatttttggaaaaatccggggaaattttttgaaaaaccccctttttttttaccccaaggggggaaaagggggaaaaaccccttttttttttcaaaaaaacccccccaaaagggggggggggggtgtccccctttgttagaaaaaaca

SEQ ID NO: 4360 - DNA, 799 bp, Zea mays
aggccggccgggcccggtttccctccccgtcgcccccgctcccggaagcttcaagaaggtggacggtcggagggacgggctacatgggtggctgcttctggtagcttcggtcgcccgccgcgccgccgccaggtgagtggaaggtagggggaagcaaggaaccagagggtgggatgtggatgtagaggattggatgctataatggcgcaagctgctgtcgagcccgctctgaatggtggctctttgattgggaggcagccggtggttccaaggatgaagaggaagacaccgtctgaactgaggggtgagcaactgaagcggcgtacctctgaaaagcttggagatgatctgttaccttctgccacattggataggtcaaacaatggactttcggaacacagagcaacaaaagatttccaagtacatcaacacacgtgttacagaggtgttccctgtgagaaaagcaagaaaccttgggaaggaaaattccaaggatgtcttacagaataatgagaaggtttctaagtttgttaatggtacaccagcctcaaattttgcatcatcttcacttctatgtgggcatggcgacactgctaagttggaccctttagctcccaaccatgggaggctgcacacccaggtttcaagaaagttgagaaatgcagtgaaaatgctctgcggagtgtatctgagcttcatgtaggcgatgagaagcagactggttctaacaaatttgatatggaaaaggtactgaaaaggttttggagctcgtgatgcttttgtggcttctgggctcaat

SEQ ID NO: 4361 - DNA, 2528 bp, Zea mays
cctctcctgccgcgccgactaagacaacaccgacgtgcttgcgccggcccgtgcgccacctccccgtcctcaacttcatatcggatcagatcatatggcgcctccatctcccagttgctagtgccccgcgcgctcggcctcggccgcggcgtgttctacgaggcgttcggcaccgctatcgagatctccttcgcgcgcatgctccacctgaccgccgtcgtctggaatgcaacacggctcgctggcatcggaagtgagaggcggctccgtgaggccatccgcatcgtcggtggcgaagcaacggttcttgcggacatcgtcgtcatcttcgtgctcgccgagaaggactccacatcctccgcgctcacatggttcttctagctcctcgccgcctccactccctcgttccgcaggtgccgctgccagggaatgacggagcgttcacgctcacgaacaggtagagcgactgagcgggacgtagaaccgcgatggggaggcacgacgcgacgaagctgtgcaggagctgcgccgaggacgaagctgcgagtcaaaggcttggactggcagcgttaatagttgtctacgacggtaaacgtgggaaagatagaaaaaaaaccaaagatcagactgttatagtacaaggattccaattgcaaggtttggcatactaattttacgaagcccgttaatcgcgataccagcaatcaaaaaagctacacaaccccacccttcttcttcctctgccatcgcagcctccgtccaaagattttggaaacccacacccaaacccgtaccatgcagtcccttgcgaaatctcggtcgctcgagtctctccttcccctcgccgtccacctccagtccatggcatacgtgaacgtacgtgatgatacggtggaaggactcatcgtttgatgccatccccgagatctcccacgcgcgtgatatccgcccgctcgtctccctcgcacgcatcctgtccccatcgcccacccctgtatcagcggtctccaagctcgaccccttgctcgagaccccagaccgctgggtcaccgctttcctccgtcgcttctccgccgccttcgtcgagtccgtggggcagcacaacatcccctggttccggctctctgatgccgccacccaactcctacaagaggagtggtccgtcttcgccgcccgccgtgccggcgcgtcgtcttgatgacctcacgacaccacctcccgctccgcatcacgcagggcatgctctagcatcttggcattccggagagctacttaaaggacctggatcatgacattgcacgagatggattcaggattgtaatttcaggagatggtgaccatggaagggaattggagctaattgacgatggcaagaatgaagaaatgcctctgtcagttctccacgtgaatgctatgagaaagttgggatcggtggaagaggtgtctgtcccgctcttcccgtccaagtgtctttggttgaagcaaaagattaaggactggttggaagggttctagaggctcccttatgtatgatgtatctccatatgagaatttcagccacatcaatccgggtagtgatgtttcagagaagcgggcagtcggggtgctccatgagctgcttagtctgtttgtgacatgctctgctgagaggcgacggttacgctgcctccggcagcacctagggctgccacagaagtttcatcttgtgttcgagcggcaccctcatgtgttctacttattgttaaaggagaagacatgctttgttgtcctcaaagaggcctacatagctggagaagacactgcaattgaggcgcaccccatgttggaagtgttcaagaagtatgttgagttgatggagcagtcacgggaaatcataagatgtcgacggagcgggaagcctattgaactagagtccaaggcatgcggggatagctgagaagaaggatggggatacatgtgcaaatatgacctctataacaagaatgtggatatgtactcttggtaggagctagtttatttctcattatttgtagagaaatatttctcattatttgtagagaaatacatcaagtgctgaaacaggttggtgactatgatatttaatctgcattcttaaaaaaaaaaaaaaaaaaataaaaaataaaaaaaaaaaaaaaagctttttcattccgccaacctccaaggggggccccggaacccattccgccattaaaggagccgatttacgcgggtcctgggccggccttttaaaggctcgggattgggaaaccccggggggtacccaatttaagcccctggggagaaatccccctttccccagtggggaaaaaaaaaaaggggcccacccctacccccttccccaatgttgcccccctcagaggggaaggggaaatttgaagcgcaaaattttttggaaaaacccccggaaaaattttttgaaaacccccctcttttttttaaccacaaggggcgaaaaggggaaaacccccctttttttttccaaaaaaaaccccccgcggggggggggg

SEQ ID NO: 4362 - DNA, 1669 bp, Zea mays
tggaattcgcggccgcgtcgacagtttgtcgactcgactggcattgctgaacgaggcaaatgcgccttcatctcctcaacgccgcacacatgtttggtttcgtcactgatttggcgtaagcgtgattgtgttatgtaaagtggattcagatccaatgcgcgcaacattccatgacactgccctcaggaatccaattgtaaggttcgtcatactaattttacgaagcccgttaatcgcgttaccagcaatccaaaaagctccacaaccccacccttcttcttcctccgccatcgttgcctccgttcaaaagatttcagaaacccacacccacctaaacccatgcagtcccttgcgaaatctcggtcgctcgagtccgtccttcccctcgccgtccacctccagtccatggcgtacgtgaatgtgacgatgcggtggaagaaggactcatcgtttgatgccatccccgagatctcccacgcgcgcgacatccgcccgctcgtctccctcgcacacatcctgtccccatcgcccacccctgtatctgcggtctccaagctcggccccttgctcgagatcccagaccgccgggtcaccgctttcctccgccgcttccccgccgccttcgtcgagtctgtggggcagcacaacatcccctggttccgtctctctgatgccgccacccgactcctgcgggaggagcgggccgtcttcgccgcccgccgtgccgatgtctgtgctcgcctgcgccgcatcgtcttgatgaccccgcgacgccgcctcccgctccacatcgcgcagggcatgctctggcatcttggcattccagagaactacttaaaggacctggatcatgacattgcacaggatggattcaggattgtaatttcaggagatggtgaccatgggagggaattggagctaattgacgatggcaagaatgaagaaatgcctctgtcagttcttcaggtaaatgctatgagaaagttggggtcggtggaagaggtgcctgtcccgctcttcccgtccaagggtcttcggttgaagcaaaagattaaggactggttggaagggttccagaggctcccttatgtatctccatatgagaatttcagccacatcaatccgggtagtgatgtttcagagaagcgggcagtcggggtgctccatgagctgcttagtctgtttgtgacatgctctgctgagaggcgacggttacgctgcctccggcagcacctagggctgccacagaagtttcatcttgtgttcgagcggcaccctcatgtgttctacttattgttaaaggagaagacatgctttgttgtcctcaaagaggcctacatagctggagaagacactgcaattgaggcgcaccccatgttggaagtgttcaagaagtatgttgagttgatggagcagtcacgggaaatcataagatgtcgacggagcgggaagcctattgaactagagtccaaggcatgcggggatagctgagaagaaggatgggaatacatgtgcaaatatgacctctataacaagaatgtggatatgtactcttggttggacacaatatagttgtcactagttggggggaaatatttctcattatttgtagagaaatacatcaagtgctgaaacaggttggtgactatgatatttaatctgcattctt

SEQ ID NO: 4363 - DNA, 905 bp, Zea mays
cattgggtacctcgaggccggccgggatcctatcatcacctcttcacactcaccaaccatctttttaagcttactaactgcataagatagacattccctggtcggatataataattcttttaatttgcacccttatcttcaaccctcaaacaactctcccaatcatcaagatgcagtccagcttgttcttttacgttcttgtcgcatgcagcggtgtcatggccctccctactagccctccccaactcgaagcccgatctgaggctcatcacaacccagatagttacgaatcttacaatcaagcgagcccctcttactcgccgcctccttcgaccgattaccaaccggcctctccgcacgctaccgccccatcgcctcctcctcgtaccatcccatcgcctcctccacgcgtcgcctctccatcgcccccttcgcccgctacctctccattgcctcttccgcacgctacctctccatcgccccccccgcacgctaacaccccatcgcctccttcgcacgttacccatccgtcgccttctccgcagggtattacaccatcccctcctccgcacgttaataccccatcccctcctctgcacgttaacaccccatcgcctcctccgcacgttaacaccccatcgcctcctccgcgcgtcatcactccatcgcctcctccgcgcaccacaggcccattgccctctttgcaccctactattccgtctgccccaccgcgcggtaccatccaagctgagacgtctcgccccggtggacggggcggccttgttggtgccacagaagtcggcaccggcggccttcctatcgttggcgtagcaggaggcgttaacgccaatatcggtgccaccgttcccgctgtcgctgttggccacttgggcgttggtgctggt

SEQ ID NO: 4364 - DNA, 697 bp, Zea mays
gggtacctcgcccacgcccccgaccaccaggcaccagcatagatctcgttctcgccactattattctgcacagcaacgcatcaagccttctagaaccatctcgccgccgccacaccacaacccgtcgaagcgaagcaagcaatggccggagtcggatcgaaggccctcgccgttgccgccgttctggcggccgtctccctctcggtggccgccgcggccgaggcgccggcgcccagccccgtctccgccgccgtcgcggcgtcgtcgcccttcgccgcggccctcgtcgcctccgccgccgccttcctcttcgccgccgtccgccactgagccgatggggcctcgtgcctgcaggctacctagcagtacttccgccgctgctgccgccgccgcctagatctatttattggagtgctatccagtagtactagtagtagtgagatttcttcggtgctgtcgtgtcgtcgtcgcattttggtcggatctggtttccttggtgcagggagggtttctataccatgtcgtggtgtcggttgtgtgatctcatcccccccttgtagatagtactctgctatctcgtcgtgatcgtgagtggtgattctgtctggttgctatttgctactgatattggtcccatttgagatacgcgttgctgctaaagcggccaaaaaaaaaaaaaataaaaaaaaaaaaaaaa

SEQ ID NO: 4365 - DNA, 1175 bp, Zea mays
gggatcccagcagcaggtcgcagcagcgcatgactttgtatctgcaactcgtttcgactagcctgcacgccgggagcccgcccttctccacctccgaagatcctgcgagttcaacccgcgagtgagcatgtcgtcctactccccgccgccgccgctgccgccgcgggaccagtccatggacaccgaggcacccaacgcgcccatcaccagggagcggaggctcaaccccgatctgcaggagcagctccccaagccatatctcgcgagagctctcgaggcggtggacccgagccacccgcaggggaccaaggggcgcgacccccgcggcatgagcgtgcttcagcagcacgccgccttcttcgaccgcaatggcgacggcgtcatctacccctgggagacgtttcaaggactgcgagcgataggatgtggactcactgtatcattcgcgttctccatactgatcaacctcttcctcagttatcccactcagccgggatggttaccttctcctttgctgtccatccgtatagacaacatccacaagggtaagcacgggagtgattctgaaacttacgacactgaagggaggtttgatccatcaaagttcgatgctatattcagtaagtacggtcgaacccatcctaatgctctaacaaaagacgagttgagctcaatgcttcaaggaaaccgcaatacgtacgatttccttggctggttggccgctgccggtgaatggctcttactctacagcttggcgaaagacaaggatggcctcttgcagcgcgaaactgtccgtggtctatttgatgggagcctatttgagcgactggaagacgacaacaacaagaagaaatcgtcctgaatgctgagcagccttgtacagctcagggaagcgctgtcagtacaaaactaccagatataccattggtcgtgttcaaataacaaatgcttcggctttgttcatccgtcattaactatgagtgctgggatttgtttgtatgtgtgtcgtgctaccagtttcttctcctgtcgtctcacacaggtactgaattacgcatgtgttttctagtgtccgtgcggaagctgtattataagctgaaaatgtgcgtttgaaatttatggccaaaactgtcttcttggtcttgaaatgtgaaatctgggtttccttctttaac

SEQ ID NO: 4366 - DNA, 785 bp, Zea mays
cccggacgcgtgggagcatagatctcgtgctcgccactattattctgcacagcaacgcatcaagccttctagaaccatctcgccgccgccacaccacaacccgtcgaagcgaagcaagcaatggccggagtcggatcgaaggccctcgccgttgccgccgttctggcggccgtctccctctcggtggccgccgcggccgaggcgcccgcgcccagccccgtctccgccgccgtcgcggcgtcgtcgcccttcgccgcggccctcgtcgcctccgccgccgccttcctcttcgccgccgtccgccactgagccgatggggcctcgtgcctgcaggctacctagcagtacttcccccgccgccgccgccgccgcctagatctatttattggagtgctatccagtagtactagtagtagtgagatttgttcggtgctgtcgtgtcgtcgtcgcattttggtcggatctggtttccttggtgcagggagggtttctataccatgtcgcggtgtcggttgtgtgatctcatcccccccttgtagatagtactctgctatctcgtcgtgatcgtgagtggtgattctgtctggttgatatttgctactgatattggtcccatttgagatatgcgttgctgctagtctcgtctttctctgcgcttgatttatcgttatacatcgctccatcgctcgctgcgaatttcgcgtcgctgtctgtgacgcgttagatttgattctactagggatccgcgtcgcgttgcatcgacgcaggtccgtttccgttcttct

SEQ ID NO: 4367 - DNA, 771 bp, Zea mays
ggattttaaaaaaaaaaaaaaaaaaaaacattggcaacctcgaggccggccgggaccaggcaccagcatagatctcgtgctcgccactattattctgcacagcaacgcatcagccttctggaaccatctcgccgccgccacaccacaatccacaacccgtcgaagcgaagcaagcaatggccggagtcggatcgaaggccctcgccgttgccgccgttctggcggccgtctccttctcggtggccgccgcggccgaggcgcccgcgcccagccccgtctccgccgccgtcgcggcgtcgtcgcccttcgccgcggctctcgtcgcctccgccgccgccttcctcttcgccgccgtccgccactgagccgatggggcctcgtgcctgcaggctacctagcagtacttcccccgccgccgccgccgccgcctagatctatttattggagtgctatccagtagtactagtagtagtgagatttgttcggtgctgtcgtgtcgtcgtcgcattttggtcggatctggtttccttggtgcagggagggtttctataccatgtcgcggtgtcggttgtgtgatctcatcccccccttgtagatagtactctgctatctcgtcgtgatcgtgagtggtgattctgtctggttgatatttgctactgatattggtcccatttgagataaaaaaaaaaaaaaaagcagcccctatctacgccccctttatcgttatacatcgctcgctgagaatttcgggtcgctgtctgttacgtgtta

SEQ ID NO: 4368 - DNA, 3953 bp, Zea mays
ttggtagggatatagagtacgaggatatagatatgaaatagaggttatggactcaacagagatgtgtacaaatatcctcctaatgctgatgtataagagaggtcgtcgaataagacctatgccacaccgacaaggtgtcatagtgattagtgattgattgttgagcaagtcagtaaaacttttaaagtttagactccagatatgattccatataagaaaaaagaataaaagactataatctaaataaatacaagggaattgaagagtgtgggggtgtggatgaacccaaataaccctctctatttatagggcggattttattttttaaaacttcaaactgtccattggaaccaaactgcacaaaacgtactgagcaaaggcggcacaagacctggaacgggaaacggacgatgagcgtgcagcagcagcacaaccccgttcccgaacaagaaaaaccagctccgtgcaggctccttcactcgcgccacccaccctggcgcctgtaggactcgtcctgcttctgctgcgcacgagaccattacctagaacatcctaaaaaaaaaaaggaaagagagaacgcaaaccaccactccgcagtgcccaaggacggtcaccggtgccggtacattcactagccacccctgctctcccgatcagtattcaggagcgcgccatcatccgccatggaccacctcctcgaccatcgcctcggcgcgcctctcgtcgtcatcttctcctgcctggcgctcattcttgccgggtgcatcagcgcgcacgcagccccgcgcccggtcttcgcgttcccggcagccgccgccaaggcgcaggcaatggcgcgccacgagcgcctgagcgtcgcgctcgatgccgccgccacgcgcgtgggcaaggcgctcggcgcgctggccgccgccacgccggcctcctcgtcgccgctggccgcggccgcccggaaggactgcgcggagctgctggacgaggccctccagctcctggccggcgcgggggcgcccggagcggcccgccgcgacgcgctcacgtggctgtccgccgcgctcaccaaccacgacacctgcgccgatagcctcgccgaggccggggcgcccctccacgcgcacctcgccgccgctcgcggcgtggtccgtgacagcctcgccatgtacgcgtccaccgccgcggaggccgcaaccgccaccacaacaactggggccggcggcgcgggcggcctcgtcatgggcgaggaacgcagcggcaagaacgagacgaaacggcggggcccgtgcggtttcccgcggcggcagccggcgagggaccggcgcctgctgctagcccccgcggcggcgctggctgcgagcgccgacattgtggtcgccaaggacggcacggggacacacgccaccatcgccgacgccgtgaaggcggcgcccgagtgcagcgagcgccggacggtaatacacgtcaaggaggggcggtatgacgagaacgtcaaggtggggatgaagaagaccaacctgctgttcgtcggggacggcaagggcatcacagtggtcgccggcaaccgcagcgtcgctgacaactataccaccttccggaccgccacctttggtacgtgagtgacgcaaccattcttctccacggagcactagtgattccaagatcgagcttttacaatcatttgcactgattttttttccaacggaatcgaaaagcttagagcatccttcaaagcagaataatttgtagccaagtaggtttcgtgaagttcgtaaccgttcttaaatggatcatttggaagtgaagtgccattaagtgatctaccaagtaaattaaatttcatgaacatggaaaagtaatgcccatactgtgtttggggacgacttggtacagcgggccgggggtattgtagattagcggcctttaactgatgcgcgttaccgatggcccggtgaggtggggtgcccggcacttggctgctgcatgctgcgacgatgtcacgtcgccctcgctggctcgccctgcaattctgccacgcatgcctttacatgtcattgtcacggccttttccatttgtcttggtacatatagtacaacacgcttacacgcatgaatgttggactcggacctgttgctgcgtgcagccgcgtccgggtttgggttcatgatgcgcgacatgacggtggagaactgggcggggccggcggggcaccaggcggtggcgctgcgcgtgagcgccgaccgcgccgtcgtccaccgctgcagcatcgccgggtaccaggacacgctgtacgcgcattctaaccgccagttctaccgcgactgcgacatctacggcaccgtggacttcgtcttcggcaatgccgccgccgtgctccagcgctgcaacctctgggcgcgcgtgccgctgccgggccagaagaacaccgtcaccgcgcagagccggaacgattcgtgccagcgcaccggcatcgtcctccacgcctgccgcctcgtggcggccgcgccggcagaaggcctctcgcccgcggcggccccggcgcccgtcccggaccgttcgccgctgctcctctccccgacgacgtacctgggccggccatggaagtccttctccagggtggtggtgatgatgtcgtacatcggcccgcacgtgccgccgcagggatggatggagtggaacgccaccagcacctacgcactcgacaggctttacttcggcgagtacatgaactacgggcccggcgctgggttggccgggcgtgttgcgtggcctggccaccgcgtcatcaacagcaccgcggaagcggagagcttcacggtggcgcggttcatcgacggcgcgtcctggctgccggccgccggggtctccttcgttgccgggctctcgctgctgtaatcgtcttgatggaaatcccagggcacaccagggaccaggcaggctgagtgacaagtagacgtgataatgtacttttagtggcggcagttcgaatcaattcaaatcattttgctgtgagatttcagataacaaatttgcagcacaaactgacttgattgcttcttgatcgagctccctgctgtatctgcttcagcctccataaacttggcaaaatgcacttaccatctccaatttctcccacatttctagtacgtcgttcacaagaaatcgatagactcagactccgcgcgcttctcgctgcgcactacgggcggccaagccgacgtacacggtacaccacacagcctgcaggctgcagcccaacatccaagctgttcgtcagagtccaagagaaagttgaaggcaggctgtagtgaaaggctcaaggccaccggtgtatccgaaggccccacagccagctccacctactaaggtcaaccgcaatagtgtcagctcgtccaatgccacatgtgctgacggctcgaaccaactacgcaaggcgcggaaccgaagacagcagggtcaggaggcccaattcctgtacgcgggctctgagtgggccatagggtcaggaggcccaattccgtatacgcgggctctgagtgggctgtgtgacacttgtatgggttatatgcctggtgaatgcctgtgaggcaaagggggaaaacattgctgtaagaaataactaagaatacgcagcttctccgtatcttcacccttctccagcaattcttccgatcagtatctgtggtgctgacaattggtatcagactaccaatcttgggttgcggagtccgggtacttcacacggcgggcgaaaatggcgggcgcagcagatcctggcatcacagcggctttggcggcacagtccaaacagatcgactcccaatcgaagaacatcgccacacaatccaagatcctgcaacaactctgcgagcgagatattcaaggtgtgtgggcatcttctcctgtggagtctgaatttccttcccattgtgtctcgtaagggtgttcctggtcatcc

SEQ ID NO: 4369 - DNA, 1412 bp, Zea mays
cccccccccccaaccccccaaaaaaaaatccggtcgatcctagctcgcgatgttctccggcaccggaccctccggcggggcagcccactctacgtccaccggtggtgggggtggctcgccttccgacaggggcggccccgcgccctcggcctcggcgtcggtctccacgccagccagcgagagcaccgtcgcccgccgcctaaacggacttgacccccacggcgacgacgctccatcgtcgcagccagccacgagcaagaagaaaaagagaggggcacgagcagttggtcctgacaaaaatggccgtggattgcgtcaatttagcatgagagtatgtgagaaagtcgaaagcaaagggagaacaacctacaatgaggtggcagacgaactggttgctgagttttcagatcccaatattaatattgactctccagatcctgataattcgtctgcgcaacaatatgatgagaaaaatatccgaagaagagtttatgatgcgctgaatgtcctaatggctatggaaattatatctaaagataaaaaggaaatacagtggagaggtctgcccaagacaagtatgaatgatattgaagaactgaagacagaggtcaatggactgaaaggtcggattgacaagaaaaatgcatatctgcaggatttacaagatcaatatgcatgtctgcaaaacttggttcggcgaaatgagcagctatatgggtcaggagatgcaccttccggtggagtggccttgccatttatactagttcagacacgtcctcatgcaactgtagaagtggagatatcagaagatatgcagcacgtgcattttgatttcaatagcactccatttgagttgcaggatgattcatttgtactgaaagcaatggcattatctggcgaagaaactgattgtacccaagctcctggtgcgaatggaggcgagtgctcaagtacacggaacaattattggcaccaccaccaacaaccgcagcctccagggccaagagtagttagggtaccaaactcgcctcctattccagggatactaaaagggcgtgtcaagcatgaacactaggcttcaatatgcttagtggtgtcaaatgagctatttactttattgtccccagctagttttacctgtagaaaatgcatgtaaattatgcctgtaggggcagccgcagtctaatttgacttcgctgatggatagttcgatttgtgtcatgatatgccatacgcctagctcacgttaactcctagtattcagttgtttggtcgaggaaaagagtctgtggttaagtgtaattgtgtagtttatcttcaaacagtcggcatatcgtatctatgggacgatttgaggaacagtgttgtcagtacactccaattgatatacaataaaatgcaaatgtttgttt

SEQ ID NO: 4370 - DNA, 904 bp, Zea mays
gccttcatttcttggcacaaccaaccgggggctcggaagaggagaagagccgaccagccgggcatattctctcttcctccctccggtgctctctccagcggtccagccgcagcgccctgaaagagggaggcttccactcttctttctccccgagcacccgccgtacgtctcctgcaccttcttccagtttctcccatttcagtttgtccactccctgtcattcctgccgcctcgacctccccgctctggaaggttcagatttagcctgggtgcgtctgcaggttccggttcatggagagatggagcctgggtgccaaagtggtagctctcgcactcctgctgtctgctgcttctcatggaagagagttgcctgtcaagagtagtgaccgcagttttatctacaatcatactcttgcaaagacgcttgtggaatatgcatcagcggtgtatatgacagatttaaccgctctgtttacgtggacatgctcaagatgcaatgacttgactcaaggattcgagatgagatctctaattgttgatgtggagaactgcttgcaggcatttgttggtgtagatcatagtctgaattcgataattgttgcaatcaggggaactcaagagaacagtgtacagaattggataaaagacttgatatggaagcagcttgatctaagttatccaaacatgccaaatgcaaagctatcacaagtgctgtgcacaaggcaagaaagtcatatggagatatcaatgtcatagtgacaggccactcgatgggaggagcaatggcttctttttggcactcgatctagctatgaagcttggaggtggcagtgtgcaactcatgactttcgggcaacctcgtgttggcaatgcagcattcgcctcatactttgccaaatatgta

SEQ ID NO: 4371 - DNA, 1007 bp, Zea mays
ccggccgggcctttttttctctctgaagagtgggagtgtacccggcggcctggcctaccgccttcatttcttggctccaccaaccgggggctcggaagaggagaagagccgaccagccgggcatattctctcttcctccctccggtgctccctccagcggtccagccgcagcgccctgaaagagggaggcttccactcttctttctccccgagcacccgcccaggttcagatttagcctgggtgcgtctgcagcttccggttcatggagagatggagcctgggtgccaaagtggtagctctcgcactcctgctgtctgctgcttctcatggaagagagttgcctgtcaagagtagtgaccgcagttttatctacaaccatactcttgcaaagacgcttgtggaatatgcatcagcggtgtatatgacagatttaaccgctctgtttacgtggacatgctcaagatgcaatgacttgactcaaggattcgagatgagatctctaattgttgatgtggagaactgcttgcaggcatttgttggtgtagatcatagtctgaattcgataattgttgcaatcaggggaactcaagagaacagtgtacagaattggataaaagacttgatatggaagcagcttgatctaagttatccaaacatgccaaatgcaaaggtgcacagtggatttttctcctcgtataacaatacaattttgcgtctagctatcacaagtgctgtgcacaaggcaagaaagtcatatggagatatcaatgtcatagtgacaggccactcgatgggaggagctatggcttctttttgcgcgctcgatcttgctatgaagcttggaggtggcagtgtgcaactcatgacttttgggcagcctcgtgttggcaatgctgcattcgcctcatacttcgccaaatatgtacccaacacaattcgagtgacacacggtcatgatattgtgccacatttgccaccttatttcttctttctttcccagctgaca

SEQ ID NO: 4372 - DNA, 1977 bp, Zea mays
  misc_feature (1972)..(1972): n is a, c, g, or t
ccacgcgtccggggggctcggaagaggagaagagccgaccagccgggcatattctctcttcctccctccggtgctctctccagcggtccagccgcagcgccctgaaagagggaggcttccactcttctttctccccgagcacccgccgtacgtctcctgcaccttcttccagtttctcccatttcagtttgtccactccctgtcattcctgccgcctcgacctccccgctctggaaggtcaaatccttcgcccctaagcttttatttctgtttgtatttggttctggaatcgttgcctgctggctgctgctgctgcacattacccccgtattctgtgctccggccgtgggattgccctgctcgctttctttcaaaaaagaaaaggaaaaggagcaattgctctgctcgctttcagtttgtgtggttgacgtctctctctgagtctctgtgcttcagcaggttcagatttagcctgggtgcgtctgcaggttccggttcatggagagatggagcctgggtgccaaagtggtagctctcgcactcctgctgtctgctgcttctcatggaagagagttgcctgtcaagagtagtgaccgcagttttatctacaatcatactcttgcaaagacgcttgtggaatatgcatcagcggtgtatatgacagatttaaccgctctgtttacgtggacatgctcaagatgcaatgacttgactcaaggattcgagatgagatctctaattgttgatgtggagaactgcttgcaggcatttgttggtgtagatcatagtctgaattcgataattgttgcaatcaggggaactcaagagaacagtgtacagaattggataaaagacttgatatggaagcagcctgatctaagttatccaaacatgccaaatgcaaaggtgcacagtggatttttctcctcgtataacaatacaattttgcgtctagctatcacaagtgctgtgcacaaggcaagaaagtcatatggagatatcaatgtcatagtgacaggccactcgatgggaggagctatggcttcttttgccgcgcccgctcttgccgcgctcgctcctgcgatgaagcttggaggtggcagtgtgcaactcatgacttttgggcagcctcgtgttggcaatgctgcattcgcctcatacttcgccaaatatgtacccaacacaattcgagtgacacacgggcatgatattgtgccacatttgccaccttatttctcctttcttccccagctgacataccaccatttcccaagagaggtatgggtccaggattctgatggcaacacaactgaacggatttgtgacgacagcggtgaagacccagattgttgcaggtgcatctccatgttcggcttgaggattcaggaccatttcacttacctaggagttgatatggaagcggacgactggagcacctgtagaatcatcacagctcaaagggttcagcagttccgactggagctagcgggcaacatcatgatgaccaagcacgatatcgacgtctccatcgttgaacctagtgtacaaaacagattggagcagttctagataggcggaacattcgttttgtccagattcagagaagcaacagcctcttgttaatgcagtggaaattgttcagagacgaaggcgacccttgttttctctattagttcggtcagaatgggatgttctttcagatcaaggaaataaatcgggagtcatctcttgtaacaaagagaatcagagcatgatgtacataaggaaaaatcataggcacggtttatgctggatatggtagggattgcttctgtgtaaatatatgtatacaatgtaaacttgcaatggctatatttgcagcaacataagcaccaagctaactgaaaaatatcagttaaccgaatgaatgaggcgtatctattttgggcggccgcaaaaaaaaaaaaaaaaaaaaaaaaaaaaaaaaaaaaangggcg

SEQ ID NO: 4373 - DNA, 3171 bp, Zea mays
tgtttattcgccggccggggcggcctacacaacttgactattgtagcatgcaagttgtgtgttaatgatattttgtcaggtatgctaatgctacattcctttttagaggttattccttttttagaggttctgtcttacggtatatgcagtttcatggtaattggtagaacacacaattgtggtttcaattctcgaagctttgcgtgctaattctgcttggttcagggtcaatgggccccgaaaatacgttgtgatcaatatgtataattatgtgagtatgactgtataagtacatggtgccactttagggtcatttggtcaaccatattccaaaataagggattgcagggacaataataactgtactactacaaagcatattactacaaagcatcagtcgtcgtgagtctaaaacttttaaaaaatttcttatattttttaaccaccagatcacatatactttagtgtttaaaaataatcaataattatatttgttgcctaggcgccgttccccagcctcgttgcaatgtagtggtgaaatagctagattaaaataaaaaaaatttatatatggctaggagcctaaaattacaaatagattatgaaatcttttttcgtaacaatataacacacatttagatataaattattgcattttagttgtttccgttgcaacgcacgggcattcacctagggaaacaggagaggaagatgtgacatgagctagaactggaagcgtctagcaaagagtgtatattcaaattacacctgctgctgcgaatgtggaaggcatccaatgaagaaccgcacgtctgctctaggatgccggttgctgtgaccatgagatgaaagagttctatattaatttttggcggcaaacggagcaactgtgctatattttccctcaaagtgaatttgtgcacggcaaatatgggcttgactgggccgtgacaaatggttctctcagtggcatcgttagattcagcttatggacaggtgtatcacgtactgcacgcgcgtgccgtaaaggaccgaagtcagccgaccccgataaaagactcacacggtacgcgcttctcctcctcgcttgccgccgccgccgccgccgcgatggaaaaggagaagctctcgttctccatatcctcctcgaagcagcggccccccaagcctcccgcacgacctgcggccgccgcagacgacgatgacctccgctccgcgcccgctccgggccagcagtacgtcaccgagttcgatccgtcccaaaccctagccgccgcctgcgcggcgcgcgccgtcatcgcgccgctccccaactccggcaacttcctcacccaccgcccacgcaaaccgtcctcgctccccacccctgaggaggaggccgccctcgccgcggaatccggcggctggggccccgccttcgtcctcgacacctcgaccgctcccgaagacccatcatccaaaatcggctacggcctcactcgccgcaacggcgccatcgacgctgctgctgccaaggaaccggagaaggcgccgccaccgtcaccgtcaccgcctcgggccactgatgctgcctccgctgccggcaacctcatgctgcagcggtacaaggaggacatggaaggccttccggagcaccgtggaatggacgagttcaatgagatacccgtggagggatttggcgcggctctccttgctggatacggctggacagaaggtaagggcattggtaggaacaataagatgggggataccaaagttcttgaataccaccgccgtgctggcacacaggggttagggtacaacccctctgaagcagaccctaggaagactcgttctggcgactggattgttggcaagaaggtgtcagagggcgggagtgcgaagagagatcgaggcagtagagataggatggaagagagcgattctagtgcccagaagaagagatataatgaggaaaggtctgagaaggagggccgtgaaaaggtgaggaatggccgtggtagccgagaaggcacaagtaatgcaagtgatactcatagcaatgtacggtggttgcagagccatatcagggttcggattgttagtcagaaactaagcaagaggctgtacttgatgaagggtaaggttgtcgatgtggtggggcctacaaaatgtgacatcatgatggatgatggatcagagttggtgcagggcgtggagcaggatatgcttgaaactgtacttccacggacgaacgggcgggtgcttgtgctttatgggaagcacaagggtttatatgggcacctggtagagaagaattccaaagaagagatcggattggtggaggatgcagatacaaaagatattgtacgtgttagatatgatcagatggcagaatacactggagatccagagttgcttggctactgattaagtttttttgggggaggatatgcttaccgggagccttctgctatgcttggtattatatttttcttctttacaaactgtcaagaattgctgcaatgtaaaaccttgaacaaactggcggttgctatgcatttcttacttgtctttgtaagcttgctacttatttgtcagccctcaagttagtaatcatctaggagtgaccactaatgttggagtggggctcttttgataaacagtggaatgtttctgagtgtaactgtttgtttctttgtacgcgaaagaagctgtagttttgtgttctattaacttcatgtcgaccgatgttattttgttctctcttgcttcctttcttgagttcttataaattgaagagggcttcttgaatgacttagtggaatacttgccatcttgtttttctgaactttgtttattgtcctgtgattgtcactatctataactaatgttcactgaaatgcatcaaaatcatgcatctatattaatttatgctcacatcagaaaattagggattgctttcataatatctcaaacttgtggggagagtaaaggagggaaacaacttaatgtggaaaatggattgacctttaattctcgtattattcaccaaactgttgatattaattcacgtctatatttgataacttcatcgttaattttggtgctcttttttaatattgtgaaacttcctatttggttagatattagtctgtgtggcatgttcatttaccttttgttttcacacaa

SEQ ID NO: 4374 - DNA, 5251 bp, Zea mays
  misc_feature (4197)..(4197): n is a, c, g, or t
  misc_feature (4917)..(4917): n is a, c, g, or t
cttaccatttgtatagtataatattttgatagttgtttaatttttgtgggtacgggtgacccgatgggtgacccatacccacatgggtatgggtatgggggtaaattcatacccgccagtgtatatgggtgacccggtggggttatttttgtgtcgtgggtatgggtatgggagtagtaatacccggtgggtatttacccattgccatccctacactgcacccgtcgcggacgcctagctagctagtactacgtacgtacgtgacgcgtctctggctgctccagtgctcagccagccatatgctcctcgcgtcccgttgccgtcgcagcggggggggcctccacgaccggcgtgcgagctccgaaagaccgaggatagcctagcgcactagtctacacgcgctattctgacgacgacgacgacgcggcacaaagggggcatgcaaagtcaagtcaaccacccagagtaggagtacagagcaaatgtgctggaggagtttccatgcattatgtactaccctaagggcatgtacagcctaagttttttgtttgattttctaagtagaagagacgagtaagaaaccacatcatataaccttgagctcctacaatattaatgcagttaaaaaaagtatttataaaaattcacaaagagcttgtctcttgttttcttttccacttatccctctaaagactccttaaaatacccttaattaaagaaaaaaaatatgtacatctaagatgaaagaccctcttttgtagcccctcacatccatgacttaaaggccccaaaaaacagattaaaatttgtaacttaatcctttaattatttatttttctttaattatatggatcaccaggtgatagatgtgagggccgcaaaagtgtttctttatttttcttccttaattgatggggttgtatatgccctaaagttactgtacttccaattccaatagactccatcaattctgcgctgtccaatcaagtttaaagaaacgtcttgcggttgcggctctgcattctgtctggtctggtgcaccttgcagtagtttaggcggcatggatggtttatgcttcgtttcgtgcgccccacatgcatgcgttgcttatttgcatcgtcctctcctcgtagcggaagtcgtcgcctatacgaacggcgctgtgccagctgagctgagctcagtagtttgattttttttttttccgccactacagcctgtcgtcgacgacgacgccgcccagtgtcaacccaactcccgctaaccgttttgtaaccaatggaggtatatgtgaggattacaatttttttattaggatcatcagttgttacattttttttatcatgatcggttttcacttataccttgcattgcactaccgaaatcaatcgctttgccgagtgcctgaagcactcggcgacgccttaaaaacactcggcaaaggctttgccgagtgtgacactcggcaaagaagtctcggtaaagactgcatcggcaaaagcttctttgccgagtgctttatctcgggcactcggcaaacctcttttccgagtgccagagagcactcgacaaagaaaagcggccgttacggcgccgggtaacggagacggcggctttgccgagtgtccctggtacactcggcaaagaagctgtctttgtcgagtgtcttccaggcagcactcggcaaagcctcggattccggtagtgttgcttcaccaataaaatcactccaccagacaatcaaagtacaaaaaagaaaagaaacgggttaaacttccacttaggtttaccgaagatatataccatcttctggtcttcacttctggcagtacggtatgtactactgcgcgtccctgccacgaaaaaacgaaagctgacaaagaaacatgctgcagttgcattggcctctatattcaaagagcgtcgcagtcactctatactctataccaacgtgcagctgtgagcttgtctctcgctcgctctctataccaacgaattggacccagtcaaacccgcacagttttgcatcccggcactcgaagattcagtgaatcattactactccctccatacgcacagcgcccctataacgtactatatatcgagctgtaaaccggcaagcgagtctgccgcctatataaacatggccgggtcgactacggtttagagccgcgcgcacgcctccagcagatagagaagcttggaatggcgatccaaatggacaagacgtccatcatcgtttgctcggtgatcgggtctctagggttgctgagtgccatcctggggttctcggcagaggggacaaagctcactgtaagcacggcggatctaacagctgtctcttgtctttcctttttctctctcgatcagttagctaatgtcattgatactcaccacgctcgcgctcgcctgcttaaccgatggatcgatgaactccgcgcgctcacgctccacgcatatatatgcagccatataccatactggtgtacggcgacgactgcctctacccgcagaacccggcgatcgggctcgggatctgcgccgccatcttcctggtggtggctcagatcaccttctcggcggtgggcggctgctgcggctgctgcaggtcccgcgccatcccttcggagaccaaaaggatcgtcagcatcgtctgcgccgttttctcatggtcagtagtacatatatactataggttttgcgaacatatatagtattattattatctatgcgaacaaaatgatggaaccggcacacgtacgtgctgcgcgcgcgcgagcaggatagcggcggtgatcgcgttcgcgctgttcatacaaggtgcggcgtggaacgccaacgtggtgcgggtggaacaagcgccctactgcccctacctcaaggacggcgtcttcgccggcgcggccgtgctcgccctcgccgccacagcgctaagcatcacctccttcatcatgcagcggacccagccagctgcggcggcgacggcgacggcgacggcatcggctgtgggcacaccgaacatgccaggagggcagtcgccgtcccccgaggtagtaatgggccagccgctgtttccgtcgggcaaggcgcatcagaacgattaccccgtaaaaccccagggatacgagcacgagcagcagcctcatcaggtgcagcaggtccctcctcctaccgactctcaccacccaccacaaggctacgcacagtccgctgcgccaaaccaccagctccctccgcgcccagccccagcggcagcagccgcagcaccggcggcggtcgcagcggcagccgcagcctcggcaccgagcgtgctgcagccggcgctcgggacggtcgccatgggccagccgctgccgctgcaggtcccgccacagtactgccttcctgtcccggcacctcagatcggaggcgtggacattcctgccgctctcccctctgctgctgctccggcggcagggagcgggtccacgctatcgacggctatccgcaacgaagtagtgagacaagggattagaatggctgcggaggtggtgaaagattccctctttcctgaaaacgggggtagcgttctttccatgatgacggattccgctggaggcgacgctgttcaggttacaaactaattaagtaaggatatgacgatgcgcttattgcttaatgctctgtgcgttataccttgcctttagtttgctgtatgttcttcctcctgtgtatctgtcagtagcttcggcactgtgaagcatgtcctgtgtctgtatacctacttgctgtcgtttgaatcgtcctaaactcgaacttcaagtcacttttttcattgtacctgtgtaatatgtagcttttgcctagtatccatcagaattgtgcagctacactgtttataaaaaaaaaaaaattgtatttatttggaggcgactacatcctctttcatttgccttttagtgttcctagccaaaatattttgccgtcaccgtgttattgatgtctacagaaatgcagctaaacagaacgtgtcgattccaaactaacgtggctcaaatatgaagtcttctatcagtgaccttgggagcaaatcgtgaaaaatgtatctgcttttgatatcctattgtcttacactatctgttcttttttatttatcgtattttagttcacaaataaagtttgtcacaactgaaaataagcacagtgcagtgcagtanaaactagaaaggtgtgtctagcaggcttggcctgtgtgatggttccacaaattgtttggaaatgcttgaggctgcaatggacgatgggccgctggtagtcttctgacttctgaggccgtagcaaacatgagaggcatctgtagtttatttccttttttgccgtaatgcatcatcggattcctcgcaatttaatctggatgcatatgaaatattgtgttgacctgattacgtgccagaattttatgaattataacagttattgtgcattttactatgtgttaatattttaattttaatacaaatatattatattattttgatgggctacatcgtggttctccatgtgtcttctttcgcacgggcacacgggtgagaggcaaatcggttaaaacacgtgaaatttagtgttagaaattggttagagtggagaaatagagggactaaccattatcatgatattgtttgaagagggaaaattatgattggtgtatgttggatctctattcttactagtggtgttgtttagattcaccttagatccacctatctaagagtatatatagattgaattctccccctagcgcatacacccattagctatggctagtagaactaacagtttcaaacacaactcttggaattctaccgctccagcaacataccatagggctatctccagcataccatggaaatagttgtgcaaaacactgttttgcaagntagactgcactgtttacagagtaaagtttggaatatgaagtgagattgacaacaagataagtaagctgctggagatagcctaacacacatcaatgagtagtgaaacaatcccaaacactgggctgccccattgttttgtggttcttatcttacatattatggtatgagatattgacttacacacatcctttattggtgggtaagaatgaatctaactagggatttcacttacacgattggtagcagtttctagtgcaatctattgtgcatgtgcgtaaaaggggtgtttggtttcaggattcactccatcctgaataaggtggcgcatcagtat

SEQ ID NO: 4375 - DNA, 1403 bp, Zea mays
ggcacgagccactccaatcggcgaggcgaggcattctccgcaaacccctccacaccccacgcactcacggtcacgcagaagccagaacccctcgtctcccggcgcctgttccccgcgcgcaccgcggctacacataccctctccccatcccatttcccccagatcccaccaacgcagcgcagggatcgagtagcccaccaccccaccccgcgacgctaaccgacgcaatggcgacgctcaccgttccttcctccgtcccggccgtcgccgaggactgcgagcagctccacaaggctttcgaaggttggggcaccaacgagaagctgatcatctccatcctggcccaccgcaacgccgcgcagcgccgcgcgatccgccgcggctacgccgaggcgtacgggaaggagctgctccgcgctctcggcgacgagatccacggcaagttcgagagggcggtgatcctgtggacgctggaccccgcggagagggacgcggtgctggcgaacgaggaggcgaagaagagccaccccggcggccgcgcgctggtggagatcgcgtgcgcgcgcacgcccgcgcagctctttgcggtcaagcaggcgtaccatgaccggtttaagcgatcgctcgaggaggacgttgccgcgcatgtcaccggcgacttccgaaagcttttagtgcctcttgttagtgcgtaccgctatgatggcccagaggtgaacacatctttggctcattctgaagccaaaatacttcatgagaagatccataagaaggcttacagtgatgaggagatcattagaattctcaccacacggagcaaagctcagctacttgcaacattcaatagctacaaggatcagttcactcatgcaatcaacaaggatctgaaagctgaccccaaggatgagtttctttcaacactgcgggcgatcatccggtgcttcacctgccctgacagatacttcgagaaagtcattcgactggctcttggaggcatgggcactgatgaggatgacctcaccagggtcgtaactactcgcgccgaggtcgacctgaagctgataaaggaggcttatcagaagagaaacagtgtgccgctggagcgtgctgtggccaaagatacaactagagattatgaggatattatgcttgccctccttggggcggagtgaggaggcgtgcctcaactcgatctcatctgctcctacttgtttgatggggccaaaaaactgcatcgacgtggtatccacatggccgtggttttgaataataataaatttgtaacacgtagcctgcattagcagcgcgttttaaataaaggaacttcctgatatacttgttatcgtttgactgcgttttcacagaagctgttttgttcgttatggttatccttaaaaaaaaaa

SEQ ID NO: 4376 - DNA, 1357 bp, Zea mays
atgactacgccaagcgcgcaattaaccctcactaaagggaacaaaagctggagctccaccgcggtggcggccgctctagaactagtggatcccccgggctgcaggaattcgcacgagaccattacctagaacatcctaatcgaaaagattaaatccagcgaaggttcaccttcttcaacttgaactccttgtggtccggactgacgaattggggactgagattcacatcaacgcagatgtggaccccacgaccgagtcgtcgcgtcgtctcctccgctcccgacactctcctgctctgcctcctcctgcttgccggcgccgccgacgccgcgccgctgctcgtaggcgtttctcccaaagatgaggcgtacttcgcgacgcaggtgatcgcctgcagagacggatcgggctctttcccgaggagccggctcaacgacgggtactgcgactgcggcgatggaaccgatgagccaggcacttcagcttgtccagaaggcaagttttactgcagaaatatcggagatacccctcgattgttgttctcttcgtttgtgaatgacaaaatttgcgattgttgtgatggaagtgatgagtacgaaagtggtatccattgccagaacacctgtagaaatataaaggatactgctgaggctgatggtggtggtggcgacctcgcagtaacacatttagatgctactgatgattttatgagtaaacatgcaattgctatggaagaccatatccagaacaacagcaacagagaccttgtccagaagataagaggattgagaacagccctagttattgagctgggccttgttgtatgtatttttgctttttgcattgctcggcgtcgcactagaacacgcaggagacaacatattttgaaacgttagctgaacagtagtaatatacaaagacgatagatcggtgctcatttgcaaacattaaagcttccggagatggtggagaatcagagatgggatgaaggagcctgcacgtcatcctctttaaatcacgaggtccatctgctgttctgaactttgtagggtaggaaaattaagtatgtactccctctagtcgcagaaacttgtcatttaggacagatatggtcaaacctttaaaagtgcaagtatttacattatttactttggaaccatgtaggtctaatgtcgatctgcattcgagattcatgcaaaatctcttatatcggaagggttttaagaatatattctagaatagtggtaaaaacatgcactgaagatcgtgcaaaatcaaatgtgtcaagttgtgaccagatggaaggtagtacatgtttaacataaataacttaattgttgtaactgatttgtggccc

SEQ ID NO: 4377 - DNA, 2292 bp, Zea mays
  misc_feature (2276)..(2276): n is a, c, g, or t
cctcgagccggccgggccgagacgtgttgggtgggcggtggcacgtgaggctgccgctaggaaactccggcctccgggttctctgttctccctttccttccgactttcccactgccgtgacgattttcacagcgaattctccggccggcgccgccccgtccgtccgtccgttcttccgataccgaactcgccagtcgccacagcgatctctctcgctcgctccgccgacgcagcgctcggcttcagctcgagaggaggaaatggccagcagcggctacgaagggatcctcctggggatggggaaccccctcctcgacatctccgctgtcgtcgacgagggcttcctcgccaagtatgatgtgaaaccgggcaatgtcattcttgctgaggacaagcatttgccaatgtaagtctcgttgcccctttagctccccttgcagtttgaaatgttggtcatcgatactagcttgtcctgaacggagaatgggaaacaaattcttgatgttgtcacattaagcacccatgagacggggagaaacgtagtggactcgtaatttttatggccaggtatgacgaattggctagcaagagcaatgttgaatacattgctggaggagccactcaaaactctatcagggttgcccaatggatgcttcaaattcctggtgcatcaagttacataggttgcatcgggaaggataagtttggtgaggagatgaaaaaaaatgcacaagctgctggtattaatgcccattatcatgaggatgataatgctccaacgggcacatgtgctgtttgtgttgttggtggagaaaggtcacttattgctaacttgtctgcggcaaactgctataagtctgaacatctgaagaaacctgagaattgggcacttgttgagaaggcaaaatatatttacattgctggatttttccttacggtatccccggattctattcaacttgttgctgagcatgccgctgcaactaacaaggtgtttatgatgaacctttccgctccctttatctgcgaggttttccgtgatgcccaagagaaagctcttccgtacgtggattacatctttggaaatgaaactgaggcgaggacctttgctaaagttcgaggttgggagattgagaatgttgaggagatcgctttgaagatctcccaattaccgaaggcttcaggaacacacaagaggattactgttatcactcaaggttgcgatccggtagttgtggctgatgatggaaaggtgaaaactttccctgtgatcctcttgcctaaggagaagcttgttgacaccaatggtgcaggtgatgcgttcgttggaggcttcctgtcccagttggtacaagagaagagcatcgatgagtgtgtcagagctgcctgttacgccgccaatgttgtcatccaacgttctggctgcacttaccctgagaagcctgacttcaactagagccatttcagaatttagagtcttatggcatctggtctgtataattagtcgggttcgccttggtctgtttacggcacattctagtgtcaccgtacaggtcaaatgttcatgcgtgtaaggcgtgtcatactgtcatggcactctacaagtgcatgtgccagaaacgtgcatgcgtctctcggttacggactctttacagttgcatctaaaacaattcaaagcaccttgcggtgcatccttgaaaaaaaaaaccgaaaaaaaaaaaaaaaccacgctggagctaattgctagcttgctctacggcctataccctataagtcagcctacacctatatataatggttttgaacatctcgagctgaattccggaacacataggcagtcaaattcaacgagggcgggccggtaccgcggtcagctgcacagtgccgggctccactctcgctgggcgtcgacatggcagaggacagcgaggaacatgtcctcgtcgcaggggaggcacagcctggtgtcggcggcggcgaagccgtactcgtcccgcgcccggtcgagcaggtcgcggaacagcgggtggtcgagggaggacaccctgaccacgtaccgcctcagcgcctccccgacgtacaccacggtgtggcccctgggcacgtccctggggatggcggcctcgccctcgccctcgccgccgtcgagctgggcccacccagcgctggccgccgtctcagcggcggcgagcctcttccatgcatgcaggaaggccttgaggttgaggaatctcctcctctgcttggaccctgccttcatgcctgcctgtggacanccaaagggtgaccacc

SEQ ID NO: 4378 - DNA, 1452 bp, Zea mays
ctttccttcctactttcccactgccgtgacgattttcacagcgaattctccggccggcgccgccccgtccgtccgtccgttcttccgataccgaactcgccagtcgccacagcgatctctctcgctcgctccgccgacgcagcgctcggcttcagctcgagaggaggaaatggccagcagcggctacgaagggatcctcctggggatggggaaccccctcctcgacatctccgctgtcgtcgacgagggcttcctcgccaagtatgatgtgaaaccgggcaatgtcattcttgctgaggacaagcatttgccaatgtatgacgaattggctagcaagagcaatgttgaatacattgctggaggagccactcaaaactctatcagggttgcccaatggatgcttcaaattcctggtgcatcaagttacataggttgcatcgggaaggataagtttggtgaggagatgaaaaaaaatgcacaagctgctggtattaatgcccattatcatgaggatgataatgctccaacgggcacatgtgctgtttgtgttgttggtggagaaaggtcacttattgctaacttgtctgcggcaaactgctataagtctgaacatctgaagaaacctgagaattgggcacttgttgagaaggcaaaatatatttacattgctggatttttccttacggtatccccggattctattcaacttgttgctgagcatgccgctgcaactaacaaggtgtttatgatgaacctttccgctccctttatctgcgaggttttccgtgatgcccaagagaaagctcttccgtacgtggattacatctttggaaatgaaactgaggcgaggacctttgctaaagttcgaggttgggagattgagaatgttgaggagatcgctttgaagatctcccaattaccgaaggcttcaggaacacacaagaggattactgttatcactcaaggttgcgatccggtagttgtggctgatgatggaaaggtgaaaactttccctgtgatcctcttgcctaaggagaagcttgttgacaccaatggtgcaggtgatgcgttcgttggaggcttcctgtcccagttggtacaagagaagagcatcgatgagtgtgtcagagctgcctgttacgccgccaatgttgtcatccaacgttctggctgcacttaccctgagaagcctgacttcaactagagccatttcagaatttagagtcttatggcatctggtctgtataattagtcgggttcgccttggtctgtttacggcacattctagtgtcaccgtacaggtcaaatgttcatgcgtgtaaggcgtgtcatactgtcatggcactctacaagtgcatgtgccagaaacgtgcatgcgtctctcggttacggactctttacagttgcatctaaaacaattcaaagcaccttgcggtgcatccttgaaaagtt

SEQ ID NO: 4379 - DNA, 3427 bp, Zea mays
cgacctgcagcttgtgttgcaccttgtttggatcagaaacctcttgcaccatattccacgcctcaatcatggtcaagattagggactgttcgctgaattcctttgctgtcatgagcgtagctgtcgccatccacttcacctccggcaaactatcttgttctcctttgccaagacagtgcccctccctgcccacgttgacaagtcacagcttctgcaacaaccccagtcccttaacatcctaatcaccctccccttgatcagcccgaatgggagtgcctaagaaaccgtcggttgaacggacggaaacacaggtttagaaggctgtcactggcggagtctccaatattgatacgttcatggcattacaaattgttgaagataaagcataaggattaaggctggaaaaaaaactcgagctcgacgagctggctcaggctcgcagcagctcgctcgacgcttaaaacaagcccgagccgagcctgtttttgtggctcgtgaaaagagcgagtcagcttggttcggtgtagctcgcgagctagctcgtggctcgatccaacaacaatttgttacataaaatcttaattaacatataatattagtaccaaatagacaataaatttatgttatttgagattactataaaaaataatctattttatatattatattagggatatatttatttactaatttaaaaatatgttatttaaaatatttttaagattttatattataatttagagaacagatttaaatttatagttgggctcgttggctcggcgagccggctcgcgagcctagagcgagccgagccgagccaagctcggctcggctcgtttccactcctaggtctatatacggttctagcctacatggtaaaactacagtgcgtttggatataagtaagactcagaacaacaattaagtttttaaaaaatatattttaaaagtttatggacgaagataacacaccacgaaaaatttaaagaccaaaaatgtattttagaagcccaaccctcccccgcctgccagcccctctcggccggctatcggcaaattcgacatccgctccgccgtctacagtctacataaggaatcgaggtagccccagtcgtcttcggcgctcaagtttcggccgccggccgcggtgccctccgccccttcccaatcctgcccccaagccccagtcagccatcgaaactccaacccccaggcggccaggcccaagcgtccggcggttgcggccccgcggcttggcgaaggcgaccggtggctaggccccagcgactcagggcggatcaagtaagatttgtagtttcaattaattaggcctgcagatgcacccccgatgcccggttttggatttcccactgccgatgcccgagatgaaggccgccactgcgctggggagctggctgctcccggctgcgcctgccattcgccccacactggtgaatctcagatcccgggggttctgcagtcatggttatttcccctcggcgtcccggatttcttgctcatcagagttatctgatagcgatagaggtctcgccaaggagatggagtcagaattcagtgacgagatatgtgccgagaatggtgctgaagaggacgatgaaacagaggatttaatttggagcaaagaagagatcgatgctatttcagcgctcttcgaccggccgatgcgccagaagcccctgaagccgcgaaaccccgcgaggcagagggcgcttccattgccactgccgcacaagacgaggctgcccgtggctcctgcgccgaagcagcacgtccgcctcgctgcaagagcggggctctcttctcgtgcttgcttcagcgaccaggtgcgcaagaaaccggagttccttctcgggattgcccgggagatcgcagcgcttcctcccgagcacgacgtctccacggtgctcgaccgttgggcgaggttcctccggaaaggctccctgtcacttaccattcgtgagctcgggcacatggggctccccgagcgcgcgctccagacactgtgctgggcccagaggcagaaagctgtgccgttgttccctgacgatcgtgttcttgcttcggccatcgaggttttggcacgctttgaacggctcagagtggagtctgcgctggagcaatgtgtgcccacggccagccgtgccgttctcgaggccatggcgagcgggttcatcagggcggggaaagtagaccgcgtgcgcaagctcctggaacttgcaaggatcaataacaggacgctgcaccccagcatctacgtgaagttgatgttggaagccacccggacacctgaaggctacgggcttgcgtcggcactggttgatgagcttggcgagaggccggagttggagttgcgtccacaggactgcacggctgtcatgaaggtctgcataaggctccgacggtacgcagccgtggagagccttttcagctggttcaggggggccattgggagccccaccgtggtgatgtacacgacggtgatccacagccggtgccgtgacgggaggcaccgagaggcactgtccctggtgtgggaaatggagcaggcaggctgcctgcttgatctgccggcctaccgagttatcgtcaagctatgcgtggcattgcacgatccggggagggctctccgctatctgtcaaggatgaaggaggctggttttattccaactggcgacatgtacgacagtctgatcgagggctatttggcagatgggaggctggccaagtgccgacagctgatcagagatgccgagtcagccggtgtgaagctggataggaggctgctttcgcggttgtctgaaactggaggcagacatccttagttgactctggtgagtgttgttgacatgtgttatgcacgggtagaatccggacaggacaggaacaccacagaggaaaattatctctagcatttattgtagagtaatacaaagagtaatcttggcagaagattagtacgttgttgcccagtttccctttgtatttgtcagtaatccatgatttcatgacaacgatgaattgctggctgaaatcggctccacctttaagccaaaatcctgaaactgctaacgcatgcttgcaagttcctttgtatcctttcttctgagcataccatgaactgaccattttaattttttgctcttattcgatgacccctctgggcttctgaagctttagcttcaagaatcaagactgcccagtctgctgtgctgaatctatgttcatccttgaattcacagaagccttggagtcctgacaaatttcttttttggccattctcagctatgactacgaccagagcatcggttcatcgaacgtagaagagatttatagctatactagtgcttttagggggtgtttgtttctatggactaatttttagtccctacattttattccactttag

SEQ ID NO: 4380 - DNA, 1155 bp, Zea mays
aaactcctcgctatcctcttccaatccgaaccacccggactcccggagcaagcggccgccggctaagcagacacgaacgcaggtccggcggcaatgcaacgcgccgcgctcgtcgggtcccctctcgtacctgtgggtccccttgctcagcttgccgtgcggcgccgctgccgcttccatggtggtgttcgcgtgaggtcctcaaccgggaaggacgggaccgggactgggaccgggggcggaagcgagggcggcgacggcgccggtgccgcagcgtcttggctgagctcggcggtcggggagaaagtggacgagcttctgcgccgcgaagagaaccgggccctgctcgagggcgtcgaggacgccgagcgccgcgttgagcgcgcgcgcgccgcgctcgccgacatcgagcgccaggaggccgccgcacgcctcgcccgcgaggaggtccgccgcctcgagaagcggcgcgatgagattgcagagtcccagcgggaattgcttcaagcaagagaaatgattgatgaagctcagcgatccttgtcttctagtcttgacgaaggaagctttggagatatgtcaagtggtgatgttgatgaagataacgagagaatagaatccgtaaaagctgctgcagtttcctctgtcgtcggtgttctggctagtttgcccatatctttctatgaagttgaagatcttccacaactattccttcggtcatcaattgttttcataagttgtgctttgtttggagtcacattccggtacgctgttagaagagatctggataatatccaactaaaaactggggctcctgcagcatttgcttttgttagaggccttgctctgctggaatctggtagaaccttcgagctgagtactgataccttaatatcagttactcttgatgctgcagtcagtgtggttgagaacattttcatatttctgcctgctgctgttgcactggactactgttttaagatgagatttttgagtccctttcctagaagaaaacaatagcttctgtgaagaatatgtatgatcaatagcaatcttgatagctcaaatggtcatatgtaacacaagtgatatcttagattcattaaaaaaaacatttcccctcatttttctagagttccaaaaaaaaaaaaaaaa

SEQ ID NO: 4381 - DNA, 2818 bp, Zea mays
aaatataagatccgatcagatatgtgtcgatgctcatcccagtgtactcccgatgtaacgcacgagcacacacctagtaaattcttatgtttggtaaaatagagaataaatgagtgtgaccaaacaggctgaaatatgggggaccctcgggttcggccgggaaaacaaacgccgaaaaccgcagtacgctgtacgcagctgtccctcgcagttgggcgcaccggtctactcctcgatcggcaaggccgcaactacctagatctcgaaccctcgccgccgcttctttcccgatcgccgcggccatggcgaaggagttccccgtgccgccggtggtcttcacgccgtccacaccgacgcaccgccggtaccctccccagggcgtgggggcctcccctccgcccgcgttcgcgccgccccgcccctccacctcatccgccgccaacccgctccccttcatgtcgttcgatgtatcagctgccgcggcctcctcctcctccgcgccacccctcttcgcggggcctatcggtgtcgccggttccggctcgtccttcgaggacgagccgccgctcctcgaggagctcggtatcaacacgcgccagatctggcggaagacgatctccatcctccacccgctccgctccgccgacccctccctccacgccgacgccgacctgtcgggcccgttcctcttcctcctttcctttggactattccagctcctcgcggggaagttccacttcgggatcgtgctcggctgggtcaccgtggcgtccctcttcctctacttcgtcttttccatgctctcgggcggccgccgcggggacctcgatctttacagatgcgttagcctagtgggctactgcatgctgcccatggtcatcttctctgctgtctccctctttctgccgcgcggtggcgggttcatatttggagtagggatggcgttcgtgatatggtccgccagggtctgcaccaggctgctagcagagcttgcatccagtggagacgagcacagggggctcatcgcttatgcgtgctggctcgtctacatgctcttctcgttgcttgtcatcttctgataccatttatggtctggaaggtatggtcggacaactatactagaccttgcaaatatttaatttgatcattgttgttatatgcactcgtggttgcactatagcaatagtttcctgtgtaaacctctaaggtattcattttacctctgatttaggtgttatacataattattgtgttgtgaggagaaatggaaaatatatataaatttatttgatcgtataccaattaacaaacatttggccactacaatcttgatttaacaagatttgagtctggtggttactttttgttcttttcctttgaaacctcatagaatatcaacttgatggatgtttgctgtgttgacctcatctggatttaacttgactaccccatgatattgttctggtttctgccattattgtaagttgtaactgaaatgtggttatgagtatgcactacccagttaaatacatgattgtaattcattcaagagtgacctataagtgttattggaaccaatgaattgttagcagtgtgatagtgatgctcacatgttataagtgataataatgttcatagaatgacaaattgttggtggatattatctgcaagtatcatttagaactggaaattgacaagttgttgattttaatgaacccagtgatgtctctaaatcgaatgacattgaagacactttacagtaaaatatttaacaccttgagcatggagggctttaacataactattagatttcctttccatttatcttagtggctgaagatacttattgtctttatgctgctaaacaacttggtacttccaaattctgatatatgattaactgtttttatcatttttcttttcatatgttacctaaaggaatctgtgtgtgctttgtccattatgtatctcaggccaggtcttatattgcttgtttaatatgctaagtagaaatgttctggtgatgagatatgagcatggttatcaaagtggtaaaacgaggcgtggcgactaactactgccttacgcataagcgagtaagaccgtgtccagctgttcacctatatggtcacaaaatactgttttgcactgtttcacactgtagattgtactatttgcagagtgaaattttaaatgtaggtatgaggatgggtaatagcctaaggtgaggcgatgccttacggccatgcacatgctacattactatacaagcatgtcataccttgatgttgtcttctcctgtggagcctgcatacaagaactgactgcagaggagagacaattcgtgttagtagcaaagtaatattaattaacactgatcattaatggacaactggacagtagacacaaatagttaaatagggctcatgttggctcaggttggtatataaaaaacaaattgccatcaagattccctcctctcctctcctgccctccctcccccagtctctctctccccgtctgagtaatcaaatccatcatcatccacgccctggcgaaaccgaaacaccacccaacaggtaccctgccgttcgtcaggcggttcacgcccaaggaggtggaggccgccacgcgcggcttcaccgcggtgctcgacgccgccggcacggcctacagggcgcgcttcgccggcggcctcgtcgccaccgtcgtcaggcgccgccgcgacgccgacgacgccgaccaccaccgccagggagagggaggaggaggagggaccacggacgccttctacctggagctgcagggggatcctcta

SEQ ID NO: 4382 - DNA, 1539 bp, Zea mays
tttttttttttttttttggaacgccaaaaacacttctaacctgttttgaagagcaacaatgtttgagtaacccgttttgacgacccggcctcgaaacggtctatttcgcagagcggcaacctagagtgactgttttgccaaatttctctccggtcctacagtcctcctgacctcgattcccgcactacctagatctcgaactcccaccatcgccgccgccgcccatggcgaaggagttccccgtgccaccggtggtcttcacgccgtccaccccaacacaccgccgccaccctcccccgggcatgggggtctcccctccgcccgcgttcgcgccgccacgtccctccacctcatccgccgccaacccgctccctttcatgtcgttcgatgtctcagctgccgcggcctcctcctcctctgcgccgcccctcttcgcggggcctatcggtgtcggcggttccggcgcatcctttgaggacgagccgccgctcctcgaggagctcggtatcaacacgcgccagatctggcggaagacgatctccatcctccacccattccgctccaccgacccctccctccacgccgacgccgacctatcgggcccgttcctcttcctcctctcctttggactcttccagctcctcgcggggaagttccacttcgggatcgtgctcggttgggtcaccgtggcgtccctcttcctctacttcgtcttttccatgctctcgggcggccgccgcggggacctcgatctgtacagatgcgttagcctcgtgggctactgcatgctgcccatggtcatcttctcggctgtctccctctttctgccgcgcgggggcgggctcatatttggagtagggatggcgttcgtgatatggtccgccagggtctgcaccaggctgctagcagagcttgcatccagtggagacgagcacagggggctcatcgcttatgcgtgctggctcgtctacatgctcttctcgttgcttgtcatcttctgataccatttatggtctggaagattatgtgcctaatttgtttaggggatgctgtggacagtggactgccttttaccagtcacggagtgtttttgttgtgttgtcacagaactacatacgatctggccagttgatctcttagttccattgggcatggttggtgttcggtaaaaagaaaaggaaatcaaggtccagaaacagcaaatgtgcagtaattaggttttaccgaagtattggtggaaatctaattactttctaaaggtcgtggtatgtgcaaatctgtttattatgattacttaccacgacctctacttttaggatcaccgtggtagtttcttttcttttaatgcattttggcagagataattgttctatctttaggtatcatgttagatacttaatcatcataaatcaaagggacgttagttttctttttatttgttacaagttgtgaccctcgcaatgaatttatcttctggggtaacaatatatgttatttacaatttgaaaaaaaagaaaaaaaaaaactcgagggggggcc

SEQ ID NO: 4383 - DNA, 1420 bp, Zea mays
ccggccgggacacggtcacacggagttacggaccccggtccgccgccaccccggaccctgtgttttctttcctccactcccccagcgaagagcgtgcgagcactccctcgccgcccaccgcgcctcgtggcggcaactgggcggccgtcgctgccgccctacgccaggtgccgaggtgattttccgccccttggccggcgacgagcaccaccagatactctgagcctggctgccgaaacttccttttggtgtccctgttacattcggtttcgtttttgatgacttcatcaagaagcaagagcaggagccacagtcgcagcaggagcaggagccgcagtcctcagcgaagagataggttgcgcagcgaacgtgcaccccgccacagtcgcagtcgcagcaggagccgcagcccataccgtcgcagagaacggcgtggatacaaggatctcgtatgcaagaactgccggagacctgggcactttgctaaggagtgcccatctgcgcctacgtgcaataactgtaaccttccaggccacttcgcagcagaatgcacctcaaaaactgtttgctggaactgcaaagagcctgggcacattgccagtgagtgcaagaacgaggccctgtgccacacctgcaacaaaacaggtcacttggcgcgtgattgccctacttcaggggctaacgtcaagctatgcaacaaatgttttaaatcaggccacatcgccgttgactgcaccaacgaacgggcatgcaacaactgccgtcagccagggcacatagctcgagagtgcaagaacgatcctgtttgcaacctgtgcaatgtctctggccatgtcgcgcgcgtctgtccaaagacgactctggcttcagagatacacatacagggaggcccgttccgtgatatcctgtgccgcatctgtggtcagccagggcacatcagccgcaactgcatggccaccgtcatctgtgacacatgtggcgggagagggcacatgtcttacgagtgcccgtcggcaaggatatttgatcgcgggttccgccggttctgagagcctttcaccgctttgtttctgatggtttgagtttcgccaggatgtttaatttgtttctgacaatattggaacaattttccctatggttgttgaggaatgattctgtaaggatgtgttgcggttaaaactccttttttactttttgttcggttactctagtatttccctcaatacacatggattaatacacatggattgaggtgtattggggtagcttacccctcaatacacatcaatacatgtgttgtattgaggtaaatcctagagcacccaaacaaagcttaatccctaatcaggatatagggccctttgtgggctaacagtgctgtaacggctcatgtgaaaattgccaggtcatgtttaactct

SEQ ID NO: 4384 - DNA, 10697 bp, Zea mays
  misc_feature (10258)..(10258): n is a, c, g, or t
ctgccacttgagccctcgatcaaatccaaagaaagaaataggaatacgagtcctcatcccgggtcctagactagggagaatggaaagatttctacggaggcttgtttaaagtaaagtaaagaagggccattttcgaatgcttatctagatatttctagaatccacccgctgccaggccaggaaatagtgccagtccacttttccatctctatgaaagaaacggaagcggaagtttgcacttgagccttgtcttgccaggtcagttcggcgctggaatggcattgttcatatctctctcgggtgggcctattcccacttccgcatggttccttctccactacttctggtgtctaatttgcatggtattggtgcccgccatgttccttgctattttagctgagctgtattgactcgccaggaaaggtttaacgctcacttctagtactagaagttccagtaacagcattagagtttcgaagggaatcgggttatcatcgactttctcgctttcgacctctcatttccccatgtcggataagtctcaattcactggatcgagtgataaaatccgaattgtcaaccaactgtgagtggagtgcagctacacgaagaacagaaggaagggtacacgaagaacggagtcaagctcttgtcgtctggtttcagggccagggctgggcatagatctggtaatggaatggtaactggccttcttttgccacttggcgagagcaagttttcttatcttcgtactcgtttcgagggtgccattgggttgcgtacttttgtcccatggcgagctgcactggttcaaatccattttctggttggtttgccatcctagtgatgacgaaaaacacgggcatttgtaagtagttgagtgcgcatgccagctgttctgttaaattctccgcatgatcttgtgattgattatccggatctagaaccagctacgggtggggtctccgcattccagatagcttgacttccaaccggcgtgcaatacttgactcgccatctccggctgaggtttctgtgtttgatttgatttgaatagtagaagcttgtttcataggataggattcgatttgcaggcaggcatgctccgggaaagtgccggttattctcatgttccggatctctttcttggtcttgggtaaggcggcaggctcagcaggggtatatgatttcgaatagaaccagtgatcagtttccgtttcgatccacaaaggatgccatgccggttagaatatagccagtgatgaaccagatctggatctagatgagttaccttgcttcaggactggcaggtttcttgaatcatagcttacctatcccatattccgccgcttgaagggtttaggtagggtttcctaaatgaagcagcagaagatggcctagctttagaaaaatcaagtacggaagtccgcctcggagtccgaagagaagaacaagtgctgctcacttagctggaaaaaaagtactacctgcattcctgcactaaagactatttgcgtatcgggattcagtgaatcttgtttttttctccgatccagcctgcaaccgggaaactgatacacactcgagactgttcatttcacgagctggcacacttacttcaccacgacacgacggatcccaacagaaatgatctactgcgtatgatcctggtttcgtaccaatcctgactactgattcatatcatacaagtcaacctgtgccactagattcacctcacttcgcatcccatctgcgagttcttcttcttcggctatttcctccactgcagagaattcgataccgatacgaccaatagcagtagcagcattccgtttgtgtagcttgactcgaacgaatacgcctttcctcgaactcggcaatccagagacagagaagagaatgagatcgatcaagagcaggcagcttttccctcaacttatagctagaaagaaagccaacctggaaacggaagaagtccaaatccggattcccatttcactaagaaaatctgcttgaggacaaaaaacacggtaaaatggaaatgcagaagtcgctccaacccaggcccgtagcttaagatcggcttcaagtccattggatgccggtggatggatagatagttggaggtgagcgagtagcggcagtaaagaaagtatcggtcagtgagtaactagactagagcatgtgtccagcgcctaacgcgcttatcctctgttggaatcgatggccctaatggtaacgggacatcatgaggcgtctgtctaaattgacttggtttctgagagagtggagcgggaatagcggatccgctaaaacaagatctttaaaagtgttcagtgcatccaaatctgaacctgcgaacgtaggctaggacctgcatgtaatgttacaagccttgccaatacttccttttgataatgaaatagccgaggacaggctgtctcggaagtaagtgctttcatgacattcccaactggttaacacaaccactatcttcttcttttttcaggaattggtatatcgatcaagtggaatatgatatatgtgcaaatatgtcatcatcactggaatcagcataagatttggattccatcaacttgaacccctctatctttttcttctgttcttttattttaagcttcaatagctggaatctttccattcgtagtagttatgagctcctgcttaaggttctgggctacgaattccttccttggtcccttccttcgctagccctgttcctaaacctattccttgcatacgagcgaggcccacgcaaatactacgtaggatatgaaatcaaaactacgattgattcccacgagctaaaggtcaatacgagcgttgcactagcgaaatctaaaggatttgtgtcccctcctgcttgtagtattgtattgtcatccgacaaattatctagttgtaggcgtccgttcaaagcggaaagaaagagcactggtccacggataagctaaaaggcaggatgcaggtactgttatagaaactcggcatgaaacaggaactagggacaaagaagagagccaaataacaagtttagcaaaagaccaagcacccgcaggaaagagacacagaggaaaatggcattcatgcaaagccaaaaggtgtagctgaactccaaacctaaagtagaggggacagtaagtagaaccatcctccgaggaagcactggttcgaggaagaataccagatccagttgaggaagaggtggtactctgcagccaaaggagtagtactggggttagctctaaccatcttgtacagaagaagggattacgactagcccaggcaaggaagtaactcaatctcaaaagggcgagagtttgattcaattagaaatctcaaatcaaggcaaatccgttcattgaaggaagtgagctagctcccatcacttcatctgctgcctgttcaactaatcgaattcaccctttattccgattggaattccttttatcgaatatccctgctcgtacttcgaagtcggattgtcctcccggcggttgcatctaacctgctcccaatctgatccctatcctagttctggctccggcccactttcatcagcagatcctgcctttcctaagctatttcattccaaacattcccatagcatcttctttcccttgccaatacaactagagaatcgtaggcctcgtacgtgcgtattggtttctagcgcaaggaagcatatgaactgcaccggtaaaccaacccgtctcctacaaggattcgctgttcctatcttttccattgatgtgcaaaagcacagggtgatgcatacaagttggcagatgccttgctttgcctaagagcttatccgtgtcaatatccctagctatccaggtgccccctcgctgcgtccatggcatactctattcggaacaaataaacaatacttgcgaaaagcgtagcctacacgaaaagcatcgtatctagtagcaaaggaaaagaaatggtttctacaccctccggggttgacgccagggaaatatgctttttatatttctaatgaaatagccgaggatacgatctgtttggagggcgtagtactaggtttgttttatcctggttaacctttccgttgttgccgtgccttgccccaaaaggaaggttccgctcagttatagttgaattaaaaagtagtactttcgcctatatgtgttcctaacttttttgcaatgggtgacccacttccttttccaaagcttagtgaaaatgctattcattgatttccccgctatatgagatcaactttttaaaatccatcatctactttccgaagggaaatcgggtttactacttttgcccatatatgagaatgatcctaactttgttaaaaggagagcctagcattggtaccgtgcccctttgcctttgttagagggataggagcagaaccggagacatgggactggattcgattagtattgcgctcgtaaaaggaataggaaggaataaacctcagatgaaaaggaatatctctactctagcgctcactacgttctctagcgttattattggcgaaagaaggtgagcctctaggtgcggagcctgtatatacgtaattagatcgatctatgaacaaaggaaagagtcagtccggaaaatctcatattggcgtacctgataacaacgctcatatacgtcaattcaaggaaaggatgctgctctggctcgtaggaacgaatgcttaggataggaatcgcgctaggggatgattcggttgggataactgatcatggggatagccttgccataccaatcattacccggtatggagggggaaagcatccaattgtatattccttactcctggattcgattaggctggtttaaaagagaaacccaccctaaagccgagccgaaaccttttaacgggataaaggtaccctttaacggatgccgaggaatggatatcgatggatgaactacagttagttacgaggatagtaggataaaggctaggggtagtaggctaggcgaacagacgcattgggattggaatgaactgcaccatcattttggcatgattcagatctcttacctgaggaagaactaacttctatccgtattggagcatcaattcactgacttctatgcgaggcgaggaatactttcttcggggaggagaggaacgaaagcatagaaaatcgataaacagaaatgagtagttgacacgggagactaattgcttcagcctagtccagagttttctacaagccgagtaaagtgttccttttgccaataacaaccattgctaaaagcaggtgcctttccccaaggataccgtcaaccgattaaacctttgctaatggtggaattgccaaacctttgcccatgccgaaaaagaagccaagtccgattcaataattacctttcttttgtctctatctttggactgaatcagaagaaaagcaaggctaaaggaaaggaagcaggccaggttggagaaactggttctggtccggagctcggggatagctcctcccctatgatctctgttctctagtgctttgcctcccaagggtcagatacttcttgggcttgagcaacaggagaggactcgttttccttcttagcaacaggccgtggttttccaagaaagggtctggatcgcatccgttgggaaaggtcgaactaccggtattaagcactgccttctctaccggagaatcacccgcggaagagatatcagctccggtatagttgtaccttactagagagacacgccactccagcactctcactctttagaagaagagacaagaagagcattgtaccaattcgagaaatcaagctcattcgaatactggagggatgtactacactacaggcaaacagatctcatgtaatgaacgcgtacgaagcactataagttaagtgaagtttcattcatagctttctctggtttcttggtggatatgtctccaggtctaagggaaggcaaggcttctttctatctttgcttgggaataccattcctgcttctccatttctcataagagcattcctggcctgcttccttgatcatagctttggaaaggaaagtcaatcaaagtcaagggaaagtaaagtaccttagcaggataaatgacatttgatttgctattgccaaaatctctgctgctcagtttcttccttgtagaaggaagtatgagtattccaaagagggattagagattccagtttcttggtaaggcatcttcaagtcatctttgctttgtgtatgcatgcatgggcataaagagagcctgaattacgcatatagcaacagaaaagtagaaaaatgggaagtcggaatagcatctgatcggaaaagactaaattagtaggacgtaaagctcggctcgtacagtataaaacggataggaagtgaagacaaagagcctggctttatgctcagcccccactagcatcccacccaagactaatgaacgggaggaggcctatgttacccatatatcgatgtcctttttttcttactaatgtatgcatgtttctcttacttttactcctttccaacataaagtaactcatctcactttcttgaattgaatgttaacctatgttattaatgtgcatgtactcgcgttgatagtccttactactaatattaatataaggtcttcccccagttctgaagttctggtactaaattaaatgccctaacactatttctcaaaccagagtgaactactccatccacgtgttcaatcaaaggaactgagacattgcttgatagaagaaaaagacttttgagttagcgaaaagaaaatcctcctcaacggatcaaacaatactaccgtacccgccgacgccgaagtaatatcgatcgaacctattccactcgcactgacactatagagagcttccacctttcaagctgtcttgcctttaccctgagaagtagcacttggggcctcacggatgagaatccaatttccacaaaattgcattgtttgctttttcacatacataagcctagggcacgaggagatagggacgataccctgcgcaccctctctaaagcagtgaactcgatagcgcaattcctgtttttttttgttttctctctcttctattttgaatattaaaatatgctctttggagccgggaaataagatcggtacttgaataaagagatatagatagagatagtaagttttccattcatttaggttggcggaaggatagcgatttttttcatacagctcgggacaaccattattacaggggtcaaagaccaacgaatggcttgggtcctactttcatcacttattgctaggataggactttccttaccagaaagacaaggcgcgaagcgatgccgccctcttggttttgatttcctcacaagtatacttttccgggaaaaagagattcatacaacttcctttctgcctccaccttactcaccggctctcgcttgtcagtttggctttgtgaatttgaaataccctctctcctcgcttctaggctagggattggctcgtatcctggttgagaagaagcagttttcaagcttgacttttcttgtaataaatgatagagcagagcactcgctcgtcaactcgctactctctccccttctacttgtctaggcttcatacccgaaagatcaactggcgcaagcacattcttgaaagataaggccagagaatagtaggtatagcgctgttgtaggttaaaaggaggaagaaatagctgtacgagttgcagagctggtgacaagtgccactgtacgctagaaagaatgagtccctaacaaagtaaaaaaagataggtcgaaatgcctgtattcctactggaaaagtgcgtgatggttactctttatcattggcatacttgcattcctttccccaactatccgagtttgggtttcctaccagtcctttcccttcgccagtcttagacagttcgcttacccgataggcttggcaattccactactttaagttgggatttttttcatgtatctttccttttgtcctcgaaagcctgtcttccccgagaagacagtcttcctctataaaacaacaacattagtggatatagactaggctaagggacggacttcatctctgttcttacccaaggaaactgggtatcggggcggtatagtatagtataggaaaggagtagatctgccaagtatctgccttctgtttggggcgccaggtcgaatacgtcaaataaaagacaaagtgtggaacagcagatctagtttcttggcatgttgatcgatcaacccttttgcgggtctatagtgccagggctctcttatagacttatagatgggtttcttgctttggaggcaggctattggagtgcgagggttagcccgcgtgttctttcttatttgaggtaaggtgatccgctataggctataggacgagaacgggaatatgcaaatatacgagtgccagacccgataaaatatacgagtgcaaacgcgccctccatgatcattgcaaggtttagagcagttaataagccaagccaccagcatccaaaataagtagcgaaggatattaatatgattgcttagcacggctcacgcacgttgctatacatcaaaaaagcttcttcgtctgtctgtcagcagcgtatacaaaggctgcatgataaacctatcattatccatctcacgaacccacccttgggacgaactcactcctggttctcaagcttcctgtttctaaatcgaggaaacagataccaaccaagtcgtagacttaccacttgagtatgctcatacagccaaaccttttgattgcaaacattagtagttaaagccatactgtaatcacccaccaacaatacaggacggaaaaaaacaaacttactgcattttcttaccagcaaagcaaaatgcggcccaagcagcgtaggcttgtgaatcttctcatccgccataaagtcttgcacacacttacccatagcataaactgagttcaacaggttgtcaccaacagactgcccccatgcatactcccacaacccttcaagatcaccatcataatcccagaaaaacatttgaacaacgtaccggacgaaaggtaagtgcgaagggcgaagttgcgaaggaatagttgttactactcttagtttagtttagtacccacggtccatttgatcatttgctgcggtaccaaagttcaatcgtcatctgccgttgaaagagtacacattatattgagtacctccctatcttcgatctctcttgtaagaaatcctacgcatccctcccttgtcagaaaataaataggaatatgagcctgtactcactcacgctgccggagtactttttgagttgagggtaacgtagtaaaaatcctttatttctggggatttgccttttctttcaaaatgaatttatgcttagtctaaaattggtaaataccaaataataataatataaagatataatatatattattattattataaatatgtaccagtttcctgaaactaacaaatagagttatagctttgattgacttactagcttacgggaatgctttgaatctcaacttacttttttagagggggggattactactgcatggaaggatggtatactggaacgcaggtgttcttactctttctcaggtacctgagaaaatagagttggctgactataacatggaaggccccaagcgtcgccttgaaaattatgtggaagagttccggcttgcttgcattaggatccatccctccaagaaaccatcaatatatgaagcatatggctcctctttgagttctattttcttggggttgggatgagagcacgatatgagcatgcgaatttcttcgaatctaccattggagagaaaataaggggttatgtggatgggggatttggagattcttgaaagaatgttttggcttcttcctattacgcttcaacacagaagaagattgttaaaaggtgctggaaggaggatatatttttccaattgtttcaattgcccaacctcggaatggccaaggtttaatgatttcatgtaattcttccgcttacaggtttttaatcggtctgtatctttggacatcctcgggcgtatttattgcaatctttttccatgtttggccaataaaacccatatctgtgtatcagccatctcattcttctgcccgcttgatgtgctccagcgattctttcatggacctcagccattaccaataaagcccccctttaccttctctttctattctataaaaaggcgaacatctaatntaggcccggtcgcctttctatgaaggcgagcagcccagcccccttgtggaaatttgtatattaaggaagccgtatttcgcaatagcagctccgagaagctgggcttagggtgcgcctcctgcggtcgtttcagtgactcaattggctggcttccctcagctcagactggtgtcgccacctctcccaggaccggaatgattatccctgcccgatgggtctacattcatccctgaatgtcgtcgggtactcttcacttccccgccattcttgtaaccgtcacctgtaatccgcgcaggtgtgtccgcacccccctggagtggacgagaaagaaaggattttttctcggagcaaccccagaaccaggagttcactttcccgtatgagcattcggtacatatataagtcagtggaagagtcaaagggtcaccactactgaggg

SEQ ID NO: 4385 - DNA, 1371 bp, Zea mays
cggcacgaggcattccctcactccctccccgcccacccccagtcaccaacgcccaccgggcctcgtccctcgtggcggcaactgggcggccgtcgctgccgccctacgccaggtgccgaggcgaccttcaggcctttggctggcgacgagcaccagtgcagtagtgcaccaccaatactctgagcctggctgccgaaagtgccttttggggttcttgtaatcttgttacattaggattcatttttgatgacttcatcaagaagcaagagcaagagcagaagtaggagccgcagtcgcagcaggagcaggagccgcagtcctcggcgaagagatagattgcgcagtgaacgtgcaccccaccgcagtcgcagccggagccgcagcccataccgtcgcagagaacggcgtggtcacagggattttgcatgcaagaactgccggagacctgggcacttcgctaaggagtgtccatctgcgcctatgtgcaataactgtaaccttccaggccactttgcagcagaatgcaccttacaaactgtttgctggaactgcaaagagtctgggcacattgccagtgagtgcaagaacgaggccctatgccacgcctgcaacaagacaggtcacttggcacgagactgccctacctcaggtgctaacgtcaagctatgcaacaaatgctttaaatcaggccacatcgccgttgactgcaccaacgaacgggcctgcaacaactgccgtcagccagggcacttaagctcgggagtgcaagaacgacccggtctgcaacctgtgcaatgtctctggccacgtcgcgcgcgtctgcccaaagacgactctggcttcagtgatacagggcggcccgttccgagatatcctgtgccgcatctgcggtcagccggggcacatcagccgcaactgcatggcgaccatcatctgcgacacatgcggtgggagggggcacatgtcttatgagtgcccttcggcaagaatattcgggctccgcaggctatgaagagcttttcgccaagagctccgctttgttctgatggctgagaattcgccaggatgtttcattgtttctgacagtattggaacagttttccttctgccgttgtagttgaggaatgattctgtaggatgtgttgcgggtgaaaacttccttttttccccccttttaatcaggatagccctttgtgggctcaaacattgctgtaacggctcgtgtgaaaattgccaggtcatggtttaactcttgtgctcgtgctctgctgtgtcttttgaacgcttgttttgtgtactcacttatactgtattgtaacgtcacgtagaactgtgaaatttgtatggtgacgttggtggtttgatctggac

SEQ ID NO: 4386 - DNA, 1437 bp, Zea mays
cctcgagattaacccccagcgggcagcggccccgcccgccctcagtccctccccgctcaccaccagtcaccaacgcccaccgggcctcgtccctcgtggcggcaactgggcggccgtcgctgccgccctacgccaggtgccgaggcgaccttcaggcccttggctggcgacgagcaccagtgcaccaccaatactctgagcctggctgccgaaagtgccttttggggttcttgtaatcttgttacattaggattcatttttgatgacttcatcaagaagcaagagcaagagcagaagtaggagccgcagtcgcagcaggagcaggagccgcagtcctcggcgaagagatagattgcgcagtgaacgtgcaccccaccgcagtcgcagccggagccgcagcccataccgtcgcagagaacgacgtggtcacagggattttgcatgcaagaactgccggagacctgggcacttcgctaaggagtgtccatctgcgcctatgtgcaataactgtaaccttccaggccactttgcagcagaatgcaccttacaaactgtttgctggaactgcaaagagtctgggcacattgccagtgagtgcaagaacgaggccctatgccacgcctgcaacaagacaggtcacttggcacgtgactgccctacttcaggtgctaacgtcaagctatgcaacaaatgctttaaatcaggccacatcgccgttgactgcaccaacgaacgggcctgcaacaactgccgtcagccagggcacatagctcgggagtgcaagaacgacccggtctgcaacctgtgcaatgtctccggccacgtcgcgcgcgtctgcccaaagacgactctggcttcagtgatacagggcggcccgttccgagatatcctgtgccgcatctgcggtcagccggggcacatcagccgcaactgcatggcgaccatcatctgcgacacatgcggtgggagggggcacatgtcttatgagtgcccttcggcaagaatattcgggctccgcaggctctgaagagcttttcgccaagagctccgctttgttctgatggctgagaattcgccaggatgtttcatttgtttctgacagtattggaacagttttccttctgccgttgtagttgaggaatgattctgtaggatgtgttgcgggtgaaaacttccttttttccccccttttaatcaggatagccctttgtgggctcaaacattgctgtaacggctcgtgtgaaaattgccaggtcatggtttaactctaaaaaaaaaaaaatgctgtataatttgaacgcttgttttgtgtacttatactgtattgtaacgtcaacgtaaaactgtgaaatttgtacggtgacgttggtgatttgatcttgacaaagagatgcctgagagttgggcactcggcactttgtattgcatgtgatttgc

SEQ ID NO: 4387 - DNA, 1057 bp, Zea mays
ctcgtacccctgcgccgagcccagtcgagggagcaagacgccggaagcgacgcgccccgtactctgcatctctgccgccgccgctgctgctgcttgcttctacagtcccctggccccctgttgctgccctgctacgatggcgatgcaacacggccaccagtagcccctgctcgctcctgccgcagcacgcgacgggaaagggccaaagggaggggaggcgagaaagaaaaacaaaagatgggatcttgaggaggaggtgctggggttggggaggcggcataatggcggccgcggtgtgctagcgggctaaagggggtgcactactgattgctgatgggaaaaaggaggtgcaggtggtggtggagatggagtggacgcgttcatgcccgcgcctagctagctagcttacctgtccacgcctccgtgctgtgtcctcttggctttctctttcccgctctcctcctcgcttgccccccgccagctcgatctccagggagtggactagtgcagggagggagggaagaaaggagtggtgcagctgtgagtgaagccgcctctcgtttccttgattgattggagccgagccggaatgtgatgcgagagaggtgtgcagattagcaccgttcgcaggacacaactgagcaatcctctgaaggccaaacaccccctttcagttagccatctctgaaggaacatacaggctttttcataagatagtcatggcagagttcaagatcggtaggctggatggccaaccaccaagggtcagaaatgtgcccattgccgtcaccccggaaggattctggtgctgcccatcacaggccgcgcttcagaagacagcgaagagcccaaaccagcagggcaggccttagagggggagcatcccctgcgccttcgaaggcgtcctcggttcagagggttccaaccgtttcttcagagaagagagcacagtccactcctactaggtccagaaccaattcagaatgagcaagtgtgccctccagcaaatgctgtggctgcccctgatccgccaaaggtagtacctgcaccggcacct

SEQ ID NO: 4388 - DNA, 6386 bp, Zea mays
  misc_feature (2961)..(2961): n is a, c, g, or t
attgggtacctcgaggccacgcagtccccgcagcgggatataaagataaaagaggtgtgtggagcgggagaaggccggactgaaggaggaagacgagcagggagagggaggtagggcaaaaggaagagaatccgagaataaattcagagagggagggagggagggccatgatgatggcaggcgtggcgtcgtaggtggttaaagcgaagggcgcccctcgtcgtccggtctatgagctggtaccagaactgctcataatattcagggggaaaaaaaggcaacatggcggaatcgaaggtcgcaagtctggatgcccgaacgacgaagatcagaaacgtccccatcgcagtgaccccagaagggttctggtgctgcccgtcgcaagccgtgctccagaagacggcgaagagccaaaacccgcaggcgaagacgaagcccagagggggtgcctcgcctctcgcaccaaaggcggcaccaccaatccagagggcgcccacaatctcgtccgagagaaggacgcactcgactccgaccagggcgaaaaccaactcagaggagcagaggtgcttgccgccggcagaggacgctgcggctaataataacgccactaatccgcccaaggcagtgaacgagaggccacagaagcagcacaaggtatctgttgggttcggccagctcgagacgagtgacttgaaggtggtgctgtatggcaaggacggcgttgcggtgaagatgagcgtccacaagaacaccctagctggaaacagcaccttctttgctgacaagctctccgggcagtctccggtgtcgagtatagaagtgcctgactgtgaggatgtggagatttatgtcgagactgttgggttgatgtactgcagtgatgtcaagcagaggcttatcaagcaaaccgttcctcgtgttcttcgagtcttgaaggttgcagagctgctgggtttcccagcatgtgtcatgtcatgcttagactacttggaagcggtcccttgggtcggggaagaagaggagaatgtggtctcgtctgtccggaacctgcagagcgagagctatggcgtcagtcctgtgctgaagagggtagcaccatctgatcgaacaaccccaccaaacgatacgttttcacatatcatcgaactggtcttgagaagcagcgaggacagggggcggcgcgagatgaaatctctggtgcagaagcttctgaaggagagtagcactggctgcatgagtgggtcttccgacctgtgttctgcggtcctctacagatcatgccggaactgcctggattccttactaatcctgtttcagcaagcaaccgacagtgatttcgctgagcaggctcttaataccaaagaaccagttttccgacaagttgctctagaagcagataacctgctctggttagctgagatcttggctgacaggaatgccgctgacgagttcgcggtcatatgggctagccaacgtgagctggctgggctgcactctaggttgccagtcaagtcgcgccaccttgtcagctgtgtcacggcgaggctgttcgtgggcatcgggaaaggggagatgcttccttcgaaggacacgaggcggcttctcttggacgtctggttgcagcctctcatggatgactacaactggttgcagcacggctgcaggtcgttcgaccggaaagtggtggaggaaggtgttgggcggaccatcctgacgctccctttggaggatcagcagacgatcctgctctcgtggcttgggagcttcctgaaggttggggacagctgccccaatctccagaaggcctttgaggtttggtggaggagaactttcgtaaggccctatgctgagcagcaaggtaatcgatcgcaatcaggtcggagttgagatgtcaattggttgcagaagaagatagtcttgtttcctagtgtagtatatttgatgagaagttagggtggcggtttcttcttgcgtggtagcccgcgtgggagatccccagtatgtggaggaaatgcggttagtactcttgacctgcgtgaggcttgaggaagttcgcgttgtgcttgtgatgcttcgtatgtatgtcaagatctctgaattctgggtgcagaatttgtatcgtcaggcatctgttttgatgctctgttctgcttctcacaacgttgcacgatgttaattaaggatctgttatgtaaaagaactcgacgccttcaatgcaactgtaaagattttgcagaatgtgttcttcaaaaatggagacatatcggtttctatttgtgttgtatggatgattgtccagtttgaaacggtgatgtgtgttaggaaatgaatatctgatacattgattgagggctggaggattatgtataggatcctgcctagggttccaccctaaccctaatagactacatggactgagctctaggaccatatcatagaaccatacacaatataaaactacacagtaacacatagcagtctaacaccctcttctaaccacaacaaatgttaagattggaccaaaactcaaagaacatcgaggatggaaggcccttgatgaagatgtttgcaaaccaggagcttgtcaggacatggagaacgcggacgaccgcaatggcaacacacttacgaacgaagtgaaaatcgatctcaacatgcttcatgtgctggtgctgttccaagttaataagagatagatgacgtttacgttgtcgcgacagataagtgtagagctagttaaggggttgtagtgaagaaagcggtactcaccctcggcattggaaaaggagaccattggctggcacttgaaggaccaggagatgatgttatcttcaataaacatgacctagccgaacgtggattgtccgaatagcctgtctcgtcattgttgatgtagacgataaactcttgggtggaggagtaccgaagaagcccatagtcgagtgtgcctcggaggtatgngaggatccacttgacagccgtcaggtgcagcttctagggataatacatgtgaagacatacctactaactgcataggtgatatcgggcctcataaaggtgagatattgtagggcactagcaaggctccgataaacagtggggtcgccaacaagaggactgtcactacatgcctttgtctttgtctatatgtccagcggagtcgcacatgacttagaatcatgcatgtcaacatactaagatgtctaaattgtatcgccgctgctgaggaaagaggacattcgagcgatgctcgatgtctaggaagtgaggaagaggacctaaattcattatcgtgaactctgctgaagagtggtgctgatccagtgcacaagagccgacgtagacgcaatgaaaataatgttaccaacatacgggaggggatacattgtcaccgtcacactggtgaacatggtagttttatattcaggtagttttataatgagaaaaaagttttataatgaaaataatgagaaaaacgttttcgattaaaaaaagtaacgttttatcatttaagagagatttaatgctctcaatcttcttcgatccaaacacaactgaacaagccttcggtagtatttcatgaaaggtattaaaggattcccatgatcttctaccgaaataattttctcttaaaaaagaataaactgtaacgtaactgattcactggtgtgacacaccgaacaacacaagatgaagcagcaaattgcttcaggcaagcagcagcatccaagtagatgacgcatttgccctgcagcaaattgcattgcctcatctggatgcagacctctcaacgctctgaaggcgaaacccacaacgtaagccggaatcagttagctcatcatcctctggaactcgtggaagtcgaggccaccgtcgccgtcgacgtcgtaggcccgaatcatggcctcgcagtcggcgacagaacgcttgtccccgagctgggcgagcaccctctgcaggcccctggccgtgatcctgcccgcggactccacggcgttgaacacgtcgaacgccctgcgcaggtcctcctcctggccgccctccctctccatcagcgccacgaagccggcgaagtccagcatgtagccaccgtcgccgtacgacggcggcatgtcgtcgcccatggacacgaagaaggcgcgcagctcggcgccggagatcttgccgtcgttgtcccggtcgaagtgctggaagatccgctgcagctcgccgtgcctgctgctggagctggaggcggagctagacccggacctggaccccctgccgagtgacgaggaggaggacgacgacggccgcgtgacagccgcgcccctcgggctggccacgtccgactgcccgcacatgaacggcagcctgaagctccgtttgctcgacagccgcttcgccatctctgtgccgtcgctagctgctcaactcttgcaagaaccaggaggaagctattgtcgcgtacgcttagcttgtgtcacttcacttgtgcgctgcagtctgcactctgcaggttattatacttcgaccaggtgccgcgggctcctggtctcgccccgcagctcagcttctgcttgctgtgctgcgatccgaaggagaagccgccgcccatgccatatgcatctttgtgtggggtttgaccggtcgtgatgagaagttagttgagcctgcgtcgcaactacctcgctcatcagataatgtcacttggctgcattatctaactcccatcagacaacgtgatcatgtgctcacgatccccgcgccgccgcccaccgaacaacgatatctcggaatccgtgatttagttatggtcttcgagatccagtggttcatcattgaatttgcagtttgggggcgccttgtgacatgacaagtcatgggtcggttgaacagttcacatttcagaagctgtgaaaaaattcagaagctgttgacatgacaagtgatgcagcgagactgggaatgaaggaatctgaaactagctaatagcaatcagagctctttagatgaggagtagcaatgcgagtatcagttgagaacttgagatcattgagcactaatgattgttcttgatattgtctccttcgaatgtcaagttcatatctgcagtggagattgagatttgaagagagagagatctgatcacgtctgagggagcaaacgaaatctgcaatctcgataccgctcgagaacgagtacaagattttcaaatgcagagcttccgtttccatgtgactcgcatggaggttaccaacaactcaaacatagggattgcctacggcacatgttttcgtggcatcatcaccacatggaagtagaagctactggctgtttacttactgatgataaatgacccacctgaaactcatcattgggttcgggcatctaagatgaccggcagagcatctttcctgtcagtgtgtctgttcatccttgtatttgaccagaatgaagaaaacattggatgctacccatgatggaccgatgcactgacaaacagttgaaaccccaagttcaccacaccgaccaccaacaatacgggcatgaatgaacggtatggaatctgcatcctttgcaaattgcgatggaggaattcgcccatgcacagatctcaagacaatataattaactatctgttgcgattttgggtgactctgtaatatgtagtgtttggtttcagagtttagttggccgctcaattcaatcaccaacacctacaagaggaagtaaaacggaagtaaaacgaagtcgcaccaatacagaaatatcctctcaagatactgcatctttgtggtcccaaaaacaacccaaatggatcaagaaggaagagagtggtaccaaattctaggttggagcaatttcagcaagccactcatacactagccatcgccacatgtctaaaaattaagtttcataaaagcgagcttttttgttatagcaacagctaaggattatgaaaaccattactcacgtatcttcggatgcggtattggattgacgcatcataggttgagaaatagtgatcgacgaggtgtcattgatatgtttgataaaagacttagtaactggaaagggaaattctatcgtcacgaggacgtttagtgcttattaattcagttctcagcaaccttcatattttcatgatgtctttctttgaaatactagcaggggtgtgacaaaaatggatgttattcgattcttttggtaaggagactatcacaaaaagaaatacaagctcgtgaagtagaaaattatttgtcaaccaaaggagctactgagctagatggcctaggggttgtgaatctatgtaccaagaaaatttgcttattcaccaaatggttgtttaagcttcttaacgaaaatggagtttggcaacaacttctcaaaaacaagtatttagg

SEQ ID NO: 4389 - DNA, 2224 bp, Zea mays
gggtacctcgaggccggccggtttttttttccctctttccgttgcccttttcccgttccctgccccttcttctccgtctttctccggtcggctttggagaaagaggtgatgtgaggttcccatcactcacgcctggctgggtagctagatgctcccgggccgtctttattacggctgtcgccgggctgggctgcggtcggcggcggaagggagtcttctggcggagatatgagaggattgttttagtgaggtctatgagctggtaccagaactgctcataatattcaggggaaaaaaaaggcaacatggcggaatcgaaggtcgcaagtctggatgcccgaacgacgaagatcagaaacgtccccatcgcagtgaccccagaagggttctggtgctgcccgtcgcaagccgtgctccagaagacggcgaagagccaaagcccgcaggcgaagacgaagcccagagggggtgcctcgcctctcgcaccaaaggcggcaccaccaatccagagggcgcccacaatctcgtccgagagaaggacgcactcgactccgaccagggcgaaaaccaactcagaggagcagaggtgcttgccgccggcggaggacgctgcggctaataataatgccactaatccgccgaaggcagtgaacgagaggccacagaagcagcacaaggtatctgttgggttcggccagctcgagacgagtgacttgaaggtggtgctgtatggcaaggacggcgttgcggtgaagatgagcgtccacaagaacaccctagctggaaacagcaccttctttgctgacaagctctccgggcagtctccggcgtcgagtatagaagtgcctgactgtgaggatgtggagatttatgtcgagactgttgggttgatgtactgcagtgatgtcaagcagaggcttatcaagcaaaccgttcctcgtgttcttcgagtcttgaaggttgcagagctgctgggtttcccagcatgtgtcatgtcatgcttagactacttggaagcggtcccttgggtcggggaagaagaggagaatgtggtctcgtctgtccggaacctgcagagcgagagctatggcgtcagtcctgtgctgaagagggtagcaccatctgatcgaacaaccccaccaaacgatacgttttcacatatcatcgaactggtcttgagaagcagcgaggacagggggcggcgcgagatgaaatctctggtgcagaagcttctgaaggagagtagcactggctgcatgagtgggtcttccgacctgtgttctgcggtcctctacagatcatgccggaactgcctggattccttactaatcctgtttcagcaagcaaccgacagtgatttcgctgagcaggctcttaataccaaagaaccagttttccgacaagttgctctagaagcagataacctgctctggttagctgagatcttggctgacaggaatgccgctgacgagttcgcggtcatatgggctagccaacgtgagctggctgggctgcactctaggttgccagtcaagtcgcgccaccttgtcagctgtgtcacggcgaggctgttcgtgggcatcgggaaaggggagatgcttccttcgaaggacacgaggcggcttctcttggacgtctggttgcagcctctcatggatgactacaactggttgcagcacggctgcaggtcgttcgaccggaaagtggtggaggaaggtgttgggcggaccatcctgacgctccctttggaggatcagcagacgatcctgctctcgtggcttgggagcttcctgaaggttggggacagctgccccaatctccagaaggcctttgaggtttggtggaggagaactttcgtaaggccctatgctgagcagcaaggtaatcgatcgcaatcaggtcggagttgagatgtcaattggttgcagaagaagatagtcttgtttcctagtgtagtatatttgatgagaagttagggtggcggtttcttcttgcgtggtagcccgcgtgggagatccccagtatgtggaggaaatgcggttagtactcttgacctgcgtgaggcttgaggaagttcgcgttgtgcttgtgatgcttcgtatgtatgtcaagatctctgaattctgggtgcagaatttgtatcgtcaggcatctgttttgatgctctgttctgcttctcacaacgttgcacgatgttaattaaggatctgttgggggggccccc

SEQ ID NO: 4390 - DNA, 4046 bp, Zea mays
  misc_feature (465)..(465): n is a, c, g, or t
  misc_feature (2992)..(2992): n is a, c, g, or t
cgaccgaaatttaaaaaatgtgacgtatgacatgaaaatattaatcgggtcaggtataaaaccctctccatacgatctctattttttgatgaaaatggtcacgaaggaccgttttcattagtaccattttctaacactgaaaatatagcatcgttaaatatctaagatctactaaggctccgttcggttccattagactaaagtttagtctagggactaaattttagtccctatcctgtttagttgtagggactaaacagattctaaatacattaaatataacacataaagactaaaatgctctttcttttgtttgacaccagttttctagcaagagtaattgaagtaaatattgccctttagtcccttttagcacccatgcgaggactaaagacactcatgtgaggactaaagactaaagtctaattagtctctactttagtctttacgtttggcaaaataaanactagacgtgactaaaaattagagactaaagatgagtacctctaaccaaacgggactaagcattacggattaaaaatctgcaggttccgggtttagggttctggtgccctgatacgctgcacgcagaccgcgggaaacacatgatccctgacgtgtggccccgccgcatcggcaaagtaagctagggactcggaatcggacggacaaaaagctgcagtaaaaaatctttcttcgcgaggccgcactgaggcttgactgtgtgaatcaccaccattcgcagcggcgtggccgagccgaaggagacaggcgaatccgagtgacgggtgtgagtgtcgttggatgaggaccgagaggggcatctccagctgcgccgagcccagtcgagggagcaagacgccggaagcgacgcgccccgtactctgcatctctgccgccgccgctgctgctgcttgcttctacagtcccctggccccctgttgctgccctgctacgatggcgatgcaacacggccaccagtagcccctgctcgctcctgccgcagcacgcgacgggaaaggcccaaagggaggggaggcgagaaagaaaaacaaaagatgggatcttgaggaggaggtgctgggggtggggaggcggcataatggcggccgcggtgtgctagcgggctaaagggggtgcactactgattgctgatgggttaaaggaggtgcaggtggtggtggagatggagtggacgcgttcatgcccgcgcctagctagctagctagcttacctgtccacgcctctgtgctgtgtcctcttggctttctctttcccgctctcctcctcgcttgccccccgccagctctccagggagtggactagtgcagggagggagggagggaagaaaggagcggtgcccctgtgagtgaagccgcctctcgtttccttgattgattggagccgagccggaatgtgatgcgagagaggtaactcctggccagcttcgtcccaacgtaacggtgcttcgtgtccgccttcgttacttcctgttcccttcgattttgtctgtgtgctagctatgtgatgtttgactacttcttcggttttgtcttggtgccttcatttggaagtgaggggggcggggaacgtggggctgtgatccaggcagggtgccttgatttccaattccaagagagggggtggggaatgtgggactgtaattcagggtgccctgcggttaggttttgtgccaatttgatgtgatgcctttgagcatttgtgcccggtctagagtgaggttcagtatgttgttggttcatgttcttgttgttctagtaattgtttttactgcttgcggtgcccttgcttcgaacatgctaacttgctagggtttgaacagagatccagactattctggtttgttcaaaggttgcgggctccaattaattactgaccggtaggaaatgtagagatccaaactattcttctttcttctttcttacttttatgtggtagtcatgtgatgttctagcagttcctggttttgatttggtgccttagtttgcaagattggaagaggcggggaatgtgacactgtaatttagagtagcttttggtttgcttctgtgtccattcagttcaatagtgaggttcagcaaattgttggttcctgttcttgtggttatactagttgttttacacttctataccgtttcccgtgctcctgattccaatttgcttacttgctatggtttgaatagagatcagaactattttttgtctgtacaaaggttgcatgcaggcttaccaattattgagcgctaggaaatttggagaacctgagcgctgcaatgctttcttgtttcttaattggcattcttcgctatacacagtgtatcctaaattcctaatttagtcgtttgcttgaagtccgaactaaacatttcgacccttgtccttcaggtgtgcagattagaaccgttcacagcacacaactgtgctttcctctgaaggccaaacacccccatccagttagccatctctgaaggaacatacaggctttttcataagatagtcatggcagagttcaagatcggtaggctggatggccagccaccaagggtcagaaatgtgcccattgccgtcaccccggaaggattctggtgctgcccatcacaggccgcgcttcagaagacagcgaagagcccaaaccagcagggcaggcctagagggggagcatcccctgcaccatcgaaggcatcctcggttcagagggtgccaaccatttcttcagagaagagagcacagtccactcctactaggtccagaacccattcagatgagcaagtgtgccctccagcaaatgctgttgctgcccctgatccgccaaaggtagtacctgcaccggcaccttttttgccgatagaatctcgaggcagtctccggtgtcatgcattgaggtgccagattgtgaggatgtggagatttatgtcgagactgttgggttgatgtactggaagcggttccttgggtcggcgacgaggagganaacgtggtgtcgtccatacggaagctgcacggcgaggatcacagggctaaccccttgctaaggagagtgacatctgacaccctcgcaaatctgccgaacgacacccttgcgcacatcattgagctggtgctgaagagcagcgaggacagaggctggtgcgagatgaagtctctggtcctgaagctgttcaaggagagcagcaatggcagcgccaatggttcttcagcagactcgtcctgtatcacgaccttgtacgaatgtttccagaactgcctggattccctcctggtgctacctcgcgaagctaccggtgcagacgagcttgcggtcgaagaagaatcgtcgtcaggcagcaaagagcaggcgttcagaaagatcagaaagatcggtctagaggtggacaaccttctctagctagctgagatcctgtcggaccggcacgcggtcgacgagctggcggccatctgggcgaggcagacggagctggccgcggagctgcaccctaggataccggtgatgcaccggcacctggtgagctgcgtgaccgcgaggctgctggtggcggtcgggagaggcgcggcgctgccgtccagggagacgtggcagtggctgctggacgtgtggctatcgccgctaatggacgactacaggtggctgcaacacgggtgtcgctggttcgaccgcgccgcggtggaggacggcatcgagcaggccgtcctaactcctgacgctaccgctggaggagcagcaggccgtgctgctggcgtggctgggcaggttcctcagggccgaaggcgacgggtgccccaacctgcagtgggcgttcgaggtgtggtggaggaggaccttcatcaggccgtacgccgagcagcctgagagtgggagctcgtcgtggtcgtcgtcatcgtcacggcgacactgaccgttgtccagcggttggctggaaacgacaacagtccacacgatgcagtttctttcaagtgtctgtactcgttggagtcggtgcgggaggagacgctggagttgtttaaacacaataaaattggaacgtgga

SEQ ID NO: 4391 - DNA, 1262 bp, Zea mays
tccacgttccaactttaccgtgtttaaacacctagaacatcctaatcgaaacccccactggtccctcacggcagtcctccctccgccgccccacctcccccaccgttcctccatccgcggtctctctgacgtctcctaaaatctccgccctccctcgtcccaccccagatcctcctagaagctgcacggcgaggatcacagggctaaccccttgctaaggagagtgacatctgacaccctcgcaaatctgccgaacgacacccttgcgcacatcattgagctggtgctgaagagcagcgaggacagaggctggtgcgagatgaagtctctggtcctgaagctgttcaaggagagcagcaatggcagcgccaatggttcttcagcagactcgtcctgtatcacgaccttgtacgaatgtttccagaactgcctggattccctcctggtgctacctcgcgaagctaccggtgcagacgagcttgcggtcgaagaagaatcgtcgtcaggcagcaaagagcaggcgttcagaaagatcagaaagatcggtctagaggtggacaaccttctctagctagctgagatcctgtcggaccggcacgcggtcgacgagctggcggccatctgggcgaggcagacggagctggccgcggagctgcaccctaggataccggtgatgcaccggcacctggtgagctgcgtgaccgcgaggctgctggtggcggtcgggagaggcgcggcgctgccgtccagggagacgtggcagtggctgctggacgtgtggctatcgccgctaatggacgactacaggtggctgcaacacgggtgtcgctggttcgaccgcgccgcggtggaggacggcatcgagcaggccgtcctaactcctgacgctaccgctggaggagcagcaggccgtgctgctggcgtggctgggcaggttcctcagggccgaaggcgacgggtgccccaacctgcagtgggcgttcgaggtgtggtggaggaggaccttcatcaggccgtacgccgagcagcctgagagtgggagctcgtcgtggtcgtcgtcatcgtcacggcgacactgaccgttgtccagcggttggctggaaacgacaacagtccacacgatgcagtttctttcaagtttcagtagtagtaggagactttgagttaggagacgctggagtttgtgcctctctgttgttgtaatgctttgggatcgatttgacaacccgttttgatttcttggcccaaaaaaaaaaaaaaaa

SEQ ID NO: 4392 - DNA, 711 bp, Zea mays
attgtgttggggtcacctgttgatacactgtcaaagaaaaaggcacttgaaaaatcaaaatacgagcagtcgctggagacagttcggcgtttcattgcaatatccgagaaggaacttgagctttattaccggcatgtcgcactttatggaatttcacaatcccagaaatctgatcttgtttgcggtgatgatagagaagcttctttgctcaaaatggagggattggatcgagggaagggccaagagcctcacctggctacgaatcatttctctgatcttcacatcggtgatgtttctgaatccgacgaggaagatagttccggcagtgaatatgatgctgctgacgacgacgagaccgaaagcatggccagcgtttctgaagacgctagctagtgtttctgatcatggcggtttagccaactgggcccggcgaagtgtggttaccttgcctcacataatgaccttgttggctagaaatttgccttggaccgagccacctcatcataacatgcttctgttgtcagctgtaattaagcttcttttttttttggtgtggcggtttaccttgaaggacttgatgtatgccagtgcaacaaattcagccaaatgtggccgtgtatctaacatatccttctaataaaattgctccctccttgctgtcagaggagctgggacagacgtgacagctgtggaagagtactatacattacc

SEQ ID NO: 4393 - DNA, 2249 bp, Zea mays
cattgggaccctcgaggccggccggaggaatgtttgttggagagggagggaaaaatctaggtcataggtttccgaacgggttggctttgatggagcaatagaacaagtgggctgaaagcttgaagtaatgaacggctcgagttgtgcagctttgccccgcattttttttttgaaaagtgcagcgttcctccgtttcgcttctcccgctcccttccgcaacggcgtactccctccgccgcccgccgaccgccgactcccgccgcgaaatcctgcgtcagaagcgccgattctcggacgtcctccggatctgagacaccgagcgcactacgagctgtagctgtagtgacctgaaaatgagtgagggggatgctactcagcttgcccttgagaaaggattaccacaagtgtctaatgatgatggttcgagtagtcctgcaactatgcacaagttgaaagttgacacagaagatgctggaagcaaaattgaatcacccactccagagaagcttgaatctagaagcaaaggggttgttgtgagttcgttggcaaggaatttacttgcagagaggtacaaagatagatttgcaaatcagttcctggaagatgagggtgacatagatgatgaagactataatgacagtatttcgccaggcatgagccgatctcagagatcaagaagcattgaacttctggagaagcacaaggatttactgaatctttttaatagaatggagagttctataaggttgctacgcttacggaagaggatggctacatttaataatattgccacccaggtggaaatactcgcaaaaaggaagttatcgtactgtcatttggcccaaatgaagtatttgtttccagaagcaatccagattaagagggtacttctacatgacgagaaaagcctatgcatgtatgctgatatggaaatcatacttgtaatggatgttgtggaatacacaagtactgatcactctccatccatgacaatttgcgatgctttttactcgaagcttttgacatttttggatgctcatcataagggtacagacattccagaggcaatcttaccagaaccctttaacttgaggtcaaggggccagttaaatcttgaggcatcacataatggacatgctgctgagccacatctgcaaggcaccactaaggatggattctcaaatgcttcccacttcccacaatcttttcgaaagctaatgtcccagaaagtcattactgatggagctgaaaggactcaattgctacttgatccaacaaaactgagctctgtgagtgcttatgatacagaaggaacaaacagaagccctaaaaagcaagacaaacatgcttcagttacagtgaactctgaaatttctgctactccaagccgtcatttgatctctcgttgtcaagagggtacgccaaaacaagagaccttagaatcaccattgttggctcaaacaccagcaactcagacacccaaaaggcaattgcccactccacttgagaaacttgaggccacatgtggacacatttctgaaccacgttcagctagttctgcccgcagatcactaaatacatctttaaaatttgaagggggaagcccttcttatcatgatagaatggaacatgtggctacatctaaaattggaattttctcggaagattcatctagtttcaacaagtcattagaggagaatggtcctgtcttctttactgatagagacaaaatcaatctggcagacccagtgggtgtccaggaaaagattgcttcgttacgttccacatttggcatcgtctgcgatatttctcgttctatcaagaattcgctaattacaaaacaggagcttttccataatattcttgccaacaacttggagatagaacagatgggagagatagaagagcagctacatattttagaggatctggctcccaattggatatctaagaaggtgataaatggagaagaaatactttacagctttgaaactatagcagatcagaattcagtgtgggaaaggcttgtagaagctgtgtgaggtgtggaatagctgggattggtttaaagctaaagaatcagccgcatagtactatgtatgtaacgctaacggaacccatcaaacagccacattttctcatcatggaatcctcaggattgctcttgtcttattcaattttaattttttcttctgttgcattgctaatgtgctaattacatgcttaatactgaaatttctacaagacat

SEQ ID NO: 4394 - DNA, 12393 bp, Zea mays
  misc_feature (642)..(642): n is a, c, g, or t
  misc_feature (1813)..(1813): n is a, c, g, or t
  misc_feature (1999)..(1999): n is a, c, g, or t
ttttgttgcacgcccctacttaccgtaggctatgccgttctccactgcagctcttttggtactgtataatacactccaataggattaggatagagtattttgtaaggtgcctcagcgcaaacagcctaattaagagatatattttgtcatggatttggagaatcttctcaaaccacacacagactctaccaacaaagctttcatcgaaagctgtttggcagtttctggcgaattccttgcgagtgataaaagcttgagattgctgcatcagcacaacattactgatggtgatgctttggctttggagccagccctgcctgctaggacgctaggttaccaaggttactagggtgctctttttgtctcttgcaggagcggcagcccccctgcactgcactcccaaaaagggagaaacaaaggcaggcctagtgctgtactagtactacggagcagtagccggcattgaagcgcaccactgccactggacagctcttcggttttactgttctctattaataaggctgatgtttatttaccttttagattatagtccatgttttgttactcattcttacggtgagatagattttatcggctagaaaccaaacatttttgtattctatgccttggataatgtgctgnatcacagaatctccaattatcaaccttatgaattgcattttcttgcttggatagtgtgcagtgtgcactatccagattccgaaaattctgcttgttccaaacgtcgccataatttagcttaaataagttggaagttaaacaaacaacacagattatcgggtaaattatgtaatctagatacctagactataataatacataaacaagttaatatatgcttatatagtatatacgctggattatagtcttgtaagcaaataaacatggcctaaaatcaaacacagtgttaagaacatcccactactgcaatccagcaggggctgaagagtgttggctgttgggtttggtttatgaccacccaaacttacttttgccgtccggattatacatatactagcactgcggcggtgaaatatgttggtctctagcaaccagattgtttcgcatattgtgtatacctaaacctccaagagaaacatgcgttccgttgaggctagtgtgccactgtgcctgtgcccaaatacgcagagacctcgaataaaaataacggtgtgcaaaggggcttggccggaatttggtccaagcaccacaacataaatacggcgagggggggtgacactgaatactaggcaaaggtggtggcgcaacgcaacacaagacaagctgcatgcagagattcgtgtccagtacgtacagtacgtgtagagtacagtacacagagcgcccacgcccttgccgcctttatttctgacagggcacgtcccgctctcggtatactactgtaccgtgcatttacggtatccggagccggtacgtataagtacgtgggtgtggtcgcacgcacgcgtacgcacgtcttctcctgcacgcgtctccgagccagtgccggcaggagcgcaccaagcaaagatcgacagcgcgcgcagcgagtgacgaacggccagagcaaaaagccggacgtggaccgccgatggcgacgtcaaagatcacgcgccagcagcgtcagcgctcgctcgatccagcggcacgcagcaggggcaggccatggtggtcgcctgccgtcctgcctgcctggctggcgcaggtggagccgctggagggtgggcgggaaaaagaagacgggggcgactggcgactggcgactggcgaggcgacgaatagtttggctgcncgcctgcgccagcgcaggtactactagtgcagtagtgcacaaaggcagcgcagcgcgcgagcgaggccgaggcatccactgctgcgtctgcgtctgcgtctgcgtgcatgcatgcacggccacgggcgccgcggcaggctttgtgagttgcgaggccatggcacgccacgccacgccactacgggntacggcaccggcaccggcagcaggagacgggcagcgaaagcgtgcgcggccagcgagcatctcatctgagagagagacctggccggcctcaaaagaggtgcgggggaaggcggcagcggccaggagtccctggcggccggccggccggccgggctcgcgcatgtgattccgtcgcgcgaatattatcgggcacaagaacattttcatcgtcgccgacgaccgtcgaccgatgcgagcgagaggcaggccggcggcaggtggggagggcgctgtcctatgcgtttgttttacagccttacagtgtacagtacccccatcgacagcaggccgaatttctcgattcctgttgaggtcatgtccatgggtaaaaaaaaaacatgttacaattgaatattacatttacttgtaaatctaattgtatcatgtctgtgcaataacaattaaaaaatgttagtcaaattgttatatgcgtttgcaccttagggcagctccaacagtgttagaagagggtagttcacaggatatatttttttgagtaaaaagaaagagaaggataagatttatcttcatgaagagtcaagctcgtacatttttatatggagttagaatgttagatccatcaatggttgctaaacttgtcaagagatgctacttaaatccacgaattttgaaaatacatttctaggttactgaacttgttaagtgatgcaccacatccacacatcactaaaacttgtagaaacaatgcatcgcaggtccattttcagaccaaacggtccacttcgttgtgctacttaacaagcttaggggccgctcatgcatttaactcctttttattatatatatgtgtttatgtatacatatttttctgtactaaaatatattatgttatttaattaaagcaaaaaaaatgtttgaatttttggaaagtaaaatagacatttattttaagacggaagaggaagtatacaaagggggggaaaaggaaaatcatgaaaagttttggtgagaccacactaaccgacaaggtacacataggtagggcagaggcagtgtcccgggtcagccctgatcggcatccacatcggcaccccttttatcgaaaggagcaggagacaggaaagctcttgctctgcacttgcccaccatcccccctccgtggtccagacgctaatctcccatatttgactgtttaacggccgaggtgaggactgaggaccatgcccagcctctaggctctactagcgattagtgattgtgatggtcgtccccatcgtccctccccggctcctccattcgtcaggcgctaatcatggatcattggaaaccaggaagaattgtgatgagatgcgtggcaatgatcacgaggagctactagctctcattggccctgtggtccagcggattcttaattccaaccggttaatcagcctagcgattagtaccaagcactaatctaggtttagccccggtgatttacaactatatccggtgattagccgccgccacgaccacctcctaattgctgttaaatgttaaaggctactagcaagttgcagtgcttaggtgggctgccatcgtcgacacggcgtgcgcttggatgcgagctaatcatgcatgttcacggagaatccagggaagatagactaatgcatttttatactagggaggtgtttgtttctaagaactaatttttagtctctaattttattcaattttagtctataaattgctaaatatagttttagtttatgtatctagcaatttaaagaataaaatatatgaactaaaaattattcactacaaacaaaacacccccctatatatgttaacatctttccaagacgatttttgaatgtttttgagagcgtcgggggaactgtacgtactacatctacatgcgtggcgtggcgcctatggggccagctggcagtattttttagatgctagctaggctagctgctgcatgcactgtcggtatttatatcagcgtaagatcgggaagatctatagtagtagtacgtggaacagcgtgtttgacgcgacgcgatctgttttgcttccagatcgaatgctttttgtcctatccgatcgctaatcatgagctccagcgtcacggcccttgaaattgctctgctacgacattccattgggaataatgaacacgtctaggatctgctggtttatgttggcagatgacaatttgaattatatagaacttttcttcattcgagatggtatactttgtacatggtccctctattccgaacgtggttgcgaaacgacactaggaatgtgagttttaggagagacaagggagcaggccggtattatgttgaacataagcatgacttaaaaccaacacacgaggttaaggtcccagtgtacgtaatacaccatatgccgttacaactcatctctttcttctcgtcgatggatggacataaatatgaaaaaagattacaagcttatatatagcacaaccgaacatcataacatcccggttctcccctcatctcttggttatggcgtaggttctagcctatttatcctaatccacctttataccagctctataatagagtgtggcgaatatctatctaactaggagagaagtcctcgattgaacaaccaaactattttttttatacgaccatcctttctttaaatgttattctacacctccttttgataaatactcggtttctatcatatatatggacatgtatgtagatccatgccttcaactgtgccacaacataggagttctccttcagtcggctaccatacgcataagttacaagaagttattgaagtcgtaaacaaactgagttgtgaagatgggtatggatgggcggggttgtagtttttttcttcctattttaatccataagggcttttttcagtttggtggggattacattggaggtcaatggaagatagctgaaaggtattaaagggaattaaatcctctacaagctaaaataatgtcgtggagaagaataactaaactaaccctaagaggaaaagtttgtacaatggcatgctaaataattggtaaatcacaatcacgagagatcgaaattagctttgtgggaaatgatttttaggaagtttgcatgcccatatagcagttggacccaaagctcaagccgatgagaaaaattgtgacaattcacgtatacatcaatactcccgtgatgtataggcttctttcgggctcaaaataaaagttaggtatggtttattttatttaatcatgctcaccgtgacttgaacctgataacggataactgcagtatcatattgaattgcatggtcaattaagttagacgaactccaacggtaatctatacaaccatataatccaccactttagactttcaaaaaagacatacctaccaaatcactctcgcactcatagcctctattaactacatcaaacaaatttgattaagacttaacacaccataaaaaccaatggtccaacaacctccccttcttaccctctattttaaacttcactttataaaacagtgcagtctaatgtgggaaaaaaatattttgcacgtgttcatatatacacgcttcggagaagatggtctaataagtaagtttgcgtgaatgaatataaatggacagttaggtctataccgtgttgagaaaaaaagagagagagagcatatatcggtcagggtcatggatatatcttttccaacacggactgcgggtgttttggcatttgacaagaggtactgtgtgtcatgcacggttgcatgcgctcctcctctcattgatacgatacgcacacaaaaacctaatcaagtactagtagtaccggccgggagcacggagtaacatgctgcgttgatgaaaatatggatgaggcacgcggtcctcctccaactccccatccaaggaccaaggctgactgcgcacgctgcactccatgattactggtggcgattgcgtgatccgaaaaagagattcggcgagcccccactgcggaggacaccccgctttccgcttcgttttcgttagtcccgtccggcgggccggctggtggtggaggaggtggacgcatgcctggccggcctgttgcgttgcccaaaacaacaccaaagctagctcgactagcgttcgtcggcgtctgacgaagcaatgcctggtggatgcaacgcagctcatccgacggcgcgaagcgatgcgtcgccttgtctcatgagttgtgacttgaggccgctgcccatgcccagccaggaggcaggcaccgcgcccacacacacacactgttcatgctggatggccagcaacgggtagcggcggcctctatggccaccagcatcgcctcatcggccggccccgactcccgactcccgagccgcggagccgcccccactgacttgtgacttgcatgcagggcagcaggggccagctcgaaccccaattcccaagcaaaactggcagccttttttttctttcttttttacgagcactggcctttgcatcagcagccactgtgctgtgcctgccagccctgcctgcaactgcaacagcggccggccgcagccttgcacagtcgcattgcaccgcacaggggctaaaatgggaggctactgcctactgccccgctacagctactcagctagcgcccggcaggcttggctaggtgccgtgccaggctagcggccacatgctgggcgacggctgtatgcctcgcatcggatcctagagcctagcgtttgcgctggacgccggcagtgcggcccggcgcgtggcgaggctgcgttccggctgttcccccagtagctctagtagcagtagggaccggactaccggagacaccggacaccataggaataggatggagcgagccatggagagagagacctggaccctcccgtgccgtgccgtgcgcgcctcgttacgttgactcatgtgtcaacaaatgccgaccattctgtgaggtctgtctccactgtaagctgcggctctttcaaaccgaaccagtttctacaaaaaaaaaaatccatgctgtaaaattctctatgcacaggacatgagtacacacgtcctaaggctgcactcgagtgtcatgagtcctaaacaattccaccctgtgactgtgagatgatgctagcagcaacggtgacatgccgtagaaacaactgctttggacgccgtagtcaaacccacgtggtttgggttttcgctccccctttctttcttttttttttcctttccccaccaccacccctctagctttggagcaggataaacagatcttttcacccgcgcgcaaaaaagtaaaaatattcattcacccgatacgatcgatcgcaaaggggatgggaaaagctgggttctacacgaaagtactcctgctaccactacgggaacgctactgttccaaatccatgcgtcggcctagctgacaaagaaacaaagtgcaagaactccccgactttttttatataatatatataataaatatgcggaaaagaaaaataaatgggaagaccggacgaggtggctaaaatatagtagtagtatagcgcagggccccaggtcaaggaggccgagaccgtcacggagaggaagacgagcacgcgtagcagcagcaggaggcagtggtagtaaaggggcaggtagtagtagtaaatgccagcctcctcgcctcaccaaaccaacaaaacaaaccatctgtcctcggctgcccccgtgcgtgtttcttgggactactacgacctctgctggtgctggccctggcctgcgccctcaacagaagagcgacgagagagagcccgggggcagaaggccagcgcccagcagcaggaggaggaggcgtgaaatgtaagcaagcggaggggagggacacgccgagctgaagccgcagagaagctgtcgtcaactgaactccgtctcccaacgagagagagagagagagagagaggtagcacagcagcagcagggcgagcggcgccgtgtttcctgcgagcccgtccggccgccatgaagttcatgaagctcgggtccaagccggacgccttccagaccgacggcggcggcggcgacgccaggtgatcccctcctgtcctacacaatcttcgtcctcctcctccgcctccgccctctcaggccccagccattgctcccgccgtgaccgaacggcaacgcgtacgtacgtgttcttggctgcgatctcggcccgctctccctctgtacaagaaaaacggacgagggcagcaaacctgtctatcgccatgtcttctagttctagcgtctctgtttcggtagcacgaacaagaacaacgcaatgccatgtgtttcattcgtgcctgcctgcctgcacgcctggctcctaggattaggtcccttgcttctctcttacctgcggtagcattagcaacgctgcgttctgtgaacgaagagcaaaccaaaaagaaagggctttctctgcaagcgtggatctttcggcgcgtgtctggagttcttgattcgtcgagttgaaaaaaaaaagagagagtgccttttccgttgggttacggtgtcacagtcacagaacctgccggcgtgctgtgcctgtgccgggggctgccggcctgccgctgctcgtcatgagtgctcgtgtactacgtggttccactccacggcacaaagctgaattgacccggggcgacggcccaccctttttctcgccaccaaaaagtcccttttggttttggctgcgccaacacactcatagcggttgtagaagtagttgtggtgtgagggaggatcatgaggttacgtttttttttgactgcctgtgatgaggaccacatttggtgcatgttcttcagctttgtttggaggtcttggacttgctcctaaacttgcaaatgcttgccttccatttctgtttgaagcccaccatcccacccctacccgtgtttcttttttttcttctcccctgttctgtacctgtatgtgagtaggcttttgattgaacatggacagcagcttgtgaacagatccattttttttaaaaaaaatattgtatgttttgtgcttcaaagtcttgtctccatttctaaagaaaagtgggtgcttttcactactgcctttgtttctcatggaaatcagatctacagtgcactcacttcaactaagcacaagcgcaaaaaacaacaacagagccttttttactcccaagcagcgcgaggtaggctagagttacaatccaacggaaagtcactaaaccaagtttatcttttcatgtcaactttagtcctcccccttttattattatcatcgtgtcttagaattccattatgttaaaaaactcagccggggaggaaatggtgctccaaaacattgattccaaccgagaaaaccccccaacaacatcgtaaaccgagagcggatgagacacaacgagttaacaaaagcttgaaaattcgtccccaagaggaatcaaatccaggacttgaagtgttagtcggaagccttaacctctatactggagacgtttgccagaattccattatgtattggtgtctttggaggtattgatgtatccaaattatctcaatcgatgttaaataagtatctttttttgagaaaaaacggaataatatactgacttgctgtgaaaggtgtagtcgtcctgttgtgctgctaaccggtagacgttatttctgcgtttttttttctctttcgtatatgaacgtgccttatgaatatattcattagcaatcatgttatgttgactacgccaatctcatattctcacgcagatacgtgctgtcagaccttccgtcagacatcgtcgtccatgtcgacgacgcaaggttctacctgcacaaggtaactccacaccatttttttttaaacttaagttacgaacctaagtagagaggttaggtcgctgattgttcccccaaagctgatgctctgtactcgagagttaaaaacaatggatccgccaaacatacagcttatcagcacacgagaagatgccgcaatagtaacgtcttttgtcaggcgccacctgtaaatttggatttttgctgctctcagaatctttcccatggttcctttgcttctgctgggtaccatgcgattaaggaatgccctcctcttcaatactttgacaaatattaatgctacaagaaatctagaaacgtctactgtctacggtctactgtccaattatacggccaattcactgttaagagttttggtaaactagtctctgaaagtttggtcactctggtgtccactttgcagttcccccttctctccaagagcggtctgttacagaggctgatagtagaggcgagccagaacggcagcgacgaagttgccatacaagacgtccctggcggagcgaagaccttcgagatctgcgcgaagttctgctacggcatggtggtgaccctgaacgcgtacaacgtcgtcgccgcgaggtgcgcggcggagtaccttgggatgaccgaggacgtcgagaagagcaacctggtgttcaagatcgaggtgttcctgagctccggcatcttcaggagctggaaggactcgctcgccgccctgcagaccaccgacgcgttgctgccgtggtcggaggagctcaagctggtcggcagatgcgtggactctgtcgctgccaaggctaccgtcagcgcgtcgaacgttgtgtggtcgtacacctacaacaggaagtctgcgtcctcggacgagatcgtcgaggctcgcaggagctcccaggcggttcccaaggactggtgggttgaggatctgtgtgagctcgatgtggacctctacaggcgtgtcatggttgcggtcaagtcgagggggaggatcccctccgatgccatcggagaggcgctcaaggcatacgccgctagatggctgcctgagtgctgtgacgcgctggtagacgacgcctactctggagcgtacaagcacctgctcgagaccatcgtctggcttttgccctcggacaaggggtcttcggggatctcctgtcgtttcttcctgaagctgctgaaattcactgtcctcgtcggcgctggggagctcctgaaggaagagctcatggacaggactgtgttgcagctccacaaggcctcggtcagtgatctcctgatcccctccaggcctccggcgcagaccgtctatgatgtccagctggttcagacactcatcggcaggtacatgagccatgccggggtatctcaaggtgggatttttctcaacgaccttgaccaggagatgtttgagacgaacgtggacggtgaatctttgctagcgttgtgcaagctggtcgataggtacttggctgaagttgcctctgatccaaatctctctgtttcgagctttgtggatttggcgacttccatgcctgaaacagccagaccgacacatgatggattgtacactgccattgacgtatatctgaaggtatgtgtcacagcaaccactttgtttgaaacctaggacacctagctaaaaaattgttcgccctgtgatgtccagttgcatcccggcctacccaagatggagaagaggaagatttcgaacctgatggacgtgaggaagctgtccaagggggcgtgcatccacgcggcgcagaacgaccgactcccgctgcgcgtggtggtccaggtcctcttcttcgagcagctgcgcgccgcgggagccgccgccgccgctgggacgcccagcgccagcgtggcgcggtgcatagcgcgcctggcggagcaggaggaagaggaggagcgctggaacgacggccgcgcgctgccggagcccccgacccccggcgcgctgaagaggcagctggggagcctgaagctgcagggcgaccaccaccagggcgcgggcgacgacgggcggcgcctggtggcgcgcagcaacagcgtggccaaccagagcagccggatgtcgctgtcgtcgcggtcgcggaggatctttgacaggctgtgggtcggcggagcgaagctgcccggggaggccgccgccgcgggcaaggggtcgtcggacacgtccgggagctcgcagagcccgcggtcgtcggcgaagccgccggagtccaagtcgtccagctcgtcgtcaaggaaccggcggtactcggtctcgtaggccggggccgggggccggccggtcggcggcggaggctgtacagagaggaaggagagcctggtccaagcctaaacgtagctgctgctaactttcagagttcatgttgatctcgtgctgcctgcagtatgtggcatgcagctagaagaaatctttgttctgtcagtccagttgttctatctaatcttgagataatccctggtttctgtaacagacttggaaactatgattcagtcgaattctccatgaactgggcaatcctttttggcggcccc

SEQ ID NO: 4395 - DNA, 1150 bp, Zea mays
ctcggcgccggcccggccggggggaagccatttcggtgaaccctgcgccaccgttccggtcctcccgaaagctaagggagacgagcagcctaaaaaccctagcccccgaatcagatccgaccgcccgccggagcgcggaaccctgcccccggccgccatggagatgagcgatgcggagcggctgttcttcttcgagatggcctgcaacaactccgaggtcgcgtacgagcagaaccccaacgacgccgacaacttgacgcgatggggcggagcgctgctggagctatcgcagctgcgtaacggccccgacagcctcaagctcctccaagatgcggaagccaagctggaggaggcactgcaaattgatcccaacaagtctgatgcactctggtgcttgggaaatgctcagacttctcatggattcttcactccagacactgcaatggcaaatgagttctttgcgaaggcaactgaatgtttccagaaggctgctgatgtggaacctgcaaatgagctgtacaggaagtcattagacttgtcagcgaaggcacctgaactgcactcggagatccataggcaaatggcttctcaagcggcaacacaagcatcctcagcctcaaatccaacgcaatcaaggaagaagaagaagaagaaggacagcgagttctggtacgatgtttgtggatgggtgatccttggcgcgggcatttgtgcttgggttggattggcaagagcaagcatgcctcccccaccggcaccagccacgtgaagctgatcgagtgccaagaatgctttgcaaatgttgttaacatgcccccatgttaaggtgcctcaggcatgggatctttccaggtgttagttttccatggagaggagagagtggtgtttccatacgggttggatcaatttttcatgcttgttcttttcggagcctcgatgaggtttcccttataatcggcatatgctgctggataattttgtacttgcttataccgttttgagccttaaaaaccgtcacgacgttgcgactgttacagctgtgttcgctatgaatcctgaaatggtgcccatgcataaagtggcaaataaatgtatgcggctgtttgtttaaaaaaagtttaaaaaaactagagggggggcccggtaccca

SEQ ID NO: 4396 - DNA, 1102 bp, Zea mays
ctgtgcggcgctcgagccggcctactgcctcgaggaccggccgctccggctctccccaattctaagcgagacggggcacaggaagaggagagcctaaaaccctaaccccccgaatcggatccggccgccggagcgcggaaccccaccccggccgccatggagatgggagggatgagcgacgctgagcggctgttcttcttcgagatggcctgcaagaactccgaggtcgcgtacgagcagaaccccaacgacgccgacaacctgacgcggtggggcggcgcgctgctggagctgtcgcaggtccgaaccggccccgacagcctcaagcttcttgaagatgcggaagccaaactggaggaggcacttcaaattgatcccaacaagtccgatgcactctggtgcttgggaaatgctcagacctctcatggattcttcactccagacaatgcaatagctaatgagttctttacaaaggcaaccggatgtttccagaaggctgttgatgtggaacctgcaaatgagctgtacaggaagtctctagacttgtcaatgaaggcacctgaactgcatttggagatccagaggcaaatggtttctcaagcggcaacacaagcatcctcagcctcaaatccaaggcaatcaaggaagaagaaggacaatgacttctggtacgatgtttgtggatgggtgatccttggcgccggcattgttgcttgggttggattggcaagagcaagcatgcctcccccgacgccaccagccaggtgaactgatcgagtgccaagaacgctttgcaaatgatggcatgcctatattaaggtgtcccagaaccttctaggtgctagtgttgtatggagaggagagaggtgtttccatacggtttgctcaaattttcatgcttgttcttttcgagcctcatgtgctgctggatagttttgtactttgcttaccttgataccgttttgaggcaaaaaacatacagtgttgcgactttttgcgttctctatgaatactgaatgttctcaaatggtgccataaaaaaaaaaaaaaaaaaaaaaaaaaaaaaaaaaaaaaaaaaagggcgccgctcgcgatctagaac

SEQ ID NO: 4397 - DNA, 1750 bp, Zea mays
ctgcagacctgttcacatggggcttgagcctcgtgcagtcaggttgccatgcaagcatctggaagaatatccatggaagaactatgcttttgccttttacctgccaaaaaacttctgtttctgctgcaatgtcgagtgcaatttggtttaactggaaactgaagttcggacctttttttgtaggaacctgcaaatgagctgtacaggaagtcattagacttgtcagcgaaggtgtgttattttcttctttctcttcttcagtatttccaagtcctgatttctgaatgatggtaaactgtggagcactcatgctacagaggctaaactaagcttattttattattgatacggggtttgagtttcaaataatcaggagtgctgtttcagcttgttactattagtttttatatttgttacaacttgcaagttgcaatgctaaaagtagatttggacagcttcagccatcaatcttttacagttgtattcaatcatgctgttataagtggttagcgataatgcacgtgtactattctagtgacatttgcttccgattacctcaggcacctgaactgcactcggagatccacaggcaaatggcttctcaagcggcaacacaagcatcctcagcctcaaatccaacggtactctaccttatcctgttcctatgaactacttaaccacttgtcagagtgacttcagaatagtttcgtgtcggttaaatctaccattctgtgtgttttctacccttttatttatttattactattggtggctcatgatgtggtttagtatgtagtttatcccaaatttgttgagcatgaattgccttttttttttgttttatgcactgttctcgttacaattaaaaatgatttttttaattggtattcctgttgtatatatactgttacaactggaatatctgccccccgtgttttctagagcgtagataaccttcttctgttagaacagttttgacattttatagtttatatactgatttcatatggtatatgtggtttgccttaccctgggccttaaggtgcctgccatatttaagctgacaacattatctgcagcaatcaaggaagaagaagaagaagaaggacagcgagttctggtacgatgtttgtggatgggtgatccttggcgcgggcatttgtgcttgggttggattggcaagagcaagcatgcctcccccaccggcaccagccacgtgaagctgatcgagtgccaagaatgctttgcaaatgttgttaacatgcccccatgttaaggtgcctcaggcatggggatctttccaggtgttagttttccatggagaggagagagtggtgtttccatacgggttggatcaatttttcatgcttgttctttttggagcctcgatgaggtttcccttataaccggcatatgctgctggataattttgtacttgcttgccttgataccgttttgagccttaaaaaccgtcacgacgttgcgactgttacagctgtgttcgctatgaatcctgaaatggtgcccatgcataaagtggcaaataaatgtatgcggctgtttgtttgctttgttttctcacggtgcccacgaggcacttgtacagctatattttcctctaacccgactgtttggatccgagatccatgctccgactgtttgcaagccggctaccgaccacatgatgctgcactgtgagtgctgttaaagtcgtctgacagatccatatgacgctgcgacagaacatgct

SEQ ID NO: 4398 - DNA, 2504 bp, Zea mays
aaaggctatgttgatgatagtttataatagtgatttcatatggtatgtggtttgatgtgtgccttgcctggtgcccaatttatcctcagcctcaaatccgaggcaatcaaggaagaagaaggacaatgacttctggtacgatgtttgtggatgggtgatccttggcgccggcattgttgcttgggttggattggcaagagcaagcatgcctcccccgacgccaccagccaggtgagaactgatcgagtgacgagtgccaagaacgctttgcaaatgatggcatgcctatattaaggtgtcccagaaccttctaggtgctagtgttgtatggagaggagagaggtgtttccatacggtttgctcaaattttcatgcttgttcttttcgagcctcatgtgctgctggatagttttgtactttgcttaccttgataccgttttgaggcaaaaaaacatacagtgttgcgactttttgcgttctctatgaatactgaatgttctcaaatggtgccatacataaagtggacatgctgttcaacaccgcaaataaatgtatgctttgttttttttttcgacagcatgtagaactctggtgttctcaaattttgctttgtgtaattagctgtagaattaggttcaactttattctaaggatctttatcctcccgtcgtcatcgagcccgtttggttcaactttgttctaagtatcttttctgataatctgtttgtgaaaagaatttgagtattttctaggtccggaggaaaataaaagtgtttataaggtttatgatgtaggtgacggttttctagtattgtaacgactagaccgattcagtgtttacgttgatgttagatggttttgacaaaagtgacttttatagaaacaatctaaaaaactgagcatttgggagtctacggactacggtacatagcttctccgcttctcgtgaagctgaaagcagggccatcatctccccgtacccgtcgcgtaccctaccaacgtcgtacacctaaaaccccgtccgggccggccgcaggtgggcattcctggaagatcacgaaaaggtggccttggcccatggtggcgtgtcacgcgacgcgctcgagcgcgggctgatgatgcgttggttggtgcagtaactgcagggccagtcggtctcctaggacctaactcatgttcgctcatgatggacggacgccgacgcgtgcaggtgcaatgcaacccgggtcacgaacgacaccttcctcggtacgaagcacgattttctgtctggcatatacacggtacgggcaaatgttgtgtgggctagaatcagcagcacgacccattacatagctagcagggctgctgctcgtgctcgggcggcccaatcaacaaacaatagttggctcggtggtggcctagaccgctaggagcccaccaaaataccacaccctttcgtctgttaaacacaaaacaccccctcccccggctccggcggtgcaaataccctgcttcctagttcatagtgtcgcgtcctctcgtttccacgtagagacgacgatgtgggtctcggactggtcgagtagaccatgtcaagatcgatgaccagacgccgcgtgctctgcctgtgtttcaaccaggcaacccgtgtcgtgtgcacatctatatactactgggcctcgatgtcctagctcgctctgacccggcacgccctctcctgtccatggctgatgcacggacaagcgcgacttcaaggctggagccgtgtcgcggctcggggcgtacagtaagagcgtggtcgcgcgtaggggtgggcacggctacggagtacggacacggatgatgcatgaatagaagaaagccaaatcaagccaaagcgatgcttccttcctcctcacgcctgctatgctatgctatgctagctttgcacgcgggcgcggcacgttgacccgatcgtaggagcaggttgctggcagcagcaacagtgccggggcgcccggccgaccggacggaccatcaccgtgcacgcatgcatgggcgcgccatgggttgttgcatcggatccaatcggattagcacatgcccctcctcgtcctcgctcatgcatgcatatcaccactccccgtgtggccgatccatgcatgcatgcatggcatatagtatatgagtgcgttgcaagcagcgtccgatccagagtggtaccgtacacgtggtagtgatgaatagcagtgaccgatcgatcagtcgtccatctcctcccgctccccctgttggctgtctgctgctggcccctcaactcacctcacgtgatcgactacgtgagtgagtgacgatcaagcaaggaaggaccatgcatggcgttccttatcatcagcaaaccatattgattgcggcttttggtcaacaaacacgtactacgttccgcagcaacaataatatcccctacttaatgaggtgcacgttcgttcccaggaaaaaccaaaaaaagatatatatatatatatatatatatatatatatat

SEQ ID NO: 4399 - DNA, 1266 bp, Zea mays
aaattttagtgcttcagccgcgcagctgggccaagaggttttttccccctccgcccccttccccacccgtgcggccgcgtcgatccccatcgcctctccccatcccctctcctgtctgaaaaccagcacgccacgtcccaccgccaaccaccgcgctccggctctccccaattctaagcgagacggggcacaggaagaggagagcctaaaaccctaaccccccgaatcggatccggccgccggagcgcggaaccccaccccggccgccatggagatgggagggatgagcgacgctgagcggctgttcttcttcgagatggcctgcaagaactccgaggtcgcgtacgagcagaaccccaacgacgccgacaacctgacgcggtggggcggcgcgctgctggagctgtcgcaggtccgaaccggccccgacagcctcaagcttcttgaagatgcggaagccaaactggaggaggcacttcaaattgatcccaacaagtccgatgcactctggtgcttgggaaatgctcagacctctcatggattcttcactccagacaatgcaatagctaatgagttctttacaaaggcaaccggatgtttccagaaggctgttgatgtggaacctgcaaatgagctgtacaggaagtctctagacttgtcaatgaaggcacctgaactgcatttggagatccagaggcaaatggtttctcaagcggcaacacaagcatcctcagcctcaaatccaaggcaatcaaggaagaagaaggacaatgacttctggtacgatgtttgtggatgggtgatccttggcgccggcattgttgcttgggttggattggcaagagcaagcatgcctcccccgacgccaccagccaggtgagaactgatcgagtgacgagtgccaagaacgctttgcaaatgatggcatgcctatattaaggtgtcccagaaccttctaggtgctagtgttgtatggagaggagagaggtgtttccatacggtttgctcaaattttcatgcttgttcttttcgagcctcatgtgctgctggatagttttgtactttgcttaccttgataccgttttgaggcaaaaaacatacagtgttgcgactttttgcgttctctatgaatactgaatgttctcaaatggtgccatacataaagtggacatgctgttcaacaccgccaaaaaaaaaaaaaaaaaaaaaaaaaaaaaaaaaaaaaaaaaaaaaaaaaaaaagaaaaaaaaaaaaaaaaaagcggcc

SEQ ID NO: 4400 - DNA, 1281 bp, Zea mays
aactactaactagccatatccgcgagagaaacccctcgatagcccgcagcattgcggcgcgcgagcacaccgaaccacccacctcggcggcggcggcggcggcttttctgcctgcgaagagagaaaccaaggagaggggcaactcggaagagggcgaggatgcctcggccggagttccaggcgccgccggatgtgttctacaacgagtcggaggcccgcaagtacaccacctcctcccgtatcatcgaaatccagtctaggatttccgagagggcgctggagttgcttgctctccccaacgatggcgtccccaagctacttctcgacataggatgtggttctggacttagtggtgagacattgacggagcatggccaccactggattggctacgatatttcaaagtctatgctcgatgttgccttggagcgtgaaacggaaggagacctcctacttgcagatatggggcagggcttgggcttgcggccaggagttattgatggtgcaattagtatttcagcaattcagtggttatgcaatgctgacaagtcttctcatgaaccaagattgcggttaaaggctttcttcggttcattatatagatgcctagcaaggggagcaagagctgttctacagttttatgctgataatgtgaagcagagtgaaatgattgtgacttttgccatgcgtgctggttttgctggcggagtggttgttgactggcctcatagttcaaaagcgaagaagtcctaccttgtcctcacttgtggaccaccttcagttactacatcacttccaaaaggtaaaggtgaaaatggtgaggcgtgcagcgatgatgacgataatgagagcagtggcgaagatggcgacagaacagtgggcatatatgaaaggaataggccgaagaagcggcagaagacgaaaaagaacggcaaaggcaaggactggctcctgagaaaaaaggagcagatgagaagaagaggacatgatgtgcccgccgacacgaagtacaccgggcgtaagcggaaaggctatttctagctctgtgcaatgccgccttgcctgcaatgctggctgttcagttatgatgctagttcatttagcagaagcagaaggatttttgtaaagggtgaagcgaggagttgtactggtattcgggagtcattgcatttttagacaacgatgtgaaactgtcatttttgtagaacgtggatgttgagatgaatacagttggtttgcgtgaaaaaaaaaaaaaaaactgcggccgcccagactttggct

SEQ ID NO: 4401 - DNA, 2428 bp, Zea mays
cctcgatgccggccgggacggtgcagagaactcagcggtcatcctcatcttgcgaaacttcactgaagaaccttcttccttttccttcctctacggcacgcgcacacgctctctttcgctctctgttaattgaccaactttctctgtcatcctcgtcttccctcgccacaaaacaccatctgctctgctctctccctctgtcttcccttcctccttccttcccaggagccaggaactccattgcattatttccaccccaagaacacagcacagagtcggatccgaatccacaggagaggcataagcacaactcactccccactccccactcatcagtccctccacccatcagctagccatgggcaaggactgcggcaaacacggcgacgacgacctccggcgctcgtgcaggcgcctgctagccatcctcgtggtcctcgcgctgaccgttggcgtcgtcgcgctgatcgtctacctggtgctccgccccacgcacccgcgcttctacctgcaggacgcgtcgctccggcagctggacctctccaacgccaccaccagcaccagcaccagcaccctgctctccaccgcgatccaggtgacgctggcgtcgcgcaacccgaacgagcgcgtcggggtctactacgaccgcctcgacgtgtacgcgtcgtacaagtaccagcagctcacggtggcggcgtcgctgccgcccgcgtaccagggccacggggacgtcggcgtctggtcgccggtgctggccggtcccaacgtgcccctcgcgccctacctcgccgacgcgctccgccaggactgccaggcggggtacctcgtcctccaggtcaagctcgacggccgcgtccgctggaaggtcggcagctgcgtctccagccactaccacctcttcgtcacctgcccggccttcctcgtcaccgccggcggcaacggcgcgcccggggccgccgggttcaggttccagaccaccacctactgccacgtcgaggtctaggtctaggtctagccggccccttgcctgtctgtgctgctgtgttgtccgtactccgtatacaaacagaggccgccgcctgcgaaggaaacagagatacaaaggcctgccttgcgccatatatcatgggatggctgcctgtctccctcactctctctctctctctctcagctgcactgcctgcattgctggtgtgttactgctgcagttatgcggacgtaaaggatggtaaaaatttcctactttttttcttcttcttttaagtaagattctcctttaacgtacgatcaattacagttggaggggtagcagtaacagtaatttctatgtccagccatttcggtgagactactttcaacacagagaaaaccgattgtacctttgcgcgtctctcttaattaagtcttatgactgatttggtaatcagagaattgaatagaaatgaaatttctctccaaaaaaaaaaaaaaaattctctgtcaccaacaagccttagggctagtctttagaattgaagatgaaattaattcatttcaatcccaatcatctccatgtggggacactgctagtttcatctgatcatgagacgcaagcgcgtgacgagagtacacaaactcatgcaggggggggggggggactctcctccgctgggacgccaaagcggtggttgatcgctcaacagtcaacacccatctaatgacagtttcggttacgagttaggtgatgtcgttttcaaaattgacataatctatagtattaaatataatacaatatatattttaaaattttattctataatatttaggtatctaatttcatcattcatagagacttgataataaagtcacatccttatacaaaagggaaaaccccgtttgttctcccctactttttataaacatcgttcggacagcgctgccgttgccatcgccagtatttattagtggagggaaaattgataatggattataaataagtatagaaaatgatattttatggttgtagtagggtatattagaaaaatttatggtgtgagagagataaagataggggtggaatctggatgacatgacgcaaaagtagaatataaggtgaaatttagagaaaaccgttgcaaacgatcttaatgactttcgaatcttataattgatgagacatgcaccaaaactgcaaccaaacggcccctggaccctgagcattgaatgcaaattttggcgtcctgaatcccatccaaagtcatccaatactacatctcatcaaatggagcattatctggtggcttcatttttcatccaatggtgaacggatatcttacagttctccccctcccacctctctctagtatctctctattttcatgcaaagagatccttgccacactcgaccggtcatcatcttctatctacgatcactgcaggcatgcaagaa

SEQ ID NO: 4402 - DNA, 1030 bp, Zea mays
  misc_feature (862)..(862): n is a, c, g, or t
  misc_feature (974)..(974): n is a, c, g, or t
  misc_feature (1001)..(1001): n is a, c, g, or t
gggtacctcgaggccggccggggcaggcattgctgtgctgtgccagtgatgactggttacccataccatacatacatacaactgctctctctgtggccactgctgtacatacaatcgcaaatatattatgacgtgtctgcaagtgcttcctcacttcactgctatggggcacacacgctctctttcgctctctgttaattgaccaactttctctgtcatcctcgtcttccctcgccacaaaacaccaccggctccgcgctgctcgcccccgcggtcttcccttcctccttcccaggaactccattgcactatttccaccccaagaacacagcacagagtcggatccgaatccacaggagaggcagaagcacaactcactccccactccctccacccatcagctagccatgggcaaggactgcggcaaacacggcgacgacgacctccggcgctcgtgcaggcgcctgctagccaccatcgtggtcctcgcgctgaccgtgggcgtcgtcgcgctgatcgtctacctggtgctccgccccacgcacccgcgcttctacctgcaggacgcgtcgctccggcagctggacctctccaacgccaccaccagcaccagcaccctgctctccaccgcgatccaggtgacgctagcgtcgcgcaacccgaacgagcgcgtcggggtctactacgaccgcctcgacgtgtacgcgtcgtacaagtaccagcagctcacggtggcggcgtcgctgccgcccgcgtaccagggccacggcgacgtcggcgtctggtcgccggtgctggccggtcccaacgtgcccctcgcgccctacctcgccgacgcgctccgccaggactgccaggcggngtacctcgtcctccaggtcaaggtcgacggccgcgtccgctggaaggtcggcagctgggtctcgaacccactaccacctcttcgtcacctgcccggccttcctcgtcaccgncgggtgcaacggcgcgcccgggccggncggtttcaggtttcagaccacacctactg

SEQ ID NO: 4403 - DNA, 978 bp, Zea mays
  misc_feature (903)..(903): n is a, c, g, or t
  misc_feature (944)..(945): n is a, c, g, or t
  misc_feature (956)..(956): n is a, c, g, or t
cattgggacctcgagccggcgggaccttcacagaaactgcaaaaacactcctctcttcgtcctcccccctcccttctccatcccatcacataccataccattccacaaaagaagaaccacagacgctcgctcgctcccaactcccaagccaagccggatcccaaatcggcacagcgtacccactccgctcagtcccttcgttcacccccccatcatccatccagccactaagccagccatgggcggcaaggactgcggcaaccacggcgaggacgacctgcggcggtcgtgccggcgcctgctagcgatcctcctagtcctggccctgatcgtgggcgtgatcgcgctgatcatctacctagtggtccggcccacgcacccgcgcttctacctacaggacgcgtcgctgcagcagctagacctctccaacgccaactccaccaccacctccgcgtcctcgtccctcctctccacgacgctgcaggtgacgctggcctcgcgcaacccgaacgagcgcgtgggggtgtactacgaccggctggacgtgtacgcgtcgtacaagtaccagcaggtgacggtggccgcggcgctgccgcccgtgtaccagggccacggcgacgtggacgtgtggtcgcccgtgctctccggccccggcgtccccttcgcgccctacctcgccgacgcgctccgccaggactgccaggcggggtacctcgtcctccaggtcaaggtcgacggccgcgtgcgatggaaggtcggcagctggatctccggccactaccacctcttcgtcacctgccccgcgttcctcgtcaccgccggcggcaacggcgcgcccggcgcttccggggtcaggttccagaccaccacctactgccacgtcgaggtttaataaattattangagcgagagggaggagaagaggaaggaggggaaaggagcannagagacatggntggctggctaccctctctagct

SEQ ID NO: 4404 - DNA, 918 bp, Zea mays
aacactgcaaaagcacgtcacctcaacgagcgctccctcccttccataccattccaccaaagaagaacggagctcctttccctcgccgtcccagacgctcgcaagccccaactcccaagccaagccggatcccaaatcggcacagcgcacccactccgctcggtcccttcgttcaccccccatcatccatccatccatccatccagccatgggcggcaaggactgcggcaaccacggcgaggacgacctgcggcggtcgtgccggcgcctactagcgatcctcctagtcctggccctgatcgtgggcgtgatcgcgctgatcatctacctagtggtccgccccacgcacccgcgcttctacctgcaggacgcgtcgctgcagcagctagacctctccaacgccaccaccaccaccaccacctccgcgtcctcgtccctcctctccacgacgctgcaggtgacgctggcctcgcgcaacccgaacgagcgcgtgggggtgtactacgaccggctggacgtgtacgcgtcgtacaagtaccagcaggtgacggtggccgcggcgctgccgcccgtgtaccagggccacggcgacgtggacgtgtggtcgcccgtgctctccggccccggcgtccccttcgcgccctacctcgccgacgcgctccgccaggactgccaggcgggctacctcgtcctccaggtcaaggtcgacggccgcgtgcgatggaaggtcggcagctggatctccggccactaccacctcttcgtcacctgccccgcgttcctcgtcactgccggcggcaacggcgcgcccggcgcttccgggttcaggttccagaccaccacctactgccacgtcgaggtttaataaattattaggggcggcagagaccatggctacctctctagctgctcctgctg

SEQ ID NO: 4405 - DNA, 1229 bp, Zea mays
attgggacccccgattacgcaccttcacataacactgcaaaagcactcctctcttcgtcctccccctcccacctccatcccatcacataccataccattccataccaccagagaagaaccagtctcgctcgctcccaactcccaagccaagccggatcccaaatcggcacagcgcacccactccgctcggtcccttcgttcacccccatcatccatccatccatccagccatgggcggcaaggactgcggcaaccacggcgaggacgacctgcggcggtcgtgccggcgcctgctagcgatcctcctagtcctggccctgatcgtgggcgtgatcgcgctgatcatctacctggtggtccggcccacgcacccgcgcttctacctacaggacgcgtcgctccagcagctagacctgtccaactccaccaccgcctcctccccctccgcgtcctcgtccctcctctccacgacgctgcaggtgacgctggcctcgcgcaacccgaacgagcgcgtgggggtgtactacgaccggctggacgtgtacgcgtcgtacaagtaccagcaggtgacggtggccgcggcgctgccggccgtgtaccagggccacggcgacgtggacgtgtggtcgcccgtgctgtcgggcgggcccggcgtccccttcgcgccctacctcgccgacgcgctccgccaggactgccaggcgggctacctcgtcctccaggtcaaggtcgacggccgcgtgcggtggaaggtcggcagctggatctccggccactaccacctcttcgtcacctgccccgcgttcctcgtcaccgccggcggcaacggcgcccccggcgcttccgggttcaggttccagaccaccacctactgccacgtcgaagtttaatagattaggagcgagaggaggaggagggaggggaaggaagcagagagaccatggtccatggctctgctgctcctcctgctgccgttgcctggtgtggtaataactctctctatctctctctctgtccgctgctggcgttactgctgcagtgatgcgggatgtaaaggaggggtaaaaaagttcctttcgttttcgcctccctcttttttttttgttttttttttttttgcatcttctccttcacctttccatatactactagtatgctctgtcgactgttgttcaaaggaagcttccaattgtcaataaacattttggatcggaggatcaattgcaatt

SEQ ID NO: 4406 - DNA, 1222 bp, Zea mays
ggccagggttcaaaaaaacattgggacctcaattactccccttcacaaacatttgcaaaagcactcctctcttcgtcctccccctccctcctccatcccattccataccattccgccaaagaagaaccacagacgctcgctcccaactcccaagccaagccggatcccaaaatcggcacagcgcacccactccgctcagtcccttcgttcacccccatccatccagccagccagccagccatgggcggcaaggactgcggcaaccacggcgaggacgacctgcggcggtcgtgccggcgcctgctagcgatcctcctagtcctggccctgatcgtgggcgtgatcgcgctgatcatctacctggtggtccgccccacgcacccgcgcttctacctgcaggacgcgtcgctgcagcagctagacctctccaacgccaccaccaccaccaccacctccgcgtcctcgtccctcctctccacgacgctgcaggtgacgctggcctcgcgcaacccgaacgagcgcgtgggggtgtactacgaccggctggacgtgtacgcgtcgtacaagtaccagcaggtgacggtggccgcggcgctgccgcccgtgtaccagggccacggcgacgtggacgtgtggtcgcccgtgctctccggccccggcgtccccttcgcgccctacctcgccgacgcgctccgccaggactgccaggcgggctacctcgtcctccaggtcaaggtcgacggccgcgtgcgatggaaggtcggcagctggatctccggccactaccacctcttcgtcacctgccccgcgttcctcgtcaccgccggcggcaacggcgcgcccggcgcttccgggttcaggttccagaccaccacctactgccacgtcgaagtttaatagattaggagcgagaggaggaggagggaggggaaggaagcagagagaccatggtccatggctctgctgctcctcctgctgccgttgcctggtgtggtaataactctctctatctctctctctgtccgctgctggcgttactgctgcagtgatgcgggatgtaaaggaggggtaaaaaagttcctttcgtttccgcctccctcttttttttttgttttttttttgcatcttctccttcacctttccatatactactagtatgctctgtcgactgatgttcaaaggaagcttccaattgtcaataaacattttggatcggaggatc

SEQ ID NO: 4407 - DNA, 777 bp, Zea mays
  misc_feature (683)..(683): n is a, c, g, or t
  misc_feature (713)..(713): n is a, c, g, or t
cattgggacctcgagccggccgggaccttccagaacactgcaaaagcactcctctcttcttcctcccccctcccttctccatgcccatcacatatcattcctccaaagaagaaccacagacgctcgctcgctcccaagtcccaagccaagccggatcccaaatcggcacagcgcacccactccgctcggtcccttcgttcaccccccattcatccatccatccatccatccagccagccatgggcggcaaggactgcggcaaccacggcgaggacgacctgcggcggtcgtgccggcgcctgctagcgatcctcctagtcctggccctgatcgtgggcgtgatcgcgctgatcatctacctagtggtccgccccacgcacccgcgcttctacctgcaggacgcgtcgctccagcagctagacctctccaacgccaccaccccgtcctcgtccctcctctccacgacgctgcaggtgacgctggcctcgcgcaacccgaacgagcgcgtgggggtgtactacgaccggctggacgtgtacgcgtcgtacaagtaccagcaggtgacggtggccgcggcgctgccggccgtgtaccagggccacggcgccggggccggggggtcgcccgtgctgtcgggcgggcccggcgtccccttcgcgccctacctcgccgacgcgctccgncaggactgccaggcgggctacctcgtcctncaggtcaaggtcgacggccgcgtgcggtggaaggtcggcagctggatctccggccactaccacc

SEQ ID NO: 4408 - DNA, 2436 bp, Zea mays
ggtaaacaaacaggccctaaaaactccctcctcccctccagctgggttccccattgggaccctcgaggccggccggactcctctcttcgtcctccccctccctcctcctcccattccataccattccgccaaagaagaaccacagacgctcgctcccaactcccaagccaagccggatcccaaaatcggcacagcgcacccactccgctcagtcccttcgttcacccccatccatccagccagccatgggcggcaaggactgcggcaaccacggcgaggacgacctgcggcggtcgtgccggcgcctgctagcgatcctcctagtcctggccctgatcgtgggcgtgatcgcgctgatcatctacctggtggtccgccccacgcacccgcgcttctacctacaggacgcgtcgctccagcagctagacctctccaactccacctccccgtcctcgtccctcctctccacgacgctgcaggtgacgctggcctcgcgcaacccgaacgagcgcgtgggggtgtactacgaccggctggacgtgtacgcgtcgtacaagtaccagcaggtgacggtggccgcggcgctgccgcccgtgtaccagggccacggcgacgtggacgtgtggtcgcccgtgctgtcgggccccggcgtccccttcgcgccctacctcgccgacgcgctccgccaggactgccaggcgggctacctcgtcctccaggtcaaggtcgacggccgcgtgcggtggaaggtcggcagctggatctccggccactaccacctcttcgtcacctgccccgcgttcctcgtcaccgccggcggcaacggcgcgcccggcgcttccgggttcaggttccagaccaccacgtactgccacgtcgaggtttaaattaggagcgagaggaggggaaggaagcagagagccagagaccatggtggctacctctctagctgctgctccacctcctgccgttgcctggtgcggtaataactctctctctttctatctgtccgctgctggcgttactgctgctgcagtgatgcgggatgtaaaggaggggtaaaaaaaattcctttcgttctagccccttgtttttttcatcttctccttcacctttccatatactactagtatgctctgtcgactgttgttcaaaggaagcttccaattgtcaataaacattttggatcggaggatcaatcgcaaaaaaaaaaaaaacaaaccagcaaagtggtcacacgttgatctcggagccagatcgaccgtctttggcgaatgggtggggtatccctcgttcgtttgaccctaaagctagacgcaacaagcgcgtgatctaggtagagtttggagttttgcttgggggcaaggagccagcagatcagatttggtgtgggggaagccgggaaccccaagtagaagtacacacacagcaagcacatggggactctccctctcctgtggtgatcgtcctctactgcccatgccaaagcggtggttggtcgcccagcagcactcatcattcttcttctctctctctgtctgtgtgtgtctctgatcctcactcaacagcagcacacagctgtagcttcacttagccagcaaggaacaccatattgggcgtgcatggtcatatactcaccatgtggtgtgtcagctggtttccttctgttttgtagtactacactagtaggagttgtgccagtttgccgatgcatccgcatgtgcaagtctgcaggtggtagaagcatctatattctcttctgaaaatgaagaagaaaaaaaaaatcacgactagagtacacggcttagtagtagtagtattatttagaaatttgacgtgggaatctgttcctgcccatacagtagtagtagcctagtagtaggagtagcgagcgacagtagacaagtcacaactcacaagtgccgccggtagcaatttttttttttttttgcattcccaaaagaaagctctttcctttcttcgatgtacactctcggtggcaccgtttccttttctttgtcgcgcttcaactttgcgcaaaagttttactattttttgcgaagaaatatatattaaaaagagagcatattcaatgtgggggtggcaatgaatgaacgatcgacaggtgccggtgtgtgtcgatggagctagtgccatccgcgcgcgtgtgggggcctggccccccatccatatggcctgcagctgcggaagcggagcgatacgcatcccgttccaattcgattcgattcaatttaattcaaagaatccaaatggacctcataatcctgggttgggaatgtattaatagaaaagttaagtgggccaaaggccattacaataggggtatacatggaaaccctaacaatatactctaacaaagagaaatatttgactccatgaatgaaggtatagtggtatactcatttgtggatactc

SEQ ID NO: 4409 - DNA, 2247 bp, Zea mays
ccggccgggccgggactgggcaccggcgcacgaacgccgcgtgctccccgaccaccagctccaattccctccctccccatcccccccctccccgccggccgggtctgcccaacacccaattgaagacgtcccaatcccaaccctactcccttgcctccccctaatgacatcgcctggcggcgtcttctccgccgcgctcgtcgccgaggacttcccttgggtggacatggaggaggagatggggatggccccggacatgtaccgcgaggtgttcgacctcgcgcagcgcgggacacgagcctttcgcgaccgcctcttcgacgaggcaatatcctgttacactaaagctcaaaatttgagaccagatccaattatccttggcaatcgaagtttgactttctgccggttaagtcaactgttgagggagagatcagcagctgactctgaatatcagcccttgaatggccttgatcctacaactcatgcagagttagctctgaaggatgcagagaagatattatctatcaacagtaattctcctagaccatatattctcaaggcatatgcgctatttctgatggagcattaccatgaggcacgtgagacccttcttgctggtcttcaagttgatcccctcagtcatgtcttgcaaacctgtctgaatgatctggataggaatacaaatattgcagctggggcaaggcgtgcaaggttagctaggattgatgattttgagtgcacattatgctttaagctattgtatgaacctgtcactacaccatgtggccattcattttgtcgctcttgtctacatcagtcaatggatcatggtaataagtgccccatgtgtcggacagtattatttatcggtccaagaacatgccctataagtgtaacattaagcaacataattcagagaaatttcccagaagaatatgctgagaggaggtcagaacatgagactatgacatatgctggtgttgatttgatgcctctctttgtcatggatgttgtacttccatcccaaaagatggcactgaacatatttgaacctcgctacagactgatggtacggagaataatggaagggaaccatcggatgggaatggttgctattgattcggcaacgggtactgtagcagattgtggctgtgaggtggaaatttcagagtgtgaaccacttccacatgggcgcttttatttagaggtggaaggcacacgtcggtttcgtatcgtgcgatcatgggatcaagatggatatagagttgctgaagttgaatggttgaaagatatacctctgccagaaggttcacaagggagaagagaactaatggaactggccaatggagcttcagagctggccagggcatatatcagacatgctagagataccgtacggactgcaaggcgaacaagacatctggatcttgagggcatgcctgggccacaggacccggaaaaatttagtttctggctagccaacttgataagtttgaggccctcggatagattagatacgttacgccttcgcgacactagggagagaatttctagtagcatcagtttgctccgtgattccgaacaaggctgccgtgtacaatgacggaaacagtacaagaatcgtttccacagaccaattcgttcgtctaggagtatatcgatttggagctactccgtgattccgaacaaggctgccgtgtacaatgacggaaacagtacaagaatcgtttccacgtaccaattcgttcgtctaggagtatatcgatttggagctactccgtgattccgaacaaggctgccgtatacaatgacggaaacagtacaagaatcgtttccacagaccaattcgttcgtctaggagtatatcgatttggagctagggatgtaatatgattcagaaaatatccgtccagatccagactcgaagatggtgaatactggttcggatggaattttcggatatccggacttttttcggataacggatacaaatacggatattttattcggatatcgaattcgaatacaatatgtctgatatctgtcggatatcgaatatccggatattttcttggataaatcttctcggatatccggatagctgtgtgtattttgttgatttttttagaaagaaattaataatacacaaatatccttagaaattcatgaaaacttatggaggcataccatatgtccacatgtaatcctccaatatatttggaccataaaatacataatatgatagtg

SEQ ID NO: 4410 - DNA, 974 bp, Zea mays
  misc_feature (5)..(5): n is a, c, g, or t
  misc_feature (8)..(8): n is a, c, g, or t
  misc_feature (14)..(14): n is a, c, g, or t
  misc_feature (32)..(32): n is a, c, g, or t
  misc_feature (36)..(36): n is a, c, g, or t
  misc_feature (43)..(43): n is a, c, g, or t
  misc_feature (54)..(54): n is a, c, g, or t
  misc_feature (63)..(63): n is a, c, g, or t
  misc_feature (65)..(65): n is a, c, g, or t
  misc_feature (69)..(70): n is a, c, g, or t
  misc_feature (78)..(78): n is a, c, g, or t
  misc_feature (81)..(81): n is a, c, g, or t
  misc_feature (97)..(97): n is a, c, g, or t
  misc_feature (105)..(105): n is a, c, g, or t
  misc_feature (111)..(111): n is a, c, g, or t
  misc_feature (129)..(129): n is a, c, g, or t
  misc_feature (145)..(145): n is a, c, g, or t
  misc_feature (147)..(147): n is a, c, g, or t
  misc_feature (195)..(195): n is a, c, g, or t
  misc_feature (198)..(199): n is a, c, g, or t
cgatngcngaatgnccccaaaagtgtggaacngcanttgatanataaactatgncgatgcgcngnaaannctgtattnttnaatcctccctaagganagcccgcntccagnggtgttaccaaacaatgnaagggatattaggctnangtatgcgctccatttgagaccatgctattcattccgtcttttctactncgnnggttcattcctgcctcttgtggtggcttgcaggatggcttatccaaataaatatgagatttatcgaagggttgacactctcaatggaaaagagaactatattcttatagctgaattcacgaacaagccaactcctgatgagatcaccagtgctttcaaaggacaaaaaagggaagaaaaggcatcttctggattctggggtttcttaagtggtttattttaagtcaagcgatctgctgtacggcgatgcaatcctccttgtatatttttatctgataatggatgtaatatggttcggaaaatatccgttcggatcaggattcgaagatggtgaacactggttcagatggaattttcggatatccggacttttttcggataacggatacgaatacgaatattttgttcggatatcgaattcgaatacaatatgtctgatattcgtcggatatcgaatatctggatattttctcggataaatcttctcggatatccggatatcttatctggatagctgtgtgcattttgttgattgtttgtagaaagaaattaataatacacaaatagcctcaaaaattcatgaaaatttatggaggcataccatatgtccacatataatcctccaaaatatttggaccataaaatccacaatattgtagtgtttctttcatttcactttcacttgtgtgaattacacgggaaatcactctaattatccaagttcactttatcctttttatcaaagaaatacggacgccgctacctaaattaatcgg

SEQ ID NO: 4411 - DNA, 3010 bp, Zea mays
gtcgccgacgacgaccagtcggtggaggaggaggcttctcctccgcgcacctccgcgcggaatctcttcgatctcctcgacgacggaaacggcgacggcgacgaagaagatgaaaaggtacacatatgacccttcagtcagccatgtgcaggaattatttgaagccgccaaagcagcaaatgatctcaatgctattgcagccatattagggaaatatccatatcatccagaatcactgttgacatttgctgagcttttcaaatattctggagagcatcaatcatcagcagatgcagtggagaaatgcctatttgcattggagtgtgcttggcatcctttatttagcccacttcagggcaactatcagttgaaattcaaccatgacacaaataagccactgtttacagcactctttagtcacatgaaaaatctggataggcgtggctgccatcggtctgctttagaggtctgcaagtttctgttgtcactggactttgatgatccaaagggttctctattttgcattgattactttgctctaagatcacaacagtacaaatggctggagcaatttgcagaagagtaccagtgtgataactccttgtggttatttccgaatttctcattttctcttgctactgcacggttttaccttgagcgtgatgcagcgtcagagggttctgatgatgctgacaagtcaacatctcttgatctcatgaagcaagctctgatgcttcatcctatggtgcttcgcaagatagttgacaaggctcctctgaaagactcatcatggacccaaatactcggaaatgtattctttggatcagcaaaaccgggaagcccttcacttgagcatatgatcaatatatatgtggaacgccattatatcatgtggagattcccagaactgcagaacttgctgaaagaggctgctcttttggtgattgaatcactaaagcaggataacagagaagccctggactgggcttgtgttagaaaagaagcattctcgtcagacaagaatgagtaagttcctctgaactctgtgcaaagtcagagttaactgttcttatcggttatgccctttgtttgcatagctttgcattgcttatgattctttggtagcgacatgagttgttggttttgcctacagtttgaaaggttaaatggaaaatacagggttgatctaacatagctatgctatcgcaacttagcagtagctttgcatctgcggagtttagcaaattgtggtacctataacctttctagtttcagtgatgctcccttgactgtgtattatggtatactataatgtttttagaaatcatcccagactacattctgagtagaggtatgagttcctgagtttgccccctaccttgcaggtactctcatctgcttgtttcagacttcactgacacaacgccgtcgctcccaccagaagaactgcgaccatttatggtcggtccaggaatgttgcatgagatgccacctgttgaacaagaagctggacccgagagactccgtgctcctcgtgaagtcgctgggcgtaatcctgcagtagtcttccttgaatcactgctcccatgggtcgactatggtgacaaccatcaaggtgcaaatgacgatgacaacgacgacgattgatcagttggatgtataaagtggcaaggactcacaattgcgcctgaactattgaatgtgacacatgattaagaaaagttgttgttgctcatagggtcacctcggtactatcaataaccaccacaagtctgcaagccaagtggtcttgtgtttttcatgatggggcagaggcctgaggtatgtatggggatcgaccactaagttgccaaaacatgtataccaaattttagggatcgagtaccatccttgtccgagacttgactctatgctaattctgcaaacatagtgaaagggtttaatactttacggtgctgttagaaaatttaccccaggctaggaaaggctttcacaaagaattaaatgtcttatttaaataatatcctcgtggattgttcaccctgaaaaaaattaggggtctcaagaggatttgatttgagttttcaaactaatctcaaatgttgcgattctgttcctcctagcggtcctcggggagaaggggattaaaggggctaaaatattttgcaatttagtaatagcaaaaagattttagccactttaatccattctaatcctcttactttcagacagccctaacgcactggttgacctagagccgctgcttgagctccgacgtccgcacatgctagagtttccatggcagtacactcatcagcaagctttagggcatgtttggatgtgtgtataaggctatctctagcacattactgatccttatatctatattcaaacttcactctgtgaacagtacaatctataatgcaaaacattgttttggataaactgttgcagacggcctaaggtgctaaaaactgctatatattttatgccacaattgcttaaggttatacacttaaatttttcgctacatcttagcaggtctaagaaaactttgtctcacttttactaatgattgacgagtcatatactgtaggagaaaaaagcttgccataattgttgctacaaaccaaatatatacctaagccgattaaacatgtctggtggcaaataaagcagcaaaccaaacaactccttaataagacgcattatttggttgatgttttgtgatttggccagattccgctgggtcagccactacctcaatgctcctgcaccttcgttggaggcacgctgtagaagacgatgggtacctgaaacccgaatacctaatgggttttacccgatatgaaggcgggtactgtatgatttctctacctgcgggtatgttaatgggtaaaaacctctacccgtcggatagacgtatacgggttggtactactcatacccgtctacccataggtaaatatacccgtatcaataccactataaccatataatagagcccatc

SEQ ID NO: 4412 - DNA, 2115 bp, Zea mays
cggggaaaaggaagatgaaacagaaataattcaagctgtgggctatacagaacagagacattctgtgcaaaagaaagcgaacgctgttcccgaaacaaacaaaaaatccaagaaaaagaaaaaaaagagcaaggcggagccgtcatcaacaaaggcaaaggatgcacagtcgttggagtcaattctggaagacttatgtattgaaaagaatccaatacaacaaagagctcatcagagtgacagggcagctggaaaggaatttgagacaaatgaagctactcatgtggcatcctctgttcttgcaatagacccaaaacatctaaagggtgaaaatgagatgaggcgcatttttggatcaaaggtagtggattcatttgaaaatcaacggagtatgccaagcagttcaaggcaagtacgtggtgctaggcgtgttgcccataatccaagaaaaactcttcttgtgtctccacctagctactggccaccatgggataagtcaataacaatggatcttcttgagatgaagaatggtttgaattacttcaggtacacatatgacccttcagtcagccatgtgcaggaattatttgaagccgccaaagcagcaaatgatctcaatgctattgcagccatattagggaaatatccatatcatccagaatcactgttgacatttgctgagcttttcaaatattctggagagcatcaatcatcagcagatgcagtggagaaatgcctatttgcattggagtgtgcttggcatcctttatttagcccacttcagggcaactatcagttgaaattcaaccatgacacaaataagccactgtttacagcactctttagtcacatgaaaaatctggataggcgtggctgccatcggtctgctttagaggtctgcaagtttctgttgtcactggacttcgatgatccaaagggttctctattttgcattgattactttgctctaagatcacaacagtacaaatggctggagcaatttgcagaagagtaccagtgtgataactccttgtggttatttccgaatttctcattttctcttgctactgcacggttttaccttgagcgtgatgcagcgtcagagggttctgatgatgctgacaagtcaacatctcttgatctcatgaagcaagctctgatgcttcatcctatggtgcttcgcaagatagttgacaaggctcctctgaaagactcatcatggacccaaatactcggaaatgtattctttggatcagcaaaaccgggaagcccttcacttgagcatatgatcaatatatatgtggaacgccattatatcatgtggagattcccagaactgcagaacttgctgaaagaggctgctcttttggtgattgaatcactaaagcaggataacagagaagccctggactgggcttgtgttagaaaagaagcattctcgtcagacaagaatgagtactctcatctgcttgtttcagacttcactgacacaacgccgtcgctcccaccagaagaactgcgaccatttatggtcggtccaggaatgttgcatgagatgccacctgttgaacaagaagctggacccgagagactccgtgctcctcgtgaagtcgctgggcgtaatcctgcagtagtcttccttgaatcactgctcccatgggtcgactatggtgacaaccatcaaggtgcaaatgacgatgacaacgacgacgattgatcagttggatgtataaagtggcaaggactcacaattgcgcctgaactattgaatgtgacacatgattaagaaaagttgttgttgctcatagggtcacctcggtactatcaataaccaccacaagtctgcaagccaagtggtcttgtgtttttcatgatggggcagaggcctgaggtatgtatggggatcgaccactaagttgccaaaacatgtataccaaattttagggatcgagtaccatccttgtccgagacttgactctatgctaattctgcaaacatagtgaaaggggttaatactttacggtgctgttagaaaatttaccccaggctaggaaagcctttcacaaagaattaaatgtcttatttaaataatatcctcgtggattgttcaccctg

SEQ ID NO: 4413 - DNA, 862 bp, Zea mays
ggaaatggcccacgaggctgcggccccgggttcgtcggtgctcggccgcgcggtggaggaggtgcgctcggccctcaacgagcacgccgacgtggttgccgacctcttcggtcgcgtctcctccgaagtgcgcaccggcttcgcgcccgccgtcgactccttcgttggcttcttccacgccgtcgactggaagtttctggtgtattccttgctgagagattaaatacgttcctggcgcaaaactggaagagcttctctacccaaaactattttgatccccagggccttttcatttcggtcatctggtctggccctctcctcctgataacgatccttattctggtgaacactctcgtgacgctctgcacgctaatggtaaggtggaaaagggcagagctcaggcatcgcgctcggcaggctcgtgacaagcaggactgatctgaaacctgcgtctatgtatcattcggtggctagtagaaagtcgcgttcttgctacggttggtctaaccaagaatcacgttcctggaaaacggtgcccatttcattaggtagcagaatataacgttaagatggtcagattttgctcttgtggacccttttggtgcccggatggccatttactacgctgcaatattatcacgtcacgcgatttctttgggcgaggacactaggcctgtgataatgatgtgtccatttgttcgatgctgaacctcggaaccggttgatagttgttgttttcctagctgtgtcgggtcgggtgcagcatgctctgattgttgattacctcaagaataattcgttggactgctgaattttagccatctttacggatgttcggatctgaaactgtcgctcgaatttc

SEQ ID NO: 4414 - DNA, 1926 bp, Zea mays
ttgaaaattttgttttcacaaatggccttgctagaattcaaatgcttaaattttagttttagaagggttcatcattctcaggaaatgacaatgcatttgccattcatcttattatcagattattggaacggcaactagttaaattttcacttttaactactggataggaaggtatcttaaggcttatttaagagcaagaatattggatggattgccggggcaaaatttatcttgctatttaaaatttaatagaagatgattttagaccctcaaatcattggtttcaaaatttaatagtaagatgattttagtttcttcaattttcttcggtatcgttgctctcaaaaagctcaagtgcttttgagaactgaggcatgtattctaatgactaattttaagtccctatattttattcgctaaattattaaatataaaaattaaaactctattttaattttcgtatttgataatttaggaactaaaatagaataaaatgaagagtctaaaattactcaggaaattagaccaatgcaaaagttttttttcaggaaaaggcatcatttttttggagaattgaaaacggtgggacagcacttttccgagagaaaatacggggccagcccatctttaaacgggcctcggttggctttggcctaacccattttcatgaagcccagtaagggaagggagagccgattcatttgcatttttctgagcagatgcagatcgatcccgagttccgctgactgcagaggagagagatctagagcgagggagggagggaaatgggccacgaggctgcggcgccggggtcgtcggtgctcggccgcgcggtggaggaggtgcgctcggccctcaacgagcacgccgacgtggttgccgacctcttcggtcgcgtctcctccgaagtgcgcaccggcttcgcgcccgccgtcgactccttcgttggcttcttccacgccgtcgactggaaggagccttggctgatcagcatactatctttccatgccattctgctactggttaccatcatctcgaggaggaatatcaatttccagctcatcttgtcagctctaacattttctggtgtattccttgctgagagattaaatacgttcctggcgcaaaactggaagagcttctctacccaaaactattttgatccccagggccttttcatttcggtcatctggtctggccctctcctcctgataacgatccttattctggtgaacactctcgtgacgctctgcacgctaatggtaaggtggaaaagggcagagctcaggcatcgcgctcggcaagctcgtgacaagcaggactgatctgaaacctgcgtctatgtatcattcggtggcaagtagaaagtcgtgttcttgctacggttggtctaaccaagaatcacatccctggaaacggtgcccatttcattaggtagcagaatataacgttaagatggtcagattttgctcttgtggacccttttggtgcccggatagccatttactacgctgcaatattatcacgtcacgcgatttctttgggcgaggacactaggcctgtgataatgatgtgtccatttgttcgatgctgaacctctgaacctcggaaccggttgatagttgttgttttcctagctgtgtcgggtcgggtgcagcatgctctgattgttgattacctcaagaataattcgttggactgctgaattttagccatctttacagatgttccgatctgaaactgtcgctcgaatttcactgcatctggtgtcggtgtgcaagctattcctgatgtttgtgggcacttgaaaatgttctctggttgtactatggactgaatgatgcatggcatccgttgtcagcttcgtgtgtgaaagggggatgctttcttggtttgccagaaacaaaaaaaaaaaaaaaagcggcc

SEQ ID NO: 4415 - DNA, 2279 bp, Zea mays
gacgccacgcgtccgcggacgcgtgggcggacgcttgggcccacgcgtccgctcactgctcgttgccggctgcccccgcggccccggccagtccatcccctcgctcgctccccaactccagcaggcagatcagatacatccatccattcgcggaccggaaggtgagcgccgtgaacgaaccatccgccctgctagctgcgatctgtagccttgcgtcgctttcgcgcctagatcgtcacgtcacctatcacgatccgtgcggttctagatctgtggtttttccttcccctggtggtcgaatccttccatccaccagaccaccacgggacctcgtggattccttttggttttcctgtgccgagagccaaaatcgagggggggggcttgttttttattggctcggtctcccgctgtctcgtgatctgatttgctgtagtaatcagcaggaaaggaagggttgaactatgagcgccgtggcggtttcgtcgtcgctgaacccggacgcgccgctcttcatcccggcggcgctgctgcaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcagggccccgtcgccgccgcccttaagacaggtactgatgtctctctctctctctctctcttactctcccctcgattttagatctgcctgaaggacgaatcatagtgagccccgtcggtgccgcccttaagacagattcggtgctcaaggcgctgaacatgacctccccgaagggcggcggcgacgccccgcgggggttccgggagaaacccaggaacgccgagaagccgaccaagtacgccggcagccccaagagcaacgctccccgcgtgatccaccagcctcgctaggttcgctgggggaactcatcaggaaggctgctgcccctcttgcagccttgctcctggctgccgccgctgtcgtggtctgctctttcaagtcgaagtaacggtggttcgagctagtggatagtgtggctcaactgtagaagttccttttgtatagcaagcaagtaaaaaaaaaaatgaccaaaaaatataacaaaatgcagctgtaagtttactgctgctctctaagtcgtgttcagtcatccagtgtgtctagtctagggaaaccccataaaaatggtgaaggtggaatcccatcccagtgtcataattaaggatgcacttcttctgtaagcaaatgtatgatgtacaatggccggccggcagtctaaatgttacaactagctcttcttggtgaattcaccggtccacactgatgtgtctgctatgtatcattactatccagttagggcttgttcggttattcctacgccatatggattggacgggattggaaaattttagtagacattttgacttctatggatttaaacccacccaatcccctccaatccacatggattgagatgaaaccgaacaagcccttagttggatggatggatgatctcacgcgcttgagtttatctagttgctgatatgggagagcccctcaacacctcaaatattgtggataagtttaatcctacactgtcagtcttcagttataaggcacgcactcttcgacgttgggcgctgtcttttgtttcaaaggttgaggcaacctcaacctcgtttaaaacagagagcaaagctaatttccaaactgatgtaagtcatgtgtccttaattaccaaagtagcaatgatgacattgttatgttgtgtgctaatgagccattacgtgaacatcagttcctgccttgccgcttcgttcagccgggccggggtatattttgagtcactaaaaggacacgtcggatgaatggaaaattgcctcttgtctttaccaagagtgtcgcccgcgagcagattaactcgaacgattattcttatctcgtgcgcgattatccatctaatcacgtagaatctattggttatcgtctaagaaaatatctagatttcatcccctataaatataaagggtatggtcgattgagaacactcaaacacattccaatcgaatatatttactttatttacattttttgtcctaggagtaaatgtaacgtagctagctttagttgtagtcttctgcatatccacctccatccctattcgaatctacgtcgtctagatccgtctttaatggcctc

SEQ ID NO: 4416 - DNA, 1061 bp, Zea mays
gccggccggttcgtgtgcggcgctcgaggcggccggtcgcaccagaagctcactcactgctcgttgccggctgcccccgcggccccggccagtccatcccctcgctcgctccccaactccagcaggcagatcagatacatccatccattcgcggaccggaaggaaaggaagggttgaactatgagcgccgtggcggtttcgtcgtcgctgaacccggacgcgccgctcttcatcccggcggcgctgctgcaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcagggccccgtcgccgccgcccttaagacagattcggtgctcaaggcgctgaacatgacctccccgaagggcggcggcgacgccccgcgggggttccgggagaaacccaggaacgccgagaagccgaccaagtacgccggcagccccaagagcaacgctccccgcgtgatccaccagcctcgctaggttcgctgggggaactcatcaggaaggctgctgcccctcttgcagccttgctcctggctgccgccgctgtcgtggtctgctctttcaagtcgaagtaacggtggttcgagctagtggatagtgtggctcaactgtagaagttccttttgtatagcaagcaagtaaaaaaaaaaaatgaccaaaaaatataacaaaatgcagctgtaagtttactgctgctctctaagtcgtgttcagtcatccagtgtgtctagtctagggaaaccccataaaaatggtgaaggtggaatcccatcccagtgtcataattaaggatgcacttcttctgtaagcaaatgtatgatgtacaatggccggccggcagtctaaatgttacaactagctcttcttggtgaattcaccggtccaaaaaaaaaaaaaaaaacaggccccgaaaaaaaaaaaaaaaaaggccccta

SEQ ID NO: 4417 - DNA, 970 bp, Zea mays
gccggccgggtccggccgcccgctcactcgctgctcgttgccggctgcccccgcccactccaccgctgatatttgtcatcgtctcgttcctgccctcggccctcccctcgctcgctccccaactccagcaggcagatcagatacatccattcgcggaccggaagtaatcatcaggaaaggaaggggcgttgaactatgagcgccgtggcggtttcgtcgtcgctgaacccggacgcgccgctcttcatcccggcggcgctactacaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcagggccccgtcgccgccgcccttaagacagattcggtgctcaaggcgctgaacatgacctccccgaagggcggcggcgacgccccgcgggggttccgggagaaacccaggaacgccgagaagccgaccaagtacgccggcagccccaagagcagcgccccccgcgtgatccaccagcctcgctaggttcgctgggggaactcatcaggaaggctgctgcccctcttgcagccttgctcctggctgccgccgctgtcgtggtctgctctttcaagtcgaagtaacggtggttcgagctagtggatagtgtggctcaactgtagaagttccttttgtatagcaagcaagtaaaaaaaaatgaccaaaaaatataacaaaatgcagctgtaagtttactgctgctctctaagtcgtgttcagtcatccagtgtgtctagtctagggaaaccccataaaaatggtgaaggtggaatcccatcccagtgtcataattaaggatacaaaaaaaaaaaaaaaaaagcggccaaaaaaagcggcc

SEQ ID NO: 4418 - DNA, 1393 bp, Zea mays
ctgtgcggcgctcgccgcccgggtgggcaccagaagctcactcactgctcgttgccggctgcccccgcccactccaccgctgatatttgtcatcgtctcgttcctgccctcggccctcccctcgctcgctccccaactccagcaggcagatcagatacatccattcgcggaccggaaggaaaggaaggggcgttgaactatgagcgccgtggcggtttcgtcgtcgctgaacccggacgcgccgctcttcatcccggcggcgctactacaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcagggccccgtcgccgccgcccttaagacagattcggtgctcaaggcgctgaacatgacctccccgaagggcggcggcgacgccccgcgggggttccgggagaaacccaggaacgccgagaagccgaccaagtacgccggcagccccaagagcagcgccccccgcgtgatccaccagcctcgctaggttcgctgggggaactcatcaggaaggctgctgcccctcttgcagccttgctcctggctgccgccgctgtcgtggtctgctctttcaagtcgaagtaacggtggttcgagctagtggatagtgtggctcaactgtagaagttccttttgtatagcaagcaagtaaaaaaaaaaatgaccaaaaaatataacaaaatgcagctgtaagtttactgctgctctctaagtcgtgttcagtcatccagtgtgtctagtctagggaaaccccataaaaatggtgaaggtggaatcccatcccagtgtcataattaaggatgcacttcttctgtaagcaaatgtatgatgtacaatggccggccggcagtctaaatgttacaactagctcttcttggtgtgaattcaccggtccacactgatgtgctatgtatcattattatccagttagttggatggatggatggtctcacgcgcttgagttttatctagttgctgatatgggagagcccctcaacacctcaaatattgtggataagtttaatcctacactgtcagtcttcagttatcaggcacgcacttttcgacgttgggcgctgtcttttgtttcaaaggctgaggcaacctcaacctcgtttaaaacagagagcaaagctaatttccaaactgatgtaagtcatgtgtccttaattaccaaagtagcaatgatggcattgttatgttgtgtgctaatgagccattacttgaacatcagttcctgccttcccgcttcgttcag

SEQ ID NO: 4419 - DNA, 2221 bp, Zea mays
cccctgtaacagagcggcatccggtggagggaagtgggcggtgggttgggagcagaggctggcgactagagggagggagtagggagaagagagagaaagttgaaaatctagctctgataccatgtgagaaactcaaccctaatcatggttgggactgtattagatagaccgagtagttatgtcaaactcattacactggggtagtcagttaattacaagaggactcacgccaaaacactaaaaacactatatgttatctatctttattgcacctttacgcgagattgtacacacgacacgagtgaatcgtgtagagatcggctatttttgaaggacatgtctttcgcattttttcaattagtctatagagatcctcaaaagtccctatattaaatgaggttacatgccctaatggccttctcttatgtggcgtagtctctaccctgtccagatcatcatctcatttgctgcgttgttttgtttgccgcgcccacagaaataggcgccagttcatccgcttccattcctagttctcaccacccagaagtccacctccttgttgccttcctccaatcccaaatctcacctccttccagttccagctatcgcttctcgtgttggctcgcctcttcctccattcagtggctccttagatcggctcagggacacaccagctgatcgtgtcggcgccgaatctagtggcaatttctcgctattgttgccccggagcagtggtttggatccaagaaagcggccgaccttcttggttgtatatcctcccgcaatggcggcgctcctggagctgttcctgggctcctcgtccgcaccggtggactgggaggcagaggcctacccggcgtacggggacttcgccgtgctacccttactcgtcgcctttttccccgccgtccggttcctcctcgaccgactcgtcttcgaggttttagcacggaaacttatatttggaaaagaacatgataagctttctgaaacagatgacagtagaaagaaaatcaataaatttaaggaatcagcatggaagtttgtttattttctttctggagaactgctttcactatctgtaacatacaatgagccatggtttaagaacaccagatacttttggataggccctggtgaccagatctggcctgatcaaatgataaaactgaagctcaaagctgtctacatgtatgctgctggattttacacatattcaattttcgctcttctgttctgggaaacaaggcgttcggactttggagtatcaatgtcccaccatatagcaactgttgttctgattgttctttcctacattttcagatttgctcgtgttggctctgttgttttagcccttcatgatgcaagtgatatattcctagagattgggaagatggccaagtacagtagctgcgagtggctagcagttgtggcatttcttcttttcgtggcatcgtggatacttctccggcttgttatattccctttctggatcctaagaagcacaagctatgaagtactgctgaccctggacaaggagaaacatcagttttatggccccatatactattatgttttcaactgtcttctgttctcactcctagttcttcacatatattggtgggtactgatatggcggatgctagttaagcagattcaatcgaaagggcatgttggtgatgatgttcgatccgattctgaaggcgaagaggaacatgaagattaactttttaggttgaatgcttaactgaagaactatgttgtgtgatacctacagcaaggcacaccttctgaaaccacctttttccttctaaagaagatttgcagatattagattttattagatcatatcattctttcagcatcaaagatgacaactatcatttgcgagttgccactgaagccgtctgtgctcttggatgtttgcatgaaaacagaagtgcattgtatttttttcccagtcaaccgtcgtttgtaaaagatacagaataatcgcttgttcatccattcttgtaactagacagttgatttgatttcaaatcatgtaatttgctacatcagcttagttgattacttggtgtatcatccattatgatgtaaatgggagtcttgggaagttcacaacaagaatgtgacactatgtactgttatttctcctattattttaataagagcacagagaagtagcccaagtgcaaggatattaaaaaaaaaaaaaaaa

SEQ ID NO: 4420 - DNA, 1657 bp, Zea mays
gcgttattttgtttgccaacccacagaaaaaggcggcagttcatccgctgctgttcctagttctctccacccagaagtcgacctcgttttttcctccctcctgtcccaaatctcacctccttccagttccagctaccgctgctcgcgttgactcgcctcttcctccattcagtgactccttggatcggctcagggacacgcaccagcgtattgtgtcggcgccgaatcttgcgcgcatttcgcgctattgttgccccggaggagtggtttggatccaagaaagtgatcggccttcttggttggatctcctcccgcaatggcggcgctcctggagctgttcctgggctcctctcccacgccggtggactgggaggcagaggtctacccggcgtacggggacttcgccgtactccccttactcgtcgccttcttccccgccgtccggttcctcctcgaccgactcgtcttcgaggttttagcacgaaaatttatatttggaaagggacatgataagcttgctgaaacagatgacagtagaaagaaaatcaataaatttaaggaatcagcatggaagtttgttttttttctttctggcgaactgctttcactatctgtaacatacaatgagccatggtttaagaacacaagatacttttggataggccctggtgaccagatctggcctgatcaaaagataaaactgaagctcaaagctgtctacatgtatgctgctggattttacacatattcaattttcgctctcctgttctgggaaacaagacgttcggactttggagtatcaatgtcccaccatatagcaactgttgttctgattattctttcctacattttccgattcgctcgtgttggcactgttgttttagcccttcatgatgcaagtgatatattcctagagattgggaagatggccaagtacagtagctgcgagtggctagcagttatggcatttcttctttttgtggcatcgtggatacttcttcggctcgttatgttccctttctggatcctaagaagcacaagctatgaagtgctgctgaccttggatagggagaagcatcgattttatggccccatatactactatgttttcaactgtcttctgttctcactcctagttcttcacatatatttgtgggtactgatatggcggatgctagttaaacagattcaatcgaaagggcgtgttggtgatgatgttcgatccgattctgaaggcgaagatgagcatgaagattaactttttaggttgaatgattaactgaagaactacattgtgtgatacctgcagcaaggcacaccttctgaaccttttttttttcttttacagaagatatccagatattgtaattcattaggtcatatcattcgttcagcatagaagatgacaaccatcatttgggagttgtcaatgaagccgcctatcggatgctttttatcaaaacagaagtgcattgtatttatttcactaaaccatcatttataagagatacagaatgatcccttgttcatccaaaaaaaaaaaaaaaaagttgatttgctttcaaatcatgtaatttgctacagaagcttagttgatttcttggtgtatcattcattgtgatggaaatggaaatcttgggaagaagttcccaacaag

SEQ ID NO: 4421 - DNA, 1717 bp, Zea mays
  misc_feature (4)..(4): n is a, c, g, or t
cggncgcgtgggtccagccaaatttttcttttctggaagaagctaggctgtgtcacaagtcgatcctatttgggccaaaagcccaattccggagcccacttgactgttcgcgcctttccccaaaccgccgcacggatcaccccttctcactgcctgtccaggcgccgccgcttcgccgctgcccgtttcttcgaaccactccgaagctgccccgccatggacagctccgccactgacggcgcgaggctaccgccgccaagggccgggagtcgcctctgcgtcaggtgcggcgagaggaaggccgcgctgaagcggcccaaaaccctagaacagatctgtagggaatgcttctatatcatctttgaggacgaaattcatcaaactattgtccagaattctctgtttaaagctggtgagcgtgtggcaatcggagcttctggtggaaaagattcaaccgtgcttgcatatgtgttatcggagttaaaccgtcagcacaactatggtcttgatttgttccttttatctgtcgatgaaggaatcacaggatatagagatgactcactagaaactgttaaaaggaatgaaatacagtacggcctgccactgaagattgtttcctataaagatttgtatggctggacaatggatgatattgtcaaagcaattggtctaaaaaacaattgtactttctgtggagtttttcgacgtcaggcactagatcgaggtgctgctctcctgaaagctgataagattgtaactgggcataatgcagatgacattgcagaaaccgtcttgctgaacattctgcgtggtgatattgcaaggttaagtagatgtacctttataactactggtgaagatgggccaataccaagatgcaagcccttcaagtatacctatgagaaggagatcgttatgtatgcatacttcaaaaagctggattacttttccacagaatgcatctattcaccaaatgcataccgtggttttgctcgtgaatttattaaagatttagaaagaatgaggcctagagctatactagacatcataaaatccggtgaaaatttcagaatctccacaacaacaaggatgccagagcaaggaacgtgtgaacgatgtggctacatttctagtcagaaattatgcaaagcatgcgtcttgctggatggattgaatcgaggcttgccgaaactaggcattggaagtaccaaagcaggtgctagagctgacagtgatggtaagcaacgcaccaaacgttcagagaggaatacatcgagtctacaagggaaacatgggaacttcgatttctagatctctactgctatttttctccaaaaattgtaataaattttgatagtcattggtcatttagtggattttcttctaagccactgttgtttatctgacttcattctgcagtcgtgaaccaaaagaaattatgtggccacaattttgacgccctctttacgttccttgaggaattactcgagtctacaagggaaaacatgggaaattccatttctaaaatctctactgctatttttctcaaaaatttgaataaattttgattagtcatttggcctttagtggattttcttcctaagccactgttgtttatctgaacttcattttggaatcttgaaaccaaaaaaaatattatgtggccactaattttgaccccccaattaaaaaaacccatacaaaaaaaaatatctaa

SEQ ID NO: 4422 - DNA, 716 bp, Zea mays
ctcccggccggccgggaccgaccggactccggtctagttatcgagtggaacgaagcaagacaagagggaggccgagccgcctagggtagccccgtccggtctcctgcgtccggcgaccgactgcctggcgccggcgaatcgatgggctactggtggcaccgcgtcgtgctgccggtgcggcgggcgtggctcggcgtcgcgtcccgcttcggggttcggcaaaccgggttgtggaggctgcggcaggaggtgagcacgtgcgagtacgaggacgtgcacgtgatgtgggagatgctgagccgcaccacggcgccggcgcccgcgcccaccaggcggcagcacagccggttccggccgcagccgcggccgcggccgtggggcgtcaagttccgcctctgccgaggcttctagtagaccaaggccgccgccgccgcgcgtgtcagctccgctgctgttactgcgggatagatatagcgcttccactttcttctgtctttttcggtttcttcttcttcactggttcccgctgcttgtattgtattgtatctagtatgtatcgtcgtccatccctccggcgggctctgagatgtaccttccattcctcctcgtgtacccgtctcgatccccctgcagatgataccggggcatgtgaatgaacagagctggtttcgacccgaaaaaaaaaaaaaaaaaaggacctgggcctccagcttttg

SEQ ID NO: 4423 - DNA, 765 bp, Zea mays
cattgggtacctcggggccgcgcgcggaggagactaccgaccggaccccggtctagttatcgatcgaggggaacgaagcaagacaagagggagaccgaggaggcctagccgcctagggtagtcccgtccggtctcccgcggccagcgacggactgcctggcgccggcgaatcgatgggctactggtggcaccgcgtcgtgctgccggtgcggcgggcgtggctcggcgtcgcgtcccgcttcggggttcgccaaaccgggctgtggaggctgcggcaggaggtgagcacgtgcgagtacgaggacgtgcacgtgatgtgggagatgctgagccgcaccacggcgccggcgcccgcgcccactaggcggcagcacagtcggttccggccgcagccgcagccgcggccgtggggcgacaggttccgcctctgccgaggcttctagtagaccaaggccgccgccgccgccgccgccgccgccgcgcgtgtcagctccgctgctgttgccgccgctgcggttgctgcgggatagatatagcgcttccacttaatttcttctgtctttttcgggttcttcttcttctctggttcccgctgcttgtattgtattgtatctactatgtatcgtccgccatccctccggcgggctctgagatgtacctccattcctcctcgtgtacccgtctcgatgcagatgatacccggggcatgtgaatgaacagagctggttccgatcaggttactgtgtgtgcttggtttctatatac

SEQ ID NO: 4424 - DNA, 744 bp, Zea mays
ggccggccgggctaccgaccggactccggtctagttatcgagtggaacgaagcaagacaagagggaggccgagccgcctagggtagccccgtccggtctcctgcgtccggcgaccgactgcctggcgccggcgaatcgatgggctactggtggcaccgcgtcgtgctgccggtgcggcgggcgtggctcggcgtcgcgtcccgcttcggggttcggcaaaccgggttgtggaggctgcggcaggaggtgagcacgtgcgagtacgaggacgtgcacgtgatgtgggagatgctgagccgcaccacggcgccggcgcccgcgcccaccaggcggcagcacagccggttccggccgcagccgcggccgcggccgtggggcgtcaagttccgcctctgccgaggcttctagtagaccaaggccgccgccgccgcgcgtgtcacgccgcgcgtgtcagctccgctgctgttgctgcgggatagatatagcgcttccactttcttctgtctttttcggtttcttcttctctggtttccgctgcttgtattgtattgtatctagtatgtatcgtcgtccatctccatccctccggcgggctctgagatgtacctccattcctcctcgtgtacccgtctcgatccgcctgcagatgataccggggcatgtgaatgaacagagctggttccgatcaggttactgtgtgtccttgtttctaatataccacacctggttctccctctctgttgc

SEQ ID NO: 4425 - DNA, 774 bp, Zea mays
ctggccgggtagaaagtcacagaagaagatagaagatagaggagagaggaccgaccagagtaccggacacgcagcgagggggaggaagaaggaagcaagaaggaggaccgagcaggcctaggccctagggtagtcccgtccggtccactgcggcgcaagtccggccggccggcgggctgactgcctggcgtcggtagggggcgacggcgatctatatctgtcgatgggctactggtgggaccgcgtcgtgctgccggtgcggcgggcctggctcggcgtcgcgtcccgcttcggggttcgccagaccgggctgtggaggctgcggcaggaggtgagcacgtgcgagtacgaggacgtgcacgtgatgtgggagatgctgagccgcaccacggcgccggcgccggcgccagcgcccaggcggcacagccggttccggccgcagccgcggccgtggggcggcaggttccgtctctgccgaggcttctagtggtagatcaaggccgccgcgcgcgtcagctccgatgatgttgctgcggtgcggggtactagtgattccgcttcattttggcttcttttttctgtctctctctctcttgttctttggttttcgctgcttgtatgtaccgtcggcgtccatccctcctggctctgagatgtacgtacttccattcctcctcgtatatccgtctccatccgcctgcagatgatataccggggcacgtgaatgaacagagctgatttcggtcgggtaataaaaaaaaaaaaaaagccagt

SEQ ID NO: 4426 - DNA, 958 bp, Zea mays
gcacgagaccattacctagaacatcctaatcgaaaactctccccccgcgcgtacaaatagggggaggcggagagggaacgagggatagaggagagaggaccgaccagagtaccggacacgcagcgagggggaggaagaaggaagcaagagggaggaccgagcaggcctaggccctagggtagtcccgtccggtcccctgcggtgcaagtccggccggcgggcgggctgactgcctggcgtcggtagggggcgacggcgatctatatctgtcgatgggctactggtgggaccgcgtcgtgctgccggtgcggcgggcctggctcggcgtcgcgtcccgcttcggggttcgccagaccgggctgtggaggctgcggcaggaggtgagcacgtgcgagtacgaggacgtgcacgtgatgtgggagatgctgagccgcaccacggcgccggcgcctaggcggcccagccggttcgggccgcagccgcggccgtggggcagcaggttccgtctctgccgaggcttctagtgctgttgctgcggtgcggggtactagtgattccgcttcattttggcttctctctctctctcttgttctttggttttcgctgcttgtatgtaccgtcgtcgtccatccctcctggctctgagatgtacttccattcctcctcgtgtgtatccgtctccacccgcctgctgcagatgatataccggggcatgtgaatgaacagagctgatttcggtcgggtaataatcctgtcctctgtttcgaccataccacctacctacttctcttttgaaccttgacgacgaattcatctgtaaacaaaggggtagagagtattagtgtacgatttcaagattcagccagttggtcggaggccgcccgccaaaaagaaagctggtccagcaagtaattaagtccgggcaggtgccggcgggcgagccatctatacaatagta

SEQ ID NO: 4427 - DNA, 1621 bp, Zea mays
  misc_feature (18)..(18): n is a, c, g, or t
gcacgagaaccatttacntagaacatcctaatcgaaaagctatctccagtagagaagtcattcggacatgtgggccacatctccaccgccgctcccagtccagctccggcgaccgccgcatcctcgcttcatcgcccgccgccgtaacaagcggctggaccgcatcgcggcctcacaggacccgctaaccgcgctgacccgggtgctgtggggaggcgcgctgccgccggcgcagctcgtcgtcgccgtgcgccacggctggaccacggcgtggcagctcctgatgcggcagctggcgccgtccgaccccgcgacgggcggcttcgcccgtgcccctgcccgcttccccgccgtcgtggggaagcccagctcccggctccacctctacgtgggcctcccctgcccctgggcgcaccgcgccctcgtcgtccgcgcgctgctcggcctcgaggcccgcctcccggtctccgtcgccgtccccggggacgacggcgcgtggtccttcacgcccggcagccccgacctgctctacggcaagcggaagctccgggaggtgtacgccctgcgcggcggcgggttcgagggcagggcatcggtgccgatgctttgggacgccgagcgctgcgaggtggtctgcaacgagagcatcgagatcgtcaagttcctctgcgacctcgctggcgacggcgccggtgacctcgacctgtggccgccggagctgcgccaggacatcgaccgctggtacagcatcatctaccccagcgtcaacaacggcgtgtacaggtgtgggtttgcgcagagccaggaggcgtacgacgccgcggcgagcgagctgttcggcgcgctcgacaggctggaggcccacctcgccggctgccgttacctgtgcggggacaggctcacgctggcggacgtctgcctcttcacgacgctcatccgcttcgatctcgtctacaacacgctgttcaggtgcaccaggcggaagctggccgagtaccctagcctccatgcctacacgcgcgacatctaccagatgcccaaggtcgccgagacgtgcgacatggaggccatcatggcaggatacttcaagacactcttccccctcaaccccggcgggatccagccacacccgccggccacctgcgatagggagtcgctcttgaggccgcatggtagggaggccttgtcctctgctgctggcacgccgcttgaagcagctgcggtttcataattcattcaggctttgaacaaaacttcggaaactgcagaaagagttttcagttctaccagatactggtgcttcagcttcacaggatcaaatcacatcgcagtaactgccatttgcaaattcttatcttgtccatatgagtcactggttaattatattggcaagatctgtgctgccaatggtgattatgatagtctctttggatgaaaatataattggttctgctcactgtacctaaactagaatacttagtgtaataaatcgctcctgtttggacatggaaaaaaaaaaaaaaaagcagttgatcagttgtataatggcatgtgttctgttcaatagaatccgttacagagacatcttttgtctgtgcttatatacatcagaactgtctgc

SEQ ID NO: 4428 - DNA, 1159 bp, Zea mays
ttttttttttttttttgttttttttttttttttggaataaccttggcatttatatggttgccagaattcatgttgtatgtagcacttggttctggcacaaaagcaaaattaatcaacatacaactcacttcaacccccagaatcacatttaacaaaaatatagtagtaatttaagtggtcagttccatttatttcactgtgtttgtgcgaagtaattgctcagaatgcacggtccagatggtatcctgaggtagacgtccacagccggtccatgtcgattacagagtttaccttcatgatagtgaaaatctccaaatacctctattacagcaatgctatgtcgccgccactgccttccataaacagcttgtgttctctgatgtattcaattacttcatcactagtgagatactttatcgatagagatcttcttatgcagtctcttactctggaggaactgatctgatttggcacaatctcatcaaccgaaataatgttatccctgcattcttgcaatatatcgctgttgtctatcaattttccaacatcctttccttctcgccgtatgcatacgacaccaaagtcctggcatatggttctgacctggtctaggatccaaacacctggagtgctgaatgactcgagcaagtcagagccacataaaagcattaccttgaggctaccttggtcagctacaccatccttgcatagtgagtttcgtattctcgaaagaacggtcaaagtgcgctgataaccattctgcattgcctcccacggatcaaccatcacaaaagatgagcttttggacgcaagttcacaaaagcgaattcggtgagcagccggtaagaggtccttcttcttatatgcatcattcaccggagacatgtagccgcccaacacagaataacctcgcagctcgagttcatcctttgccagctcaaacatgcgcaggtgcatgtaggtgggagggttaaagctcccagtggccacgagcacgacgccacctccgtccctgtacggtgcagcggagagcttctgtttcgggagaggcatgtccccgcccacctcctccatcgccggcgagaggagacgaggcggcgctgcggtgcgtgggtgtggccgtggggggagaagaatctcccggccggccccggccggc

SEQ ID NO: 4429 - DNA, 1357 bp, Zea mays
attgggaccctcgaggccggccggggggcggccacgcgcacgcacccataaaagtcctcgctccaccccctccaactcccgtcccctctccctccctccttccccgccgccgccgccgccatccaccaggtcagctccagcggacgacgtctcaacagtctcgcgccactgagatctcgccgagggagggagagcagcaggcagcagcagacatgtcgtcggggcggtacatggcgtactcgccctcgccgtcgaccaccccgcactccccccgcatccacggcctccgcaccccctctgccgccgtcgccgagcaggagaagtacctttccgaactgctcgcggagaggcacaagcttaccccgttcatcccagtgatcccacatagtgtacggttgctgaatcaagagttctccagcttatagctggcttggaggatctcaaggcagctcctctggactcattgtcaagaaaacaatgaaggtcgatatcccagtagacaaatatccaacatacaattttgttggccgcatccttggtccaagaggaaattccttgaagcgggtggaggcaaatacggattgccgcgtgctaataagaggtcgtggcagcatcaaagatccagcacgggaggaaatgatgcgagggaagccaggatatgagcatctgaatgaacctctccatatattggttgaggcagagctacctgttgacatcattgatgctcggctgatgcaagcccgcgagatccttcaagatctgctaaagcctgtggatgaatcccaggacttcttcaagaagcagcagctccgggagctcgcgatgcttaatggcaccctgcgtgaggaagggatgcagaggttcggttcagcgtcccctttccacaacagccttggaatgaagagagccaagacaagggggtgatgaagaaagtcgcaagcatcatgaagggagaacttaaatcatcatctattctgaggccaatcctgtgtacgaatggggggttgccttgctggctactggcccaatacggtctcgcgccaccagcatcgcggcgcgggcggccgtgcacgataaaacatatatctggagttgtgtctactgggggagttgagtttggttatgcgccatgggttgttacgctatatattgggctgtgcaggcttttgtagcaatgtggtttgtgtaaatgctcatttggagcgtttggaagctctcggcttgtatttctttcttatcgagatagtattcaaggacgctgtttgggatttgaagcaatgctctaaactgcgacaagcatggaggcttgatctgtttcattcgaatctcttgtttgacaccaaaaaaaaaaaaaaaa

SEQ ID NO: 4430 - DNA, 1606 bp, Zea mays
agtaccaccaccgggagaccgggcgcccctcgcggccgcccgccacgccccggctactattcacttcacttgttaccgcgcgcggcgcgcctaccactactctctactcatcactcccccgcgggcggccacgcgcacgcacccataaaagtcctcgctccaccccctccaactcccgtcccctctccctccctccttccccgccgccgccgccgccatccaccaggtcagctccagcggacgacgtctcaacagtctcgcgccactgagatctcgccgagggagggagagcagcaggcagcagcagacatgtcgtcggggcggtacatggcgtactcgccctcgccgtcgaccaccccgcactccccccgcatccacggcctccgcaccccctctgccgccgtcgccgagcaggagaagtacctttccgaactgctcgcggagaggcacaagcttaccccgttcatcccagtgatcccacatagtgtacggttgctgaatcaagaaatttttcgtgtttccacactattggagaacgcgtctcttttaaatcaaagtggccttgaacatggtagtccactaacaacgggaggattatattcaaacggagcagctactgacatgaatgggtggccatcagcatttcaatcagaaagttctccagcttatagctggcttggaggatctcaaggcagctcctctggactcattgtcaagaaaacaatgaaggtcgatatcccagtagacaaatatccaacatacaattttgttggccgcatccttggtccaagaggaaattccttgaagcgggtggaggcaaatacggattgccgcgtgctaataagaggtcgtggcagcatcaaagatccagcacgggaggaaatgatgcgagggaagccaggatatgagcatctgaatgaacctctccatatattggttgaggcagagctacctgttgacatcattgatgctcggctgatgcaagcccgcgagatccttcaagatctgctaaagcctgtggatgaatcccaggacttcttcaagaagcagcagctccgggagctcgcgatgcttaatggcaccctgcgtgaggaagggatgcagaggttcggttcagcgtcccctttccacaacagccttggaatgaagagagccaagacaagggggtgatgaagaaagtcgcaagcatcatgaagggagaacttaaatcatcatctattctgaggccaatcctgtgtacgaatggggggttgccttgctggctactggcccaatacggtctcgcgccaccagcatcgcggcgcgggcggccgtgcacgataaaacatatatctggagttgtgtctactgggggagttgagtttggttatgcgccatgggttgttacgctatatattgggctgtgcaggcttttgtagcaatgtggtttgtgtaaatgctcatttggagcgtttggaagctctcggcttgtatttctttcttatcgagatagtattcaaggacgctgtttgggatttgaagcaatgctctaaactgcgacaagcatggaggcttgatctgtttcattcgaatctcttgtttgacactatcaataaccagtgcatat

SEQ ID NO: 4431 - DNA, 1483 bp, Zea mays
tacctcgaggccggccgggccgggatgcataaaacgtggctccctccctccttccttgccgccgtctaccagtacagctcgagcgaacgacgtctcgacagtcccgggccgctgagaacttgccgcgggagggagagcagcagcggcagcatcagacatgtcgtcggggcggtacatggcctactcgccctcgccgtcgaccaccccccactccccccgcatcgccggcctccgcgccccgtctgccgccatggccgaacaggagaagtaccttgccgaactgctcgcggagaggcagaagcttggcccgttcgtcccagtgatcccgcatagtgtacgcttgctgaatcaagaaattttacgtgtttccacactaattggagaacgcatcccttttaaatcaaagtggccttgaacatggtagtccactaacaacaggaggattatattcaaatggagcagctactgacatgaatgtgtggacatcagcatttcaaccagaaagttcaccagcttatagctggcttggaggatcccagggcagctcctctggacttattgtcaagaaaacaatgaaggtcgatatcccagtagacaaatatccaacattcaatttcgttggccgcatccttggtccaagaggaaattccttgaagcgggtggaggcaaatacggactgccgtgtgctaataagaggtcgtggcagcatcaaagatccagcacgggaggaaatgatgcgagggaagccaggatatgaacacctgaatgaacccctccatatattggttgaggcagagctacctgttgaaatcattgatgcgcgcctgatgcaagcccgcgagatccttgaagatctgctaaagcctgtggatgaatcccaggactacttcaagaagcagcagctacgggagctcgcaatgcttaatggcacccttcgtgaggaagggatgcagagatccggttcagcgtcccctttccacaacagccttgggatgaagagagccaagacaagggggtaatgaacaaagctgcaagcatcatgaaggcagaaccaaatgaatctattctgagaccgatcctgtgtgcacatgggattgccttgcttggctattgtactggcccagtacggcctcgagccaccagcatcggggcggccgtaccctgataaaacatatatatctggagttgtgtttgctgctaccgggggagttcggttatgcgccataggttgttcgctatatattgggttgtgcgggattttgtagcaatgtggtttgtgtgatgctcatttggagcgtttgagagctctcggctcgtatttctcatcaagatagtatttaagggcgctgtttgggattttgaagcaatgctctaactgtctctgtacacgacaaacatggaggcttgctatatttcatgaatctctcgtttgctgctatcaatcactgatgcatactagtaaagtgatggcgtcttcagttgc

SEQ ID NO: 4432 - DNA, 1364 bp, Zea mays
gccggccgggtcgggcagttcacttgttaccgcgggcggcgcgcttaccactactctctactcgctccccgcgggcggccacgcgcacccatatggccatataagccctcgctccaccccctccaattcgcctctcctctccctccctccctccttccccgccgccgtctaccagtacagctcgagcgaacgacgtctcgacagtcccgggccgctgagaacttgccgcgggagggagagcagcagcggcagcatcagacatgtcgtcggggcggtacatggcctactcgccctcgccgtcgaccaccccccactccccccgcatcgccggcctccgcgccccgtctgccgccatggccgaacaggagaagtaccttgccgaactgctcgcggagaggcagaagcttggcccgttcgtcccagtgatcccgcatagtgtacgcttgctgaatcaagagttcaccagcttatagctggcttggaggatcccagggcagctcctctggacttattgtcaagaaaacaatgaaggtcgatatcccagtagacaaatatccaacattcaatttcgttggccgcatccttggtccaagaggaaattccttgaagcgggtggaggcaaatacggactgccgtgtgctaataagaggtcgtggcagcatcaaagatccagcacgggaggaaatgatgcgagggaagccaggatatgaacacctgaatgaacccctccatatattggttgaggcagagctacctgttgaaatcattgatgcgcgcctgatgcaagcccgcgagatccttgaagatctgctaaagcctgtggacgaatcccaggactacttcaagaagcagcagctacgggagcttgcgatgcttaatggcacccttcgtgaggaagggatgcagagatccggttcagcgtcccctttccacacagccttgggatgaagagagccaagacaaggggggaatgaacaaagctgcaagaatcatgaagggagaaccaaatgaatctattctgcaagacatggggttgccttgcttggctactgtactggcccagtacggcctcgagccaccagcatcggggcggccgtaccctgataaaacatatatatctggagttgtgtttgctgctactgggggagttcggttatgcgccataggttgttcgctatatattgggttgtgcgggattttgtagcaatgtggtttgtgtgatgctcatttggagcgtttgagagctctcggctcgtatttcttatcaagacaagatagtatttaagggcgctgtttgggattttgaagcaatgctctaactgtttatctctctgtctctgtacacgacaaacatgaaggtttgc

SEQ ID NO: 4433 - DNA, 1554 bp, Zea mays
ggaccctcgaggccggccgggaccacttctctctactcgctccccgcgggcggccacgcgcacccatatggccatatttgccctcgcctccacccccgccgggtctcctctcctctccctccctccctccttccccgccgccgtctaccagtacagctcgagcgaacgacgtctcgacagtcccgggccgctgagaacttgccgcgggagggagagcagcagcggcagcatcagacatgtcgtcggggcggtacatggcctactcgccctcgccgtcgaccaccccccactccccccgcatcgccggcctccgcgccccgtctgccgccatggccgaacaggagaagtaccttgccgaactgctcgcggagaggcagaagcttggcccgttcgtcccagtgatcccgcatagtgtacgcttgctgaatcaagaaattttacgtgtttccacactattggagaacgcatcccttttaaatcaaagtggccttgaacatggtagtccactaacaacaggaggattatattcaaatggagcagctactgacatgaatgtgtggacatcagcatttcaaccagaaagttcaccagcttatagctggcttggaggatcccagggcagctcctctggacttattgtcaagaaaacaatgaaggtcgatatcccagtagacaaatatccaacattcaatttcgttggccgcatccttggtccaagaggaaattccttgaagcgggtggaggcaaatacggactgccgtgtgctaataagaggtcgtggcagcatcaaagatccagcacgggaggaaatgatgcgagggaagccaggatatgaacacctgaatgaacccctccatatattggttgaggcagagctacctgttgaaatcattgatgcgcgcctgatgcaagcccgcgagatccttgaagatctgctaaagcctgtggacgaatcccaggactacttcaagaagcagcagctacgggagcttgcgatgcttaatggcacccttcgtgaggaagggatgcagagatccggttcagcgtcccctttccacaacagccttgggatgaagagagccaagacaagggggtaatgaacaaagctgcaagaatcatgaagggagaaccaaatgaatctattctgcaagacatggggttgccttgcttggctactgtactggcccagtacggcctcgagccaccagcatcggggcggccgtaccctgataaaacatatatatctggagttgtgtttgctgctactgggggagttcggttatgcgccataggttgttcgctatatattgggttgtgcgggattttgtagcaatgtggtttgtgtgatgctcatttggagcgtttgagagctctcggctcgtatttcttatcaagacaagatagtatttaagggcgctgtttgggattttgaagcaatgctctaactgtctctgtacacgacaaacatggaggcttgctatatttcatgaatctctcgtttgctgctatcaatcactgatgcatactagtaaaaaaaaaaaaatccatattaaa

SEQ ID NO: 4434 - DNA, 1683 bp, Zea mays
ttgggtcccctcgaggccggccgcgagctgtgcggcatcttcgatcgtgtcaccactggcgatggacatggcggcgagcggcgcgctccccgtggtggacctggcgccgttcttcacggacggcgacgagggcggcgcctcccgcgccagagccaccgaagccgtgcgccaggcgtgccggacgcatggcttcttccgcgtcgtcaaccacggcgtgccggcacacctcatggcgcgcgcgctcgagctgtcgtccgctttcttcgcgctgccggacgacgacaaggccagggctcgggcgcccgagggctccgaagcaccgctccccgcgggctacgcgcggcagccggcgcactcggcggacaagaacgagtacctcctggtgtttggtcccaagcttgggttcaacgtgtaccccgccgagccatcaggattcagagaggcagtggaggagtgctacaccaagctcaccgagctggggctgctcgtgcaggaggtcctgaacgagtgcatggacctcccgccgggcttcctcacggactacaacagcgaccgcagcttcgacttcttggcggcgctgcgctacttcccggcgacggaggaggaggacaacggcatcagcgcgcacgaggacgggaactgcatcaccttcgtcatccaggacggcgtcgggggcctcgaggtcctcaacgacgacggcgactgggtcccggcggagcccgtcgagggcagcatcatcgtcaacctaggcgacgtcatacaggtgctgagtaacaacaagctcaagagcgcgacgcaccgggtggtgaggaagcccgtgcacaggcactcattcgtgtttttcttcaacatccacggggccaagtggatcgagccgctgccggagttcacgaccaagatcgacgagccgccgcggtacaaagggttcgtgtacaacgagtacatgcagctgcggatgaggaacaagacccatccaccggcgaggcccgaggacgtcgtccacataacccactatgccatctagcttgcttgcgaatccaaaacaggcttcaaggcgcagaaactgcacaaacaagcaacctgcacgcaaatggatgtgtcagctcttgttaagattgttgtggtctggccatcccacgtaccatgctatgctatcattaaaatcgagattaaataaacaacaaatccagctatgcacagtcgccgttgtttccgcttttccctaggcataattcttgcggttatcgatttttgtcgattctctgattctcaattacaagttttattttcaactccgaacaatggtgtggtaggaaaaaagcgagtttattgtagggtgtttagcgggattcttaattacaagttttatttagttaaacctaagattatttgacttatcgagaaacatgaatgtgttggaagcttacaggctgaacaaggaagagggtcaatttatttggatgctggacggatcagaaaaatacactacaggatccatcatccatgtatagaaggctaagttttatgggtgtgactaataaaagaatgattaaactatggaaaattaaggttttcatgtgccgggctatgcaggacacattacaggcggggaaaatctcaaaagcaaaacaagtggaaaggaaatcaaaaattgctgcctttgcggggtctctgaaggggggg

SEQ ID NO: 4435 - DNA, 1899 bp, Zea mays
tgggtacctcgaggccggccgggaaaaaaaaaataaacatggggctcctccgggccggccgggaagattccggctctgcatctggcccagctctgggttgcgcgaacagtcggaaccctaattccctccccggcgccggcgccggcgccccctagctgcgcccccacgaccagcagaatccagatcgaagttttgctcttgccgcggccccgcctaaactccaaaagtgcgaaccccctaactcatcgatcccagcctgcctccgcctacgcgcctcgtgacggcgtggacccctcccctatctgcgtgctgcgcgcatccgcctgcggcctgtcccgtgcagccgtgcctcctccgcgcacatctccagggtctagccgagagcagaccgccgtgacgccaccactcgcgctcgcgctcctgacatcgttgtctgccttctctgtctaagatcagagcagagctccatcgaaagcgtcgcccgcctgcttggatgatcaatcaccacgaaatagtgcagtttgggaagctgtacaatagagacatggaatcagctcctgctcatacccctcttatacatggtcttcctgatgaggtagctctcatttgcttggcaagagttcctcggcggtatcataatattctcaggcgtgtctcaaggagatggagagctctgttatgcagtgaagaatggcacttgtgccgcaagaggaataacttggacgagccgtggatctacgtaatctgtagggaagcaggcatcaaatgctatgtgttggctccagatcctccaagccggtgctttcgaatcatgcatgtcattgaacccccatgctcagggaggaaaggtgttaccattgaagctttagacaaaaagctatttcttctgggtggctgcagttccgtgtatgatgctacggatgaagtatattgttatgacgcatcctcaaatcgctggagctcagctgctccaatgcctacagcaaggtgctattttgtgtctgcatcccttaaggagaagttgtacataactgatggatacggcttgacggacaagtcaccaaattcatgggacatctatgacccggccacggactcgtggtgcacccacaagaacccgttgctcacccctgacatagtgaaattcgtcgcattgggcgaggagctggtgaccattcaccgagcggcgtggcacaggatgtactttgccggcgtatacgacccgctggaacgcacctggaggggcagagggaacgagatcgctctctgctactcgagcccgacggtggtcgtggacgggacgctgtacatgctggagcagtccatgggcacgaagctgatggtgtggcgggaggacgccaaggagtgggccatgctcggcaggctctccgacaaggtcactagacccccctgcgcgctcgtggccatcggcaggaagattcatgtggtcggaagagggctgagcatggtcaccgtggatgtggacacggcggcaagggtggacgggttcctggttaccacctctgtaggcccgttggtggaggaagacctgaccccggagaggtgcgtggtgatcaccatctgaaggggtgggcgtgtccaagcttccttgacgccgggtgtattgtggtaactgtgactgactatcgtcgctggcgccgaacatttggctagctagcgtggatgatatatactgcgatgtgagtgaattcaataagaggcttggctctccatacagccaataactatagttagcatttgtatctcgtgttgtttgggctgcttttgtcgactgctggctgtaagaacaatatttgagcttcgtttgttgagtactgtgcgtcccagatggatgggattaatacaagctaatgtgatcctcgtcaaaaaaaaaaaaaa

SEQ ID NO: 4436 - DNA, 1425 bp, Zea mays
gcccgctccatctaatccaacccgcccgataaaaagggttttggtgtctatacagatcaacaacattcccacgccactcccagagctcctaacccggaaccacgaaggggatccatggcggcggcgggttggctccgacgtgcggcggcggtatcgctgccccgcctgccttccggacttcccctcataccgcctcctccttccggccctctcaccgaggcgcagtcgctcgtggtccccggcctcggcgccgccgccgggccagccatggagctcatggccgtccctaagaagaaggtctccaagtacaagaaaggtttgaggaatggacccaaagctttgaagcctgtgccggtgattgttcgttgcaggtgctgcggccgagtgaagctaccccacttctattgctgcagtggagaaagaggaaacccaagcgagtcgaactcataaatgttttgttttcctactttgctcactatgctacgtctgaaatctggacatcgtaataccaatgaaataaattgtcagatcgctcttggtattcaccttgttctccttccaagcattgaatcaatacacacttactctagtttgaattcgaagtgtaagactatcatcaagagcctttctaattttctgatatcatttgagtaaaacttattttttatatttttataccctccaacagttttttttaaaaaaaaagcggccaacttgactgcaataaagaagaaaaaagaagcagttaaaccagctgattttcatgacccagcaagggagtcgtttgaggaagaggaggagaggcaacggctggtggaggagcaggcaaagcaggcagctctattttatgcaacttgtattaatacttggtactgacttcaaaacactttggaaggtccatatatatccagagtttctctttaaataattggtttatttaatcctaatgttttttagcttcttggctcaatctcaacctatagtaactaaaaggtcaacaacaacagtttcaaaataactgttgtataaagaagctactataaggccatgatgcataaggtgaagtctcttaactgaataaaatgttgtatgtagaaatctgcttaaactgaatatagtgaggtatgtaaactgaataaattgtacaaactaaaaaaagtcaagtatgtaatcttaataatatacacaaactgaaaactggttaaaggttgctgaaactgacaatgtacaggttgcatagattgaataaaggtttgtttggaaccgtagcaatgcaatctataaactatagacactgataaactttatggaccacaatctataccattttcatgaatgtggagtgccatctctaaaaagagaatagtataaaaattatggaccacaacctggattcatgagtactactatctaacaaagactgca

SEQ ID NO: 4437 - DNA, 774 bp, Zea mays
gtttacgtatttgttgtccttccggccttcagattcctgcccgctccatctaatccaacccgcccgataaaaactctacggccagatcaacaacattcccacgccactcccagagctcctaacccggaaccacgaaggggatccatggcggcggcgggttggctccgacgtgcggcggcggtatcgctgccccgcctgccttccggacttcccctcataccgcctcctccttccggccctctcaccgaggcgcagtcgctcgtggtccccggcctcggcgccgccgccgggccagccatggagctcatggccgtccctaagaagaaggtctccaagtacaagaaaggtttgaggaatggacccaaagctttgaagcctgtgccggtgattgttcgttgcaggtgctgcggccgagtgaagctaccccacttctattgctgcagtggagaaagaggaaacccaagcgagtcgaactcataaatgttttgttttcctactttgctcactatgctacgtctgaaatctggacatcgtaataccaatgaaataaattgtcagatcgctcttggtattcaccttgttctccttccaagcattgaatcaatacacacttactctagtttgaattcgaagtgtaagactatcatcaagagcctttctaattttctgatatcatttgagtaaaacttattttttatatttttgtaccctccaacagttttttttatatcttgtatgcagtccgattatatgcagcctgaaaaaaaaaaaaaa

SEQ ID NO: 4438 - DNA, 2379 bp, Zea mays
cccagcgtccgcccacgcgtccggtagtatactagaagaggaggaggagagccacgcgtcgaagcgaagccagggcaaggtcgtcggagccggagagggaggaaggtggagaacctctacctgcgtcacgtgacaactgtctcctgacccacaggagcggcggactccctctgctcgccgcgcgcggcctgttccggttcggtcggcggccgacggccggcggcggaggcagcaggaagctactgtaccaaccggcccaagagaattgcgggtccagaggcagtgatggcggggcgctacgattgacgtgctacgattatgggcatccaagggaacaaggcggcgacgcacgagcacgacttcctctcgctgtacgccgccgccgccgccaaggacgctcctctcctgctacacgactccaaggcgccgcctccttctcaaggtaatttcctcttgaagacgcacgacttcctgcagccgttggatcagaagccgggagcgccgccggagccgtcgccgctgcccgcttccgccgcggagagcaggcaccagccgcagcagcaggtcgtcgtcgcgaaccagcacgcgctgcccctgcccggcggcgtcggcaccttcagcatcagccccgcgcccgtgtccgtcgcgctgccggagccaaagctaaaggcgggcgcttttgtgtgtttcttgtgttgtgggtctctccaccaccaccagcagggcaccagcagcagtgggcgctccccttcgccggcgccgggcaggtcaggctgccgccgcagcaggcgcctccggatagaaagggccggggcggcgccggtggcggggtcatggagtctggctccagatccagcggcggggcggggttcgacgacgacgacggcctcaccacgcgccgcgaggtctcctcttcgctccaagatttgacagtaagggtggacaggaagggtgggagctgcagcgatggtggtacggatcagcggccaaacacaccgcggtcaaaacactcggccacagagcagcgcagacgcagcaagatcaatgataggtttcagatacttagggagctgttgccacacagtgatcaaaagagagacaaagcaacatttctcttggaggttattgaatatatacggtttttgcaagagaaggtgcaaaaatatgaggcaacatttccagaatggaaccaagaaaatccaacgatgcttccgtggagaaatgcacagagtaaaggccaaatctcaggagattccccgcctgacccttcacatttcgtgagaaatggatcctcccctggatctaatttcactgggaaacttgatgataatcacaacatagtgacatctgcagctgcatcaggggcacaggatcaggcagaaaccgaccacatggctagcggatgctacagatcagcagaaactacggcgaattttacaaataatgctatgtctcagtcccaacctcaatggaccggtccgtcccctgtggatgactctgcagtgaacagtgagacgcttaacaaccagcagttggtgattgatgaaggaacaatcagagtgtccagtaactattcccaagagttgcttaactcgttgactcatgcccttcaaagctcaggtgtagatttgtcccaagccaacatctctgtgcagatcaacatgggaaagcgtgccgccaagagacccgctgctggtgtatccagcaactccaaggaaccagctgatccggcatctagcaacgaattagggcatcagttgacgctgtcgggtgccggtgccgactgcctctctcacgcaacaaagcggcataaacggagcaacagctgatggccgctctccctcacctcgctccccgaccgacggacggacggatgacggattggtgacattcttcttttccctcccagccaacggggaggctcgtggattggctggctggctgtacattgtgtgctgtgcttggtgacaagctgagacctccggcgtattctttgattcgatcacccccgcgcccgccatcccattgtttacgtagagaagaggaaccgtggagcttttcatcgcggattgtgaagccgctcttgtacacaggcttccattcaatgtgaggagcttccccctccttgacacatctccgtgttgtagacctgtagccacctgtaagatatgtgatgatggcccaacaatcaactctgccagaccactggctagtcgagttgtttgggtcactttatgtacggtgttctgttatgctgggagtgtaattgccccgccgtctcagtgaactgatcgtcagttgtgtgcttgtttgcccaagggtttactatgtgagaatagagatggcaacgggtacccacccactgggttttgccgtccc

SEQ ID NO: 4439 - DNA, 2287 bp, Zea mays
tgtccagtaactattcccaagagtaagtcgcaaagaatatgagttatattttgctcattccgttcaaaaatgcttgccacatttgattatgcatagtcattggtgcatatctttgagtacaaaatttttcttggcaacatgttcttagccttaatccttaaaatttatgttattttgctagtatttgtcaatccaattatacacatatagcttgcatattttcaaactaatcgatttaaaagtttgatttttttaaggtttgactaaatcttgtcctaaacaacataacccaacagactactacttttctctcataagctctcattcttattgttaagtcttttttttcctgtttagtgggtccaccattaggttttcccaccataaatttcttgctatttctctttgtaccttggttctttcagaatattagctcagaaagcactttgtgtttgggcatgggcagctaatgatttgttatcttcgccgaagataaatgtatgttgatacatcttttcttttatttgggacagagttgcttaactcgttgactcatgcccttcaaagctcaggtgtagatttgtcccaagccaacatctctgtgcagatcaacatgggaaagcgtgccgccaagagacccgctgctggtgtatccagcaactccaaggtacagtaccccgaccatatgaacaggtgttcatttagaagatagcattccagcaagacgactcattttaggtttgagatgggaaatacgcaacggccttttcacaattaaaaaatgggcatggtttttttacgatggaaatatgtgcctgcttagtacttgatatatgcatataacttgtgagtctttagcagtgttctgtacaagcggtggaagctctgaaatatcatctcacaggcatctggaagctctgaacattttgcatctgcatcattcgtccacgctgatttatgattttgacatgggacttgaatccggcgcaaggaaccagctgatccggcatctagcaacgaattagggcatcagttgacgctgtcgggtgccggtgccgactgcctctctcacgcaacaaagcggcataaacggagcaacagctgatggccgctctccctcacctcgctccccgaccgacggacggacggatgacggattggtgacattcttcttttccctcccagccaacggggaggctcgtggattggctggctggctgtacattgtgtgctgtgcttggtgacaagctgagacctccggcgtattctttgattcgatcacccccgcgcccgccatcccattgtttacgtagagaagaggaaccgtggagcttttcatcgcggattgtgaagccgctcttgtacacaggcttccattcaatgtgagaagcttccccctccttgacagatctccgtgttgtagacctgtagccacctgtaagatatgtgatgatgcccaacaaacaactctgccagaccactggctagtcgagttgttgggttacttatgtacggtgttctgttttgctgggagtgtagttgccccgccgtctcagtgaactgttcgtcagttgtgtgcttgtttgtccaacggtttactatgtgagaatgtgtgggaattcgtggacggatcccgtcgcagcggcggcggcaagcgtgggagacgtatggagcccgagtcgagatacgatcggggtcactaatgccaaatgttgcgaggggtgatgatttgaccaagcgaggataaggctagctttttggtagtggggcggactagtggctgctgcggcctgcggtgcaatataccatcaggtgttttatagtcgtcaagcccacgcactgcgtggcgcgaccaagcaacgcatcaccagtattttactgcgatacaccggggcagttggctatagactatagtgattcgatcactaatggtgatgccaactggttggattttggtggactcagcacgcctgcctgagacagacatgcgactttgcgagtagagactggtaccccgtcgcgatcatgcgccgctcgatcggcactgcgaaaactgcacggcggcttggagttggagatgcatggggccccgacaaagcgctgaccgaaccacctcccacccatgagggatcaaactcgcacgccggcgtgggggcaaggcgatctcgcgttcagatgcaggtacgccgacgctgtcactgcctagacatacttcgccagggccaccacgacattaggtgtcaattggtggatctgcacgtcatacctctgcaagacctccgccaca

SEQ ID NO: 4440 - DNA, 2285 bp, Zea mays
ctgcagccgggcgcgcgaggtacgtctatactacactcgctacgtgtccaaacgcttttaacgctaaactaaatacatacatatgttttactatataagaaaatacatataactctaattaaacctagttagattctgtagcgacaccaattgggaatggagtacattgatgggaacggagggagtacatgctcaagagtcaggagactcaagtactcaactagtcctcatgtacctccaccatttcgtctagctagtccatcccgaaatacacacgccacaaagacacggcgccacggtcgcagcgcgtgcgcgtcgtgtgccgtactgccatgtcgcatggttaatcgtgcacgcgggccccggcttttgcatgcctgtctcaacagtgcgccagagatatgagagaacggcccaacagacctcgtgcatgtacgtactccgccgggccagcaagcccgggtccatgttgcccgtgcacttcagcctcctgtcgcgtcctctttctcgcgagacccaccccacccacgtgacctccaggtgctcgcccgccgggcctggcccactgatggccgagctgccggctacatccacgccgcgctagctgccactggccccaccttccaccgacatgtggggccgctcggcttccgcctgtgcaatacttcgatagtaactgtttgtgtgggaaattactaaaaacactttttgtttgtgtgggaaagaagaaaaaaagaactaacgttaaaggcggcttgtgttgtggcgcagggcaccagcagcagtgggcgctccccttcgccggctccttgcaggtcagtccgccgccgcagcaggcgcaaccggataggaagggccgcggcggaggcggggtcatggattcaggctccagatccagcggcggagccgggttcgacgacgaagacggcctcaccacgcgccgcgaggtctcctcctcgctccaagatttggcagtaagggtggattggaagggtgggagctgcagcgatggcggtacaaatcaggggccaaacacaccacggtcaaaacactcggccacagagcagcgcagacgcagcaagatcaatgataggtttcagatacttagggagctgttgccacacaatgatcaaaagagagacaaagcaacatttctcttggaggttattgaatatatacgttttttgcaagagaaagcgcaaaaatacgaggcaacattcccagaatggaaccaagaaaatccaacgatgcttccgtggagtaaaggccaaatcccaggagattccccgcctgacccttcacatttcgtgagaaatggatcctcccctggatctaatttcactgggaaactcgatgataatcacacatctgcagctgcatcaggggcactggaccaggcagaaactaatcacgtggctagcggctgctacagatcatcagaaactccggcgaatattacaaataatgctatatctcagtcccaacctcaatggacaggtccgtcccctgtggatgactctgcagtgaaaagtgaaatgcttaacagccaggagttggcaatagatgaaggaatgatcagtgtgtccagtacctattcccaagagttacttatctcgttgtctcacgcccttcagagctcaggtgtggatctgtcccaaaccagcatctctgtgcagatcaacctgggaaagcgtgctggcaagagatctgcatctgctggtggtgtatcctccaactccaaggaaccaccagccgatccagcatctagtaacgaactaggcggccatcacgtgacaacgttgggagctagcgctgacggtctcctcccccacgcgacgaaacggcataaacgggacaacagctgatgatgggcctctctcactccgcctcgttcccagacgacagacggattgatcattcttttttttttctcccagcccgacgggaggctctctcttggattggttgcacatcgcgtgctcggtgatgggctgagaccccggctgtattctttttgatttgatcgctcccgccgccatcccctgtctagcccattgtttttacgtagaggaacgaaccgtggagcttcccattgcggattgtgaagccgctcttcttgtacacaggcttccattcatctgagaagcttcttcccctccttgaacaggtctctccgcgttttagacctgtatactagcaacctgtaagatatgattatgatgtcccgcagctctcccaggcacggcaccggccagtcaagttgttccgttaaaaaaaaaaaaaaa

SEQ ID NO: 4441 - DNA, 1237 bp, Zea mays
aattcggctcgtcgcaccaccagcagggcaccagcagcagtgggcgctccccttcgccggcgccgggcaggtcaggctgccgccgcagcaggcgcctccggatagaaagggccggggcggcgccggtggcggcgtcatggagtctggctccagatccagcggcggggcggggttcgacgacgacgacggcctcaccacgcgccgcgaggtctcctcttcgctccaagatttgacagtaagggtggaccggaagggtgggagctgcagcgatggtggtacggatcagcggccaaacacaccgcggtcaaaacactcggccacagagcagcgcagacgcagcaagatcaatgataggtttcagatacttagggagctgttgccacacagtgatcaaaagagagacaaagcaacatttctcttggaggttattgaatatatacggtttttgcaagagaaggtgcaaaaatatgaggcaacatttccagaatggaaccaagaaaatgcaaagatgcttccatggtcaaatatgtattttcgatcattctggaaaaatgcacagagtaaaggccaaatctcaggagattccccgcctgacccttcacatttcatgagaaatggatcttcccctggatctaatttcactgggaaacttgatgataatcacaacatagtgacatctgcagctgcatcaggggcacaggatcaggcagaaaccgaccacatggctagcggatgctacagatcagcagaaactacggcgaattttacaaataatgctatgtctcagtcccaacctcaatggaccggtccgtcccctgtggatgactgtgcagtgaacagtgagacgcttaacaaccagcagttggtgattgatgaaggaacaatcagagtgtccagtaactattcccaagagttgcttaactcgttgactcatgcccttcaaagctcaggtgtagatttgtcccaagccaacatctctgtgcagatcaacatgggaaagcgtgccgccaagagacccgctgctggtgtatccagcaactccaaggaaccagctgatccggcatctagcaacgaattagggcatcagttgacgctgtcgggtgccggtgccgactgcctctctcacgcaacaaagcggcataaacggagcaacagctgatggccgctctccctcacctcgctccccgaacgacggacggacggatgacggattggtgacattcttcttttccctccc

SEQ ID NO: 4442 - DNA, 3136 bp, Zea mays
cgccgtcccccgcaccaacccacccccaccacacggaaggcggaaatcccccgcccgacctccgttcccttgttgcttggcgtccgtctgccgaaacaaaagtcgccgtcctcccccctcgtcgcttcatcacctcacctccgccgtcgcctcccctcatccctccaccggcccgtttgaccctctccctggctcgctcgttctcctcctcctccgtacccgtcctagtaggtttagcgctcaacagaaccccaatcaccaccccggcgccccccgagagcagttgccttgccgcttgctgcggttccatatggtgccccccgcgtcggcgtgagggctgcgcgcgctcgtgctgtttatcgggaggagatagatggggcccgccgtccgcagtagcgtcgtgatcagggccactgtggtagggctcgtgctggttggcatcgccctggccctgccgctggccgcggcgctgcggccgctccgggagcacgtcgcgtccatcggagccgcagcctccgctggttcgtggggcgatgagcatgccttctacaaaagggatgagaacgatataggcccatattcatggaatattactggaacatataaagggagctggacttttgctggtgccacaaatggttcgtctagatttcttgagtttgtggaatctaaaggtgattcagttttggaattgttgagcactccaacaaagataagcggggtgcattatgttcagggttcagttacattccatgatgtcattgacaatgcccacaatgggtggagtggctcaaataaggttagaaggagtttacatatggccttttagacaacttcgcatggtagcaaacagtggtgcagatggtgaaccactccaggaagaggattatttcttgtcaaatccataccatttattgcggattttctcctctcaagtgtttcaagaatcttctgaagagaagaaccgaaggaagaattctctcacatatgacatggagaaacattgcaacacagaaatagctgctaaggtggttcgtgtgtcatctaacccaaatgatggagaacacgagaagtaccgtttggagggtttgatggagagtccagccgtcgatgatgatggggaatgcttctctcctatcttattgaatgcaacttctttgaatgttgaagtttattacaacaaagcagtcaactacacactgatggtcacttttatctctttccttcaagttttgctgctgattagacaaatggagcatagcaacacacaatctggagctgctaaggtttctattttaatgattggccaacaagctatcatggatgcatatctctgtctacttcacctgactgctgggatattggttgagtcactcttcaatgccttcgcaacggctgcattcttcaaatttgttgtattttctatttttgaaatgaggtaccttctcgccatatggaaagcaagtaggcctttaaacagtggagaaggttgggagataatgaggcgagagctgtctgttctttacagccgcttttatggcattctgttgggaggaatccttctaatgtatgagctgcacaatttcttacgcccacttctcctcctgatgtactccttttgggtacctcaaattgtcacaaatgtcatcagggatacaagaaaacctctgcacccacaatatattttaggcatgacagttacacggcttgctattccattgtatatatttggttgccctagtaatttcatgcgtatcgagcccgacaagaaatggtccatagctgttacagtattcatgggtatccaagcagcagtgcttctgcttcagcactatcttggttctcgctgctttattcctcgccagatactgcctgagaaatactgctaccataggaaggtagaggacagcacaaatcagcccatcgattgtgttatttgcatgactacaatcgaccttacccaaagaacaagtgaatacatggtggcaccttgcgagcatatatttcactcaggctgtttacagcgttggatggacattaagatggagtgccctacttgccggcgctccctaccaccagcttagatgaggctttgtatcatatataatagtgaacaagaagtaggtagctcagcttatacaaggtgggggaactgatgtacaataaggtgaggctgcaatcgtgtgaaagctatgaacagaactgtagaaaagttttatactattgatttcaagaggtcttgtgttgtgcaaactagcgtatcaagcatcccacgaagaaatcgtccttccccgctcatgcggttatcactgttgcatgcctttgcctgctaccagtatttcggcccagcgttttggtctgagctttgtgcaaagtttgttaacgccgtgaaagagttcgagatgtgcattcttgatttggtggacacattagtagcgtgtttggtttgaggaatgagatctctctcactcacttttttgtttggtttgtggaatgaaatgaattaatctatcaccatttcatttctcgtagactcataattagtaataatatgaggaatgggtttattccactaaattcgtgaaatagattctcgaggcaccgccttatttagaatggattgattcttcaatccaaacactccctatgatttttgcatcatgagcagcgcctttttgttctatcgtaggttaggagtcacgctgctgatccagttgttcgatctcgtgttcgtcctggtgttttcaggtttgagacgtcagttaagtacttggtcatttctacttaccctagcttcatccggaggtggagttggatgacaggatgagaagctgggaggagccgagtgtttcgtgtacgatcaggcaagcatggttttcgcttactggtcgtgtttagctccggctaggaggaggcacgggcgctgtcggccttcctgcatctcattgtttcctctctcgccctcgcattgccgatagccgttgttgcgctacagattctggtaccacccatttcgccagcctgttctacgtctctacgcaaagtcgtgaggcgcacgacgctgcacgacccggcgtctgattgggcgcgcaatccgcgcattgtagtcccaacaaccggcggggggggggggggg

SEQ ID NO: 4443 - DNA, 2174 bp, Zea mays
tggggtacccccgaggccggccgggagccgccgcctccatcccgtgcctcggtttcttggatagtccgtagccgcttgccctgttcgcatcttcgcgcgtggcgcacaccgctccagctctccttcgacgggcacggccgagccgccttcgtcttggccgcagcggtgcgcgctctccatggcgtcctaattagcctagccgcaacgccgcgcccgtgcctgcgaagtagggtgtaaagttttgtatatgatgccaggcatggatgaaccccttcttggcaatggtcttaagaccagcgggaaaagagagagcctggtagtggccgaggtcagaaaacagatgtaccttgctgggccactcatcgctgcatggatcctacagaacattgtccagatgatatctatcatgtttgtcggtcaccttggtgagcttgccctctccagtgcctccatcgccacctcctttgcaggcgttactggcttcagcttattgtctggcatggcgagcagcttggacacactgtgtgggcaatcgttcggggcaaagcagtactatcttcttggcatctacaagcagagggcaatccttgtgctcactctagtcagccttgtggttgcgattatctggtcatacactggacagatccttctactctttggtcaggatccagagattgcagctggggcagggagctatatccggtggatgattcctgcgctatttgtgtatggtccactacagtgccatgtccggtttctgcaaacgcagaacatagtcctcccagtgatgctgagctcaggtgccacagcactgaaccatctgctggtgtgctggctgctggtgtacaagattggtatgggcaacaagggtgctgccttggccaatgccatctcatactttaccaatgtatcaatcctggcaatttacgtcaggcttgcaccagcctgtagaaacacctggagagggttctcaaaggaggcttttcatgacataaccagcttcttgaggcttggtattccatctgcgctgatggtttgcttggagtggtggtcatttgagctcctggtacttctttctggacttctccccaatccaaagcttgagacatcggttttgtccatttccttaaacacaggctctttagcgtttatgatcccttttgggcttagcgcagccataagcacccgtgtttcaaatgaacttggtgctgggcgaccccatgctgcccatctggctacccgtgtggtcatggtgctggccatcgtggttggcgtattaatcggactagctatgattttggtgcgcaatatctgggggtatgcatacagtaatgagaaggaggtggtcaaatacatctccaaaatgatgccgatcctagccgtgtcattcttgttcgattgcgtgcagtgtgttctttcaggtgttgctaggggctgtggatggcaaaagattggggcttgtgttaatcttggtgcatactaccttataggaattccagctgccttctgtttcgcctttatgtaccatctaggtggaatgggactttggttgggaataatctgcgcactcgtcatacagatgctattgcttctcacaattaccttgtgcagcaactgggagaaagaagctttgaaggcaaaggacagagtatttagtacatccgtaccagctgacatgatgacatgatatttctgaagatatttttttgaaggaaatgcccatgaaactttgccaaggaacatactaagaattggttgttcagattcaaggcctttctccatgccatcagaatgatgcttgggtctagtaatagctcctgagcagtctgttttttacttttggtcaatactcaatacatggaagatgtttggtttgaagaaccacgccatcctagatgaggtggtatattataagttgatataacggctccatactagttattgaggaatgagacgatgattatctcatgtaataataatgcttttccccctctagttattgatgtaagacaattgaggcaaatgaacaaaatgtcacatttgattaaataagttgcattgtctatttgtgcagttgtttgggaaataattaaattgtaattttatagtttttaaggagctaagattcagtatattaagaaaatattctcgaaaaaaaaaaaaaaaaagcggcc

SEQ ID NO: 4444 - DNA, 2087 bp, Zea mays
gtaaaagccgccgcctccaacccttgtaaaagtttcttggatagtccgtagccgcttgccctgttcgcatcttcgcgcgtggcgcacaccgctccagctctccttcgacgggcacggccgagccgccttcgtcttggccgcagcggtgcgcgctctccatggcgtcctaattagcctagccgcaacgccgcgcccgtgcctgcggcatggatgaaccccttcttggcaatggtcttaagaccagcgggaaaagagagagcctggtagtggccgaggtcagaaaacagatgtaccttgctgggccactcatcgctgcatggatcctacagaacattgtccagatgatatctatcatgtttgtcggtcaccttggtgagcttgccctctccagtgcctccatcgccacctcctttgcaggcgttactggcttcagcttattgtctggcatggcgagcagcttggacacactgtgtgggcaatcgttcggggcaaagcagtactatcttcttggcatctacaagcagagggcaatccttgtgctcactctagtcagccttgtggttgcgattatctggtcatacactggacagatccttctactctttggtcaggatccagagattgcagctggggcagggagctatatccggtggatgattcctgcgctatttgtgtatggtccactacagtgccatgtccggtttctgcaaacgcagaacatagtcctcccagtgatgctgagctcaggtgccacagcactgaaccatctgctggtgtgctggctgctggtgtacaagattggtatgggcaacaagggtgctgccttggccaatgccatctcatactttaccaatgtatcaatcctggcaatttacgtcaggcttgcaccagcctgtagaaacacctggagagggttctcaaaggaggcttttcatgacataaccagcttcttgaggcttggtattccatctgcgctgatggtttgcttggagtggtggtcatttgagctcctggtacttctttctggacttctccccaatccaaagcttgagacatcggttttgtccatttccttaaacacaggctctttagcgtttatgatcccttttgggcttagcgcagccataagcacccgtgtttcaaatgaacttggtgctgggcgaccccatgctgcccatctggctacccgtgtggtcatggtgctggccatcgtggttggcgtattaatcggactagctatgattttggtgcgcaatatctgggggtatgcatacagtaatgagaaggaggtggtcaaatacatctccaaaatgatgccgatcctagccgtgtcattcttgttcgattgcgtgcagtgtgttctttcaggtgttgctaggggctgtggatggcaaaagattggggcttgtgttaatcttggtgcatactaccttataggaattccagctgccttctgtttcgcctttatgtaccatctaggtggaatgggactttggttgggaataatctgcgcactcgtcatacagatgctattgcttctcacaattaccttgtgcagcaactgggagaaagaagctttgaaggcaaaggacagagtatttagtacatccgtaccagctgacatgatgacatgatatttctgaagatatttttttgaaggaaatgcccatgaaactttgccaaggaacatactaagaattggttgttcagattcaaggcctttctccatgccatcagaatgatgcttgggtctagtaatagctcctgagcagtctgttttttacttttggtcaatactcaatacatggaagatgtttggtttgaagaaccacgccatcctagatgaggtggtatattataagttgatataacggctccatactagttattgaggaatgagacgatgattatctcatgtaataataatgcttttccccctctagttattgatgtaagacaattgaggcaaatgaacaaaatgtcacatttgattaaataagttgcattgtctaattaaaaaaatgtttgggaaaaaaaaaaaaaaaaaaaaaaaaaaaaaaaaaaaaaaaaaaaaaaagggcggccgc

SEQ ID NO: 4445 - DNA, 959 bp, Zea mays
tgggtacctcgaggccggccgggccgacggccgaacactgggcttgggctacgtttatctttgtggccccgtgttgcggtctgctgttcaccccgcgtcgtcttcgctctcacgatccctcggcagtcggcgacggctgggcgaccgccacttccgccttctcttcctactgagcgtctccaggcacgcttctgaattcggagttgccagcattcgctcgaggtgccggaccagatctcaccatcatgcaggctagcgatagattcaacataaactctcagcttgagcatcttcaagccaaatatgttggtacagggcatgctgatttgtctagatttgaatgggctgtaaacatccagagagacagctatgcctcttatattgggcactatccaatgctagcatattttgccattgctgagaatgaatcgatcggaagagaacgttacaatttcatgcagaaaatgctgcttccttgtggcctccctcctgagagagatgaagattgaggagctgttgcatagtttcagtgtttccaatgaccatttatgagattgtaacctctatggtactatgtgccatttgtgttaaagctcgtatgcctttgacttgtcttgcatcggtctctatcgtgatacataaacattcggaacttgtatgcattgtaaacgaaatgctggttatgcccctttgtcatgtttttgtgatgcgttctcacaatgtgaaagaaaatttagtcgaagaaaataaaaaaaaaaagccccccagaaaaaacggccctcgcggccccttcagctgcaatttctgtggcagtttgttcagctgctcacttggagtgccgttctttcataggaaaggctttcaatctcaaattttaaatttgtatcatacggtagaaaggtcatgtaaattggcaatatctagtgttcgttacttgttatcaattgctgtgaatcaag

SEQ ID NO: 4446 - DNA, 842 bp, Zea mays
cactcctaagggcgattgggccccccggggccggccgggaattgttctcctgctaccccgcgtccgctgtgtgctctctcgctctctcggcggaagttggcgacgactgggcgaccgccgccgccgtacgccaggtgctcaggtctccgtcagacccttcgccaggtcttcttcggcggcgagcaccgccagggtgtgcacccaatcttcttcactgggtcctccgctgcttctagtcacgcatctaaatccggagttgccagcattcgcttgaggtgccggaccacagcacaccatcatgcaggctagcgataggttcaacataaactctcagcttgagcatcttcaagccaaatatgttggtacagggcatgctgatttgtctagatttgaatgggctgtaaacatccagagagacagttatgcctcttatattgggcactatccaatgctagcatattttgccattgctgagaacgaatcgatcggaagagaacgttacaatttcatgcagaaaatgctgcttccttgtggccttcctcccgagagagatgaagattgaagagctagctggtgctgcatagtttctgtgtttccagtggttcctgtagtgtttgcttttagctaccatcgtactatgtgcgagcatgcctttcacgtttcttcctttagtctcttttgtgatacatagaacccgtatgtattgttaaccaaatgctggcctgccccattgttgtgtttttgtggtgtgttcagccaatgtgaaagaaaaaaaaaagcccaagagattgatgactgccgaaaaaaaaaaaaaaaaagcggccctaaaaaaaaaaaaaaaa

SEQ ID NO: 4447 - DNA, 823 bp, Zea mays
tgaaagcagtggtatccctcccggggtcggagccaagaattgcgtgctgtgtttatctctgtggccctgcgcccctgcgtgcctgcgttgtgtgctctcgctctctcggcggaagttggcgacgactgggcgaccgccgccgccgtacgccaggtgctcaggtctccgtcagacccttcgccaggtcttcttccgcggcgagcaccgccaggtgtgcatccaatcttcttcactgggtcctccgctgcttctagtcacgcatctaaatccggagttgccagcattcgcttgaggtgcctgacaaagcacaccatcatgcaggctagcgataggttcaacataaactctcagcttgagcatcttcaagccaaatatgttggtacagggcatgctgatttgtctagatttgaatgggctgtaaacatccagagagacagctatgcctcttatattgggcactatccaatgctagcatattttgccattgctgagaacgaatcgatcggaagagaacgttacaatttcatgcagaaaatgctgcttccttgtggccttcctcccgagagagatgaagattgaagagctagctggtgctgcatagtttctgtgtttccagtggttcctgtagtgtttgcttttagctaccatcgtactatgtgcgagcatgcctttcacgtttcttccatttagtctcttttgtgatacatagaacccgtatgtattgttaaccaaatgctggcctgccccattgttgtgtttttgtggtgtgttcagcccatgtgaaagaaaaaaaaaaatagcccaagagattgatgactgccct

SEQ ID NO: 4448 - DNA, 1911 bp, Zea mays
ccctcccggccggcgttgtgtaattgttctcctgctaccccgcgtccgctgtgtgctctctcgctctctcggcggaagttggcgacgactgggcgaccgccgccgccgtacgccaggtgctcaggtctccgtcagacccttcgccaggtcttcttcggcggcgagcaccgccagggtgtgcacccaatcttcttcactgggtcctccgctgcttctagtcacgcatctaaatccggagttgccagcattcgcttgaggtgccggaccacagcacaccatcatgcaggctagcgataggttcaacataaactctcagcttgagcatcttcaagccaaatatgttggtacagggcatgctgatttgtctagatttgaatgggctgtaaacatccagagagacagttatgcctcttatattgggcactatccaatgctagcatattttgccattgctgagaacgaatcgatcggaagagaacgttacaatttcatgcagaaaatgctgcttccttgtggccttcctcccgagagagatgaagattgaagagctagctggtgctgcatagtgggcagtgtttaagtggcggagtaacacaaaaacacagtggcctggctggcttggtgggctatgtgtgaccacgccggctagctgtcaggaaaaaaagcacgcagaagagctagtgaaaatggaaacacgacgaggatcaaaattgcaagtcccttcaccacttctttgcaagtctggaataattggaattgaaattgccttacctgtgttacaatttcttctgagatcgaagttgggcatttaaactagccatatgtattccagaaaaaaataaagattaaaataaataaaaaaatcgccaactcttgatcatgtttaatctatgtttagtccatctaagtgctaggaagtggcctactgcttgtctagcgcctaacatcttttagaaccttggtaaatattgagtgaaattatggcttagtacaagatgagggtttatgtatgtatagcatcattgctggttttttcatttagctatgtgtgagtatctaagtgcaatcactgttagccatgtgtgagttatcttctggcttaacagctcttctggttaaggattctataaatctttacccaaaaaaaagatgagtctgagaaacaatacaagtctgagagaactgagaaacaatatgatgctacccaaaatattaggaccttctttttctgtgcaagaaagtatggtgattggttagaaagcggaattgataaaattgtctactgctctactattttctttccatcctcagttctatacacaaggtagcactgcctaatagactgttgttttgtaaagttctctttgaacatattttgtttggtgaggacaagctttgaataatagttactctgtaacatgccatttatctgatgtaaaatcataatcatagataaggaccccatccgtttcaaattataagacgttttgacttttctagatacataacttttgttatgcacttaaaaaaactcggtcggtgggggaaaggctgcccccatggtatttcacagaagagctcaatcggagctcggctgcgaaaagccacgaatgctagccccctcatacatggggatgccgcaccaccctgtggccttacccgtgctttgagacccaaccgacacgactagccttttacacgagggcccgcctaccataggtcgattcacccatgtcggtcaagggaaccaacgagtgacttgtttttaacctcagcctgaaatttgctcccacagagagttgaacttaggacctgaggagtgctacttagaccatctaaccaactcagctagatgcatagtaaatgtcggtgtttcgaacccggagggccctcaaccgactagtgaattta

SEQ ID NO: 4449 - DNA, 1299 bp, Zea mays
aaactgtttgctctttgccagtggctcgccccgccggccgggggttagcaacgcgcagcgaaagtccctgccgcctaaaaccctagcccccgcctctacctccgctgctcgccttcccctctcagtctctcacacgcagccgcacgccaatacttagccttcagacgcctaaaatgggtcacaacgacggagagcacgagcacgagcacgagggcgacgacctctccgctgacgactcttcgtggagcgacggcgtctggtccgaggacgacgatgaggagacgttgtcgtttgaggatagcgtctccggctccgacggtgagtcccacgaggctgcggtcgcggaagagagcgactcttcggaggatgaggtggcgccaaggaataccgtgggagacgtgcctcttgagtggtacaaggacgaagagcacattgggtatgacatcgatgggaggaagatcaagaaacgtgatagggaggggcgcattgaagcctacctcaggaacgcagatgatgccaagaattggagaaagatctatgatgagtataatgacgaggaggttcagattacaaaggatgaggctaagataattagtagattgttaaagggaaagactccacataccaatgttgatccatatccagattatgttgattggtttgaatatgaggataaaggtcatcctctttctaatgcccctgagccaaagaggcgatttgtaccttcaaagtgggagcagaagaaggttgttaaacttgtaagagccattcgcaatggatggataaagtttgacaagcccaaggaggaacaaaacttgtatttattatggggagatgaaactgatacaacagataataagcggcatggcttgagctacattcctcctcctaaacctaagttaccaggtcatgaagagtcatacaatccttctgttgaatacattcctacacaagaggaaatagattcataccagcttatgtatgaggaggatcgcccaaagttcattccgaaacgatttgagtgccttcgaagtgtacctgcatatgagaaggcgttgagggaaggttttgatcggtgtctagatctttatctatgccctagaacccgcaaaaagcgtataaatattgatcctgagtcactcaagcccaagttaccaagtaaaaaggatttgaggccatacccgaaaacttgttaccttgagttcaagggccatatgagtcctgtgaaatccatttcggtcgaaattacagggcagtggcttgcatctggttctggtcatggtacaattcgtgtctggg

SEQ ID NO: 4450 - DNA, 894 bp, Zea mays
gtcccacaaaatcggcagtcctagtccctacaccctactaccagacgtccagactccagacccaccggtcaccaccgcgtcgccgccgcccttctccgcccccaccttattattataaatacggcaggaacggaaagcgccagagatgggaatcacctcctcaacctccagcccaacctccagcccggaatcgagagcaatggcgctcgccaaggccaaggagatcgttgcctccgctcccctcgtcgtcttcagcaaaacttcctgccctttctgcgtccgtgtgaagcagttgttcgagaagctcggagcaagctacaaggccattgagttggataaggaaagtgatggagctgagctccagaatgccctgaaggagtggactggacagaggactgtcccaaatgtcttcatcaatgggaagcatattggcggctgtgatgatactatggcactgaacaatgatgggaagctggtgcctctgctgactgaggctggagccatcgccggttctgcctcgaagacaaccatcactgcttgacatgtgtgttaccattcccgtgcttaaaaataatgatgctttgcaagtgctgaacttgcagatgctatgtgggagtgactgttcgttccctgtgtaaaactccctagacatcagtcgagtcgtgttgctgtggtggttgtgaaatctacaataatcattgctacaataatgtcgtgttccctagacatcagatgagaaagatgagaagaaataacattataatcttattcgaactatcatctgtaagcttcttttgatacaatatttttatttatagattttaaaaacatttgtagaactaaaaaaaaaaaaaaaaaaaaaaaaaaaaaaaaagggtttaaaaaaaaaaaaaa

SEQ ID NO: 4451 - DNA, 2138 bp, Zea mays
tggattgtggcacaattgaatttctatgcaagttcatgatttggtttgtccttatgacatgagattaaatcacttggttaggtgctggatgaacactgattatggcaataatgagtgacaaagaactaatcattggtgtcctttttgcttcttttttgtacagttctttgcaaaaaatttgtacagctttgctctctatataaatttcccctcctgctggctgctatatttatagaataaaaataaccaagaacaaattacctgacaaatgttaagtggtatgtcgttaacctgcaatatcttatatgtgtcctattgtttcacttactgctgaagtattgtggttccaagaaaaaaatattacgccaggagtgtagtacactcacggaaaacatttagcgggtctctcttcttaatttaggactctgcatagtgattatcatcatgggatttgaggcaaactcttgggtgtgtttggtgtgtggaataaattggtccatcgtcatctcactctttagtttatttgtttgatttgtggaaagaatgagttatccatcgtcaccagctaataacataactagtacattcctcacaagctaatgacataactagtacgagtggcatctcatgatgcatcacctcatctaaactgggatgattccccaaaccaaacacaccattagggcttgttcggttagctctcaatccatgtggattgagtgggattggatgggtttgaatcccaaataagtcaaacttcttaagaattttttccaatcccatccaatccatgtgtatagggaataaccgaacaaggccttactgaaccaagctgttctatttaggtgatggagctgagctccagaatgccctgaaggagtggactggacagaggactgtcccaaatgtcttcatcaatgggaagcatattggcggctgtgatggtgagcctccttatacaattatttgcacagcaaagcatataatccgactttgtgaacccctgtttaccactatcaagttactggagctgagctccagaatgccctgaaggagtggactggacagaggactgtcccaaatgtcttcatcaatgggaagcatattggcggctgtgatgatactatggcactgaacaatgatgggaagctggtgcctctgctgactgaggctggagccatcgccggttctgcctcgaagacaaccatcactgcttgacatgtgtgttaccattcccgtgcttaaaaataatgatgctttgcaagtgctgaacttgcagatgctatgtgggagtgactgttcgttccctgtgtaaaactccctagacatcagtcgagtcgtgttgctgtggtggttgtgaaatctacaataatcattgctacaataatgtcgtgttccctagacatcagatgagaaagatgagaagaaataacattataatcttattcgaactatcatctgtaagcttcttttgatacaatatttttatttatagattttaaaaacatttgtaggaataaaaaatttttaggcactgggcccctcctttagttcaagaactaaactaactaaagtttagttaggagactatagtttagtccctaccatgtttggttttagggactacaactattcaaaacacattaaataaatcatgagatgactaaaataccctttaagcattctttcaccattagtgcaactgaaataaaggatagacaaaagtggaatttatgtggtttagttccttttagtcacccgttgtctgggcctaaggaggcctacagaggggttgtggcagcagcagccatgggcccgccaaggggattagataatgataggtagagataagattataagattagttgagattatttaggagattagttgagattatcttggaaggttatcagttagtttgttgagagtttttaggggagttttaaggagataaggggcgatcagccggcctacttatgtgatcaatggatgagaaataaaataggcaacaattagagggagaaacccttctcttgctcgaccatgggcagagacccttggccgacgttcctgcctattggtacccctcttcaatctctcaccaatctagcgaccataacatctagtatcagaaagct

SEQ ID NO: 4452 - DNA, 1842 bp, Zea mays
  misc_feature (599)..(599): n is a, c, g, or t
  misc_feature (640)..(640): n is a, c, g, or t
ttgggaccctcgaggccggccgggaagaagcacactacgctccacgcatcgcgtagacggcgtagttggctcgcgggaccccggagtcagcatcgcgccgctctctcccgaagctcgcgcgtctcctcggcgcccggagcgagcctgaggcgcgcggacaaacgatggcctcgccggcggcggcgacgctgcacccttcccccaccttccttgcctccggccctcgctaccgccgccgcggacatccatcttcgaaggtcagcttccgaaggttggcgccacgattaaaggtcaatgcactttttggatggcctaggggggacacgacagcacgtgaactgatccctcctgctgaatcctatacgctctcagggtaggtgcaaaaccacgtgaggtgtctatatctgttgcttcttcaatcatggacattcctgctgcggattgggatgcctgtgcgtgtgatttagatgatcctggaaattttaaccctttccttacttatgcattcctctcaagcttagaagaatcaggttctgcggtcaaggaaactggctggttaccttttcatattgttgcacgggatgagaatggacatattnataggtgttgttccactttaccttaaaagccattcccggcngggggtttgtgtttgatcaatcatgggcagaagcttactacaactatggccttgaatactatccaaagctccagtcttgtgtgccttttactccagtaactggtcaaagaatattacttcgaaatacatcataccgtgatcaagtttttgacgcactagtcaaaggtttgatgagcctcactaccaagatgaatgtgtcatcattacatattacgtttccgtccgaaggtgaattcagcaaactgaaggatagtgggttgttacaaagaatcgggttgcaatatcactggagaaatcggaattacaagagttttgatgagtttctgatggatttgaagcagcctaaacggaagaatatcagacaagaacgtaaaaagattcctgcccaaaatttgcaaatgaagcgacttcgtggagacgaaataaagagcagacactgggacaccttctataaattctaccgtaacacaactgataatcattggggcagaccatacttgacaagggatttctttcacctcttgggagaaaagatgggggataatgtgatgcttatagttgctgaaaaagatgataaactagttgctggcgctcttaaccttattggaggtgatacactatttggccggttatggggatgcctgccagatgcttactttcccaatttgcattttgaagcttgctattatcaggcaattgaagcagccatagagttaaacctgagtaaggtggaggcaggtgctcagggagagcacaagatccagcgtggttacctcccagtgacaacttacagctgccactacttttcaaatcctggttttgcggcagctattggaaattatcttactcatgagacggctcaggttaagcatgctattaaggtccttcgtgattccggaccatacaaggaagacatactgaaagagttcgctgctcaacaagacgacgacctgtagaatacagaagggacttaaactatttgcatactgttttatagaactaacatcttctatgtagcaacagggatacaggtcatccaattaagtattaccaaactacgaatcccacattttggacactgctaggactgtaaatatttaacattgtaaatctaaacccaagcattctgcgatattatgcatctccgcgtcggaaatgatttctggggcgatattacatcaaaccacaaaaaaaaaaaaaaa

SEQ ID NO: 4453 - DNA, 2589 bp, Zea mays
gcacgagaccattacctagaacatcctaatcgaaaaaacagagaagacagagcaacaaccaccgctgtgacccaccggacaccgggtggaggggatccagccagccatggcgagtgaatgcccatgaccatgagccccgagctcgagcagggggacggcgagatccaggacatcttctgcacgctccacaagccttctgaccaggttatacttgagcacgactatacatttacgacaccatactgtgggagtgaactgtggttgtgaactcaagcactgggcaggggtaggattctagctgtaactgctccatagggaggctagctgcatacatcggtttcagatgaattttggagcatgtttcctcctcaaatatcacttcttctttaggattcccaattgaaaaagatacgaaatggccaaggattgctggcgatgatgacgacatggccaccctcgctgccatctggtagaccatcctccaagatctcaacctccacgcctctgttctaaaggtgctactcccaaattgtgtgttccttctccggggaaaccatgaatcctttaatatggtttcaagaaggagataatgactaaatacaaagatcagagccctcaactttatcgaaagtttcaaagatgttttggggaccttcctctagcggcaataatagcaggatgtgtgtacactacacgtggaggtgtcttcagtagttccatggcacaattgtaatgccatcaaataattcaaaaaaggggggaaagggtcacaaatacaaggcgaattttactgatgatttgacttccataaaacttggatcattggatgagttattgaaagcaatgagaactgttcttgaccctccttgggaaggctcaattttgatcccttgggatgtgctttggtctaacccttcctcgcagatgggtctttctctgaataaagaacaagacaatggattgctttggggtcctgatattacccagcaatttctgaggacaaatcatttgaagcgacgcacaggcgaattgatcatgtggaggtctggaagtgtaatggtggtttatcaagggagcatttacaaaaggcctctaaaatctcaagctctaaatggtgtctcatcatcggtttaaggcgaatatggtgcattgttcatcccaaatgcctcgaacgctgttgagaatgatatacaggggatatatttgtctgcaaaacatgcaattgtgtccctattgaataagtagaatattgagcacatgaatgaggaagggctggagttcaattagataattgatgagctgggcctcattttgtggattggtgggaacgggtattttaccaatggatgtcgacttgctgcctgaaataatcactggttaaaatataccatatagagttcttctgactagaatgcgttggacccttaccaatgcagagctgactagccaaatttagtgaggaaccttccatgccattttgctctagaactatcaagtttagcaacagtaatataataaggagcatgctgcaactgccctagcgcggtgacgacgatgaatatggacatcgagcgtgtgctcaaggagaagttcgacgacgctttcaaggaaatccatcgggtgttcgacggggaccagccggcggcggagacaacgtctgagacatcacattacacctacgactgatgttatttgaattggtgaagaactctctctacgactccgcctggtgcaagaccgatatattaattttgataaagatgttcctccagtgagaattatagttgctgatggagaagaggatgttactatcaagatattttttaaattttcttttgaaaatgccacggcttgaagctattctcattgtgatatgcatggtatcttcacattattcaatgagctaaagaaagaaaaactaaagaatgttgttgccaataaaagaactgcaagaacaaaaactgaacaaaagctgcaggatgagctgcagaggaagggctcaactgcttagagtgatggagacttgcagaacagtcttacgtaaatagcaggctatggcctttgcacgtgctgtagcagcagggtttgttatcgacaaattgttgtatttggtcacttttgcagagcgttttggttcttctcgcttgattgacagtgacagttaacgaaggagccatggtgtaggcaattaccaaacgagttgttgagaatccacatattggtagtttttgcaatatgcaagtagcttcagctatttatcttttttccagtaccatatgtatcatgtcgaatcacattatagatggttcttgttgaaaatcctaatcctcaatcaggatggattgtgttgcatatattataaaaggagctacatggttgtatgttgtcgcagcggcatgggcattgtactatcatatatagaagtatgtatagtactgatggttgtaatatagtgaccccgttgcaacgcacgggcacacacctagtagtattcaaaagaaccatgctttcatgtatcatgataggagacattctaggaatgtttatagaagttatgatgcttttgactctcgaaaaaaaaaaaaaaaa

SEQ ID NO: 4454 - DNA, 1662 bp, Zea mays
tgtggtaagattggtcattttatcgctaattgtcccgataatgatagtgaccaggaacaagggaacaagagggaaaagaagaaggcttacaagaaggctaagggcgaggcacaccttggaaaggagtgggactcggattgttcgtcgtccgactccgacaacgaaggactcgccgccaccgccttcaacaagtcggccctcttccccaacgagcatcacacctgcctcatggcaagggaaaagaaggtaagcactcgtgatactagtacttacgcttcctcaagtgatgaagaatctagcgatgatgaaatagactattcatgtttattcaagggcctagatagaactaaggttgataagattaatgaattaattgatgccttgaatgataaaaataggttattagaaaagcaagaggatcttttgtatgaagaacatgataagtttgtagaggcacaaaaatcccttgctttagaaattaaaaggaatgaaatgctttcttgtgaattgtctacatgtcatgactctatttctagcttaaagagcataaatgatgatttgagtgctaagttagaaatagctaataaatcaacatcttgtgtagaacatgttgtagtttgcaataggtgtaaagattttaatgttgatgcttgtagtgaacacctagtttcaatttctaaattgaatgatgaagtggctagtcttaatgcccaacttaagactagcaagagtgaatttgacaaactaaaatttgcaagggatgcctacacgattggtagacacccctcaattaaggatggtcttggcttcaagagggaagtcaagaacttaacaagccataaggcttccatctccgccaaggagaaagggaaggcccctatggctagtagtgctcaaaagaaccatgctttcatgtatcatgataggagacattctaggaatgtttatagaagttatgatgcttttgattctcatgccatgattgcttctagttcttctattatgcatgatagaaatttggctaggaaaaatgttgttcatcatatgcctagaagaaatattgttcatgttcctaggaaagtaatgaatgaaccttctacaatttattatgcttgcaatgcttcctttgctatttgtagaaaggataagaaggtaattgctaggaaattaggggccaaatgtaagggagacaagacttgcatttgggtccctaagactattgtaactaaccttgtaggacccaacatgagttgggtacctaagacccaagcctaaatttgccttgcaggtttatgcatccgggggctcaagctggattatcgacagcggatgcacaaaccacatgacgggggaaaagaggatgttctcttcctacgtcaagaacaaggatccccaagattcaatcatattcggtgatgggaaccaaggcaaggtgaaagggttaggaaaaattgctatttcatccgagcactctatttctaatgtgttcttagttgagtcgcttggatataacttgttgtctgtgagtcaactttgtaatatgggatataactgtttattcacaaatgtagatgtgtctgtctttagaagaagtgatggttcattagcttttaagggtgtactagacggcaaactttatttagttgattttgcaaaaggacg

SEQ ID NO: 4455 - DNA, 2612 bp, Zea mays
gccggccgggtctggaaaaaagtatctttctctctccctgctcgactttcctctgcagccggcccatatgaaggacaccacgtgaactcccccgacgactcagtgcgtcttcgccgccgttttcgtcgtcgcagattaaggttcccctcctctaacacgccggcgcttccccccctgccaccgcgacactcagtcgtcgccgccgtcggctctgctgccgtggccaagcgcgttggcagcgaggattgctttagcttgcaggcactttccccacccccaccgccgctgatttcgccgttatgcggtgaagcccttcgcgttgacgggctaatcggctgcctgatttctattatgatggggtaggtgtgctcctggttcgcgtctcggaggaccctcgccgtttatcgatccagtgatgtggagctcacctttctccggctagcgttgtgtcaggggagagtgcttgttgatccctcgggagctggttgagttgtctttcgtttgtgggaaatctgtgcggcagcgtaaggttgctgattcggatggcaccggtgggggatcatattgtggacatcagctccgatgaggaggacttgttcatcggcacttccctaaatatactcctagaacccctcgaccccgttaaatgggtggatgaggtttgcggtgtggctgattatgtggccggggaggatatcgatgacctcatgattatgagtgagatatctgctccaccggtgttgcagaagatagccaagcctgatgagctcgtggttatggggtgagttgtcctcaccacctgccccgcagcagaaggccagtgctaatggtgggtgccatgaggatgatgatgattgtgtagttctagatggtgaccctgataaggcgattacagttgctgaagaggggagcttgggagatggcagttcggatgaattgcagatagtggcggagaaaggcccggtagcatgcagggacttccctcattcacggcattcatgctcaaacttgcctttcagcactacttctcacgtaaagcactgttccatgtgccactgttttgtatgtgacgcaccagctccttgcaaatattggggtaacagtacatcagctgatgatcattgccatgctacagacaaggattcaaaatggacatgcatgaggcaaatattcaagcaaaaattgttgccagcatcttttctagaaaaacaccagaacggcgtttactcaacaatgacaccacctagacagcaacatatgcagtgtcatgtttcagtcccacaatcgccttcggtgtcacatgggagtcacccttctcttaccatccaaagtcctcttcttaatgaagggagccaaaaccaacaaagacatccctcagtgagagtctcactgagtgtaggggcaacagtcagttctccaagagctggaagaggtactggcaatgctcacattgctcaaagtactcattcacatgcaatattcaagagagcaggggctgttgctccagtctttgcaacaagaaatgctagccaattctgtccttctgctccagatgatctccttttgcagcaggcattgtctcacgcttctcagcctgttcaagttgcgcctacaaccaatgctttcactggcgcttctcaaaataaccattttcagagatctttcagtgcgccgatagcacctcaggtgcaacaaggtcaacctgcggcacgttaccaggtcgccataaatggaatgcacgccgtagggccgcaacttgcacggtccacctcacttacaactcagagaacacaatgcctcccagaaccagcaataatagatgtcagcacaacaagctggcaagacatacttgctactgtggcatctaatctgggggtagcagattacaacacgagcacccctgagtctcagcatgtaacggttgactctctagccatgcatcccactgcaaaccatgggttggatcttcagcatgagcccattgcagaatcagagaacctgacatattcgcttctgcatgattcatccaatggcgcagcaggtggcagtgttcaggcagatggtcctatgcaaacaccagagaatttggaccatctgattggccagagcaatcctgttccaaatgaagctcacctggatgactttgcgggtgcccccgctaatcaattaccaatagaagaagaagaagaagctcatcagcctgagatgtcaaggctggagcctacaaacattctgttcgagttcgattgggtttaagcggtgacctgcctggctgcctcatcagcatatccctaacccatgaataataaatcagtgccattgacgtgcccctttctaggtctcctgcataggagacatgtctggtgtccccttgtacagtaattaggctatgtactagaagagtttcgccgtcatgttgtttgttatcatagtggtcagatgttgtggctcttcgggctttagatgttaacaggtctgaagtagaagggtgttgggtgggtgccaagatgcttgtctaaccactggtctacaatttgacaatgtaaggtattgagatacagatgcttgggttggataccaaatttctttaaaaaaaaaaaaaaaaaaactcg

SEQ ID NO: 4456 - DNA, 2173 bp, Zea mays
agatacgggactaatcgtccttgactgggaatgtggcatgctatgcctgtgtccactccctcccaccacctcccccgtggcccgtagccgattacgccccactcattcccgccgtttattcttagggctcttcctcaactctcgcactgccgccgccgctgctacgcctacgcaaccgtcaccgtcatccccatggcttccacggcgaccacgcgccgccggccgcggcggggttccaagggccccaacgccgacctctcgcgcaccctaaccgactgcacccgccgcggggacgcggccgccgccatggccgctttcgacgccgccgtcgacgctgacgccgacgccgttccccgcctctccgctcaccagtacaaccaactcctccacctcctcgccgccaccgaccgctcctccttccccagcccccccgccgccgccgcgcgccgtgtcttcgcccacatgctccaggccgcggcgccgccctccgaggccaccataacctccctcgcgcgcgtcatcgccgccgacccggcgtcggccgccgatgaggcgttcgagctcgtggccacaatgaaggacaagtacggcctctccccgcgcctccgctcctacggccccgtcctcgcggcgttccggcgtgccggggaggccgctaaggcctacgctgtcgaggcgcacatgacggcctccggcgtctcgcctgaggagcccgagcttgccgcgctgctggatgtcagctccagagccggggatgcggacaaggtgtatgagtatatgcataagctgaggcaagccgtccactgtgtcagcgaggagactgccggagttgtggaggcctggttcaggagcgacgaggcggcaactgccggcaagcctcaatgggatgccgctcaggtgaaggacgccattgtggcgaacggtggtggctgccaccgccttgggtggcttggaaccggcccttggacggtgcagcgggtaagagttggggatgctgatcagtgtgggggatgtagattccatctcgcttgcattgacattgacatggaggagacacagaggtttgctgattccgttgctggtttggccctcgagagggagacaaaaacaaatttcagccgatttcaggagtggttggaagcaaataaagactaccaagctatagtcgatggtgcgaatattgcactatatcaacaaaattttgcggagggcggtttcagtttgacccagctggatggcgttataacagagcttcgggatagatatcatggaaaatggccacttgtcatactacacaataagcgaatttccaagcttatggaaaattcgtctaataggcatttgattgagacctggagaacaaatggggctttgtatacttcaccaagtgggtcaaatgatgactggtattggctatatgcagcgatcaaactaaattgtttgcttgtgactaatgatgaaatgagagatcacatattcgagcttctagggccgtctttttttccaaagtggaagcaacgccatcgggtaaagtacacctttaataaaggaaaaacggtgcttgtgatgccacccccttactcttcagaacttcaagagtcggagatgggatcttggcacattccaattgaagagaagtctgggaatgagagaggcaggatttggctttgtattggcaggggaggttcctgcaaagaacatggcgaagttccttcgactaatggagctgtccacaaagttcctcaaactgaggcatctaacgtggtgcagcaggggctgacagaaaataaggatgaatcgataactggtaaaagaaaggatagagattgatcaccttcacctatccaggagcaccatctgctcttgagtctgccatcttgtgagcgattgtggccacttgttgttgattcagctgaggcatttcaagaatagggatgcagcgataatgccatcccagatatgtagggtgtgataattattaatcactttcgctgggttgcagactttcattcttcacaaattgggtgtgatcttagacgatttctgtgctatgtatctgactgcatccatgatcatctagtgttaactccagaataccagctaatgaacttttttattaccatcaaactgaggcacatttgcaagtgcgttgttgaaaaaaaaaaaagcggcc

SEQ ID NO: 4457 - DNA, 895 bp, Zea mays
gcacgacgtctttttgcaaattttgctactttgtatgatagtgcttcttgtgaaaagattggaaaaattgcatttgtgcctgctgaaaaaggttttccaagtattggtggtaagaggggtggtcgaagggtacttgcctcatacaatggagctatcttattaaaagactggccattagcatggagttctgctccaattcttaccaaacaaacaattgttcctcctgagtattcttggggagcatttcggcttaggagtccacctgccttcagtacagtttttaggcacttacagattgttggtagaggcaatggtgcggacacactagcacactggccaaccttcactagtccccccccccccccccccgcctttctacaggtcttgcaatacttggataaaatatggggaacaatatcttcttcagaaaaaaaagaactggagaaactggcatttataccagttgcaaatggtactcgattggtcccagtgaagtcactttttgctcgtctgacaattaacatgtcaccttttgcttttgagcttccaagtcggtatcttccatttgtttcccttcttagagagattgggatgcaggaaagccttacaaattcatatgcaagagaacttcttttggatatccaaaaggcatgtggctaccagcgcttgaacccaaatgaactccgtgcagttatggaaatcttggaattcatgtgcaatggaatcaaccaaagtatcatagatggatcagatgggccttttgattcagtaataccagatgacggctgtaggctggtcactgctgcatcatgtgtgtatgttgacccatatggttctcgtttactgagtaacataattacatcaagactaagattcccccatccaagccttcctc

SEQ ID NO: 4458 - DNA, 3079 bp, Zea mays
catatctatatttaaactctaatctgtaaatagtgctgtccacactatataatagtgtaaaacagtatatataggtaaactttggataatccgctgatagaaagtaggctcttggtttgtggcgatcgttcatcatggatcagtgttgggtgtggccgtgtgggacgcgacggcgtgcacctagtacagattccaagcacttctcccgttgctctgcccgagacctgtctgactgtaaggtggtaagatagggtacgaatgtctggcccgtgtggggcgtaccttcccgtctgcaacggcggtgcgtgggtgccgtgtcagcgcactcggtttcgccgtgcggtgcggcggcggcttgccgaatggctcactcaacccgggggcccgcctcgcggcgcacatgcaccgactccttgacacgggagcaagggcacttggatacggtagcagccacggccacgcttccgcaccgcgtctgatgccccgtgatcacgtggcaggcacggggaatactcctttttctcagcaatattttttgtcctgacagtggcagtaatggtggtaatcatagtgcagctggtaatctccagattattccttgcagtgtaaaaggcttggctgccagcgaggccggatcccgcggcttgtgtgcacagcagcctccatgccttcagctggtgatccgagcgccgttgcccggaagaggaaccccacaaaataaaactgccccacccatcagcccatcacccaacccaaccacctcaccagctttttatatacccgcgcaccccggcgcccggccgcgatgtcagacgacgcgccatcgcgcctccaccaccccgaccctgaccccgaactcgccgtcgcaacaggccaagacgcagcagtagaagcaccaccaccaccaccaccggcacacgaccccggcggcagcgagtgccggttctgcgagatgacgcggcagcaccagccgcagtgcgcgcggcggctgccgaagcgcatcatcctggtgcggcacggcgagagccagggcaacctggacatgtcggcctacaccaccacgcccgactaccgcatcccgctgacggcgctgggcgcggagcaggcgcgcgccgcggggcagcgcatccgcgacgtggtggcgggcagcggcaactggaaggtctacttctacgtgtccccctacgcgcgcacccgcgccacgctgcgcgagatcggccgcgccttcccgcgggaccgcgtcatcggcgcccgcgaggagtgccgcgtccgggagcaggacttcggcaacttccaggtggaggagcgcatgcgcgccgtcaaggagacgcgccagcgcttcggccgcttcttcttccgcttccccgagggcgagtccgccgccgacgtcttcgaccgcgtcgccagtacgatcatccgatccgagccgagccgattcagtccatcgtctccctcttctcttctcctccccacaccattatttattgacacaccaatcaacgaacccatgcgtttgcgcaggcttccttgagtcgctgtggcgggacatcgacatggggcggctggaccaggaccccagctgcgagacgaacctggtgatcgtctcccacggcctcacctcgcgggtgttcctgatgaagtggttcaagtggacggtggcccagttcgagcgcctcaacaacttcgacaactgcgagttcagggtcatgcagctgggccccggcggggagtactccctcctcgtccaccacacccaggaggagctccagcagtggggcatgtcgccggagatgatcgccgaccagcagtggcgcgcctccgccaaccgccgctgctgggccgaggagtgctcctccttcatcgacaccttcttcgaggagccctacggctcgtcggagacctcctcctcggacgaagacgaagcagaggacaaggaggaggagaccaagctgctggagcaactataactggtttcatccacatccaatccacccattcgcctcgtcctttgaaattctctccattggattggatcttataccatgtgggaagagcggagcagtgatgctgcattcagtcatcgctgatccctctcttattcgaaaacagtctgtagcatgttcataatagctattagctagaactagaaatgattcgagggcaatttcagaaaatgctaaagaaacatatgctgtatctcaaggttttagctctgacatgattctgtatgttcctagatataagaacgcatacattctctattcaaaataaaatgctcagaggagataaatttgtctcgatcgctaccggcctaaactctaatcctgtgggcgtcgctaccactcggtctgtcgtttattggttattggcactgttgatggacagtacaagtaccatttctcacatgctgggcatcagcagacacttgtccatatgtaaaagcagagaatctttccaattccatacagctggcatggtgacagccatattcctcactaggggagtaggagcctaatcacgaatattaatgaaatcatatttgttttcatatttttattcggattcgaatttgaatataaatagctttgaatacgaatacaaatatagatagtcatatttgttttcatatttttattcaaattcgaattcgaatacagatagattcaaatatgaatacaaatatggatattctcgaatacaaatacagatagtcatatttgttttcatatttttattcagattcgaattcgaatacagatagcttcgaatatgaatacaaatacggatattctcgaatacaaatacagatagtcgtgtgtcgaatacgtaactagttcggatacggatagcgttggtaacgaatatttttgtcggatatcgtgtaagactacacatatcataattgtaatcatttagcctcaactttagtccaaacatttttttaggattatatgagaacatatgctatgtctccataaaattccatgaattcctaaggctattttgagtattattaatttctttctatagaaaattgttaaaatacaattgaattcataaaatattttagcatcgaccg

SEQ ID NO: 4459 - DNA, 1480 bp, Zea mays
  misc_feature (8)..(8): n is a, c, g, or t
ggccgggnaacccaaccacctcaccagctttttatatacattgggtacctcgaggccggccgcgatgtcagacgacgcgccatcgcgcctccaccaccccgaccctgaccccgaactcgccgtcgcaacaggccaagacgcagcagtagaagcaccaccaccaccaccaccggcacacgaccccggcggcagcgagtgccggttctgcgagatgacgcggcagcaccagccgcagtgcgcgcggcggctgccgaagcgcatcatcctggtgcggcacggcgagagccagggcaacctggacatgtcggcctacaccaccacgcccgactaccgcatcccgctgacggcgctgggcgcggagcaggcgcgcgccgcggggcagcgcatccgcgacgtggtggcgggcagcggcaactggaaggtctacttctacgtgtccccctacgcgcgcacccgcgccacgctgcgcgagatcggccgcgccttcccgcgggaccgcgtcatcggcgcccgcgaggagtgccgcgtccgggagcaggacttcggcaacttccaggtggaggagcgcatgcgcgccgtcaaggagacgcgccagcgcttcggccgcttcttcttccgcttcccagagggcgagtccgccgccgacgtcttcgaccgcgtcgccagcttccttgagtcgctgtggcgggacatcgacatggggcggctggaccaggaccccagctgcgagacgaacctggtgatcgtctcccacggcctcacctcgcgggtgttcctgatgaagtggttcaagtggacggtggcccagttcgagcgcctcaacaacttcgacaactgcgagttcagggtcatgcagctgggccccggcggggagtactccctcctcgtccaccacacccaggaggagctccagcagtggggcatgtcgccggagatgatcgccgaccagcagtggcgcgcctccgccaaccgccgctgctgggccgaggagtgctcctccttcatcgacaccttcttcgaggagccctacggctcgtcggagacctcctcctcggacgaagacgaagcagaggacaaggaggaggagaccaagctgctggagcaactataactggtttcatccacatccaatccacccattcgcctcgtcctttgaaattctctccattggattggatcttataccatgtgggaagagcggagcagtgatgctgcattcagtcatcgctgatccctctcttattcgaaaacagtctgtagcatgttcataatagctattagctagaactagaaatgattcgagggcaatttcagaaaatgctaaagaaacatatgctgtatctcaaggttttagctctgacatgattctgtatgttcctagatataagaacgcatactattcaaaataaaatgctcagaggagataaatttgtctcaaaaaaaaaaaaggtataaaaaaatgtatttttttgcggccaaa

SEQ ID NO: 4460 - DNA, 2358 bp, Zea mays
cgctgggaaaaaagatgaaccagagacaagagacagagcgtcttctaccgcttcgctcactccgatccggtgctcaccagtcaccactcaccacacccacgagtgccgcgcgtggctgaactcgtcgcctatcagaggaaagcgagccacggcacatacagattatatatggcatgaagcaagctagcaagcgttacaggttcttctctcgcgcggcgccaccgtccaccgtcacctcgtgcgtgaccagaggcgctctctcactctcttcatgcttggcactgccaattccatctactacacatcatttcacatctccccagacgatcccaagctccccagacctataagtacgtgtcctgcctcccgtccggctcggcctccgggcagtagtatgacagtgagtaccgatcgagacatcgatgacgcagggcgccgccgacaggaagctgctgagtagcggcacaatcctcctccggtgcacgttcgtcgggggcgacgacgagcgcggcgacttcacgggcgagcagctcaggtacccctgcaagctgaggcggcacatctgcgccgagtgcgggatgcaccgcggcgagcacggcggcaggcccggcgcgggcgtcagggtcagggacgaggacctgcccccgcgcaagcgggccgtgttcagggcgcggggagagttgcagccgatggtgatgggcctcggcggcggcgaggacgagggcgacggcgagagggaggggcaggcctgggctaccgccgacgccatcgccaaggggaagcggggggccaggagacggcgcgcggcgtggcgcgagctttgaaaccttgagtatataatgctgggaagccaaaagtcgaattggcgctgccactgtgttttgcacatgggctgtccactgttaatttccactcagaaaactggtcaaaccttgatcaaatttatgttagtagtcgtgctactcatcggggtggaaatttagttcgatgtttactcttttctcatgctttgagtcataaaattcctaaccaaaataagaagcaaacacaataagacttttctagatcttcacgactctcctgtccgctcttctctcagcgtcggcgagctccccgccgtgccaagctccgctcactctcatctcgtctcacccttttcccatctccgatggctcctcgccgccacctccgactaattaacgtgctaatctatcttgtcacgaagcggccctacctttatcttacccacaaccttctccactgtaagtctgtaatgcactccacattgtaaaattcaaactacacacagagaggaatttatgatgacagaaaaaaatgcatacgatatctcactacctccatctcataaagtgtgctgtttttagttttcgtactaagacaaataattttaaattaaattaaaaatactgatatttagatagattcaccatgaagcatattttaaattatatctattccgcatcataaatgctatacctctttatataaatctaagataactatacctaggaacactagaatggaactaaaatgacactagagtgaagcaaaattatcaagaataatatttaggtcaacatttatcaaaatatccttgttgatagaacaagtcgccaagccatttaacctttactttgtcatagttgacctcagataaaatttcaacaacttcaagttcgagaaacttttttcaactgaggctacagtaacatgtatggtcaataaaattcgatatacaatagagacatttagatagcaacatgcaattgcaataaactaaagaatctttaatcctgacatcaaaccatctggtaaagttacttgcaatacttgtaattcactgatcaattattgagatctacatcggataagtcaccatgagtaaaagtttttttataaaaatagtacaacaatttctcataacatgatcatcaaaagattttagtcaaactgaatttaataagaaaccaaatagattttcaaatatgtccacctactcaaatcgattacccaatgaagcatttgccatatcaattagaaaataaataactctaaaggactctatagatgatagtgattattctttagttagaatattttgctcattaaaatatttctttcttttatcttgacgggttctaaaaaatattgcctctgcacccatttcttttgcattttcttttgcaatatttgtgctaggagaaaattttcatctctatatatcagtacatattatgtatattttttgtccccttaaattgaggggccgtagttcgtcgcccctctggcctatggctagatcggtcctgacaatgttgcagatactagagtttaata

SEQ ID NO: 4461 - DNA, 5616 bp, Zea mays
  misc_feature (54)..(54): n is a, c, g, or t
  misc_feature (135)..(135): n is a, c, g, or t
  misc_feature (4285)..(4285): n is a, c, g, or t
  misc_feature (4794)..(4794): n is a, c, g, or t
ccctccttccatccttcgcccgcgcgctccgcacgcgttccatccatgctagcntacagcaccagatgaaattaaaagactttcatgattggtaacatcatcagctaagtaaatcttcaaaattttacatatttnccactgaataatattactgctacatcttttggaggtggttctgacaaccctcacttgccacacaaccatgaaatggatcaagttgtgtacactggaacatttgataacgatacagttagtttcaaagtttttggtcaactcaatgcttataacgtttgggaaccagggatccaccattatgtatttgactcttgtggtgtaatatgctgtcagtgtgctgaagcaagtgtgcatctgttattattatcttgcaggatatgattgccttctcatgttgtgtatatgatggtggtgatgaggagaaggaaatggatgcagccagagaaataggttggagaaggaaatttactaagagaggacgtgtaataagaccaggaattattagaatgaatggaaaatgtcctcttacacctttggaggtatgtcaggatctaaaagcagaaggtagaacaactgctgttattaccatttcagaaatttgcactcaagcacattttgagggttcatgatgtactcatttttatttttattcagtataaaacaaatgatttaggatcatggcataatttgtcttgagatgcttatctcgtgatctttaggttgggttaatgcttcgtggaatgggtttcagcaataagactgcaatctttttggcatcgggaaagatttacaaagcagagaagaacgtgacttctcttcttgaaatgtttcctctcctatagacaaaagagacactggcatcagaagaggaacttgctccattcaaggtagggcctgcaggatttttttgttctgtacttccatatgttgattgttctgaaatgactcagtattgccagaatttctcctcaaggatggctgctgttgactatagtatttgtgcccaaagtgaagtttttgtgaccacacaaggtggaaatttcccgcattttcttatgggtcacaggagatacttgtatggtgggcattcaaaaacaattaaaccagacaaaagaaggcttgctgtactcttggataatccacgtatagggtaggataacactacttgtccatcgagttttaagcacttgaccatcttatttgttaaaaatcacattttttattcatccgcaggtggaaggcattgaagcggcacttgcttaatatgagagcacacagtgatgccaaggggatcgaaatgaaaagaccaaacgaatctatatataccttcccgtgtcctgactgcatgtgccgcttgaacagaacagaacactcgaaatccaaacagagtagatagtatctcgtagttgcatttccagactaaccctattctttctgacatccagtttagtttgttcattcttcatatgccgtgcggcttttcatcacttcatctgccagcatacttgccagttctcacagcattgaaagcaatctgttctcccaatgtagcggtttttcccttgtattattgtatagcatatgctgctagaatggaaactccagattcctccgtggagtattagaccaatttgtgatgctaagttgctaactacatcaactgactataatcctcaacaacggatctgactccagtaggatactatccattgtcaatgaagtatcaaatggttttgggtggtattactgttgtacatggttcattagcagactgtcatcatgtacaaattttgaatggaagtcagccattgtaaaaaaaaatctcctcttgcccaaaaatgggcattgtttacaatagcctccctgtattcttttagctaggttgtctgttcacaattctaagaatgaaagctgcccagtagaacatgattcttgcttcatcagtatagaggcattgtatctgcttatttgcaatgatgtgtccaaaagctgcttgttgtagataaaaatgtgatgaaccaaaaccgttgaacgcagaatacagatatataagcaagtatcttccccttccaacttcatcctctctttccctgatggtgtgcagcgacggacggacgtgcgacaaaggtggcgcaggcgcgcgacaggggcacgtcccacggcggcgctcggccggtgcgtgtctccgcagcgccgatggcaacgctggtgcgctcgtgtgacggcgacacgtccgcgatttggtggctctcggctagggggcggcgagacgcatccacgctgcggcaccgctcgaatatctgcagcttattggcgcgatgccatgacaacaggccggcatggggctgacgggctggcacggctaagtcatcgcagagccatgtctagatccaaagttaagcacaaatgacctgacacggacttgttaccaacttaccatgtccaataataccaataataataccatgctttggtggcgtgccatgcccgaccaaggcgagccgccttttggccatctacgtcagcagtcaccactcaccaccccgcctcgccagcggcaccacctcactcgctctcgctaatccacatccaccctcgagtgctcgctcactcgaacagtggcggcgagatgcggagacagatccctcccgtctcctgcctcgtacccatcgcggtggcgttcgcgctgctcgctgcggcgtctgcagcttcgccggcgccggtcaacgtcacgggcgtgctctcggcgttcccggacctcaacgacttcacgcggctgctggcgtccagccccgtgctggcggagctcgcagggcggtcgtcgctgacgcttctcgccgtgccgaacggcaacctcccgcagtcgccgtcggcgttcgcggccgcgtcgggcgccgacctcgccgacgttctccgctaccacgtcctcctggagtacctcgcccccgccgacctccgccgcttgcccgcctccgggaagctcgtgaccacgctgttccagaccaccggccgcgcccccgcggacctcggcgccgtcaacgtcaccgcagcgggcgcctccctcgccgtggtccgctcgccggcaccgttcccgggctcgaacgccaccgtcctcggcgccattaccgcggtgccgtacaacctgagcgtgctggcggtgaacggcctcatcgtcccgtccgggttcgacctcgcggcgtccgagtcccgcccgcccgcggccgtcaacatcacccgcgtcctcgccgacgcgcgcgccttcaacgtggcggcgtccatgctcgaggcctcgggcgtcgcggccgagttcgaggacgacgagcgcggggcggggatcacggtgttcgcccccaccgacgacgccttcgcgggcctcccggcgggcgaccgcctccagtccctccccgccgaccgcaaggccgtggtgctccgcttccacgtgctccactcctactacccgctgggatcgctcgagtcgatcgtgaaccccgtccagcccacactggccaccgagttcagcaatgccggccgcttcaccctcaatatcacccgcgccaacggttcggtcgccatcgacaccggcgtcgtgcaggcgaccatcacgcggaccgtcttcgaccagaatcccgtcgccgtgttcgccgtctccaaggtcctcctgcccaaggagatgttcacccgcacggcggcggcggcgacgacgactcctccatcgtggtcgccgccgccgccgcgtcctcccccccgccagccgcaacagccccggaggcctccgagagcgcgcagacgccgccgacaaagctctcctccccgcctgcactccgcggcggcgagcacgactacgacacggcgtcggcgcaagggatcggaatcggatggtggtgtatagcattggtgtatctacttccacatctcgtgtgagatccgggactcggtcagcccattgtcattccgcttgtgctcaatttttgccttttctttttgttttctcttgtcttttctttacttgtttgggttggctatgtacactgggaggtgagggaggtgaagtagaagattgagctgcgaaaacaaaggaaatgcagcaacctgtttttagtaagaagaaacaagattggttattggccatcatcagatggggaataacagtacagcctgtaaaaatccaatcatatccattgcattcctgttcctttgctggagtacaattgttccatatcgcagccgacatcgtgtctcgtgagttcttctgggtgtgctacattgcagntgcttgagctccatttttgccctgtcgacttgctctgaactgaactggaagtgtggcgccgtggagctgggaggttccagcaaccagctggaggaagctgcagtgcagccaatgctcaccgggcggtgaggggagtgttggtggtgggtggctggctggcagtgagctggcggtcggggctggggccgtggccgcccgtcgggcgcatggcgtcagccgtcagccgtcagcgtgcccccggttagattcgcctttcgcttgcgtcgcatcgctttacgccggccggacgtctggttcttgtcgcaatgtcgccccgccccgccatgcacggacccggcaggaattccggctccaggctccagtgcgtgcaatgcaggagagctggagaggggaagcctcgcatcgcacggtgaaatgtgaatatttctgctcctgcagtcctgctgctgctctatcatgagccgcctacacatcgttgggtcaggtctgatacgaaggctggtgaatgncgatggatttctctcgctgaccgtttagatccttacatttcgaaagaattgaaatttacttgatagagtatattatttagtttagaatttgaaattccacaaatttataggattaacggtggaacttgattttatgtaattgatgttttactctacaacttataacatgctctttatatcgctctacgcaaccttacaacttataaatatcttcgttatatgacaaacaatagtatataaatatatttagtataaaatcatattaacttaattgatctgtacctaaattaggatttcaagatccaaatggggccgcacatttttcacggcgaggacagaggaaaggagccgctcctcttgggacccggccgcggacgagcggcccacaaccacaagctcgtcagcttgtagctatacaggtaactagtgtcctcataacagttgctctacttactgtctgttatgttatggtaattgattattgattgttcacggtcgggtcattggagtgagatcgatcataaatgggttctatgattggacggagtgtgatttcatgatgaggaacgagctgtgtgtttgattgcggaaatcattcagttcggagcgaaaataaatgcggaaatcattggtaagtataataaaatgatgtagatggactgtaagagatgtcacatcagatttatagtagttgtgctcacgaacttcaatatactagcttgtgaggggaagggatagactaaatgtacaacttatattataacaaagttatcatatgactaatcttttagttggttattgaaagggaaatgaccttaacca

SEQ ID NO: 4462 - DNA, 2342 bp, Zea mays
atacgaacctccattggcgtggaaggtgaggaacgcgcttccgtgcgtgcaggagggtccccctatttgttggggggcgggccgcgtggccggccggtgtaccgcgcgctcgcgcccgaaatttcacaacaccaaacccgcagggggagaagcgcaaagccacgaggagtgcgaggcgagggccgacaccggggacaagcgcggcgcggcggcggaggcagcaatggcggcgctgcagagttggcgcaaggcgtacggcgctcttaaggacaccaccaccgtcagcctcgccaatctcaactccgacttcaaggatctggatgtcgcgatcgtgagggccaccaaccacgtggagagcccgcccaaggagcgccacctgcgcaagattgtggcggcgacgtccatcgcgaggccacgggcggacgtcacttactgcatccatgcgcttgcccgacgactcgccaaaaccaggaactggatcgttgctctaaagacacttgtagtgatccataggcttcttcgcgaaggtgaccctgcattccgcgaagagtttctaacatttacacagagagtgcggattttgcagctgtcaaacttcaaggatgattccagcccagttgcttgggattattcttcatgggttcgcacatacggtttatttttggaagaaaaattagaatgcttcagggttttgaagtatgacattgaagctgcacgtttatcaaagcaaggtcaaggacctgaaaagggccacagtagaactacggaattgaattctcaggacttgctggagcaattgccagcactgcagcaattgttatatcgacttattggctgtcgagcagaaggagctgcaaaaaacaattatctggtgcaatatgctctagcccaggttcttaaagaaagcttcaaaatttattgtgcaataaatgatggaattatcaaccttattgacaagttctttgagatgccaaagcatgaagcactaaaagcccttgacgtttacaagagggctgtccaccaggctgggaacctatctgacttctatgaaagctgtcagggtttagagcttgcaagaaatttccagtttcccactttgagggagccaccacaaacattcctttcaaccatggaggagtacgtgaaggaggctccgcgtatgatgccagttgtagagccactggagcttcctgagcggcttcttctgacatacaaaccagaagaagaagttcgtgataccgttccaattgtagcggagaaactgcaagttgttgaagaaattgctccagttccttcttcccaaatagctttgcctcccaagcctgagattgcagatactggtgatttactggggttaggtgattcaacccctactgtgttggcgatagaggagagcagtgctttggccttggcaattcttccgacaggtattgataactcaacaacaactacacagcaagatagtggatttgatccaacaggatgggaacttgctcttgttactacaagcagcaatgcgattccactgtctatggagagtaatttgggtggtggatttgacaagctcacattggacagcctatacgatgatggaacctacaggcagatgcagcaacaacagctatacggatcagcccctcccaatccattcatggcaagcgatcccttagccgtatcaaatcaagtggctcccccaccgtcagttcaaatggcggccatggctacacagccccagcatttgcccatgatgattgaaccaaatcccttcggaccaccacagcagcatcacgcgggcgtcgctcctgcagcaaaccccttcctcgacgccgggttcggtgcgttcccggcagtaaatggaatgcatccacagaccaaccccttcggaggcgccgcacaacttctctagtcatatatactttccaaagtttgcattacaattacatagaagatgtgcaatctgtagatacccacgccacgatgcaagacaagcaatcgacgtctctggaatcgcttttctccgtcagaccgttaccaatcagggaatcgccatgttgcaccagcctcatctcgcccttccgtaggctttggccgcttggccttgtgtagctttctgttttgctgtgcctggttttccatcttccgtggcgagccattgcactcattgtaaagaaatttgtttcatcaggctttgggctgataaaaccatgagtacgtgccaataaggcaataatccatcagcgtttgcatttgtgtaactcctgatgaccgtccgaatatttccgcaattggtcccaaaccactttgcgccctattaaaaagcaggtaaagttgctgtcctggcc

SEQ ID NO: 4463 - DNA, 1835 bp, Zea mays
  misc_feature (1672)..(1672): n is a, c, g, or t
  misc_feature (1677)..(1677): n is a, c, g, or t
  misc_feature (1700)..(1701): n is a, c, g, or t
cctcgggccccccggggcgggccggggcctctcaccccctgctagagctagaggcctggacccactctcagatccaccccaactcgcggagaccgagcccagtccagcgatgccgccgccgccgcaggcgaacggggggaaggtgaccccgaacctggcgatggacgccgaggccacgcgcatgctcaacctcacagtcctccagcgcctcgaccccgccgtcgaggacatcctcatcaccgccgcgcacgtcactctctacgacttcaacatcgacctcaaccagtggagccgcaaggacgtggaagggtcgctgttcgtcgtcaagaggaactcccagccgaggttccaattcattgtcatgaacaggcgcaacactgataatttggtggaggatttattaagcgattttgaatatgaacttcagccaccatatttgctgtaccgaaatgcttcccaagaagtaaatggtatttggttttataaccaacatgattgtgaagctgtcgcaagcctttttggaagaatattgaatgcttatgcaaaggtgcctccaaaaccaaaagtgcctaccacaaaaagtgagtttgaagaactggaggctgttccaacatctgctgctatagatggccccctggaacctccgctgtcatccacagctgtagtttctaatgcacctgatgaatcgctggtgaattacttcaacggtgctgctagcattgggagcgtaccaagtgcacaaatggctggcagagcacatccatcgaatgatacggtcacaccttcccatgtgccactgattgttccatctgctactccaacacatcaaatgtctcatccctttagggggttcatctgctccaccacttcctctccatgacacaaatccgcatgccagtcagtctgcaaatcttctaacaccagctttctttgcaccaccaccaccctcttcaacatctgtgacaccacctgcttcatccatgatgcctacagcaccacctcttcatccgacttcaacagctgctcaacatccttcatatggcactcccttactccaaccttttcccgcaccgtctccacctccttccctgacccctgcacacaacgatggacttgttatttcaagggataaagttaaggacaccctccagagacttgttcagaatgacgagttcatcgatttgatatatcgtgagttacaaagtgtgcacatgtagactgctgctcactagtctgtacggagtttgtctaaaccaccgatagtcttatggagctgctcgtcgcgacaaagatcgcctccctgtttttcttcttgtgagttttgtatgatttatttcttataaacctgtgcatagtttgttttaatgtagagtgcttatagcagtgcttggtaagcatttatcctgctggtttccaaataactggattgtcgtatagtatttatatgtaactgagcaccaagaatgttagattcccgcgatgcccattctggggcatctcggttttgtaaaacaggacttgtgcaggatttaaatgccatatttttcgtgtgaaaaaaaaaaaaaaaaactggacaaaaaaaaaaaaaaaaaaaagaaaaaaaaaaaaaaaaaaaaaaaaaaaaaaaaaaaaaaaaaaaaaaaaaaaaaaaaaaaaaaaaaaaaaagggggnggggnttaagaaggaaacaagtttaatnncgtttgattgcgaaggtaatggtttttttttgggggcccctaatttaaattaactggccgggtttttacacctttggggctgggaaaaaccctgcctttccccactttttttccttggggggaattcccctttt

SEQ ID NO: 4464 - DNA, 8780 bp, Zea mays
  misc_feature (7488)..(7488): n is a, c, g, or t
  misc_feature (8544)..(8544): n is a, c, g, or t
  misc_feature (8555)..(8555): n is a, c, g, or t
tagagtcgacctgcagcgcgcactcgtttgttccgctcgctcgcccgccaccgagagacgacactctacgtgtgtgcctgcgagagcgagagcgcaccagcagagcagacagcttcctctgcggcctgctggtcgcttcgcttcgctccagtccagggcaaaggacggcacatggcggggggcgggggcggccgggacctgccgtcgacgccgacgtgggcggtggccctggtgtgcgccgtcatcgtgctcgtctccgtcgccatggagcatggcctccacaagctcggccacgtacgtcgctcgctcgttgccatgcatggcgcatacgctgatgagcttatggtttctttgtgtgtctgcgtctgactgctgcctgtgtcgcctttcgttgcgtgcagtggttccatacgcggcagaagaaggccatgcgggaggccctggagaagatcaaagcaggtgagctgagaattcagttgttgcataaacaaagacctttatataagcaagctcaataatgctactagctagctagcagtattagcttccctctcctaaacaataacaaaacggtttggttggttgcgtgcgtgcgtacgtgcagagttgatgctgatgggcttcatctcgctgctcctcgccgtggggcagacgcccatctccaagatatgcatcccggccaaggctggcagcatcatgctgccgtgcaagccgccgaaaggcgccgccgccgccgccgacgacgacaagagcgacggccgccggagactcctctggtacccgccgtaccctggatacgatgagcccgggcaccaccgccgtttcctcgccggcgcggctccggacgacaactactgcagtgaccaagtgaggccgcgccccggccaccattccaattgttgcgcgacgcagcgtgcatgggaggagccagcttaccattaggctgcgccacgcgtgccccggtgcgatggcgatgatgggtgggtgacgctgcttctttgtttgtttcccgcgtgcagggcaaggtgtccctcatctcctcggccggcgtccaccagctgcacatcttcatcttcgtgctcgcggtgttccatatcgtctacagcgtcgccaccatggcgctggggcgtctcaaagtaagcacacaggcccaagcatcttgaattcaatggacgactctcgcacggtgttagaaaacactcaccacatcttgtcgcgcgcgtgcagatgaggaaatggaagaaatgggaatcggagaccaactccctggaataccagtacgcaaacggtaactaatactaagaagaagaacgcagctccctattggctcttgatgcatgagcagagtgatcgaagctgacgaggtcgttcgttcttgcgttgcagacccttcacggttccggttcacgcaccagacgtcgttcgtgaagcggcacctgggcctctcgagcacccctggagtgagatgggtcgtgagtactccgacggatcgccagctctttgcagcctgttcctatcgttaagtttctccgcctcgttttatagcctaggctctctgaacactccccctcccccggcccgctgcaggtggcgttcttcaggcagttcttcgcgtccgtgaccaaggtggattacctgaccatgcggcaggggttcatcaacgtaaatgagcatgcatctccccattgttaatatgctatgtggtgactggtgattcgctaagccttttatgctgctgacacggcgatggtcgttgcttgcttccctgcagtaccatctgtcgcccagcaccaagttcaacttccagcagtacatcaagcggtccttggaggacgacttcaaagtcgtcgttggcatcaggtctgtgcgtcccttccaagtcgttttttagagaaaaggccggccaaagaagaagaagaagaaaagaactgcctgattcgcgtagtcttttctcttttgcattgttatgacgttggagccctgacatctggctggctttctgtgtacgcagtctcccgctgtggttcgtcgccatcttcactctcttgatcgatatcaagggtacttaccatccttacaatcctagatagctgttcttgttggtaaaagaaaacacagtctttattgagttattattggtcttgtaataaccaccatcattaattatgtgcgcaggattcggcacgcttgtctggatctcttttgtcccgctcgttgtaagtgttgacgccatcgtcttcgtctctttagttttcttagagcaactccctctatctgcctgtccgtccctgttggcacagacaaagagccaattggtcattccaaaacagatccagctaaaaccgccttggaattaatgtaatactacagtatagtataagcaaaggcgtcgtcgttgtttcagatactcctgctagttggggccaagctggaggttgtcatcatggagatggccaaggagatacaggacaaggcgacggtcatcaagggggcgcctgtggtggagccaagtgacaggttcttctggtttaaccgccctggctgggtcctcttcctcatccacctcacgctcttccagaacgccttccagatggcgcatttcgtttggacactggtaggtttttacctgctcttctttcttttattagtagcctgtaaaagatcctcgagtcgagtgttctgttcatccagtcgatgcagcagaacgagcagacgctgactgcctacctcctttctctttggctggtccgtcctggcgcagctcaccccagacctgaagaaatgctaccacgagaggctgggcctgagcatcatgaaagttgcggtgggcctggctctccagttcctctgcagctacatcaccttcccgctctacgcgctcgtcacgcagatggggtcgcacatgaagaagaccatcttcgaggagcagacggccaaggcggtcatgaagtggcgcaagacggccaaggataaggtgcggcagcgggaggcggcaggcttcctcgacgtgctgacgagcgccgacaccacgccgagccacagccgcgcgacgtcgccgagccggggcaactcgccggtgcacctgctccacaagtacaggggcaggtcggaggagccgcagagcgcgccggcgtcgccggggcgggagctcggggacatgtacccggtggccgaccagcatcgcctgcacaggctggaccccgagaggatgaggcccgcctcgtccaccgccgtcaacattgacatcgctgatgccgatttttcttttagcatgcggtgaccttgaacaaattctgtgtccttactcttgtatagggaagcaaaagcatagacggagaacataatgacacgttacgttagggaaagtttcgtttattcatcataaaatagaatacgtaataaactagtatctccctcttctctgtggaaaaaaaactgaactgagacccttacaatgtacagctgcaaaaaaaaatattaaaaaagaatagagcattcgaaccaggatgaagctatacattggaaacaaccagttctcacactaacaagataggttatcagcaaatacattgttcttgtgaacagctattaggacagctgcactcatcatccacaggaccacaggctagtcagcttttgcacgaacccttctattgtgaacagctactaggaccactgacactgccattccaaccaaatacccagcaacggcaccataagagacacagattggccattcctacagaacatcaaagaaacagaatagtagcaatcagtcataactcataaggtccagaaaaggaatcgtcatcaatgtgacacttgaagataagatctatggttaagtacatgttatgagataaactcatttcttcttattataatgatacacacctctccttcatttttttttgaaaaaaaaagctaaggtaaactcataaaagggacatcaggatattgagaactccaaaggacaaaacacccaacagcacgttaggcaaaccaatgaattccatgtgcttgccttgcaccaaggagcctgcatatatcgtagccaggatattttgggacacgttcacactgcaactagccgtgtttggtattcttgcagcaaacaaaccagaccaacgcaggttcttgtatgttacctgcactgctgtgggcctccacattgcccaaaggcagaatacatgagtcggttctcaaaaaaacaaagtaaaattccatttcccctccatccaggtaatcaaacacgagttactgcatcccagtggcctggcttggcccttggtgcagggaaacaaacaagcccttagaacttgcatccctacatgtttgtgatccccatatgtttaccccagccaggccataaacacaagtatgtttcgtagagctgtttagtgtcatgttaaccatcaagtgtgcacaaacatatccatatgacctagcttttccatgccttgaaattggcaacatactgcttgagattcaaagatggtatgcctacctgccagggcctctcccagtcaaggggcataggccaaccaccgagccatgctcctagcacagctccatgacaaggtgcagagatcatgtagttctcaacatcatttggcatgaaataactgatatgtacaaagacaatgaaatatcatggcacagtggctgtacaaaacaaaagaaagaaatatgcccactacatgaacctgtacagttcaaaagtttacaagtccagaacatacatggagtgagaaagcacattttgccaatcaatcttggatgctccaaagacacatgctgctggaacaaactgaaagataataaaattagtctcgcctgcctcaatcgctaaagctatgcagtaaacacaaagtggtaacttgtgagtacaagattatgaacacaatacaatactggttgttgcagttgcagtctgtgttgctcggttttgtaccagaaaatcagcaaaaatgtcaattaccgtgaacagggacatgaggagtgaccaatatatagtaggtatccagtatctacaaatgcaaattacatcaaataaggaactgttagtacccgtaaattgaaatatcatggtttactttactaaaatcagatgcaagatagaattattgagcaaagcactacagacatcaaattcctagtcatgatgcccactcatgatgtgaaagataagttaaattatttctgaatgtaacttacttgattccaacaggtgcaccaagaacgattgctccaaatgcattaaggaatgctcctggcatgggtggggaaaagatgtgcagaaaaatcagagaaatgaaaaagaggaaaataaacaaatcctagataactcataactaacagtatgactgttgttccatgaaaccgaactagcacttctactgttaccagaactgatggttcagatctgcagcatggtgctgttcgttttgggtttcatattcatacagcaacgtatcaagataagaatgcaatcgaagtcaaggtatagaaccaacccacgggcaagcagatcaatcctctcgcaacagctttgaaaatctgaaaataaggcgaacccgatgaccccattgctgaacaaaaaaaaaattaaggcacaattaatcgaacaggttgcacgcgcgccataccgagcagcttttggcatcacgccggaggtagctgaacacggcgatgactatgggcgcttcacagacctgagtgaaggagacaaatgttcagttcggatcggaagcgagaaggatggggataccgaagatacgtttaccggcaccggcggcggcgaggtcagtgaaaataccacgagaaggcggagggcgagcgcggggtctgagacgagcgcgccgcggccagcgagggtgtgggcggcagcgaggcctgcaaagcagagcaaatgcgcagccccggcggttaaggcgctgctctcggtggcctccgcgcgcatagcgcgcatccgcctttcgagcaaagcaactggtggagtttgcgcagtggactggagtctgtagggaaaaaaaaggcaaccgtttttcagttggctggtttttatttcatgtgaacgaacaaactgtttatttttagttgactagctttcaatgcctcacctatattaagaccatgtttagtttcaattagtcttaggactaaattttagttatagaactaaactttagtccctacttgtttagttctataaactaaatagattctaaaatcattaaatacattttcaaagactcaaatgcccttagaatacactcatgagagcttttagtctcttttagcacctatgtgaaagaatagagactaaatcattttagtctatattttagtcttatggtttgaaaaaaaagactaaatgagactaaaaactaaagactaatctttagtccctctaactaaacgccccctaaatcttaaaatttacataaaccttacacatgcggacatgccataatatatacggtataaataaaaatacaatatttaaacatctgataaggagcgaatccacctgcacctaaaaaacacaacatctaaaacatcgttctcagttcccactcttcaaacaaggatggcctgtgtggaccgagtgaaatcggaggagattaaatctcctgttatacaaacttgaaataaattaaatagaaagagatttaatctctcttagtcttctttaattctaatgcaatgaaacaagacctaatatacatagactagaaggacacatccacttatccacttatcgaaatgacactacacttctacatttatcatacaaattaatcacttgacaaaacctacacaaaacttgcccaaatactggatgcatgatgcagagtgcagaaacacttcaaatcacacctaaacggacaaatccttaaccctcgaaagagatttaatctctctcattcctcatgcaatgaaacaagacctagtatggacaaactagaagaacacatggacttgtcaaaatgacactacacttctacatttatcgtacaaattagctgtctgtcaaaacctacacaaaaattgtccaaatgctgaatgtgtgacgcaaagactacataaacacttcaaatcgcactccaaacggacaaacctcctaaggccttgttcgtttgtgtcggattgcacctgaaatcattccagctaatcaaagtttatatagattagagaagcaatccgattaggaatcgttccgactcactaatccgatacaaacgaacaagatctaaagatatttaaactcactcattcctcttcaattccaaggcaacattccaatgcaactaaaccagacctaatatagacagactaggacacatcgacttatcgaaataacactacacttctatattttatcatacgaattaaccgtctggcaaaacctattaaaaaacttgctcagatgctgaattcgtgacgcaaagactacagaaacatttcagatcgcactcaaatagngctggacgaaatgctggtggctcgctggctcactcggttcatagtcagctcagctcggctcggatcggcttagggatggcaacggggcgggttcggggcgggtgtagcttcagcggacccgaacccgagacccgaaccaaaaacccgacccggacccgaactccgtggtgggggaaaatccgcccccgcacccgaacccgatggggacccgaaaaccgtcggggacccgttaatcgagttatgcagacacaaatagccgtccaacgcattcaaaaatacaaacatcagagcacagactgctatttatcaatatataatgagttaatgacatataactacaatcactcaatcggtgtctgcttttacaagacatgtgagtgtctttgtaaacaacacacaacagtccaacacaggcacacaacatattagaaataacagtccaacacaacatactagaacatattataggtccaaatagcagtccaacacattacataaagtgcagcaccttacaagtagcagtccaacacattccaaacagcacattacatataacagtctaatgtagcttcacatccagatatttagcacattacaaaaagcactgcagcagtccaacataaagtgtgccattaaaacaactgtccaaaatgtcacaaccaacatattatagtccaaaaaagcatctgctgtagtgctggatagcaacatctccatcacttgatttgttggaaacttaattcagtccacaattgttgactcaggttcatcctaagaatagagtgaacatacatagagcaatattacaatagttaaaaggttgtatcaattatagtccataataaatttgtattgatcacaaaatgaaaactcgtaccatgtcttcatcgttctcttcaagccaagtcatcattgcaccaacaaaggtggattgagatcctataatccaaatttgatcacatcttagtgacacaacattgcaagaaatgtataaaataatgaaatagttatatattagatcaattacctaatatatctgagcgagaccaagcttgnatacacataanagcttctatcattgaaggtgcaagcctactgcgatgtggactaatgatcctccctccagtactaaacactgactctgatgccactgttgtcacaggaatagcaagaacatcttgtgcaatcttgcgcaaagttggatattttatccctgcatgctgccaccattgaattatatctagatcttgagtcctaggcagtagtggctcctctaagtacaaatctaactc

SEQ ID NO: 4465 - DNA, 1947 bp, Zea mays
tggcaaaggacggcacatggcggggggcgggggcggccgggacctgccgtcgacgccgacgtgggcggtggccctggtgtgcgccgtcatcgtgctcgtctccgtcgccatggagcatggcctccacaagctcggccactggttccatacgcggcagaagaaggccatgcgggaggccctggagaagatcaaagcagagttgatgctgatgggcttcatctcgctgctcctcgccgtggggcagacgcccatctccaagatatgcatcccggccaaggctggcagcatcatgctgccgtgcaagccgccgaaaggcgccgccgccgccgccgacgacgacaagagcgacggccgccggagactcctctggtacccgccgtaccctggatacgatgagcccggccaccaccgccgtttcctcgccggcgcggctccggacgacaactactgcagtgaccaaggcaaggtgtccctcatctcctcggccggcgtccaccagctgcacatcttcatcttcgtgctcgcggtgttccatatcgtctacagcgtcgccaccatggcgctggggcgtctcaaaatgaggaaatggaagaaatgggaatcggagaccaactccctggaataccagtacgcaaacgacccttcacggttccggttcacgcaccagacgtcgttcgtgaagcggcacctgggcctctcgagcacccctggagtgagatgggtcgtggcgttcttcaggcagttcttcgcgtccgtgaccaaggtggattacctgaccatgcggcaggggttcatcaactaccatctgtcgcccagcaccaagttcaacttccagcagtacatcaagcggtccttggaggacgacttcaaagtcgtcgttggcatcagtctcccgctgtggttcgtcgccatcttcactctcttgatcgatatcaagggattcggcacgctcggccgcgtcggttttgtcccgctcgttatactcctgctagttggggccaagctggaggttgtcatcatggagatggccaaggagatacaggacaaggcgacggtcatcaagggggcgcctgtggtggagccaagtgacaggttcttctggtttaaccgccctggctgggtcctcttcctcatccacctcacgctcttccagaacgccttccagatggcgcatttcgtttggacactgctcaccccagacctgaagaaatgctaccacgagaggctgggcctgagcatcatgaaagttgcggtgggcctggctctccagttcctctgcagctacatcaccttcccgctctacgcgctcgtcacgcagatggggtcgcacatgaagaagaccatcttcgaggagcagacggccaaggcggtgatgaagtggcgcaagacggccaaggataaggtgcggcagcgggaggcggcaggcttcctcgacgtgctgacgagcgccgacaccacgccgagccacagccgcgcgacgtcgccgagccggggcaactcgccggtgcacctgctccacaagtacaggggcaggtcggaggaaccgcagagcgggccggcgtcgccggggcgggagctcggggacatgtacccggtggctgaccagcatcgcctgcacaggctggaccccgagaggatgaggcccgcctcgtccaccgccgtcaacattgacatcgctgatgccgatttttcttttagcatgcggtgacctgaccttgaacgaattctgtgtccttactcttgtatagggaagcaaaagcatagacggagaacataatgacacgttacgttagggaaagtttcgtttattcatcataaaatagaatacgtaataaactagtatctccctcttctctgaggaaaaaaaactgaactgagacccttacaaggtacagctgcaaaaaaaaatattaaaaagaatagagcagaaaaaaaaaaaaaaaaaaa

SEQ ID NO: 4466 - DNA, 3162 bp, Zea mays
gagctatgttgtcgcattgcatcgcgtacgtatgctcggaattcggctcgtgattccattgatgttgacatggtggaacaagaacaaacggatgaaataaatgctgacaatgaagatataggtacagaagaagctgaacaagcagatcagaggttagatgcttcagatgatatggaggaaggagatatggcacaacatagcgatggtgtggtagataatgaaggggagcatgttgaagatgcaaatacagacgcaggtgagatggattcacaccaattggacaaggcggattcacttatgcctctgtcacaaggcctacagcctgacaatatgcaaataaattctaatggagaatctgaagcgaacttggccaacagcagtgatatgcatggcgctgttgctccttcagtaaatttttcaggaaatgaagtgcccaatatggaaatatctatgcccaatactggtaacgattcaatactatcgtctaactccaagccagatatgcaaaatgatgctcagcagcacatcaagcagacaaatcctttcagaagcatcggagatgcattggaggactggaaagaacgggccagagtctcagctgatactcaggatcatcaaccagaaactggaaaagatagtagtgagaacactactgaatttcgttatgtgcctgagggtgaggagagcacctctcaggcattgggtgctgcaacagctgaccagatcaattatgacaatcagattaatcaatctttcttggaagatgaaagctgtatcaggaatttggaacatagtgatgagagaacacctgataaccctgaggtgccttaccttcaaacttcacaagcacttcccaacaagtctgaaaatgccaatgaattggatggaagagaaattcaaactgatgcatccgttcaaaatttagttgaaagaacagatcacactttccaagatctagtttctttcaaacaacccccggcagatgataaaatagctcttattgacctaactactaacagggaattgccttctcagatggatctcgacatcactgatgcagagacaaaaaggtctaatgcggtctggaaaaatcttgagctcgcaaccatgaaattgtcccaagaactggcagagcaattgcgcctggttatggaaccaactcttgctagtaagcttcaaggggattatagaactggaaagagaataaacatgaagaaggtacttttatttccattgaacttatcatgatatgttttcctttcttctctacagggaagcatatgattgacaacaactcttgtttctcaggttattccatatattgcgagtcatttccgcagggacaagatatggttgcgccgaactaagcctaataaacggaattaccaagtggttattgctgttgatgactctagaagtatgtctgagggcaaatgtggaaaatttgctatcgaggcattagttactgtgtgccgtgctatgtcacagcttgaggttggacaatttgcagttgcaagttttgggaagaaggggaacgttagtgtgctacacgattttgatcagatctttaatagtgaagctggagttaatgtaagttgaagaaatttacagtatgattctcttatcttcattgtctaactattgctatgtatcctccatgctctcgtttcaggtgatctctagcttgtcgtttgagcaagataacaaaattgaggatgaaccggtgtctgatctcttgacacatctgaatgttatgcttgatactgccgttgcacgggcacgcaccccatcagggcaaaatcctctccagcaactgatactgataatatctgatggaaaattccatgaaaaggtaactaattttgtcgtcaggtttggctgcagctcgtatacccctttcctcttgggttctgaagttggctctctggcaggaaaacttgaggcgccatgttagagacgttctaaatcgaaagaggatggtcgcgtatgtgctcctggatagccccgaggattctattattaatctaaaggaagcatgcttcagagtaggggagaaggtagagctgaaaaaatacatggattcctttccgttcccgtattatgttatgctacagaacattgaagctcttcctcgcacattggccgacctgcttagacaggtgtgaattactcctagcaatttagactcttttaacatactaatgatctcgaatgagttaacaaatggttgccttactaatgacctcttttctactttgcagtggtttgagctcatgcagagcgccaacgagtgacccttgggagttgggagtagtgccacgcatttagctgtacagcaaactacattctagcttccatttttgcttgggcctggacagttctgtggtggcaagcttgattgtgcacaaatgccttcacggttcaaatcgctttcctgaaatatgatctctggtcgcaggcttgattgtctaaaagcatcatcacaattcaaattgtttttgggaaatttgaatagaatttccgctttcctgaaatatggtctctgctcgcaggctttattgtgtaaaaacatcatcacaatttaaattgtttctggcaaatttgaatagaatttccgtgctcaagagttatagtttgttttttttttcaatggagaattgttgctcacgtgctacatgcgacctgagtgtgattgatccttcaatcttgccctgctgttcatcttgtgttgtttgtcatgtttggctttgttgatgtacatgtttcttccactgcatgtgctacgcgttgacgatgtacgcaactgtcgctgccaacgcgaccactttatatatgtgacagtgacacatgccaggggcagatctagaaatctacaaaatctcttcaagctctttctctcttgtaagggattgtttgtttgagattaataaatggggattctaaccgtgtttgttgactctaaacctaggttcacactcatctaaccaataaaatgtatgtgtctttatattttatattatatatttaaatataaatagaaactgtaccaataaaatgcatgtgttttatattttatattgtatatttaaatataaatagaaactgtagcaatcgtataggcactttgctgcaggcgtgcaaggctgcaaccatgcgccaacg

SEQ ID NO: 4467 - DNA, 1514 bp, Zea mays
ggctagttctagatcgcgagcggccgctcggatctagaactacaatgaattggatggaagagaaattcaaactgatgcatccgttcaaaatttagttgaaagaacagatcacactttccaagatctagtttctttcaaacaacccccggcagatgataaaatagctcttattgacctaactactaacagggaattgccttctcagatggatctcgacatcactgatgcagagacaaaaaggtctaatgcggtctggaaaaatcttgagctcgcaaccatgaaattgtcccaagaactggcagagcaattgcgcctggttatggaaccaactcttgctagtaagcttcaaggggattatagaactggaaagagaataaacatgaagaaggttattccatatattgcgagtcatttccgcagggacaagatatggttgcgccgaactaagcctaataaacggaattaccaagtggttattgctgttgatgactctagaagtatgtctgagggcaaatgtggaaaatttgctatcgaggcattagttactgtgtgccgtgctatgtcacagcttgaggttggacaatttgcagttgcaagttttgggaagaaggggaacgttagtgtgctacacgattttgatcagatctttaatggtgaagctggagttaatgtgatctctagcttgtcgtttgagcaagataacaaaattgaggatgaaccggtgtctgatctcttgacacatctgaatgttatgcttgatactgccgttgcacgggcacgcaccccatcagggcaaaatcctctccagcaactgatactgataatatctgatggaaaattccatgaaaaggaaaacttgaggcgccatgttagagacgttctaaatcgaaagaggatggtcgcgtatgtgctcctggatagccccgaggattctattattaatctaaaggaagcatgcttcagagtaggggagaaggtagagctgaaaaaatacatggattcctttccgttcccgtattatgttatgctacagaacattgaagctcttcctcgcacattggccgacctgcttagacagtggtttgagctcatgcagagcgccaacgagtgacccttgggagttgggagtagtgccacgcatttagctgtacagcaaactacattctagcttccatttttgcttgggcctggacagttctgtggtggcaagcttgattgtgcacaaatgccttcacggttcaaatcgctttcctgaaatatgatctctggtcgcaggcttgattgtctaaaagcatcatcacaattcaaattgtttttgggaaatttgaatagaatttccgctttcctgaaatatggtctctgctcgcaggctttattgtgtaaaaacatcatcacaatttaaattgtttctggcaaatttgaatagaatttccgtgctcaagagttatagtttgttttttttcaatggagaattgttgctcacgtgctacatacgacctgagtgtgattgctcc

SEQ ID NO: 4468 - DNA, 2517 bp, Zea mays
acaagcgccgaggagcgagatgcagaacgtggtggaggtcgagccgggccccctgggtacctcgagccggcctccgtggggcccacctaccggagcgccttcgcccgcgacggattcccgccgcccgtccccgggatggacagctgctacgacatcttccgcatggccgtggagaagtatccaaacaacagaatgcttggccatcgtgagattgttgatgggaaggctggtgcatatacctggaagacatataaggaggtgtttgacattgcaaacaaaattggtaactctattaggagctgtggacttgcgaagggtagtcgttgtggtatctatggtgctaattgtcctgaatggattatcacaatggaggcttgcaacgcccatggaatctactgtgttccattatatgacacacttggagctggtgcggtagagtttattctgtgtcatgcagaagttgagattgcttttgcggaggaaaagaaaattgatctgctcgtgaagactttacctaagtcaaatgagttcttaaaaacgatcgtaagtttcggcaaggtaactcaagaacagaagggagaagtccaaaaatatgggctatcaatttactcgtgggatgaatttctgtccctggcggctgaccaagaatttgatcttccagtcaaggagaaggcagacatatgcactataatgtatactagtggaactactggtgacccgaaaggagtactgatatcaaatgctagcattatttgtctcattgcaggtgtggaccggttgcttaactatgtaaacgaagagttggcagaaagcgacgtttacatgtcttaccttcctcttgcacacatctttgatcgtgttgtggaggaattgtttattttccatggtgcctctattggattctggcaaggggatgttaagctactagttgaagatattggtgtgctgaaaccaacaattatgtgtgctgttcctcgtgttcttgatcggatattttctggactacaagctaaaatttcctctggtgggtttttaaagagtacaatgtttaatcttgcttacaaattcaagcagtttagaatgatgagaggagctaagcacaatgaagctgcttccatatgtgacaaagtagtttttagtaaggtgaaagagggtcttggtggaaatgttagagttattttatctggagctgctccacttgctacccatgttgaagaatacttgcgtgtggtcacatgtgcacatgtcgtacaaggatatggtctcacggaaacttgtgctggatctttcgtctcgctaccaaatcaaatgtccatgataggaactgttggccccccagtgccaaacatcgatgttcgtctggagtcggtcccagaaatggattatgatgcacttgcgagcaaacctcgtggagagatatgcatcaggggagaaacattattctcaggatactacaagcgtgaagaccttacaaaggaggtcctcattgatggatggttccacactggtgacattggtgagtggcaacctgatggatctatgaaaatcatagaccgtaaaaagaatatattcaaactttcacagggtgaatatgtggcagttgaaaatttggagaatgtttatggtcttgtttctgctatagactcgatatggatatatgggaacagctttgagtcctttcttgttgctgtggtcaatcccaacaaggaggttctcgagagttgggctgcagcaaatggaataagtggtgatttcgagtccttgtgcaataatccaagaacaaaagaatacattttaggagagctgtcaagaataggaaaagagaagaggctcaaaggttttgaattcgtaaaggatgtgcacctggaaccagtaccgtttgacatggaccgtgatttgatcaccccgacatacaaaaagaagcgtccgcaactgctcaagtactaccagggcgtgattgacaacatgtacaaaagtgctaagtgaactcactctacagtacacatcccgatgaagattcccaacgctgaatcttgaatgagcagccagaagttctgctgtgtatatgctcgtagtttgtatgcgagaattcttcctgtatcagtttttcagaaacgatttgccttgggcatatatatatagcaaaaccggcaatgtggccagcagccaagtggagacaccgtttcaaattgattgaactatggcgaatactgattgacagaagggttagggcatgcttggtacctttaccaggtactattctacctggccgagcaaattgattaaggccaactgtttggatccaatttaggccttctttgaaatgtgggattttttcccatttcctatgtatttcctgtgaaaataaactgattcctataaaattcctttacgactcctctaatgtttgggcattccaaagaagcccttagcgatggacccaggattttagtatagggtgtgtcatgtcaaaaatgttatatatataatttaataaaattcattttctaatttggt

SEQ ID NO: 4469 - DNA, 2607 bp, Zea mays
caggaaaaaaacccggtgttctagccgcacgcatctcaaaggtgatactgggcggggcgatttggagatgatgttctagcactagcagcacgcacgcatctcaaaggtgatactgggcggggcgatttggagatgatgttctagcactagcagcacgcacgcatctcaaggtcatactgggcggggcgatttgcgagtcctgtggcctcgtgggccacgtgcacgcagcagaccgcaggaatttgcacgagaccagtacctagaacaccctactccagcgaaatccgccacttcgtcgtcgtcgtcgcacggattggcattggctgccccccggccctgttcctcgtcctcctcatcaattcccgtctctcagtcctcccaataatggtggcgtggtgagaaatccttccgtccggccgtcgtcttagaagatgaactgttcctcttgctgcgccgctgccactccatcttctccggcgcttctcgccaggccgcgggggggtttagctgctagctgctccacgacgacagcaaatcagaaggtgcttttcctgggctcaaaacagtttccacggatcacgtatagccgtgcgtcgtcacggttgtcgcggagagaggtaatagcttttgccgggcaacaaccttgggacatcggcagatttgtcaagacgctgtatttcttcaacgggcctccaaaccttctcaagattgtagaatctatcatcagcagtttcactggacctgcttctagtgaagtgccaaagaaaatggaaacgtcggatgtggtgctggttactggagccaccggtggtgttgggcgacgggtggtggacgtcctgcagaagaagggagtacctgttcgagtattggctagaaatgtagacaaggcaaggagcatgttggggccggatgtacctctgatcataggagatgttacgaaggaagatacacttgatcctaagctattcaaagggataaaaaaagtagtcaatgcagtctctgtcatagtggggccaaaggaaggtgatacgccagacaggcagaagtacaaacaaggcatcaaatttttcgaacctgagatcaagggaccttcacctgaaatggttgagtacatcggaatgcaaaacttgattaatgccataaagagtagtgttggactgagtgaagggaaactgctatttggtttcaaaggcaacttatctggagagattgtgtggggagctcttgatgacgttgtgatgggtggtgttagtgaaagtacattccaaatcttgccaacaggaagtgaaagtagtggaccaactgggttgttcaaagggactgtatctacttcaaataatggtgggtttactagtataaggacaaagaattttactgtgccagaggacctgtcagcatatgatggtattgagttacgagttaatggtgatgggcgacggtataaactcattatacggactagctatgaatgggatactgttggctatacagcaagttttaacacaactaaggggggatggcaaagtgttaaagtacctttctcttctctgaaacctgtattccgtgctcgtactgtgactgatgctccacccttcgatgcaagcaacattacttcactacaactcatgtttagcaaatttgaatacgatggaatactcaacccaacatttactgaaggtccgtttgagcttcctttttcgagtattagagcatacatcaatgagccgatcactccaaggttcgttcatgtgagttctgcgggagttacaagacctgaaagaccggggttagatttaagcaagcagccacctgctgttcgattgaacaaagagcttggctccattttaacttttaagttgaagggagaggatttaattcgggaaagcggtattccgtacactattgtaaggccatgtgcattaactgaggaaccagctggagccgatctcatgtttgaccagggggacaacatcacaggaaagatatcaagggaagaagttgcccgtatttgtgtagcagctctggcaagcccagatgctgtgggcaaaactttcgaggtcaagagcactgttccattcagcgaaccgtatgtgattgaccctgcaaatcctcctcctgaaaaggactatgaagtatatttcaaagaactcaaagaaggcatcacgggtaaagaggcgttagaggcaacacctgctcaagtttgaagatgtcgttgaattaagaatttcgtctgttttcttaaattctgacacagtaacccccactctgaatgtctaaagtcatctagaaacatagatgacactaatgctaaattttgtagctgaagatcagaccaataaatattcccaagaacacattactgttaggttgggggatcattaaactcgagctaagacacaaatatgtagatgaaattagtgctgctgttcatgccttcgttggagttagccattacaggacacaagaatttagtaagaggtttggcaaaaaaaaaaaaaaaaaggagcagctgcctgatgagttggtagagtggttgctttcagtcaattctctagggtgcctatctctatttaacttgatgctgcacactgggggctcccttcagtc

SEQ ID NO: 4470 - DNA, 3049 bp, Zea mays
gatattattgcccgggccgccccggccgggccgtttcactgtgctccttctcgccgactccgccatgaccgcctcgccctacccgacgacgccgtggctgcggccaccgcctcctatggcatttctgagtctcctcctcctccttggctgcctctccccgtcgatctcactggcgggtgcggaggcggcgggggttctgagacaagtggttggtggggacgacggcgggacattcttcgagccgttcaacgtgacctacgaccaccgcgcgcttatccttggcgggaagcgcaggatgctcgtctctgcggggctccactacccgcgtgccacgcccgagatgtggccgagtttgattgcaaagtgcaaggagggcggcgtggatgtaattgagacatatgtgttttggaatgggcatgagccggccaaaggccagtattacttcgaaggaagatttgatattgtcaggtttgctaagctggttgcagctgaaggtctatttctttttctgcgaatcggcccatatgcttgtgctgaatggaatttcggtggtttcccagtttggttgcgcgatgtccctgggatagaattccgcactgacaatgaaccctacaaggctgaaatgcagatttttgtgacaaaaattgtagatatcatgaaagaggagaagctttattcttggcaaggtggtcccattatactgcagcagattgaaaatgaatacggtaacattcaaggccattatggtcaagcagggaagagatacatgctatgggcagctcagatggcacttgcacttgatactggtgttccttgggtaatgtgtaggcaaacagatgctccagaacaaattctcaatacttgcaatgccttttactgtgatgggttcaaaccaaattcctacaacaagccaacaatatggactgaggattgggatggatggtatgccgactggggcgaatcattgccacataggcctgctcaagacagtgcttttgctgttgctcgtttttatcaacgtggtggaagcttacaaaattattacatgtattttggtggaaccaattttgagcggacagctggtggtccacttcagataactagctatgattatgatgcaccaattgacgaatacggtatcttaagacaacctaagtgggggcatttgaaagacctacatgcagctattaaactttgtgaatcagctcttactgcactcgaggccggccgggattatgtaaaattagggcccatgcaggaggcacatgtgtattccagtgaaaatgtccacacaaatggaagcatttcaggaaattcacagttttgctcagcttttcttgccaacattgatgaacataaatatgcttcagtctggatttttggaaaatcttatagtctaccaccatggtctgtgagcatactaccagactgtgaaactgtggcttttaatacagccagggttggtacacaaacatcgtttttcaatgtcgaatctgggtcccccagctattcaagtaggcataaacctagaattctatcccttattggtgtcccctatctctcaactacttggtggacttttaaagaacctgttggcatttggggtgaaggcatctttactgctcaggggatattagagcacttaaacgtgacaaaagacatctctgactacctttcatatactaccagggtgaacatttctgaagaggatgttttatattggaattccaaaggttttcttccatcactaaccatagatcaaatccgcgatgtagcacgtgtatttgtaaatgggaagcttgcaggtagtaaagttggtcattgggtctcactgaatcaaccgcttcaattagttcaaggacttaatgagttgacattgttatcggagattgttggcttgcagaactatggtgctttcttggagaaggatggtgctggatttagaggtcaagtaaaactcactggcttgtcgaatggggatatcgaccttactaattctctttggacatatcagattggtttgaaaggtgagttttcaaggatctattctcctgagtatcaaggatctgctgagtggagtagcatgcagaatgatgacacagtttcacccttcacatggttcaagactatgtttgatgctccagaaggtaatggccctgttgccattgatcttgggagcatgggaaagggccaggcttgggtgaatgggcatctcattgggcgctattggtcactagttgcgccagagtccgggtgtccatcgtcatgcaactacgcaggaacatacagtgatagcaagtgccgatcgaactgtggaatcgctacacaaagctggtaccacataccacgcgaatggttgcaagagtcaggcaatctattggtactcttcgaggaaacagggggagacccatctcagatatcgctggaggttcattacaccaagacaatctgctcaaaaatatctgagacttactatcctcccctttctgcctggtcacgtgccgccaacggtcgcccctcagtaaatacggtagcaccagagcttcgcttgcagtgcgatgacgggcatgtgatctcgaagattacatttgcgagttacgggacccctacaggaggttgccagaacttctctgtagggaattgccatgcatcgactactctagacttggtggtagaggcctgcgaaggcaagaacagatgcgcgatcagtgttaccaacgaagtattcggagatccatgccgcaaagtcgtcaaggatttggcagttgaagccgagtgctccccgccatcggttaaccaagaacctcgatacgatatatgatcacggtactgtattgtggtgctcaggtcttggaagagctatggtggacgttgccgcagctttgcagggccgtgcacaatggtcctgcatcgttgtctcctatacctctgcacccatattgtatgtaaacagtgacctacatgtaaaaactaaagaagaggagggattgaaaagaaatgagatggaaaaagaataaagttgcttttgttacaaatggtcattcctgtg

SEQ ID NO: 4471 - DNA, 762 bp, Zea mays
  misc_feature (678)..(678): n is a, c, g, or t
ggcactggcactggttccgcgcgtgccttgggtaatgtgtaggcaaacagatgctccagaacaaattctcaatacttgcaatgccttttactgtgatgggttcaaaccaaattcctacaacaagccaacaatatggactgaggattgggatggatggtatgccgactggggcgaatcattgccacataggcctgctcaagacagtgcttttgctgttgctcgtttttatcaacgtggtggaagcttacaaaattattacatgtattttggtggaaccaattttgagcggacagctggtggtccacttcagataactagctatgattatgatgcaccaattgacgaatatggtatcttaagacaacctaagtgggggcatttgaaagacctacatgcagctattaaactttgtgaatcagctcttactgcagtagatggttcacctcattatgtaaaattagggcccatgcaggaggcacatgtgtattccagtgaaaatgtccacacaaatggaagcatttcaggaaattcacagttttgctcagcttttcttgccaacattgatgaacataaatatgcttcagtctggatttttggaaaatcttatagtctaccaccatgggtctgtgagcatactaccagactggtgaaactggtggcttttaatacagccagggnttggtacacaaacaatcggtttttcaatgtcgaatctgggtcccccagctattcaagtaggcataaacctagaattctatccct

SEQ ID NO: 4472 - DNA, 1514 bp, Zea mays
ggtacctcgagcccgcccccagatcacacacgagtcccgtccgccgctgtagcagtactgcagtagaaatcctgtcctgtcgctccctccaccacacactgaactgaacacgcgcgcgcgcacgccatccccctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgatccggctgggcgtgccggccgcggtgtgggcgggcggcgccaacgcgcccatgtcagcggccgacctcctcccgccgggccacccggacccgtccgtcctggagcggctgctccgcctgctggcgtcccgcggcgttttctccgagtccaccgagtccacgcccaccacgcggcggcggctattcgcgctcaccgcggtgggccgcaccctggtgccggggcccgcctcgggcgcgtcctacgccgactacgtgctgcagcaccaccaggacgcgctggtggcggcgtggccccgcctgcacgaggccgtgcttgaccccgcggggcccgagccgttcgcgcgcgccaacgccggggtcaccgcctacgcctactacggcaaggaccaggacgccaaccgggtcatgctccgcgccatggcgggggtatccgagcccttcatgggtgccctcctcgacggctacggcgccgccggcgggtttcgcggcgtcgccacgctcgtagacgtcgggggaagctccggcgcctgcctcgagatgatcatgcgcagggtccccacaatcaccgagggcatcaacttcgacctccccgacgtcgtcgccgcagcgccgcccatcgccggagtgaggcatgttggcggagatatgttcaagtccatcccctccggtgatgccattttcatgaagtgggttctgacgacgtggaccgacgacgagtgcacggccatcctgaggaactgccacgccgctctgccggacggcggcaagctcgtggcctgcgagccggtggtgccggaggagacggacagcagcaccaggacgagggcgctgctggagaacgacatcttcgtcatgaccacctaccggacgcaggggagggagcgctccgaggaggagttccgccacctcggcgtcgacgccgcaggcttcaccgccttccgagccatctatctcgaccccttctatgctgtcctcgagtataccaagtgatctccactccatccgcccaaatctccttgcgagttgaatagcagaataacgaacagataaataaagctattccattcacgttggaatccgaatctctgcctactgtactcaacgttagcttctgtaaccaggatatctctttcaagcatttccaagcttttgatgacaaaatcataatttagagctcattattcaagcattatattcctaaa

SEQ ID NO: 4473 - DNA, 1328 bp, Zea mays
taagtcattatcactgactcactgttgcctttcaaactgttgtgcagttcattttgtttgtgacgctaagtattgtaaatgatgcatctgagaattatgtttactgtttgtacttcatctttttttttctttgttttgcctcctcaggtgattactttgtgtgagaggttagctgggcaagatgccaatgtaaccactgtacctgttgcagtcttgagatttactcgtcagttgacacggtgcttccaatggacaaatgatgtggctgacagactggcattttcagaggttaccatgttgtcccttctgttcagttacatgtgtccatgtaatggtaacttgtatcatagcttgtgaaactaatagaacatttctttaaaccaggtgctctcaagtgacacagttttctctgctccaatgaatgagacctaccagcttcttggggtggatgggaatgacatcctcagcttagagaagtatttacaagattattttaccaacattttgaagaagttaaaggatctcaaggcacaatccaagcaaactgatatattcttttgatataggaaggatttctgtgacctagggacataattacaaatctgtgtctcaaatgacagatgagtgagcacaatttttcctgtatatttgcatttttgcatgtgcaagaatgctctgtgctattagtgatgtgtatataatcttaacattttgagctatcaaagttccgaaatttgtgcaaaacagcataaagtctatggtttcacgacgtcaacttaaattatgctcaactcatggcctcatgggttctagcataactgatcaaaaagtaaagaaaagaaaagaaaaaagattagttttaaattgaatgaaacaagaataaaatttgttattaatgattcgttctataccataagaaataagcaacttttgttgattgttgatccattgaagaaggccttcccatgaactggaagagactggaacaatagcatgtttcaaatggcaaacacagaaccttactatttgatctcccctattttgcttcgttgtgattacttaagtgaagtgtaaaaaaagctatggggtccacattttcttttttctgttacctgtttgatgaattcatgtttgttaattgctcttgcgatggtccaatttgttcatagcaagaatcctaataatcattttgctcatcatttagagagattttgattgaatcttctcctttttgatacatgcgatataacctgttctcatggaattatttacaagaaacaaggtttctgttaggatctgtgatgtgttaactataagtttataccttg

SEQ ID NO: 4474 - DNA, 1407 bp, Zea mays
aaaaaccccccaagaaccccccgcggccgcccacgctaccacccgcccccgcccacgccatggcgtcgaccagcctcgccacgctgccgtcgcagctcgcctccccggtccgcctgcgccgccgcgccgcactctcctccgctagccgcccgcatttcctcctccatcgtgcaaccaaaggtggatcgcaatgcaggctggcggtgacctgcaacgcgcaggcggtggcgccgaccagctttgcgcaggggacgcccgtccggccgacgagcatactggtggtaggcgccacggggacgctggggaggcaggtggtcaggagggcgctggacgagggctacgacgttaggtgcctcgtcaggccgcgcccagcgcccgcagatttcctccgggactggggtgccaccgttgtcaatgccgaccttagcaagccggagaccatacctgcgacacttgttggtattcatgccgtcattgactgtgcgacaggacggccagaagagcccatccggacggtagactgggaaggaaaagttgctctaatacagtgtgcaaaggctatgggaattcaaaagtatgtgttctattccatccacaactgtgacaagcatcctgaggttcccttgatggaaatcaagtattgtactgagaaatttattcaggacagtggtctggattatatcatcatccgtttgtgtggtttcatgcagggtcttattgggcaatatgctgttcctatactagaagagaagtccgtctggggaactgatgctccaactcggattgcttacatggatacccaggacgtagctcgactaacgtttatagctatgcggaatgaaaaggccaacaagaaactcatgacctttgctggcccacgagcttggacaactcaagaggtgattactttgtgtgagaggttagctgggcaagatgccaatgtaaccactgtacctgttgcagtcttgagatttactcgtcagttgacacggtgcttccaatggacaaatgatgtggctgacagactggcattttcagaggtgctctcaagtgacacagttttctctgctccaatgaatgagacctaccagcttctcggggtggatgggaatgacatcctcagcttagagaagtatttacaagattattttaccaacattttgaagaagttaaaggatctcaaggcacaatccaagcaaactgatatattcttttgatataggaaggatttctgtgacctagggacataattacaaatctgtgtctcaaatgacagatgagtgagcacaattttttcctgtatatttgcatttttgcatgtgcaagaatgctctgtgctattagtgatgtgtatataatcttaacattttgagctatcaaagttccgaaatttgtgcgaaaattatt

SEQ ID NO: 4475 - DNA, 1407 bp, Zea mays
cacccacgtctttcttttttttctcccgacgatgggtcccataacagagcgggacatttgggaaaggcccacgacaacggcccgccccacctacttccaaacgaacaaaccctctcgaaaaccctctctcatattcaccccgccgccgcctcctcttccccttttcaacttcgtcgaaaccctaaccctcccggcgaagtcgccatgtcgaacccgaagggctccaagatgctccagttcatcaactaccgcatgcgggtgacgatccaggacggccgccagctcgtgggcaagttcatggcgttcgaccgccacatgaacctcgtcctcggcgactgcgaggagttccgccgcctcccgccctccaagtcctccaaggccaccggcgaacgcgaggagcgccgcacgctcggcctcctcctgctccgcggcgaggaggtcgtctccatgaccgtcgagggcccgccgccgcccgacgagtcgcgcgccaaggccgcggcggcgggcggagccctcgccggccctggcgtcggccgcgccgctgggcgcggcgtgcccaccggcccgctgctccaggcagctcctggtcttgctggccctgtgcggggcgtgggtggacccgcccccggcatgatgcagccccagatctcgcgcccgccgatgcccaacctgtcggcccagccggtgtcgtacccgcaggtcgtgcgcccgccgcaggggatgcctccgccaatgcgtcctggaatgccgccgcagatgccgatgcaattccgcccgcctggggcgccgcctgctccgttccctggggcaccgccacaacagtacatgaggggaccgccgccgatggggccgccccaggtgaggcccgggatgccggggccgccaccgcctggaatgaggcctggaatgcctccgccaccattcggacagccgaggccagggatgccgcctccgccacctggtccacagcagcctggacagaacccgccgcagtagcttcctggataagcttcttgcagatacacctatggaagatttttgtatctcgagagaggatcataatcgcacctggggaggacctgtgaattgcaccaaagcttcaccattctgtctcgcatcagggcagtagtttcctttgggtattgtgagggaggagaaccttgccagcgtgtgtaccactcatcctttgatgtgagaagggaccttgtacgtagagaggccaggacttgtattttaactgttggtgttggttatgttaggaaatatggataactggctgcagtcttgttgttacggtgttgattcatgctctgttgaagttgaagcccttgttttctctctctaaaaagtactttctgtgtttgctgacgaagcaagataattggtttagagagatttaaacagggg

SEQ ID NO: 4476 - DNA, 1406 bp, Zea mays
aggccggccgggacggacccatagcaaaaactgacattgcaaaaggcccacaagacaacgccccgctccttccgtccttcggcgcctccgcccaaacggacaaaccccatcgaaaaccctctctcaaattcacaaggccccgccgccgccgcctcgtcccccattcatcttcgccgaaaccctaaccctagtcgccgcggccacccttcccggcgacgccatgtcgaacccgaagggctccaagatgctccagttcatcaactaccgcatgcgggtgacgatccaggacgggcgccaacttgtgggcaagttcatggcgttcgaccgccacatgaacctcgtcctcggcgattgcgaggagtttcgccgcctcccgccctccaagtcctccaagactaccggtgaacgcgaagagcgccgcacgctcggcctcctcctcctccgcggcgaggaggtagtatccatgaccgtcgagggcccaccaccgcccgacgagtcccgcgccaaggccgcggcggcgggcggagccctcgccggccctggcatcggccgcgccgctgggcgcggtgtgcccaccggcccgctgctccaggcagctcctgggctcgctggtcctgtacgtggggttggtggacccgcccccggcatgatgcagccccagatctcgcggccgccgatgcccaacctgtcggcccagccggtgtcgtatccgcaggtcgtgcgcccgccgcaggggatgcctcccccaatgcgtcctggaatgccgccgcagatgcagatgccgttccgcccgcctggagcgccgcctgctccgttccctggggcaccgccacaacagttcatgaggggaccaccgccgatggggccgccacaagtgaggcccgggatgccggggccaccacctcctggaatgaggcctggaatgcctccgccaccattcggacagccgaggccagggatgccacctccgccacctggcccgcagcagcctggacagaacccgcctcagtagttccttacctggataagcttcttgcagatacacctatgggagatttttttgtatcgcgagaaaggatcataaatcacacctatggaagacgaagacctgtgaattgcaccaatgctttcaccattctgtctcatatcagggtatctagtgtgtaccactcatcctttgatgtgagaggggactttgtatgtaaagaggccaggactttaactgttggtattggttaagttaggaaatatggataacttatttcatcgttgtcttaattctggacccacccttttccgtgtgtgtcgatgaagcgaggtaattgacttgtagaaattactttctggtttcaaaaaaaaaaaaaaaatcttgtctctttgatttgtttgaaaaataatgtgcaatg

SEQ ID NO: 4477 - DNA, 4223 bp, Zea mays
  misc_feature (2725)..(2725): n is a, c, g, or t
ctttacaggctctcatgtatctcctgtcctcctcagaaattttgaagccaccattgtcgctgtagaaaccacagtgcacactaacagtctcattcacctgcagaagtatggaaacacattaaacatgtcagggaggcgcaactttgtgacatcaaaacagtacgcataagtaagccttacgaccttgaagctatcttctctttcagcaagtgtctgaaatcctgtaaacaggtcgaaccttgttgcttccgcatgttgcagtaaatatgtagagtttgcttcggagtggtatgtgtcatagtcatcgtcatcagttttgtacgtgattctgctcaccacagaatcgagtcttgtaccctccgggaacaccacatttgccaaacttttggggctaaggagcttcaagcaagctgtcaatatcaacgacacaaaaactaatcatggcactcttaacattcagttgtaagtgaagtcaaactaataaagaggctaaagactctagtatcaagccaggaaaagcttactgatctgtgatctgtcagaaacatcacacgaaagaagatctctggctaataaattagaaacgggcagaaaagcattttcacactcctattctgcctgatgtatcactggtttatcagcgtgcatggtctaaaatgttcagatcgatcgcccatggatatctaattagctgtgcaaaaacagaaatcagcaccgacaaaagtacggcatatcgccgtgcaatgcagcactcgcgttaccgacaagccacacaaccaattccttgttaaatttagtcgattaggtacaaaacctcctctacaatcggcaggggcacggggcagtaggaacagtttatgcgctagatcgaactagagtaggcgggggaactcacgctcgcgcacgccatggacgagacgtgtggtcgggtcgagccgtccgaggctggagaccggtggggaggggcccggggatgaggcgcggagccgcgacgcctcgaagaggaggagcgcgacggccgggaggagcaggagaacgggccaccaccgcgccaccagccgcaccgcccgctgccccaagctacgcgccaccgccttccgtcttccagcgcgcggccgccgtgacggtgccgccgcagcaccgtcgtcgtcggagacggtgatggagatgcttcggatcgtcgacgacggcatcgggaaggaagcggtggcgagcgagatggtggccgtggtgggtttgccattcagcggacgggtgggctcgtggcctgggaaaagagagagcccaaccaaggcggcccatctgcgacgcttcggcactgtcaagcatcccgcacaggcgcagcaccgcagtcatcggtgagtcggtgacatttgtcgctacagctgtttcaggcatatctgccacctcggtcacatgccgtccgccacgtcgagaccgcgagctccatacgtgtcacgcgcagccattcccgacgtctccggtgccgtgttttaaagaacgcgccgtagccccgcgcactgcagccgcccatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttcctccagtgcgccgtctatgactccgacaaagccgacgcgcgtctcatcggtgcgtgcaccgtgcaccccatcttactgtcatcttcaattgattctttggcatgtgctcacgcccaagaaggacactgcatctacatggatcttttcttttaactgcatgcaggcgtggagtacatcgtgtcgaggaagatcttcgactcgctgccggcggaggagcagcggctgtggcactcgcacgcgcacgagatcaagtcaggcctgtggacgagcccgcacgtggcggggctgctggagaaggcggagctggaccacatggccgccacgttcggcaagttctggtgcacctggcaggtggaccgcggcgaccgcctgccgctgggcgcccccgcgctcatggtgtccccgcaggccgaccccgccgcagccgtgcgccccgacctggtccggaagcgagacgacaggtacggcctctccacggaggagctccgcgccgctagggccgacgtcgaggcgcccgccgaggagcacccgggccaggccgactactggctccgccaccgcaagggcttcgcggtggacgtcgtgccgcacgagatgaagcgtcacgcgccgtttccgtgagccgtgaccaaccggtgttttacagtggcgcatgtgtaataaaaccaaacgatccagcaggcgtctccgtccgaactcgtgaatggcacgcgtttatttgtttttcagttcatgatgttcaaatcggcagtacgcatgtgttatggatgcgtgtgtattggatgaagtggatcggtgagaacagactttagcctcgcaggtgttaaactagaactgcaattacacccttcccaattacaagtgggattttctttcattttgaacctngaattgctaatcatgttgctcaaaacagcaatctgcatgacgaagcttgcacatctaacaaggttcacaaagagagattgccatagatagataaccacaaacgaatggatcaggatcacacttgctcttgctgcttctcgttctcggtggcgagcgtcttctcctgaggcttgtacttgtaccaacttgcccagaaaagatagttgaaaaggttgacggtgctaagcacggcgagcagccagaagaagaggtcgaggtggttgcggttgatgttctctccggcgagccatccgccgctcgccgttttcttcttggtggccttgttgacggccttcacgatgacggtgctcatgaagtagcccagcgacagggagcaccagaggaacgaggacgacatggacttgagcgcctgcggcgcctgcgagtagaagaactccatgaggccgacgtaggtgaacatgtctgcgatgccgaacacggcgaactgcggcgccagccagaagcaggacatgggcaggtgctggaacccggggatcatgtccagcatgccgtgcctctcggccaccttcttgcgctgcacctccacgacggcggccatgaccatggagacgatggagagcacgaggccgacgcccacgcgctgcaggtacgtgatccccgtggggatgcccgtcaggcggcgcgcgaagggcacgaacagctgctcgtagatggggacggcgaagatgaggaagacgagcgggatgatgggcatcgaggccaccggcatctggaaatgccgtcccagcgccgtgtccatcgtgctgccttgcaccatggagaaggtctgcagctgcgcgaggcaggtgcccatgatgatggcgctgcagaagatgggcaccatggccagcaccgtcttggcgtgctccacctgcgtcacccggcactgacgccacgggtccgccgccgcgtccttcgctgtctgaactatggccgctctgtccaggaatctgcatgagcacgcaatcagacagtaaccgtcgtcagtgccttccactgccagtccttcatatgagcatggtagtggtagtaagtgtctgtcgacctgaacggcctatccctgtgtgccacgaactccgtgtcaggcgaagctttgttcttgctgatctcgtacagctcgtctgggttctccgggagctgctgtttcctgttcctgactgcggcgacgtacacctggaagatctccttcagcgcactgcttccctggaccgtggcgatgcggtacctcggcaggccagcgatgaagacgatgacggcgagccccatgacgcccgtggcggcggcgaaccccttcgcccatcccttattctcctggatccacacgaacacggtgacgctgaaggcgccgccggtgcagaggctaagcagcaggtagttgaagcagctggacatctgcagcttctccctggggtgcttggcgtcgaactggtcagcgcagtgcgccggcagggccgccttg

SEQ ID NO: 4478 - DNA, 1928 bp, Zea mays
cccacgcgtccgcactcatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttcctccagtgcgccgtctatgactccgacaaagccgacgcgcgtctcatcggcgtggagtacatcgtgtcgaggaagatcttcgactcgctgccggcggaggagcagcggctgtggcactcgcacgcgcacgagatcaagtcaggcctgtggacgagcccgcacgtggcggggctgctggagaaggcggagctggaccacatggccgccacgttcggcaagttctggtgcacctggcaggtggaccgcggcgaccgcctgccgctgggcgcccccgcgctcatggtgtccccgcaggccgaccccgccgcagccgtgcgccccgacctggtccggaagcgagacgacaggtacggcctctccacggaggagctccgcgccgctagggccgacgtcgaggcgcccgccgaggagcacccgggccaggccgactactggctccgccaccgcaagggcttcgcggtggacgtcgtgccgcacgagatgaagcgtcacgcgccgtttccgtgagccgtgaccaaccggtgttttacagtggcgcatgtgtaataaaaccaaacgatccagcaggcgtctccgtccgaactcgtgaatggcacgcgtttatttgtttttcagttcatgatgttcaaatcggcagtacgcatgtgttatggatgcgtgtgtattggatgaagtggatcggtgagaacagactttagcctcgcaggtgttaaactagaactgcaattacacccttcccaattacaagtgggattttctttcattttgaacctcgaattgctaatcatgttgctcaaaacagcaatctgcatgacgaagcttgcacatctaacaaggttcacaaagagagattgccatagatagataaccacaaacgaatggatcaggatcacacttgctcttgctgcttctcgttctcggtggcgagcgtcttctcctgaggcttgtacttgtaccaacttgcccagaaaagatagttgaaaaggttgacggtgctaagcacggcgagcagccagaagaagaggtcgaggtggttgcggttgatgttctctccggcgagccatccgccgctcgccgttttcttcttggtggccttgttgacggccttcacgatgacggtgctcatgaagtagcccagcgacagggagcaccagaggaacgaggacgacatggacttgagcgcctgcggcgcctgcgagtagaagaactccatgaggccgacgtaggtgaacatgtcggcgatgccgaacacggcgaactgcggcgccagccagaagcaggacatgggcaggtgctggaacccggggatcatgtccagcatgccgtgcctctcggccaccttcttgcgctgcacctccacgacggcggccatgaccatggagacgatggagagcacgaggccgacgcccacgcgctgcaggtacgtgatccccgtggggatgcccgtcaggcggcgcgcgaagggcacgaacagctgctcgtagatggggacggcgaagatgaggaagacgagcgggatgatgggcatcgaggccaccggcatctggaaatgccgtcccagcgccgtgtccatcgtgctgccttgcaccatggagaaggtctgcag

SEQ ID NO: 4479 - DNA, 765 bp, Zea mays
cattgggtacctcgaggccggccgggacattgggacaggcctaacaacagtagcccaacacggcctgccactaactccgcccccgcgcgcggacggcgaggccgacgccgccggcgcactgtctctgccggagtgctggatatccgcccgctgctcctcagtcgaccctccgctcccgcccatgcctcgacccaagcccgccgctgccggtggcggctggctttcagggtgggggtgggacctcatgctcggatcgattgccgcgttctacgccgtcatggcgccctacaccaaggtggaggagagcttcaacgtgcaggccatacatgatattctttatcacacttatcacatcgagaagtatgatcatttggaatttcctggagttgttcctcgaacgtttataggagcatttgttatctctattctctcatcacccacagtctttgtattgcgtttacttcgtgttccaaagttctatagtcttcttacagttcgattaacattgagttgtgtcactttgatgagtttgagacttctcagagttcaggtaaaaaagaagtttggccatcaagcagaagcattctttgtggtactaactgctatccagtttcacttgctgttctactcaagccgtccgcttccaaatatctttgctttagctttagtcaacttggcatactctttctggttcaagggaagctacctatgtacattacgggctctgattggtgcaacagttggttttagatgtgatatgattct

SEQ ID NO: 4480 - DNA, 3588 bp, Zea mays
  misc_feature (1961)..(1961): n is a, c, g, or t
ccggccgggaatctctctcaaaccaaactggacgcaattcagcacaaacccaacttccaccagacccctaaccttttcgcagctccaggctccagcgcacagccgccgccgtttcttcatcttcttcgcagagccggcgctccatcttcggctccctcccttacttgcgctcggcacgcaggcggcggcggcggcgctgtggctcgggatctcagtgacggcatcagcggcttcccctcccgcctctcgccagtcgcctccggtcctccgcacaccggccggtgatctctctcctcccgcctccggtggatcgtcaacgacgcccggccccggcggctgcgccgcgcgcgtcctgagggcagctgcaggcgctgctccaccaaggcggtcgcgcccccgtgggcgcccggtgatctctctctctctctctctctcttagtgccgctctttggaaccctggctactgctgttaaatggctcaaccttcagtcattctagcaactgcaagttatgatcacacaatcagattttgggaagccaagagcggtcgctgttaccgcactattcagtatccagactctcaagttaatcgccttgagataacccctgacaagcggttcttagctgctgctggcaatcctcatatccgcctttttgacgtcaactcaaatagccctcagccggtaattagctatgattcacatactagcaatgtgatggctgtgggatttcattgtgatggtaactggatgtactcaggctctgaagatggtactgttagaatttgggatttacggactggcacttgccaacgagaatatgaaagtcgtgctgcagttaacactgtagttctgcacccaaatcagaaagagctaatatctggtgatcagaatggaaacatacgtgtatgggatttggctgctaactcatgcagctgtgagttggtgccagaagttgatactgctgtaagatctctgacagtcatgtgggatgggagtatggtggttgctgcaaataaccgtgggacatgttacgtttggcgcctgcttaagggtactcagacaattacctgcttcgaacctctgcacaaactgcaagcccatgatggctacattctgaagtgcctgctttcacccgaattttgcgatccaaacaggtatcttgccacagcatcatctgaccgcactgtaaagatttggaatgtcgatggcttcaagttggaaagaactttagtcggccatcagcgttgggtttgggactgtgtcttctccgtcgatggtgcttatctgataacagcatcttctgacactacagcgaggctatggacgatgtcgactggagaggccatcagggtgtaccagggtcatcacaaggccaccgtgtgctgtgctctccatgatggagcagaatcagcgccctcataagcatgttgtgactgcttttctgtacatacgttagattgcagaactctttcactcttgtaaacttgagacctagcaagttgttaacgcaagcctctggggttgcgtacaaataatttgcgtgctgttggtggatgtttaaacctgctatgttttatggtgtgaatgctataaaaagacaacatgttcgttcaatagttaaagggtggtttgagcaaaaaaaaaaaaaaaattctcgcgggccgcccctttttaaggattcatcaccttattcctcatagttagcatagttaattagttagcactatatgaggaatggcctaactaaatttgagaaatatgcctataatgcgccatcttattttggattgagtgattcatcaaatcaaacattccctaaatatattggattggatttatgatcatacatgagatgagtttggaatgataatatacgtgatagactagctagaaggaaatcaaatcaattgaagaaattattgttcaacctcgtttgagatatttcggacatgtctagcngagaccagaacgtaagagatataccaaaaaaaaaatcagcctttctaaaatgccgcaatggttatgcgttgaattttgtgccacttctttttccactgagattaagcaggagaattccagcgacaaatgcaattccattccatggtgcacgatccaaaatgccctcaaactacgatgctagctgcgcacaagggcacagggagagccagagattatctgcgcaacgtgccggccgccggccgggtcacggggacggggtgcttccgtggttgtgcaacgggttcgccccacaaggtgccgtccgcaactccggcctgacgacgacgctcacgctccccgccgccaccgccggtagggcgcgctcctgcctgtgcctggtggtactgccgcggtggtgcagcgggttcgcgccttcaggcaccgtccgcagctcaggcgtgacgacgacgccacctgccgtcggcggacgcggtgaccacgacggcgtcgccttcttcttcacatgcacacagagatcacaaaatcttcactcgtagtacgtacaagaaaggcatacatatattttattttctacattaaaaaaccaacagaacgtgaaagggtgaaagtgtaacggtgatacctctacggcatcggagtgtgggtgtggctcggagaacagtggacgatggtcgccgccggtgtcaggacggccctgcgccgccggcaggagcagcgcaaggcagcagcagcagcacgccgccgcaaggcacagcgagaaccgggacatggcttggcttggacggagtcacggaggacgacgaaccaaagccaccgatcttgagacctgtgctcctggtagcagagacctatatatacagacgcgatgccgcggacagattggtttttgctaccgaattgggcttgacaaagatttggaaagcaagcgaaagttaccaaaaaaaaaaatttgacaagcaaacatcagaacgttggtaaggttttttggcaataaacaacaaaccagattacagagatgcgaatgcatacatgcatgcaaagagcccaagtcgatctcccgttgccgcccgtcgttcgccttctcgatctccggctccctctactacctttttgatttcggtattcgaaatttcgccaccctaaaaaaatgccagaagatgtccggttgaaatttcactggttttggctgctcctagctcaatgtcaggctgagcaacagagatagttataatctaggaggccttaatatactagcgtataattcgtatccttatatgctcccacatatggaagtaaggtataatctaggaggccttaatatactagcgtataattcgtactaacgctacgattccggaaaggacagggtcgacggcggcaacaacacaagttagggggaggggatattgggtcgcgagggagggggagggaggtcgcggggagggatgagagatgatgcaaataatattgtccattgaatatttgagtaagggagatatagttatcctgcaatctgaaccattggttttaatgatgtgttaagtctgggtgtaatttattcggtggatttagtagatgttatgggtgtgtggtgatttggttggttcaattttgcaaagtttaaatt

SEQ ID NO: 4481 - DNA, 1624 bp, Zea mays
cctcgaggccggccgggaaaaaaattacaaaaaactggacgcaattcagcacaaacccaacttccaccagacccctaaccttttcgcagctccaggctccagcgcacagccgccgccgtttcttcatcttcttcgcagagccggcgctccatcttcggctccctcccttacttgcgctcggcacgcaggcggcggcggcggcgctgtggctcgggatctcagtgacggcatcagcggcttcccctcccgcctctcgccagtcgcctccggtcctccgcacaccggccggtgatctctctcctcccgcctccggtggatcgtcaacgacgcccggccccggcggctgcgccgcgcgcgtcctgagggcagctgcaggcgctgctccaccaaggcggtcgcgccgctttgggagcggtttatgcccccaaagtgaagcgtgctcttagtgccgctctttggaaccctggctactgctgttaaatggctcaaccttcagtcattctagcaactgcaagttatgatcacacaatcagattttgggaagccaagagcggtcgctgttaccgcactattcagtatccagactctcaagttaatcgccttgagataacccctgacaagcggttcttagctgctgctggcaatcctcatatccgcctttttgacgtcaactcaaatagccctcagccggtaattagctatgattcacatactagcaatgtgatggctgtgggatttcattgtgatggtaactggatgtactcaggctctgaagatggtactgttagaatttgggatttacggactggcacttgccaacgagaatatgaaagtcgtgctgcagttaacactgtagttctgcacccaaatcagaaagagctaatatctggtgatcagaatggaaacatacgtgtatgggatttggctgctaactcatgcagctgtgagttggtgccagaagttgatactgctgtaagatctctgacagtcatgtgggatgggagtatggtggttgctgcaaataaccgtgggacatgttacgtttggcgcctgcttaagggtactcagacaattacctgcttcgaacctctgcacaaactgcaagcccatgatggctacattctgaagtgcctgctttcacccgaattttgcgatccaaacaggtatcttgccacagcatcatctgaccgcactgtaaagatttggaatgtcgatggcttcaagttggaaagaactttagtcggccatcagcgttgggtttgggactgtgtcttctccgtcgatggtgcttatctgataacagcatcttctgacactacagcgaggctatggacgatgtcgactggagaggccatcagggtgtaccagggtcatcacaaggccaccgtgtgctgtgctctccatgatggagcagaatcagcgccctcataagcatgttgtgactgcttttctgtacatacgttagattgcagaactctttcactcttgtaaacttgagacctagcaagttgttaacgcaagcctctggggttgcgtacaaataatttgcgtgctgttggtggatgtttaaacctgctatgttttatggtgtgaatgctataaaaagacaacatgttcgttcaat

SEQ ID NO: 4482 - DNA, 898 bp, Zea mays
tcacgtagagctcggaatcggtcgactcgagcccaacttccaccagacccctaaccttttcgcagctccagcgcacagccgccgccgtttcttcatcttcttcgcagagccggcgctccatcttcggctccctcccttacttgcgctcggcacgcgggcggcgctgtggctcgggatctcagtgacggcatcaagggcttcccctcccgcctctcgccagtcgcctccggtcctccgcacaccggccggtgatctctctcctcccgcctccggtggatcgtcaacggcgcccggccccggcggctgcgtcgcgcgcgtcctgagggcagctgcaggcgctgctcgaccaaggcggtcgcgccgctttgggagcggtttatgccccaaagtgaagcgtgctcttagtgccgctctttggaaccctggctactgctgttaaatggctcaaccttcagtcattctagcaactgcaagttatgatcacacaatcagattttgggaagccaagagcggtcgctgttaccgcactattcagtatccagactctcaagttaatcgccttgagataacccctgacaagcggttcttagctgctgctggcaatcctcatatccgcctttttgacgtcaactcaaatagccctcagccggtaattagctatgattcacatactagcaatgtgatggctgtgggatttcattgtgatggtaactggatgtactcaggctctgaagatggtactgttagaatttgggatttacggactggcacttgccaacgagaatatgaaagtcgtgctgcagttaacactgtagttctgcacccaaatcagaaagagctaatatctggtgatcagaatggaaacatacgtgtatgggatttggctgctaactcatgc

SEQ ID NO: 4483 - DNA, 2701 bp, Zea mays
gacggcagtcggcagccaaatccgctttatcatgtcgagaattgtttctcatccagagatccacgcgtgctgccgagccggggtctgctcagcctgtaagcgtcagcgtgttccagttccagcttctatttttgctccaaacaagtcgtgctccactagggatcctatccagattcgtggggacacccccgtccagttccagccttccaacttccaaccctctcctctccgcaggctgtagcatttgtcgggttggattgggttgttccgcttgggtagcctggtgggatcgaaatctgtgtgggatccatggcggcggtcgaggggacgacgaagaagaaggtaatcatcgacaccgaccccggaattgacgacgcgatggccatcttcgtggcactgcggtcgccggagctggaggtgctgggcctcaccactaccttcggcaacgtccacaccgccctcgccacgcgcaatgcgctccacctgttggaggctgttggaaggactgacatccccgtcgcagagggatcccatgtaacaatcaagaaagccaccaagctgaggatcgcaagctttgtccacggttctgacggcctgggaaaccaggatttccctccaccggctaccaagcctatagatcagtcggctgctgccttcctagttgagcaagcaaatctgtaccctggacaagttaccattgtcgccctcggtccactaaccaaccttgctctggcagtggagcttgacccttcgttcccgaagaagatagggcagattattattcttggaggtgcgtattcagttaatggaaatgtgaaccctgcagctgaggcaaatatctttggggatcctgatgcggcagatattgtgttcacctgcggtgctgatattttggccgtgggactaaatgtaacccaccaagtagttctaaccgatgctgacagggagaagcttgaacagtgtgatagcaaatatgcccgctacttatgcaagataatgggcatttattttgattaccacaaggatgcctacttcattaaaggagtgtatcttcatgatccaacaacggttattgctgctgtgaatccatcgctgctgacttacacagaaggtgttgtgagggtacagacggttggaatcacaaagggccttactgtttttgataacaccaagaaaaggtacggagagatcacagcctggagtggcatgcccaccgtgaaggttgctgtcaccgtcgatgcccctgccgtggtagagctgatgatgcagaggttgatgactgatgactagcagcaataccagttaattggcagcgccaccattaagacaatttccagttcttaagggagaaacaaatgttggaacatggaagtgcatttgttgttcaccagaaatttggtcgtcttgtcatcaaaacaccagaattgcattattgcacgctagatactcatttctttggttgttatgtgcgtgcttggtgtttatgtacagttttatgtgcttgataatgggcacatgaccagttcgacaatgtcatacagttatactatactagtacattgcttatgcttgtgagagaacagaattaagttaaatgaagagccacctgatgccagaaattggtccgccaaaaaaaaaaaaaaaaaaccgcccggccggaaaatacagggtcctagtaaatgtaactttatattatactccctctgctttctttacatgttatattagttttgttctaaactaaacatttctacttatttttttttaaaaaatcgtatagatcaacaacataatatttatatttatagattcactataaaaaatatttttgtaatatgtagttcacatgatttattataattattggccaaagttaggaatgtagaattattgtacaaacatatggagtggctcaaaaaattgtaagtgctacacatacatgacttaatatataatttactgatttttaaaacattctggtcccgtagctcagttggttagagcgttggtcttatgagccgaaggttgcgggttcgagccccgccgggaccatattttttattatttttggtttaatttattcgttattttgtcagttgagatagatgtttttttggtctgtacacccacaagctgtgctaaatttgtttattgcaattttttgctaaatttaatttggtgtatattctgtttttttttgtttctgtccagtgtcaactcacatgctgccctaaaattgttgtttgtcctttgtcaactcacaagatatatattttttatttgggtctgttcgctcacaaactggagtagtcaaggcaagccagataagttcggaaactgttgtaaaggggtcgaaaatctcttctcctcttttagggttgataggatagtttctaaacattcttaatttaagctcaattagacttcgtttgaatggatttcgccatctggtagttggatagagtctatcgaagtaggccaggttcacctagcaacccgaatatgccaacctccaaggtaggccaggtttgcatcacgagtcacgactttgttgggtttgtctgtttaggatccaaagccatccatgctgactcctgatcttggttaggccaactttcatatgtttgtgtctttggaaggtgtttttgagttctgtgtgtttgcttttcgatccgtttgttttggtggcatactaagttac

SEQ ID NO: 4484 - DNA, 1586 bp, Zea mays
gagatggtctaacgtgatgtcatagggtgattgtcttctgttctgtctggcagttttttttttttgagaatccgattagcgatcaaggctagaattgtttatcgctcgcgggcgggaagtgtggtgacgcgtctcgatccgcgcaccgcttgggcttctcgccggccggctgctcagcccgtcaccgccaccgtatgttcttgttccagttcctatttttactccaagtccactagggatcctatccagattcgtggggacaccctcttcgagttccaggcttccaaggtccaaccttctcctctgaggccgtagcatttgtctggttggattgggttgttccgcttgggtagccgggtgggatcgaaatctgtgtggcacccatatggcggcggtcgaggggacgaagaagaaggtaatcatcgacaccgaccccggaattgatgacgcgatggccatcttcctggcgctgcggtcgccggagctggaggtgctgggcctcaccactaccttcggcaacgtacacaccgcccttgccacgcgcaacgcgctccacctgctggaggctgttggcaggactgacatccccgtggcagagggatcccatgtaacgatcaagaaagccaccaagctgaggatcgcaagcttcgtccacggttcagacggcctgggaaaccaggacttccctccaccagctaccaagcctgtagatcagtctgctgctgccttcctggttgagcaggcaaatctgtaccctggtcaagttagcgttgtcgccctcggcccacttaccaaccttgctctggcagtcgagcttgaccctgcgttcccggagaagatagggcagattattattcttggcggtgcgtattcagttaatggaaacgtgaaccctgcagctgaggcgaatatctttggggatcccgacgctgcagatatcgtgttcacctgcggcgctgatattttggccgtgggactaaatgtaacccaccaagtggttctaaccgatgctgaccgggaaaagcttgagcagtgtgacagcaaatacgcccgctacttgtgcaagctaatgggcgtttattttgattaccacagggacggttacttcataaaaggagcgtatcttcacgatccaacgacggttattgctgcggtgaacccatcgctgctgacttacacagaaggcgttgtgagggtacagacagtcgggatcaccaagggccttactgttttcgacaacaccaagaaaaggtacggagagatcacagcctggagtggcatgcccaccgtgaaggtcgctgtcaccgtcgatgcccctgccgtggtagagctgatagtgcagaggctgatgaccgatgactagcaacaacgccaccagctgatccggccgcgttgtcattagaacacgagaatgcattgcgttgcattgcatgtggttatgtgcgtgcttggtgtttacgtacagtttatatatatatgcttgatacgtttgctgatgcttctgagagaacatgattaaattaaattaaacttgattaaatgaaattgcccacctgatgatgccattaaaaaaaaaaaaaaaaaaa

SEQ ID NO: 4485 - DNA, 1517 bp, Zea mays
atccagcgcggctccactcaaagcttgagccttccttttcttttcttgtttttgttttattttcttggtaggggggagtcgtcttctccatctctccttagcctaggagaaggagagatccagaggcaaaagcttcagggtttgtacaaattctagatctaaccggactaaccagaaaacaaaacaaaaaaagacgaaagcatgagccacttcgccgccgccatgaagagcccccttgcggtcgccgtcgcagcgcccgccgccgccgccgacgccaagagcccgctcttctgccccaagccgcggcgccccgcggcgccgctgcggtgccaccagagcggcggcttctccgacgccggcacggatctgctcgacctcctcctctcgaagggcgacgagagcggcctgtcgtcggcgtccccgcagccgccgctgttctgcggctcgccgccgcggcgagcgtcgaaccccgtggtccacgacagcaggttcggcgcggactgcccgcccatgcccgtgccgggactgcccgtgcaccggcccagcccgcgcccgtcggctggcggcgccgtccatgtcgccgcgagggtgcgcccgcgcgcggttcgcgttccagcccgccgcggtccgcgtcgagggttttgactgcctcgaccgcggccgcggcggccgtggccatggcatcaccgccatggcctagactgtgcacatacaacagccagcaccctgagaccctcctcccccgcccctccatccatggcacgcaagagccaggagcacctggttggaggtagaagaagagggggggggggggggggggctgttaggggaggaattgagagggatcggtttgtcctaaatcttaacccccctaaaaagtaaaaaaaaactagtacttttatataaacccgtcccatcctcccatccccaacaattacagcgagtttaggtaattttatcacagatccttttttgtatgtaaataaagttcgaggttcagaaattatgtagaaaaaatgtagaggggaggaggagcagggacaaaagggcttacaaaaagcagagaagggatgattaatcagagtttcctctctcatgtgtcactgcccctcctctctggaaggattaattagccattgggtttggtgggagggagttcgggaatagttaggtagtatgtcctagttcgtcaattaatgatgctttcttttttgttttttgatggggaattgttttttctttgttgtccgtccgtccatccatgcaaccaagaaatttcatggagaatctgtacaaaagagtggctagctattacgagagtccggtctgagagaagcaacacgagagaagtcagtggatgagcttagagaaagacattcacacgctgcgagggttgataatttgtgatattttcctctttttttcttcctgattttgtatattgtaatatcctgcttgattttccaatgaatgaatcaatcaaccaaaaaaaaaaaaaaaaaaaaaaaaggccccta

SEQ ID NO: 4486 - DNA, 3176 bp, Zea mays
cttcgttctctccctgctgctctgctcctgccgcctggctgccgtgccgccgctgatccctctctcccccctcaaagccccaattgccgggtgctcctcttccacccccattgccgactgcttcccgccagagagtggggaagggaaggggggggaagggagatggcttcttggatagggagtgggtaagaatcacacgatgcagttacctccacctttctctcttctccttttgcgggcatattcttcacctccgcctgcctagatccttctttcttcggcccggcttagcttccagtctcaccaacagttctgacctcggagcatctatcaatcgggccactctctggtaaggcaaccagccacgccacggcacccctttttgttcgagaatctgcttgcccgcgtcgccgtcgtggctttgttcctcctcgcgactgattcgtcggcctgagtcatctctttttgtctaattggtctcagcgcccgttccatcgggttttgatgcaagagtggaggagttggtaggttgttgtgactggttgttggagagctggagccagattgaggagaatttcagccaattttagcggaaccgtaaaacccatctggagaatttttcctgcgcctcctacggttaggagctgtggctggacagtgcctgcctacgctctggagttttagtgcagttttacaagttttcagtcaattttgatcaagctcaggggaagtaccaatttgggagtgctagctgctgctgcagcagcagctgcgggttccttggtggcagatgggttgctccaactctaaagtggacaatgaggagcctgtgaggcgctccaaggacaggaggcagctcatgaagcagctggtgcgccgccgccctgagcttgcagctgtgcacattgcgtacctgcacgccctccgtaacacaggagccactctccggcaatttgtggagctggagtctgcattgtcacagcagcctcccgtagaccttgtggtgccgccctcgcctactccacagcctcctcctcctcctcctcctgaactctcggtgacatcctcattgccaccctcgccatgccccccgccgcctgtcccttttagtccagtaacaaccataagaaagatggagaagagggatggtgagctcccaccaccaccaccacctctggttttgagtccgataagattaaggaagatggaggatgagttccatgggggtgattttactgatgatgacgacactgacagctgctcgactcctctaccaccacccctgccacccggcatagattgggaggacttggatccctacaatgtgtgccccttgagtttcccatctccatttgctgataggaatgataaagaagtggcctcgcatgtgaccatggacaatgatcctgaagtagacacagaattttatggagaggaggatgaaagcatgcttggcaataatgatgtcattgtggatagggtccatgtgaatccagccaagggtagggctctgggtgatggcaactcttcaacggtgagctgggtgacaaaggattcagactctatggcggtgccttggaggagtaagaagtcgcttgtagagattgttaaggagattgatgagtacttcttgaaagcagcagcaagtgggaatgacgttgtgatttttttggactctgctggtggacggcctgatgccttagaggtagaggcaaagaaaggtgcaggaaaaaattctaaacctgcgaaggttttctccacgctttcttggagctggtcttttaaatctcagcaggctagcagagaagcctcagttctgaattctagtgcttctggatatggttaccatggcaagacactggagaagctttatgacgaggaacaaaaactctacaagttaatcaaggatgaagaatttgcaaggctccagtataagaaacatgtctcagtgctacaaaagctggaatcaggagggcatgatagactgcatgccgaaagacttcgggattctattgaagaactgcaaactcggataatctcattggaagaagctgtgagtttggcatgtttttccatatcaaatctcagagacgaggaattatatcctcagatcattgaattatctgcagggcttgtgcatatgtggaaaaacatgcacgagtgccatcaggtccagaaccatattgcccagcaagttagtctccttggcaacagacctgggagtgaaccaacaagtgacactcatcgccaggcaacatctcagctggaaattgaggtgtctggatggcacactgccttctgcaatcttatcacatcgcagcgtgaatacgttagcatccttagccaatggattggtctcacagactgccttccggatgatggtggcttaatgagaagttcatctggaatccttagcctctctgaggaactccagcgtgctcttgacaggctaccagagaaggtagcagctgaagcgataaagacctttatgtcagtcatacactctatagttgtacagcaaagtgaagagcgccaactaaagaagaagtcagataacatggatagcaagttccagacccagttagagaaacacagtgaaaatacaatgcaaaactcggcccagcctccaaataagaataactattcagcatcaaagaatggaacgaaactggatgcatttataaagcaggtcgaggaggagaaagccagatacctaacctctgtgagggtaagccgagccatgacactgaacagtctgcagacaagccttcgaaatgtgttccatgctctggagggattctcaggagtgtgcgtacaggcatttgaaggtatcagcagatgcagtgaagttgctgttattcactcgggagcagcttcacctgctatttcctcgtgaccttgcttcaatgactgtgattattcattgtaagtaggcaaaggataaactggttccacgtgaatacccttcgcttctaattttcagaactttgaatagctttcgggggattatgtgaagtcaatataggcataatagtcttgaatacatcacaatgtctcaacttacattttggttcttattgcatgggatgtactgctctgtacataatcatttacattttgaccgaaccagtatttttctcccttcacattatatctatacataattgttttgattc

SEQ ID NO: 4487 - DNA, 4146 bp, Zea mays
  misc_feature (2859)..(2859): n is a, c, g, or t
ctccccactagcactttagcaagtttagggtgcagcgctgcagggtttaacggagcactgtaacctctacagttgctacagttttagggtagggtacacaaaaatcaaggggatcctttggtgcgccccttgttacggaggtacagagctcccccactagcactttagcaagtttagggtgcagcgctgcggggtttagttgagcaaccccctccccttgctagtggctacagctccctccccctggcccgcagcgctaccccctacgcgtcgaccctcttctctctccccctcaattcagtggttcactgttcatcccctccaacactatgttgtgggtacacgagtaattgttagtagatgaaaaattgatagtagatgaaaaatacgtatagaaaatgatattttatagttgtagtggggtatagggagagtatttagggggaaccactgcgagagatgaaaaaatagaggataactgttgatgatgtgactaaaaagtgatataggggaagaaatttagaaggaaccgctgcggatagtcttaaggctgcctccatatgcccctcaccttgcactgtgtatgcgtacgggtctctacgtgggcagcgactgtctccaaatggccccctacgcgctgcagcgcaaggggaggcaacgcccgtccctagatcaagggaagcactgtagcaccccttacacaatgctctcttatttaatagttgaaaaatagtaataaaagatgaataatgttaggtaataatattttatagttgtagtggggtatagtgggggaatataaggaaaccgctgcggaagataaaaaagtatgagataaaatgttgatgatgtgacgcaaaaaagtgatatagggggaaaaatttagagggaaccgctgcggatagcctaagccgtggagtgccgccagtggcagcggtggaaactggcagctctgaccacatccaatccaactgcccttgctgcacaaccgaatcccacgccttctcttccttttcccttgctctctccagcccctgctgctcctgccgggcgctgcctgccgccgctgaccgcccccgctctctctctctctctctctctctctctctctctctctctcgtcccccaatcaccccaattgcccggtccgccgcttcctgtcacccccatgttgactgctgcccgccaggccgccagagagggaggattaggaaaggggggaaagagagacggacggcttctcgcgagtgggtaagactcacatgatgcaattacctccatctttccctcttctccttttgcgggcatactcttctcctccgcctggctagatccttctttcctcgtcccggattagctcccaatctcgccaatggtccaggttgctggccgtggaacatttcttcagttgggcccactctctgtgccggttccatcgggttttgacgcaagagtagaggacttggaacccgtaaaacccatccggagaattttccctgcgcgtcccatgattaggagctgcggctggacagtgccctacgctctggagttttagtgcgaatcgttgccagtttcagtcaacttttgatggagcccaggtgttgagcgccaatttgggagttccagctgacgctgcagtctgcattcttctaaggccatcagtgaggaattttcgttccttggtggcagatgggttcctccagctctaaagtggacaatgaggagcccgtgaggcgctccaaggacaggaggcggctcatgaagcagctggtgcgccgccgcccagagcttgcagctgcgcacattgcatacctgcacgccctccgcaacacaggagccactctccggcaatttgtggagctggagtctgctttgtcacagcagcctccggtaggccttgcggcgccgccctcgcctactccacagtcgctgccgcagccgcagccgcagccgcagcccccgccacctcctgaaccctcactgccaccctcgccacaccccccgccgcctctgccttttagtccagtaaccaccataagaaagatggagaagagggatggtgaattcccaccaccaccaccacctctggttttgagtccaataagattaagaaaaagggatgatgagatccatgtgggtgattttaccgatgatgacgatgacactgacagctgctcaactcctctaccaccacccctgccacccggtatagattgggaggacttggatccttacaacgttcgccccttgagtttcccatctccatttgctgacaggaacgatgaagaggtggcctcgcaggttgccatggacaatggtcctgaggtacacacagaatttgatggagaggaggatgaaagtgtgcttggcattgtggatagggtccatgtgaatccagccaagagtagggctctgggtgatggcaactcttcaactgtgagccaggtaacaaaggattcagactctgtggcagtgccttggaggagtatgaagtcacttgtagagattgttaaggagattgacgagtacttcttgaaagcagcagcaagtggtaatgacgttgtgattcttttggactctgctggtgggcggcctgatgccttagagatggaggcaaacaaaggcgcaggaaagaaatccaaatcagcgaaggttttctccacgctttcttggagctggtcttttaaatctcagcaggctaacagtgaatccacagttctgaattctagtgcttctggatatggttaccatggcaagacactagagaagctttatgaagaggagcaaaaactctacaagttaatcaaggatgaagaatttgcaaggctccagtataagaaacatgtctcagtgctacanaaagctagaatcaggggagcatgatagactgcatgcagaaagagttcgggatgctattgaagaactgcaaactcggataatctcattggaggaagctgtgagtttagcatgtttttccatatcaaatctcagagacgaggaattatatcctcagattattgaattatctgcagggcttgtgcatatgtgggaaaacatgcacgagtgccatcaggtccagaaccacattgcccagcaacttagtctcattggcaacagacctgggagtgaaccaacaagtgacattcattaccaggcaacatctcagctggaaattgaggtgtctggatggcacactgccttctgcaatctcatcacgttacagcgtgaatacattagcatccttaaccaatggattagtctcacagactgccttccagatgatggtggcttaatgaggagttcatctggaatccgtagcctctccaaggaactccagcatgctcttgacaggctaccggagaaggtagcagctgaagcaataaagacctttatgtcaatcatacactctatagttgtacagcagagtgaagagcgccaactaaagaagaagtcagataatatggatagcaagttccagacccagttagagaaacacagtgataattcaattcaaaactcggcacagcctccaaataagaatcactattcagtatcaaagaatgaaacgaaactggatgcatttagaaagaaggtcgaggaggagaaggccagatacctaacctctgttagggaaagccgagccatgacactgaacaatctgcagacagcccttccaaatgtgttccatgctctggagggattctcaggagtgtgcgtgcaggcatttgaaggtatcagctgatgcagtgaagttgctgttattcactcgggagcggcttcatctgctatttgctcgtgacattgctacgatggctgtgattattcattgtaagtaggcgaagtataaactggttccacgtgaatacccttttcttctaattttcagaactttgaatagttttcggaggattttatgaagtcaatataggcataatagtcttgaatagatcacaatgtctcaactctcaatttgagaagagatgtgaagtatcataaaacatatgtggctttaaattatggaaaggattcatgcagacttcaactgcacgttctcatggtatgatgatgctaatcatctcaaaaaaattccaatgtatttgttcaaaaaaaattgtcaagcaacccgcctggggcgcccggtcccct

SEQ ID NO: 4488 - DNA, 2652 bp, Zea mays
  misc_feature (2389)..(2389): n is a, c, g, or t
ttacgtggtgtgttggggggccacaaccaaacacagttgttgtgcccccgatcagggcatgtgagagaggtccggctcggtccactgactgagtctggatgagatcaacccaatacacacatgactctgatggcagttaggtgaagggcaagcagatggtttggcctttcctgcatcatagttcatatgagaatactagaacttattatttttttggatgccacattatgaggtattttgcacatctttttgagtttgaggagccaagtagctattttgaagttgaggctccatttaacaagcttcttctggagataaggtggcttgagaccttggattatcttgtttggagcctatccctgcatggaaaataaggtggaatccttttcgaataaagaggaaagttatctttccacctcatccatgtgtcctaccctcaattttttttgcttttgtttgctttttcaaataaatctggtgccagcaatcactaatcagttccctctatgtgctaaacttgatagtctttagttatgcactcataagtgttaatgacacacaaatcatgtgaattttgtaatcaaaccaagtgctagttagcaagccatacagtgggatggcacctcctgggcaggctgggagatgattaagttccatctaggtaagttttcctatcactttaacctgtacaggaaacatgcattttttttcttagtgctagaagcatatatactagagtagacaaatgaatatggttccgttttgtggttctataaagaatacttccatagttgattgtcgaatttatttgtgttcccgcccatccatcagtgtcaaaatggacatactttgtgttcgacatgcaaggccagggtgcacaaccggtgccctacatgcagacaagagcttggtgatatcaggtgcttagcattggaaaaagtagcagagtcacttgagcttccatgtaagtactgctctttaggttgcccagagatcttcccgtactacagcaagataaagcatgaagcacagtgcagcttcaggccatataactgcccctatgctggctctgaatgtgctgtggctggtgatattccattccttgttgcacatttgagggatgatcacaaagttgatatgcacagtggctgcacgttcaaccatagatacgtcaagtccaacccgcgcgagctcggaaacgccccctggatgcttacggtaagattcgactagttctgaattattccttatctgctactccatctgtttttaaatgtaaaatgtatgaactaattacttgtcctaaacatcatcatatatttaaaagtggagagatctattttctattgctggtcttatgatccatggttaacaagtaaaatgtgtattctcaaataacttgtcggttcaggtattccattgttttgggcagtacttctgcctgcacttcgaggcattccagctcggaatggctccagtctacatggctttcctccggttcatgggtgatgagaatgatgcgaggaactacacatatagcctagaggttggtggtaacgggaggaagatggtgtgggaaggtactcctagaagcatccgtgacagccaccgcaaggtccgtgacagccatgatggcctcatcatccagaggaacatggcgctgttcttctcgggcggtgacaggaaggagctgaagctgagggtgactgggcggatctggaaggagcagaccaacccggacggggcctgcattcctaacctttgcagctgagcaagggagacgtttggaaagcaaaaaagaaagaaaatacggtgctgtttggctggcttgtctcaaaattgccacgttatgctttcatcatagtgtctgccgttgaaatgttgtagtagtaaaatcgtagggtgtaaaatgttttcttgtaaagtcattgtgtataccaaccaaattcaagaaagcttacaagttggcccataaatgcatgtgctacgttcttgtgtagtttgagttctgttatcaaggtattgggctcaggaaatgctcagtgttcatgtttatttgatagactattagtgttatcgcgaagaaaatgggaccaacgaattaactggatccattttctagaatggttgtggcaactatagcaaatttctatcgccaatcaactatgcttgttgatgagaaaaggtaagttttttcacacttagtcaattaaattatatgctaattatgttttttctaagttgtagggaagccctcaaacaaagctaaaaaggtttggaagagctcaaaagagccaaacttggtctagtctggaccgcaccggaccagttcagtggtccatgtgtcctggccgtactcttcggcgctgcaccagaccgatttgatgtnccatcggaccatccttcaacggctctcttcgacaggtgccatcgcgccaacgactagctgacgtggcccacggtccggtggcacaccaaaacggtttgatgccacgtagctaataaaaaccgccaatcatgatcgaggctcggggcatgtggatttggtgcgatggtgcaccggagcagtttggtgcgcccgtagatagcttagatctacaactttctaaaggaggcaagaacaactaggccttcttagcctatatatggtgc

SEQ ID NO: 4489 - DNA, 1030 bp, Zea mays
  misc_feature (13)..(14): n is a, c, g, or t
ccacgagctgctnnagtgccccgtctgcaccaactccatgttcccgccaatccatcagtgtcaaaatggacatactttgtgttcgacatgcaaggccagggtgcacaacacgtgccccgcgcgcggacccggggttggcgatatcaggtgcttagcattggaaaaagtagcagagtcacttgagcttccctgtaagtactgctctttagggtgcccagagatcttcccatactacagcaagataaagcacgaagcacagtgcagcttcaggccatatacctgcccctatgctggttctgaatgtgctgtggctggtgatattccattccttgttgcacatttgagggatgatcacaaagtcgatatgcacagcggctgcacgttcaaccatagatatgtcaagtccaacccgcgagaggttgaaaacgccacctggatgcttacggtattccattgttttgggcagtacttctgcctgcacttcgaggcattccagctcggaatggctccagtctacatggctttcctccggttcatgggtgatgagaatgatgcgaggaactatacatatagcctagaggttggtggtaacgggaggaaaatggtgtgggaaggtactcctagaagcatccgtgacagccaccgcaaggtccgtgacagccatgatggcctcatcatccagaggaatatggcgctgttcttctctggtggtgacaggaaggagctgaagctgagggtgactgggcggatctggaaagagcagacgaaccccgatggagcctgcattcctaacctttgcagctgagcaagggagacgattgaaaagaagaagaaaaaaaagaaagaaaatattgtgttatttggctggcttttttaaaaaattgtcatgctatgttttcattatagcctgctgttaaaatattgtaccagtatgtagggtgtaaaatgctcttgtaaagtaattgtgtatatcgaattcatttacaagttgtaccaccaaaaaaaaaaaaaaaaaaaaaaaaaaaaaaaa

SEQ ID NO: 4490 - DNA, 1752 bp, Zea mays
  misc_feature (1571)..(1571): n is a, c, g, or t
  misc_feature (1604)..(1604): n is a, c, g, or t
  misc_feature (1630)..(1630): n is a, c, g, or t
ggtagtgggtcttttaccaaaaataatctgaaataagctactcttgaagagattatgagattataataatctgggctttagattatataatctggacctataatctagatgtttgtttacccaccagattatttgcgctggattatataatctggccagattataatctgaaacaaacagggcctatgttatactgtagattagttcgatgtttggagtttgaaacagaagtgggcaccccgagccggccgggattctatttactttccaacaggcaaacaccgctgtcccttcccctcccagcgctacccaccatctccgctcttccctctccggctcatccccgccgggcttccgcctacctgcacacctcgccccgtttcttcctcgaacagattctctgccccaccccgattctacctataaatcacaactgcacacccccgaatcccggcaaaacccaacggccgaagctaagctcgagccgccgccgcgatgatcctccgtatccgcagccgcgacggcacggaccgcatcacggtcccagactcggcctcagtcaccgtcgccgacctgcagcgcctcatcgagtcgcacctcaccgtgcccgtcccgctccagcgcctctccctcgacccggccctcctgctccctaacccctctgccgctgtcccactcctcaccgactcggcggcgccgcttgcctcgctccgcctcgccaacggcgccttcgtctacctcgcatacccgcccgacgcgcgctcggcccgcccgccgccgcccaaggcactttccgccgctggctctttcggcaaaaagatgaccatggatgaccttatcgcgcgccagatccgcgtcacacgccaggagaacgcgctctgcgccgccgcctcttttgaccgcgatgccgccaacgcgttccagctctacgtcgccgagttcctcggcttcggcgtcaagcgggcgggtttcctctacggccgcgtcgacgcagagaccaaggatgtcttcgtcgactttatctatgagccgccgcagcagggctccgaggacgtggtccacctcttgagggaccccgacgaggaggcccgcgtcgataccatcgccgaggggctcgggatgcgccgggtcggcctcgtgttcacgcaggccgttgggagaaaggccagcgagactggtgagtacaccatgtccaaccgggaggtcgtgcaggcggcccagctgcaggctgagggcgggatcccggagtgggtcaccgccatagtcaaactggaggtgggggatgacggcaccggggatgtgcacttcgaggccttccagatgagtgagatttgtgtcaagctcttcaaggatggggtactggaaactgaggttcaggatgctgatgatccccgtctgtcaaagatgcggaaagaggtggtggctggggggaaggatactatggaggtggataatgacttcttcctcgtgcccgtcaagatctctgatcaccaggtattttcctttactcacttctcttgtactttggaatttatagttcatatgaaattatgaatagaggattacatctnagtttaccaatcgatggcaaaattggttttttncattaataggaagggttgccgctggntaatgagctacttttttctcgtcaaatttcccagtaccctttttatttacagccactggggggtggggtgaggtgatacaaggcacctaatctgggcttaaagctttaatcttttaagttca

SEQ ID NO: 4491 - DNA, 1782 bp, Zea mays
tcggccgccactgtagattagttcgatgtttggagtttgaaacagaagatgacgtcgagagttgatcggagacattctatttcactttccaaacaccgctgtcccttcccctcccagcgctacccaccatctccgctcttccctctccggctcatccccgccgggcttccgccttcctgcacacctcgccccgtttcttcctcgaacagattctctgccccaccccgattctacctataaatcacaactgcacacccccgaatcccggcaaaacccaacggccgaagctaagctcgagccgccgccgcgatgatcctccgtatccgcagccgcgacggcacggaccgcatcacggtcccagactcggcctcagtcaccgtcgccgacctgcagcgcctcatcgagtcgcacctcaccgtgcccgtcccgctccagcgcctctccctcgacccggccctcctgctccctaacccctccgccgctgtcccactcctcaccgactcggcggcgccgcttgcctcgctccgcctcgccaacggcgccttcgtctacctcgcatacccgcccgacgcgcgctcggcccgcccgccgccgcccaaggcactttccgccgctggctctttcggcaaaaagatgaccatggatgaccttatcgcgcgccagatccgcgtcacacgccaggagaacgcgctctgcgccgccgcctcttttgaccgcgatgccgccaacgcgttccagctctacgtcgccgagttcctcggcttcggcgtcaagcgggcgggtttcctctacggccgcgtcgacgcagagaccaaggatgtcttcgtcgactttatctatgagccgccgcagcagggctccgaggacgtggtccacctcttgagggaccccgacgaggaggcccgcgtcgataccatcgccgaggggctcgggatgcgccgggtcggcctcgtgttcacgcaggccgttgggagaaaggccagcgagactggtgagtacaccatgtccaaccgggaggtcgtgcaggcggcccagctgcaggctgagggcgggatcccggagtgggtcaccgccatagtcaaactggaggtgggggatgacggcaccggggatgtgcacttcgaggccttccagatgagtgagatttgtgtcaagctcttcaaggatggggtactggaaactgaggttcaggatgctgatgatccccgtctgtcaaagatgcggaaagaggtggtggctggggggaaggatactatggaggtggataatgacttcttcctcgtgcccgtcaagatctctgatcaccagggtccactctcagtaggctttcctatagagaaccgtggaaatcctgtgagcatcagcgcgttgagaagtcacctggagcggatgaagcatttggcatttgtgaagcggatctcggacttccatttgctcctcaagctcgctactttcctagatgtaaaggcagacatgcctactatagctgcatgtgtgaaaactcagagcagggtgcccgaggggtaccagcttctgatcgagtcctttgctagccagggataatatcgcatctgaaagcatggcatggcgatgcataatttgtttacttgatcacatcatgcatgtgtaacttatggatgtctcttggtgtataagtattgtgtgaattccttctttgccatcaaaatatatgtttattccttctcatgtcatgaaataaaagttgccttcaatgccatcggttttaatttttttaaaaaaaattttaaaaactatattatt

SEQ ID NO: 4492 - DNA, 1900 bp, Zea mays
catatagaattgatatataaatttatgttcttgtttttagcattgagcctataaatattcataaaaaataaacctcaaattcgttttatatctttttaaataattaatataaaattcggatacggatacgaatacatattttttatctttttgttgtagggataaaatattgcacacaaaaattatattagtgtaatttataatattcctaataaaatggtaaaatttagttttaaattatatatatatatattaaaatattagatttgtcgtataagtgagatatccatctctaaccactctccttagagcgctgtggactggcccacacgtaagccttatggcgaggattcgtttccctaccgtctcggctcttggtctcccccggcttgccccttcctcccctgttgcacacctctttcttcctcgaacacgaattctgtgccccaccccgacgctacctataaatctcatcagcacccccccccccccgaaaaaacccaccggcagaagctaagctcgctccgcatcggcagccgcgatgatcctccgcatccgcagccgcgacggcacggaccgcatctcggtcccagactcggcgtccgccaccgtcgccgacctgcagcgcctcattgagtcgcgtctcaccgtgcccgtcccgctccagcgtatctccctcgacccggcactcctgctccctaacccctccgccgctgtcccactcctcgccgacccggcggcgccgcttgcctcgctccgcctcgccaacggcgccttcatctacctcgcatacccgcccgacgcgcgctccgcccgcccgacgccgcccaaggtgctttccgccgctggctctttcggcaagaagatgaccatggatgatctcatcgcgcggcagatccgcgtcacacgccaggagaacgcgctctgcgccgccgcctccttcgaccgcgatgccgccaacgcgttccagctttacgtcgccgagtatctcgcgttcgccgtcaagcgggcgggcttcctatacggccgcatcgacgcagagaccaaggaggtcttggtcgacttcatctatgagccgccccagcagggcttcgaggacgtggtccatctcatgagggatcccgacgaggaggcccgcgtcgataccattgccgaggggcttgggatgcgccgggtcggcctcgtgttcacgcaggccgtcgggaggagggccagcaagactggtgagtacaccatgtccaaccgggaggttgtgcaggcggcccagctgcaggctgagggcgggaccccggagtgggttactgccatagtcaaattggaggtgggggatgacggcactggggatgtgcacttcgaggccttccagatgagtgaaatttgtgtcaagctcttcaaggatggggtactggaaactgaggttcaggatgctgatgatccccgtctgtcaaagatgcggaaggaggtggtggctggggggaaggatactatgaaggtggataatgacttcttcctcgtgcctgtcaagatctctgatcaccaggtatactcctttactcactcctgctcatgtactgtggaatttatagttcatatgaatagaggattgaatataacttgatgaagtaagggctgaatatataaaggacgtggtgctcagaaaccttaaaacactaggctgtaatatctgaatataattgtagattgcttctcgctgcaatgttccatttattggcatttcagaacctttgaaggggcaaaattgatatttgctttatacatgtatagcttgaccctatgtgatgttcagttcattgatttatagttcaagtggatatgtgcttgaactatatattaaatttagccatggaacaacaatttactgaatataatcaactctgca

SEQ ID NO: 4493 - DNA, 1678 bp, Zea mays
ccggccggggttgccacctctttcttcctcgaacacgaattctgtgccccaccccgacgctacctataaatctcatcagcacaccccgaatcccgaaaaaacccaccggcagaagctaagctcgctccgcatcggcagccgcgatgatcctccgcatccgcagccgcgacggcacggaccgcatctcggtcccagactcggcgtccgccaccgtcgccgacctgcagcgcctcattgagtcgcgtctcaccgtgcccgtcccgctccagcgtatctccctcgacccggcactcctgctccctaacccctccgccgctgtcccactcctcgccgacccggcggcgccgcttgcctcgctccgcctcgccaacggcgccttcatctacctcgcatacccgcccgacgcgcgctccgcccgcccgacgccgcccaaggtgctttccgccgctggctctttcggcaagaagatgaccatggatgatctcatcgcgcggcagatccgcgtcacacgccaggagaacgcgctctgcgccgccgcctccttcgaccgcgatgccgccaacgcgttccagctttacgtcgccgagtatctcgcgttcgccgtcaagcgggcgggcttcctatacggccgcatcgacgcagagaccaaggaggtcttggtcgacttcatctatgagccgccccagcagggcttcgaggacgtggtccatctcatgagggaccccgacgaggaggcccgcgtcgataccattgccgaggggcttgggatgcgccgggtcggcctcgtgttcacgcaggccgtcgggaggagggccagcaagactggtgagtacaccatgtccaaccgggaggttgtgcaggcggcccagctgcaggctgagggcgggaccccggagtgggtcaccgccatagtcaaattggaggtgggggatgacggcactggggatgtgcacttcgaggccttccagatgagtgaaatttgtgtcaagctcttcaaggatggggtactggaaactgaggttcaggatgctgatgatccccgtctgtcaaagatgcggaaggaggtggtggctggggggaaggatactatgaaggtggataatgacttcttcctcgtgcctgtcaagatctctgatcaccagggtccactctcagtaggctttcctatagagaaccgtggaagtcctgtaggcatgagtgcgttgagaagtcacctggagcggatgaagcatttgacatttgtgaggcggatttcggacttccatttgctccttaagcttgctactttcctagatgcaaagtcagacatgcctactatagctgcatgtgtaaaaactcagagcaggatgcccgaggggtaccagtttctgatcgagtcctttgctagtcagggataatattgcctctgaaagcatgacacacgatgcataatttatttacctgccacatcaggcgtggttcggttattcttaattcatgtggattggaaggtatcaggatgaattgatatagattttattaaaaaaaaaaaaaaaaccaatttaatcctatccaatttatatggattaacctcaaaacgaattaagccccttatgtgtaacttatggatgtctcaggtgtataagtattgttcaatgcaatcacttttcgatagcaaaaaaaaaaaaaaaaaaaaaaa

SEQ ID NO: 4494 - DNA, 3997 bp, Zea mays
cttccgaaatctcgtgcggcggccggcaagttcgcacttcgcagcgcattcaccaccagcttcactcccaactaccgctgatctcactcacgctcaccccagccggccagccccgtccccatccggctagaggttcacatcacctgcgtgacgataaacatcctcttccaaatcgtagtctagcccgtgcccaaaaccctagcgaccgccggagagctcgtccgaatcgaggccaccgaggggaaattagatcgcggcggacgatggagagccctgcgaaagaggaggccgggggagagctggcaatggagatcgagtcgtcggtcacggcggaggactggcgccgcgcgctttctcgcgtcgtgccgtccgtcgtcgtcctccgcaccactgcgccgcgcgcctttgacaccgaggtcgcgggcgccagctacgccacgggtttcgtcgttgacaagtcccgcggcataatcctcactaaccgccatgtcgtcaagccaggacctgtggtcgcggaggccatgttcgtgaacagggaagagatccctgtgtacccactgtacagagatcctgtacatgattttggtttttttcgctatgatccaggtgccattaagtttcttaagtatgatgagattccgctggcacctgaagcagcatcagtcgggctagaaatccgggttgtcggaaatgacagcggggaaaaggtttcaattttggcaggaacacttgctcgacttgatagagaagcaccatactacaagaaggatggatataatgatttcaatacgttctatatgcaggctgcatctggtactaaaggtggctcaagtggttctcctgttgttgattgtcaaggaagggctgttgccctgaatgctggaagcaaatcttccagtgcctctgccttcttccttccattagaacgtgttgtcagagcattggatttgatacgtgacagttgggatgcatttggtaccaagacagaatctgtttatattccacgtggtacacttcaggcaacctttcaacacaaaggatttgaagaaactcgacgtcttggcctccggaatgaaacggagcagatggtgcgtgtagtttctccagaaggcgagactggaatgctggttgtcgattcagtggtacctgaaggccctgcacataaacatttagaacctggtgatgttctagtacgcatcaatgaggaggttgtaactcagtttcttagattggagactttacttgatgatagtgttggcaaggaaattgatttgcagatagagaggggtggagttcctttaactgtaaacctgcaggttgaggatttgcactctataactccaaatcattttttggaagttagtggtgctgtcatccatccactgtcatatcagcaggctagaaacttccgattcaaatgtggtctcgtatatgttgctgaagcagggtacatgctctctcgggcatctgttccacgccatgccattattaaaaagcttgcaggagaggatattgcacatttagatgaccttattgcagttctttcaaaattgtctaggggaacacgagtgcctctagaatatgtcaaatacactgaccgtcacaggaacaaatctgtactggtgacaatagatcaacatgaatggtatgcgtcacctcagttatatactcgaaatgatgcaactggcttgtggactggaaaaccagctataccaccagaatctccgtttttagctctagctcatcatgctagtcatgtggacacaaactcaaacgctgtttcatctttatccgaatctagtcctatggatctcaagtgccagtatgattctgagaacctggcagacggatgcatcaaaatgcaaactgatgatgagattgttgtggatggatctcattctaacgaagattctgttattgagaaaaaaaggcgacgtgtggtcgaggagatagctgccgacggaactttaccatcttatggagatctagaggatgtaaaaggtggttctttgaggcatccttctaatgcagatggatctgaacttgctcgaacaatatcaagcaatgcatcattggcagaacaagtaattgaaccagcccttgtgatgtttgaggtgcatgtgccgcccgtttgcatgcttgatggagttcactctcaacatttttttggaacaggggttataatatatcattctgaacacctgggtctggttgcagttgataggaatacagtggctgtatctatctctgatataatgctttcttttgctgcatatcccattgaaatacctggggaggttgttttcctccatcctgttcacaactttgtcctggtcgcttatgatccttctgcactaggagctggagcatctgttgtccgggctgctaagcttctatcagaacctgctttgcgacgaggagattctgtctatctagttgggcttagtcgaagcttacaagcaacatcaaggaaatcaatcataactaatccttgcacagctgtcaatattgggtcagctgattgtccacgataccgtgccataaatatggaggtcattgagctcgatactgattttggtagcacattttcgggcatattaactgatgagcaaggaagagttcaagcattatgggctagcttttctacccagctgaaatatggttgcagcagctcagaggaccatcagtttgttagaggcataccaatatatgcaataagccaagtacttgagaagattatcactggaactgaaggaccttttcggcttatcaacggaataaagagggcaatgccatttgtcagacttttggaggtggaactttatccaactttgctatccaaggcaagaagttacggattgagtgataactgggtgcaggcccttgcgaagaaggatcctgtgcgtagacaagtcctacgggtgaaaggttgtttggctggatcgaaagcagaaaatcttctggagcagggagatatgattcttgctatcaacaaggagccaattacatgcttccttgacattgagaagacttgccaagagttggaccaatccattgggtcagatggagtgcttaacatgacaatattccgtcagggaaaagaaattgaccttgttgtcggaactgatgtaagagatggcaatggtacaacccgtatggttaattggtgtggttgcattatccaggatcctcactcagcagtgcgtgcacttggctttttgccagaagaaggtcatggtgtttatgttgctagatggtgtcatggaagtccggtacatagatatggcctctatgctctccagtggatcatcgaaattaatgggcaaccaacaactgatctggaaacttttataaaggtggtgaagggtctcgaagatggtgaatttgttagggtgaggacggtccatttaaatggaaagcctcgggtacttactctgaaacaggaccttcactactggccgacctgggagctcagctttgaaccagaaactgctacatggcggaggaaaataataaaagcattgcaatcagccagggcgtgatattttcatgttttgctgcgaccttttcatgctttcagaggagcatagaggtatggaagttagaggttcgtgcctttgtttggtaagctaaatcgtgcattatatatgcaggattaagcaaccctgcactttgtagggttagttgtgtgcattagcataggggtgcttgaaagatatataaaaggtacattaaaggtatatggattcattgtctgtggtctctggacaatttgaccacaggatttgccatttgtatatcgtctattcctatattttggtagaaaaagaaataaaccgttagcctttctagcggtcatttcactactctgcattaagaatgtgtgttagctatcaagttaacagctccacagatttagcccgtttttcatctcggcggcgcggctatcaccttgactgcgtagttactggaatgcctaccgacagttttttttttc

SEQ ID NO: 4495 - DNA, 1214 bp, Zea mays
cctcgaggccgccccggttcgaccccgcccggccgcgcagaagccgcagccacgcccccacaccaagccgtatcgtcttctccctcttgtccggttcgggtggtccgcggtcggggtgagtgagtgagcagctttgcttctccatctccccgttcccttccctccccagccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagacggcggcggcggcggcagcggccaacggaaaagcgtgctgccacgccgccaaggggcccgggtacgccacgccgctggaggccatggagaagggccccagggagaagctcgtctacgtcacctgcgtctacaacggcactggaattaacaagccggattaccttgcgacggtggatttggatcccagctctcctacatactcccaggtgatccacaggctcccggtcacccacatcggcgacgagctgcatcactctggctggaactcctgcagctcctgccacggcgacccatcggccaagcgccgcttcctgatcctgccttcattgctgtcaggccgtgtgtatgtcgtcgacacagcgacagacccaagggcgccatccttgcataaggtggttgagtctgaggacattgctgagaatactgggcttgggttccctcacacgtctcattgccttgcgtctggcgacattatgatttcttgccttggggacaaggaggggaatgcagctggcaatggcttcctgctgttggattcagagtttaatgtcaaaggacgttgggaaaagccaggtcacagtcccttgtttggatatgacttctggtaccagcctcgccacaaaacgatgatcagttcgtcatggggagcccctgcagcgtttaggacaggtttcgatcttcaacatgtccaggatggcctgtatggaaggcacctgcatgtgtacgactggcctggcggtgagctcaagcagacacttgatctaggtgacactggactccttccccttgaggtgaggtttttacatgatccatcaaaggacactggctatgttggctgtgctttaacaagcaacatggtgagatttttcaagaccgcggatggatcgt

SEQ ID NO: 4496 - DNA, 1032 bp, Zea mays
  misc_feature (916)..(916): n is a, c, g, or t
  misc_feature (988)..(988): n is a, c, g, or t
  misc_feature (995)..(995): n is a, c, g, or t
tgggtacctcggggccccccgggccggggcagaagccgcagccacgcccccacaccaagccgtatcgtcttctccctcttgtccggttcgggtggtccgcggtcggggtgagtgagtgagcagctttgcttctccatctccccgttcccttccctccccagccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagacggcggcggcggcggcggcggcggcagcggccaacggaaaagcgtgctgccacgccgccaaggggcccgggtacgccacgccgctggaggccatggagaagggccccagggagaagctcgtctacgtcacctgcgtctacaacggcaccggaattaacaagccggattaccttgcgacggtggatttggatcccagctctcctacgtactcccaggtgatccacaggctcccggtcacccacatcggcgacgagctgcatcactctggctggaactcctgcagctcctgccacggcgacccatcggccaagcgccgcttcctgatcctgccttccttgctgtcaggccgtgtgtatgtcgtcgacacagcgacaaacccaagggcgccatccttgcataaggtggttgagtctgaggacattgctgagaatactgggcttgggttccctcacacgtctcattgccttgcgtctggcgacattatgatttcttgccttggggacaaggaggggaatgcagctggcaatggcttcctgctgttggattcagagtttaatgtcaaaggacgttgggaaaagccaggtcacagtccccttgntttggatatgacttctggtaccagccctcgccacaagacgatggatcagttcctcatggggagcccctgcancctttangacaggtttcgatcttcaacatgtccaggatggcctg

SEQ ID NO: 4497 - DNA, 2028 bp, Zea mays
atcctaatcgaaaactcgcagaagccgcagccacgccccacgcccccacaccaagccgtatcgtcttctccctcttgtccggttcgggtggtccgcggtcggggtgagtgagtgagcagctttgcttctccatctccccattcccttccctccccagcccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagacggcggcggcggcggcggcggcggcggcagcggccaacggaaaagcgtgctgccacgccgccaaggggcccgggtacgccacgccgctggaggccatggagaagggccccagggagaagctcgtctacgtcacctgcgtctacaacggcactggaattaacaagccggattaccttgcgacggtggatttggatcccagctctcctacatactcccaggtgatccacaggctcccggtcacccacatcggcgacgagctgcatcactctggctggaactcctgcagctcctgccacggtgacccatcggccaagcgccgcttcctgatcctgccttccttgctgtcaggccgtgtgtatgtcgtcgacacagcgacagacccaagggcgccatccttgcataaggtggttgagtctgaggacattgctgagaatactgggcttgggttccctcacacgtctcattgccttgcgtctggcgacattatgatttcttgccttggggacaaggaggggaatgcagctggcaatggcttcctgctgttggattcagagtttaatgtcaaaggacgttgggaaaagccaggtcacagtcccttgtttggatatgacttctggtaccagcctcgccacaagacgatgatcagttcgtcatggggagcccctgcagcgttcaggacaggtttcgatcttcaacatgtccaggatggcctgtatggaaggcacctgcatgtgtacgactggcctggcggtgagctcaagcagacacttgatctaggtgacactggactccttccccttgaggtgaggtttttacatgatccatcaaaggacactggctatgttggctgtgctttaacaagcaacatggtgagatttttcaagaccgcggatggatcgtggagccatgaggttgctatctctgtgaaaccactgaaggtccgcaactggattctgccggaaatgccaggattgataactgatttcgtcatctctcttgatgaccgttatctctactttgtaaattggcttcatggcgatattaggcagtacaacattgaggatcccgcaaagcctttcttggctggacaagtatgggttggtggtcttcttcagaagggcagtgatgtcgtctatgttactgatgatggtcaggaacagcagtacaatgtgcctcaagtcaagggtcatcgacttagaggtgggccacagatgattcagctgagcttggatggcaagaggatatacgtgacaaactcacttttcagccgatgggatgagcagtttttcggtgatgatcttgtcaagaagggctcccacatgttgcagatcgatgtcgacaccgagaaaggaggcctggctgtcaaccccaacttcttcgtcgattttggcaccgagcctgatggtcctgccctggcccacgagatgagatatcctggtggggactgcacctctgatatatggatctgaggtcaaggattcggcgtaattaacaggctgctggagaatccctgttgttgtatgcactgtaattaacatggtatccgtgcggtgttctgtcttgtactgcgactgttgccagtggaataaggcatggtttcatgagaactctagattaataaaagaagtcctgattctaaaaaaaaaaaaaaaaaaaaaaaaggggggcccggtacccataccctcgagactagttctctctctctcctcgtgc

SEQ ID NO: 4498 - DNA, 3304 bp, Zea mays
ctccacacaatgtaatcttcgtgtgtctttcttccagtgtaggagttatgtatgaagcttcatgcacttagtcttcgtagtcgaggtttcgcggcgaaatcttcgattgcatctgacgcaaaaagtcgaatctgcaagtctgtgttggtaaaaaaagatgtttagttgtggtgaaaacctcgatagtagtttttcacggacatagggctaacgtgaaggtctgaatcttgcaaaatcatgattttttctaaggtgaaaacctcgatataacattgtctctagattttgtagttgattaatacattgaagtttgacatggttgaacatttgttttgactgctccaaggtttgtatatttcattggtcttcgtgtgttacgataatcttgctgttgttgaccttagcattgtgaaactttgagaaaaagttttttttacgattttgttgatttgttggttgtattcacaatgtctagctcgcctttgccatttttgcgggttataatgaagatctagcggatgaaaaaaaatcaattatatctaccgttatatgcaaatttcctttttcttttatggccatcttagatttgtaaaaggtttgattttgttttttgaaaaacgagacatatgcctaaaattaaaacttttgagtcttcataaaactgagacgcggagtgagctcaagtaacaatcgtaagataggtagtgttattttggaatcatcgtttgcatcagtattatagggttaatctgatgtggaagctttagctcttgttggcggcgcttcagtattcaattgtaggttttatcgtaaacaacaagattgggcttggtttaatctggtgatcgtcccaaagacgcatgggcaattggagttgattccatcgacggtcgtcgatggacacgaggcaacgccgccgcggcctcccctcatcgccgtaataacaaagcgcccgcgccgcagccctcagctcccactcattcttctccctgcctctctttctcactcatcgctcgtggagttgcagccatggctgctccggtcgccgcatactccccggcgctgcgggtccaagtgaaagcagccatggatgcagcgtcgtcgttccgagtattggcatctctcagtttccccgggcaaagagcaagctttccatcgattcggatgcagaagcgctctcaagtgtcctgttcgctggtacgtactactacctccgaccctatcagtagcaatagcaatagcaaagcaaaacaaagcgtcttcagtttgatttgtgttgttcatgcatgcatgacaacggttgattttcgatttcttgataggcagttccaactttattgtgtttaaacagcgagatcgtgaagaatcagttagctctacccgaagacaccggagtaacaggagagacaaagtttgtagacattggagccgactcactggacacggtaacagtactctgtttgtttgtctgatgatctcaaacaaacaaacaaacaaagaatctggtgtgttgttactaggttgaaatcgtgatggggcttgaggaagcgttccaaatcagcgtggacgaatcgagcgctcaagagatccagacggtggaggacgctgctgctctcatcgacaagcttatcgcggagaaggacgcttgaaacgctgtccggaggagggatgacgatgggtggttttgatttgagaccatagtgctccttattgcaattattagtcagaaaaaaaattacccagtttcttttctttcttcttcttcttctatcataatatgaaatatgtatgcatatgcatgccttttggtaaaaaaaaaaaaaaaactgccgccgagagatgagggcctgtacccaattctcttcaattcggaacatgttcatggtttacttcaagtttgaccaagagcaatccgcccgctgctcttattgtaaatgtaaagacgattcaaaacgacacacacaaatcagaacttttgttcccaaatcctctgattcactcattcattcagtgaccggattgatcttcatggcgtccattatgttctttccttggagcttactagacagcaccaggcggacgtagtcctcgacgccaatgctcctgtacctcgctggctcatcaccatcgaccatcgtctcctcaagcggcgcgtaagtgtcgccgaacctggcggagtggaaggctgcgacggacacccggtggtgggtggggctaaccagcgcccggtgctcgatgctcttgtacctgccgttggtgagcacctcgacgacgtcgccgacgttggccaccagcgctccggggatggggtcgacgctgatccacgcgccgcgcctcctgatctgcagccccgggacggcgctgacctggagcagcagcgtgaggccggcggcgtccgagtgcggcgacaggcccagcaccctgcccctgccgtgcgggcacgccgggtagtagttgacgcgcacggcctgcgcgtcggcgaccctggccagcctcgcggcgtccgccacgcccaggttcgcggccatggacgccagcaggcgggcggccacgcgctgcacctcggcagagtagcgcgccagcgagtccccgaacgtggccgggcgcgccggccagaagcgcggggcccggtactcgggcggctgcgtggacaggaaaagcatgtcggcccagtccagcttctggtcctcggagaccacgaaggcctgcccgtacccctcgatcccgccgggctcctgcgccaccgcgcgcttgtcggcgagcgggaggcggaagaaggcctgcaggtctgccttcacgtccgcgaccaccgcgtcgggcaccccgtggttgatcacctggaagaagccccactcctcgcaggccgccttcagtttggcggactcctcgtctccgtgcgacgacgggtccaggagcctcgcgaggtcaactaccggcaccgaggaggccgcgtcgccgttggcgtctgcgccgtcgacgtcgtcgcggaggtagcggcttagcacgggcggcgtgagttcgtcgccggggcgcgcggccaggtcctgcacgttgggcaccggcagcgagccgcccaggttgcgcggcttggcgtccatatgggagttggtggtgttggaactggaactggagatggtcgcccgccccgggccgcccgtgggtgacttttcttccgtcgcagccgcagccggccgccggtctgcatcaacaacagctgctactttggttggtggccggccaggcctccatttgcctgcaaatttaggcctcgttttgtttcattcgatgcatggactaaaattca

SEQ ID NO: 4499 - DNA, 841 bp, Zea mays
aattggagttgattcctcgacggtcgtcgatggacacgaggcaacgccgccgcggcctcccctcatcgccgtaataacaaagcgcccgcgccgcagcccgcagccctcagatcccactcattcttctccctgcctctctttctcactcatcgctcgtggagttgcagccatggctgctccggtcgccgcatactccccggcgctgcgggtccaagtgaaagcagccatggatgcagcgtcgtcgttccgagtattggcatctctcagtttccccgggcaaagagcaagctttccatcgattcggatgcagaagcgctctcaagtgtcctgttcgctggcaaaacaagaaacagttgagaaggtcagcgagatcgtgaagaatcagttagctctacccgaagacaccggagtaacaggagagacaaagtttgtagacattggagccgactcactggacacggtaacagtactctgtttgtttgtctgatgatctcaaacaaacaaacaaacaaagaatctggtgtgttgttactaggttgaaatcgtgatggggcttgaggaagcgttccaaatcagcgtggacgaatcgagcgctcaagagatccagacggtggaggacgctgctgctctcatcgacaagcttatcgcggagaaggacgcttgaaacgctgtccggaggagggatgacgatgggtggttttgatttgagaccatagtgctccttattgcaattattagtcagaaaaaaaattacccagtttcttttctttcttcttcttcttctatcataatatgaaatatgtatgcatatgcatgccttttggtaaaaaaaaaaaaaaaa

SEQ ID NO: 4500 - DNA, 767 bp, Zea mays
  misc_feature (27)..(27): n is a, c, g, or t
gggtacccctcgcggggccggccgggnaaaaaaaaaaaaaaaaaaacctcagttcccactcattcttctccctgcttctctttctcactcatcgctcgtggagttgcagccatggctgctccggtcgccgcatactccccggcgctgcgggtccaagtgaaagcagccatggatgcaacgtcgtcgttccgggtattggcatctctcagtttccccgggcaaagagcaagctttccatcgattcggatgcagaagcgctctcaagtgtcctgttcgctggcaaaacaagaaacagttgagaaggtcagcgagatcgtgaagaatcagttagctctacccgaagacaccggagtaacaggagagacaaagtttgtagacattggagccgactcactggacacggttgaaatcgtgatggggcttgaggaagcgttccaaatcagcgtggacgaatcgagcgctcaagagatccagacggtggaggacgctgctgctctcatcgacaagcttatcgcggagaaggacgcttgaaacgctgtccggaggagggatgacgatgggtggttttgatttgaggccatagtgctccttattgcaattattagtcagaaaaaaaaattacccagtttcttttctttcttcttcttcttctatcataatatgaaatatgtatgcatatgcatgccttttggtggtttgggattattataataaataaaactgccgccgagagatgagagacggtacccaattctcttcgattcggg

SEQ ID NO: 4501 - DNA, 1333 bp, Zea mays
tccctgatgcgcctgtcttcttcttcccatctcttcgtttgtggcccgagcctgagtcggtaggcttgtcatcttttggctcgttgacgaaggactccttctccttatcattgatgacggcccccttgcccttaggatccatctcttcgggcggttagtccctttcttgaagagaacggctcttataccaattgagagcacctagagggggtgaataggtgatcctgtgaaaacttgaaacttactgccaccaaaacttgattagagttagaacagttaagccaagtggctagagaggagaacttgcacaacacgataaccacaaagagatcaacacagagatgacacagtgatttatcctgtggttcggccaagtacaaaacttgcctactccacgttgtggcgtcccaacggacgagagttgcactcaactcctctcaagtgatccaatagtggaggatgtcctcatcagtgttctttttactttgctcttttcccgtttgcgaggaatctccacaacttggagtctctcgcccttacaataagaatcaatatgaagcacaagagtaagggagggaagcaacacactcaaaaccacagcaaatacgcgcacacacgatcaaaacttgagctcaaaacaatatctcaaggttctcactagaacagagctcaaatcactaagaatgtcgaattagtgcgcaagagtgaagtgtgaatgatcaacaatgctcaaaggttgcttggtgctttcttccatgcgcctaggggtcccttttatagccccaaggcagctaggagccgttgagagcattccaggaaggcaattcttgccttctgtcgcctggcgcaccggacagtccagtgcgccaccggacactgtccggtgcggatttctttccttctttagcgaagccgaccgttggccctttggagccgttggcgcaccggacactgtccggtgcacaccggacagtccggtgcccccttccgaccgggggctcggccacgtgtctcgcgcggatcgcgcggccgaccgttggctcaccggacagtccggtgcacaccggacagtccggtgaattatagccgtacgccgttaatcatttcccgagagcagctagtttgcctgagccagcctggcgcaccggacactgtccggtgcaccaccggacagtctggtggaccaagacagagctgacttaggctgaacaaagccatctttaattccaacttgatttttcctgtttccagcacttagacacaatacattagtctctaaataatgtactaagtctgagaaacatacctttatacttgatttgtactttgtcca

SEQ ID NO: 4502 - DNA, 2663 bp, Zea mays
cactgactgttcttccgccttgggttagctcccggaactcatcttccttgagttgcactatcccctagggtacgtggtgctcacggaaggctgcttcaaattctgcccatgtagcgtctctgatggcctcactgaaagtgtcccaccatgctaaagccattcctgaaagctgatgagctgccagctgaatacgttgattctcaggacaagcgatggctcccaacttcctcttgattgtgcgaagccagtcatctgcatcgaggggattgctggaccccgcgaacgtgggcggcttcagtctcaggaattctcccatcctgtcctggggccttccaccgcctgggcgctggttctccaggcttcgagtgaggacttcaatgagtctggtttgattggccagaatttgggctaggtctagtggtagttctggaggtgcggggaggtgggtctcacccccttctccgccagcctctccctcagctcctagcggaagtcttgctccaatcccggaggcggtaggcgtggttctatccgaagccatctgccatgggaagagagtcactattatgcacatgccattttttttaactagttattttattcattacatcaagccattacattacatagcatactactaccacaagctcatcacacacgagtgctacctagggtacccccgaactctttctctaaggtgtccccaaattccttgagaaggtcatcaaggctggccagggacatgtcctcggggtcggactggtttctgggagggttttcttcctgctgctcagtctgacatccttggcttttggtcttcttgcgggttttccttgcgggggcgagcttcttcagtatcttgtcgtagtccattttgagggtgcggtaagcttcacgggtattggtctcttcgccttcagctaacgagaggctctcttgaagggacgctttttcttctgaaagttccctgactttctgctccaggctttccacctgggaggttagggaggtgcagtggagggcgaggtcatcatattggttatcaagggtatgaaggtatccagccatgtagacaatggtgggatcattctcaataggatctcctcctgatagggcctgaagtcttttcctccaggtgggggtattcttgttgctgggtggaaagtagcgaaggggggtttcaatgattactttgttgtagttctgacacagctgtcggagggcttttcgggcgacattttggcaagcatctaggaaatggactccggtaaaagtgacttggaaggaacgttggttgggatagctttggctttcccccaggtagactgccatagagcatcttatcattccgccctcgatatgctccgtccagacgtattccggcttcttgcggattcccatgcggagcgcacagcttcgcaagaggcgtgggaacccttccacttctgagcagtaggatgacttaatggccagagagtcttccatctggaataggaaaagaagggtcttgttaaaaccggggaagggaagagaaaacttttcttgaggtaagaggtattttctttttaaggtaagttttagggtcagggctgcgacctacggccagtcctatgggctctgataccacctgaagcgtcccgatcctttgggactcaaatgtgaaacaattactagtcccaggaggctagtaaacacattccttacttcaaatagtacagagtttagataaatttattacaataccggggtacaagctcgagagagccaaatagagaagcgcagtaggaaaatacactagcccaagccacaggcagaactgggtgcagacacagccctcttaatcaagcatagcagaaaagaagtcctcggctgctgaaaaacataaataaatctgggtgaatacactaggtattccgcaagcccaccccgctcccgtagagagaaagagacctatgatgtacatgctcaatttggtggagttgtagtcactcatcattttcttagagagaggcagttgcttgaaggttttcccatggtattaccagtaaccaaaaactcaaccaccacggagcttcccgctcccgtggctttattttctttttcaaaacccatttaaacacaccttttccttgttaagaaacttagagaaaaagctctaattgccataccataccagactcatccataccagtggacacggactattcgaataggttttgactctgcgcagaggggtacactttacccactagcccggtttctgcgatctcaccgtcgcgagacccgaatgccggatctctttccttactcgtgcatcctaaccttaacggttatccggaaggagtcaggccaccaccatgcccaaaccggacaaaactttccccctccttatcctcccggtgctccccagccttcttaaccctggggttggaccgcacgagttcggattgagtgactgcccacacagtctcgagtggttgtacgtcaaaggagtacaggcagtgaaaatgacaaaccggtccttatatgaggggacaatccttctgctcacgcctaaaccagctgagccaacaccttaggccctcccctaaaccagggagtccctgatcatcccactcccagggtgatgagggtgagtacccttcatcgcaaaacttttcaag

SEQ ID NO: 4503 - DNA, 1560 bp, Zea mays
ccatcaaagtgaggaggtttaccaagtggaatggagagtaaatgagcattttcattttgcggaatacgagaataatcaaaagaaaagtttgaattgaccgttttctttttctcgtagttgtcgtcgtctttttgggaagaagaggactcgtcgctgtcgtcgtagtagacgatctccttgatgcgccttgttttcttcttcttcccgtctcttcttttgtggcttgagcccgagtcggtaggcttgtcatcttttggatcattgacgaaggactccttctccttatcattgaccaccatccccttgcccctaggatccatctcttcgggcgattagtccctttcttgaagagaacggctccgataccaattgagagcacctagagggggggtgaataggtgatcctgtaaaacttaaaacttaacaccacaaacttgattaagagttagaacaatgaaatcaagtgagtagagaggagagctcttgtgaagcacaatagacacaataaggacaagcacaagagacacgaggatttatcccgtggttcggccaagtacaaaacttgcctactccacgttgtggcgtcccaacggacgagagttgcactcaactcctctcaagtgatccaatgatcaacttgaataccacggtgttcttctttactttgctcttttcccgtttgcgaggaatctccacaacttggagtctctcgcccttacaataagaatcaatatgaagcacaagagtaagggagggaagcaacacactcaaatccacagcaaatacgcacacacaagatcaagacttgagctcaagacaatatctcgaggttctcactagaacggagctcaaatcactaagaatgtcgaacaagtgcgcaagaatgaagtgtgagtgatctaccatgctcaaggaatgctgggtgtgctcctccatgcgcctaggggtcccttttatagccccaaggcagctaggagccgttgagagcatttaacacttaggcatttgtgttggacactcaatcatcaaaatacttagaaatggcccaagggcacatttccctttcaggcccggggggcactgtcggtaccctgaaacaggggtaccccttactgcaataagaaggcacggtgcccgcgcggctatctctagtcgcgcggtaaacagtacccgaccccacctcgtggacggctccagggtcgccacgtgaccagggaagactatcctccaaggtatcaatggtgggtccggacccccatgggaaagtgtcggacccctgcatatggggaccagacctccgggcagggtccaggacctccgcgggtacagaccggacccccgggacaggtcctggacctctctatgtagggtctgggccaccctcagcagggtcccgggattctgggacaaagaatacccaggccttaatcaaggccaggcgggggcctagagccgacacgtgtccagaccataccatgtacacttctactccccgctcaggcggagacccgaggctgccacgtggcctactgcccatgacgtaagccagcgggcggagcc

SEQ ID NO: 4504 - DNA, 1059 bp, Zea mays
actcctggggaccattgggtccctcgaggccggccggggtgtttccccgccgccgcctccaagcgcccccgcgagccagctccggcgaagtcgacagcaccaagcatggcggacacgaaggcgtcacccgcggtgacgctccgcacgcgcaagttcatgaccaaccgcctcctctcccgcaagcagttcgtgctcgaggttctccaccccggccgcgccaacgtctctaaggcggagctcaaggagaggctggctaagatgtacgaggtgaaggatcccaactgcatcttcgtcttcaagttccgcacccacttcggaggcggcaagtctaccggattcggtctcatctacgacaacgtcgactcagccaagaagttcgagcccaagtacaggcttatcaggaacggtcttgctaccaaggtggagaagtcgcgcaagcagatgaaggagaggaagaacagggcgaagaagatccgcggtgtgaagaagacaaaggctggggacgccaagaagaaatgagcaaggtttcagtgtactttagccgtcttgagttcgagtaacacctgttcgccgtcagaaattttgtaccccatgtcgcaatgctttgatctagaaaaagagttttttttagctgtttacatcgactactggtacatttgaaaaggcatattccccatctttgtggcaatgtcggggcgataccatgctgggccgaggattttttaacgaagttatacttttgaaagaagaaaaaaaaaaaccgcgagcctacatagtagcgttgatttcgtttcggcagaatctgtttcagaaaagagacattctgtgaaaacgtacgtacgtttcaggagactctggatcggctctcgtccctcgcttgttcgtgcggtgcttctgttcagcgacgcagtcacacccagagatgtcaatagggcctgtccttgtcggtgaatttctccatctgtttctaaatcccttttattcaattttgagtagcaaaagtttttatattttttaatcaacttctaaccgaataaagcaatggggaattcctccgtg

SEQ ID NO: 4505 - DNA, 911 bp, Zea mays
  misc_feature (872)..(872): n is a, c, g, or t
gggtccctcgaggccggccgggccgggactacatatgtaaccctctcgcgcaaacactcctctttccgcgccgcctcccctcccgccctcttgctccgccggcgcggccaccgccaccgccaccgcaacagctagtcagcagatcgtaaccatggcggattcgaaggccgctgcggcggtgacgctccgcacacgcaagttcatgaccaaccgtcttctctcccgcaagcagttcgtgctcgaggtcatccaccccggccgccccaacgtctccaaggcggagctcaaggagaggctggcgaagatctacgaggtgaaggacccaaactgcatcttcgtgttcaagttccgaaccaacttcggaggcggcaagtccaccggcttcggtctcatctacgacaaccttgaggccgccaagaagttcgagcccaagtaccgcctcatcaggaacggccttgctaccaaggtagagaagtcacgaaagcagatgaaggaacgtaagaacagggcgaagaaaatccgtggtgtgaagaagacaaaggctggagatgccaagaagaagtaagggaggaagttacttgccttgctctttctctcatcataggctttggtttgtttagggtggggctccttccggcaatgctgaatgtttagttagaagtagagaagattttgccaattacccatcatgttgagtttctcgtcgcaccttctgttcagttttgaggcactttgtcagacacaagaatatatatatacctggtcatcacggcttttgtcctgctaaaaaaaaaaaaaaaaaagcgtcgtgcccccggctcactgaagttggatgcaaagcttctgatttgattaggtttatattaaaagantttgttattaaaagcaaaaaaaaaaaaaaaaaggcccct

SEQ ID NO: 4506 - DNA, 703 bp, Zea mays
cctctctacctccgctttcctccctctcgcgccgccgccgccgctgccgccacctccgcaggcagcccaccgcgaagcgaggtcgaatcagccatggcagacgccaaggccacgacggcggtcaccctccgcacccgcaagttcatgaccaaccgcctgctcgcccgtaagcagttcgtgctcgaggtcatccacccgggccgcgccaacgtctccaaggcggagctgaaggagaggctcgccaaggtgtacgaggtgaaggaccccaactgcatcttcgtcttcaagttccgcacccacttcggaggcggcaagtcctccggattcggtctcatctacgacaacctcgagtccgccaagaagttcgagcccaagtaccgcctcatcaggaatggccttgctaccaaggtagagaagtcacgcaagcagatcaaggaaaggaagaacaggacaaagaagatccgtggtgtgaagaagaccaaggccggagatgccaagaagaaataagaacatttctgtcttcatcttttcactatcagcctttgcttggtttaggacggtatccctgtggcaatgttgctgagtgcttaattatgactagaaaagactatgccatttgtgtcatctcccgctatgttaagaggcattttgtagtatcttatgctaagattttgaggaacttggtcagactatcgcttaaaaa

SEQ ID NO: 4507 - DNA, 798 bp, Zea mays
cgtatgactcctaagggccattgggtacctcgaggccggccggggccgccgcctccaagcgccccagcgagccagctccggcgaagtcaatcctgcgctccgcaggcagcatcaagcatggcggacacgaaggcgtcacccgcggtgacgctccgcacgcgcaagttcatgaccaaccgcctcctctcccgcaagcagttcgtgctcgaggttctccacccgggccgcgccaacgtctctaaggcggagctcaaggagaggctggctaagatgtacgaggtgaaggatcccaactgcatcttcgtcttcaagttccgcacccacttcggaggcggcaagtctaccggattcggtctcatctacgacaacgtcgactcagccaagaagttcgagcccaagtacaggcttatcaggaacggtcttgctaccaaggtggagaagtcgcgcaagcagatgaaggagaggaagaacagggcgaagaagatccgcggtgtgaagaagacaaaggctggggacgccaagaagaaatgagcaaggtttcagtgtactttagccgtcttgagttcgagtaacacctgttcgccgtcagaaattttgtaccccatgtcgcaatgctttgatctagaaaaagagtttttttagctgtttacatcgactactggtacatttgaaaaggcatattccccatctttgtggcaatgtcggggcgataccatgctgggccgagaatttttaacgaagttatacttttgaaaaaaaaaaaaaaaaaatgcccggccgcccgccgctttgttccct

SEQ ID NO: 4508 - DNA, 1027 bp, Zea mays
  misc_feature (842)..(843): n is a, c, g, or t
agattcagcccacaagcacataacaacatagcaccccccctagggtttcacaacatatgtaaccctctcgcgcaaacactcctctttccgcgccgcctcccctcccgcccacttgctccgccggcgcggccaacgccgccacaccgcagcagccagtcagcagatcgtaaccatggcggattcgaaggccgctgcggcggtgacgctccgcacgcgcaagttcatgaccaaccgtcttctctcccgcaagcagttcgtgctcgaggtcatccaccccggccgccccaacgtctccaaggcggagctcaaggagaggctggcgaagatctacgaggtgaaggacccaaactgcatcttcgtgttcaagttccgaaccaacttcggaggcggcaagtccaccggcttcggtctcatctacgacaaccttgaggccgccaagaagttcgagcccaagtaccgcctcatcaggaacggccttgctaccaaggtagagaagtcacgaaagcagatgaaggaacgtaagaacagggcgaagaaaatccgtggtgtgaagaagacaaaggctggagatgccaagaagaagtaagggaggaagttacttgccttgccatttctctcatcataggctttggtttgtttagggtggtggggctccttccggcaatgctgaatgtttagttagaagtagaggagattttgccaattacccatcacgttgagtttctcgttgcaccttctgttcagttttgaggcactttgtcagacacaagaatatatatacctggtcatcacggcttttgtcctgttatcaccattttgatttcatcattttgatttcaaannaaaaaaaaaaaaaaaaaaaaaaaaaaaaaaaaaaaaaaaaaaaaaaaaaaaaaaaaaaaaaaaaaacttttggggggccctttttttggtttttgaacctttttgtttttccccctttggaaaaacaaaagggtttttggacttttttggtaaaactttggggaatggtaaagggatttttacc

SEQ ID NO: 4509 - DNA, 3620 bp, Zea mays
  misc_feature (543)..(543): n is a, c, g, or t
caaaattacactcatgccctttacatttgataataattctatagtagtctatcgaggtctgaatagccttttcatctttaagtcggttccactctttgctgtcacgccgaagctttcctgctcgcaccttcggctctgtatcaaccttcgtattattccggtctacagcgatgccgaccttagtccgaggatacctgttcacacattgtactccagaaatactgttaaatcctgtttttgaggaccttcggatgccgaaggtccccaacaagatgtgaggaattgggagagaaatcaacaaaaaaaagttttctagtcttgttcctttggtctttaccaatgtataaaagatttaggaataagtctacatgaccctccgatctttagatgatggtctatttcacttcctcaccttcaaaatcagttatttaaccaccttaactttataaaaccagataaataacctctaagcagttttagtcgacggttttgataacatagcattagttttatccttttcaattatgtctttacctagtgatnaaattttatgcaattttacacaaaaatggtaattagagattatatctgccctatttttctcgtaatttttggggcaacagtttaattactaaaaagaacaaaagctacataaaaatagcttaatatttttgtccccgattcatttagtatcttattatactaaaattttaatagagctaaacaatactattaataaacatttgttgattttattaagcacgctaagtagtggttcttctaattactaactaaattaattttatatttttaaaaaatacctagcaaacagtaataaaataatctctaatttctaacagatctcataaactaatgtaaatattttcaaaattttctaagaactttaaatctaaaatgactacccaccctccaatcaagtcaaaggaattatgtatttatgttgagctcagccacacttggccgtgcagacacgtaacacgttgtctggcccaagcatgacaagcaaacaaccagacagcccatacctatcttgcgcgcgtgcatgcaagtagaggattttagaacaggtaatgggtttccatgccgtccaatgtagacccgttaatagttttggcccatcattgttgtaacatctaataaggcccaccactccgttccccttgtcagccacggcgacgtgacctagggttttcatcagcatagtatataaaattccgttctctcagtcctgtttcccccccgccgccgcctccaagcgcccccgcgagccctccggcgaagtcaatcctgcgctccgcaggcagcatcaagcatggcggacacgaaggcctcacccgcggtgacgctccgcacgcgcaagttcatgaccaaccgcctcctctcccgcaagcagttcgtgctcgaggttctccaccccggccgcgccaacgtctctaaggcggcggtgcccaagcgtcggagccttcgctgcgagatcctctcgttctattagcgattttgacgcgtgtgatcgcttgatattgcaggcggagctcaaggagaggctggctaagatgtacgtgctgaaggatcccaactgcatcttcgtcttcaagttccgcacccacttcggaggcggcaagtctaccggattcggtctcatctacgacaacgtcgactctgccaagaagttcgagcccaagtacaggcttatcagggtacgcgtctcttgctaccaaggtcccgttgtcgcgcacgcagatgaattggattcataggtctccatgttgaatatactgcctggtatacgctgaaagctcaaagctttagtttattgtggccattgatgtacatttatgttcgctgctccttcagattatgtcgctcatttaacatatttcttgtggaacattgatatttttatcagatagtattttagatgagaaacgaatatctgttgctcagtcgtgtgttcagattatgtcgcgcatgaaccctttatcgccttagtgatggcgatgctgctacatggttgaaaatgatcccatgatgatattgactcccattgcactgtgtgttttgtagtatttttcaaaccgggatatttttgagtcagttcgaggagtttacattatatttgttgctaactcgcaaattttgctatggtctttcattaaactatgaatcatatggaattctgggctacagcaagcaaatatcgtatcctatttttgtgaattatccatgaccgttttgtgtatggaacctagcttaaaagaccagttaacgattagcaggtccatttgtatgctcccttcacataaaaagtatcctgcaaatccatgttacattgcaatgcagattttgtgattgaaacaacactgtctgtattggtcctgcttatttttgacaagagtgtgtttgggtttctgcagaacggtcttgctaccaaggtggagaagtcgcgcaagcagatgaaggagaggaagaacagggcgaagaagatccgcggtgtgaagaaggtatgcgcacttgcattcatctgactgttgtgtctaatattactgcgcatttggaatgtggggatttcattgtgtttctgtggttctgataaaaaaatagttattttttgcgtgtaactgctaattttttgatccgcggtgtgaagaagacaaaggctggggacgccaagaagaaatgagcaaggtttcagtgtactttagccgtcttgagttcgagtaacacctgttcgccgtcagaaattttgtaccccatgtcgcaatgctttgatctagaaaaagagtttttttagctgtttacatcgactactggtacatttgaaaaggcatattccccatctttgtggcaatgtcggggcgataccatgctgggccgaggatttttttaacgaagttatacttttgaaagatgaaacgtgacgtccgtgagcctagatagtagcgttgattccgttgcggcagaatctgtttctgaaacggtacattctgtgaaacgttatgtccgtttcagaagactctggatcggctctcgtccctcgcttgttcgtgcggtggttctgttcagcgacgcagtcacacccagagatgtcaatagggcctcttccctgccggtgaatttctccatcagtatctaaatcctttctattcaattttgaccagcaaaagttttgatcttttttgatctcttttaatcaacttctaatcgaataaagcaatggggaatacctccgttagcattgtgtgggcagatttttttccccaatgattaatgtaggaaaaatattgtctccatcgtgttcagattcaagatggcgacgcatatataccggttgggttaaggtcgcgggtataaaatatttctcgtactcgtgacctgtaattttacccactcgtactcgctaaaatactagtgtatcaatcactcaaaatgtcaaataaacataagtttaacttaaaatacaacaaactatatttttacataacttataggtaaacaaacaataacaaaataagtatttttttagctaagacgtctttaattacatggtaaatactaatacgatgcgggtatattttacccatgtgtatacaattatgtgc

SEQ ID NO: 4510 - DNA, 1712 bp, Zea mays
  misc_feature (7)..(7): n is a, c, g, or t
ccctcgnggttcggccgggaccacccatcccgaaagagccccagcccgcagggagtcaagtagtcaaccgttctgcccgctccccctcacacaaaaggcaaaccacccgccaccgtcggcagacggcaactactttcatttcgtcgtcgtcgcccgcccccacccgctcctccactccaccaccaccggacagatacggatgtctccgcccgcacatccacttcacaaacgaaaacccgcagcaaacgctagcagcggcggcgccggcagttggtagccgcgaccgagacacggcgggtgacctgccccgccgcagtcggggtgtatgtattaccaccgccagaattccaggagacgaggatcgaggaggcaccgatccgtagcggcgatatcgtagagccgctggtctcacgccgcaccgagacaatggcagaccagttagggtcttacactattagatcccatggaatgatattggcaaggttgcacatgtatgactggataatacttctcctccttgctgtcatagacgggctgttgaatataattgaaccatttcaccgttttgttgggaaagacatgatgactgacttgagatatcctatgaagggcaatacagtgccattttgggctgttccactgattggaattatactgccttgggccatctttgttgggatttacttcaaaaagaagaatttttatgatttgcaccatggcatactggggattctatactcagtgctgataactgcagtgattactgatgcaattaaggatggtgttggacggcctcgtccagattttttctggcgctgtttccctaatggaaatgatgtttatgataacattactactggtgttatatgcaatggagtgaagagcgtaatcaaggaaggccacaagagctttcccagtggacacagttcatggtcttttgctggtctaggcttccttgcatggtacttagctgggaaactcacagcctttgaccgcaaagggcatattgcgaagctatgcattgtgttcctgcctctccttactgccgcacttgtggctgtttctcgagtggacgactactggcatcattggcaagatgtatttgcagggggtcttataggtcttacagttgcttcgttttgctacctacagtttttcccatatcctttcgatggcgatgctttgtggcctcacgcatacgcggtccggttagccgaggaggggaacagcagaaatgcgaactcgtacagcgtgagaccaaccgagatcgaaacagtcgatattcctgggcacggtgggatcatcaccctaagagatactctaaacgatgtggagtctggcagtgccaggagattgtgagatgggtctgcaggtgtggagattgatgtctcagataccatgggagttgcttgcatatgtgtacaggtagatctattgtagagctgttgactgctgccaccgtgataggggagggttgtttagacgggcctggcagtaaatttacttggtagggtgctgtttcttctgagaacctttggcttttgtttgtatatatgctcttatcaaagtgttgagttcagagttgtggttaaagtttgtttgctgacactctttgtaaccagtttggtcgctgcattcagcaactatgatctgatcagatgttgcccagtctactgttgttcttatattaagcgtgaaattcatttgtcacc

SEQ ID NO: 4511 - DNA, 1934 bp, Zea mays
aaattccaggagacgacgaggcgccgatccgtagcggcgccgagggcgatatcgaggagccgctggtctcacgccgcaccgagacaatggcagaccagttagggtcttacacaattagatcccatggaatgatattggcaagattacacatgtatgactggataatacttctcctccttgctgtcatagacgggctgttgaatataattgaaccatttcaccgttttgttggaaaagacatgatgaccgacttgagatatcctatgaagggcaatacagtgccattttgggctgttccagtatgtcctgctgattggaattatactgccttgggccatctttgttggaatttacttcaagaagaacaatttttatgatctgcaccatggcatactggggattctatactcagtgctcataactgcagtgattactgatgcaattaaggatggtgttggacggcctcgtccagattttttctggcgctgtttccctgatggaaatgatgtttatgataacatcactactggtgttatatgcaatggagtgaagagcgtaatcaaggaaggccacaagagctttcccagtggacacacttcatggtcttttgctggtctaggcttccttgcatggtacttagctgggaaactcacggcttttgatcgcaaaggacatattcggaagctatgcattgtgtttctgcctcttcttactgctgcgcttgtggctgtttctcgagtggatgactactggcatcattggcaagatgtatttgcagggggtcttataggtcttacagttgcttcattttgctatctacagttttttccatatccttttgatggcgatgctttgtggcctcacgcatacactgtccagttagccgaggaagggagcagcagaaatacaaactcctacagcgtgagaccagccgagatcgaaacagtcaatattcctggtcacggtgggatcaccctaagagatactctaaatgatatggagtctggtagcggcaggagattgtgaatgagtctggaagttttgaaccatataccatgagagctgcttgcaatatatacacaagtagatctattgtagagctgttgagtgctgccaccgtgataggagagggttgtttagatgggtctgtcactaaattacttggtaggggtgttgtatcttctgacaacctttggcctttctttatactccacctgtggttaaagtttgtttgcttacgaactctttgatgtcagcttggtcgttgcattcagcaaccatgatctaaccatcgtgaattgaaaattttgtcgccaaatataaggggattaatgctgcaaccaaatggaactctctgaggaacaaaattatagagaccggttgtgatatactttgtatccaggaaacaaaaggagaacaattcaatgaaacatacattcgtaacttatgtacaagatccttggacaaattgtatttctgtccctctaatggtgcttctggagaattattactatctggaaaagtttgtattttgatgctaagttgattcaacaaaatgagttcagccacactattctctatcgttgaaaaatgacacaagattggtggcttacaaatatttatgctccctgtacacctgctggcagagaagtttttcttcattggttttctaaccttgaagtgttagccttgatagactctggatcattatcggggattttaatatgattagaattccagaaaaccgtaacaaaccaggaggcgatatccaaagaatgctggacttcaatatggcaattagccagttgggggtgcaagaaatcccactcaaaggacaagcttatacttagttaaatatgcaacgccaccaaaagacctgaaaagttggattggtgcttcgtctctcaggcttggtcaatgcacttctcaaccac

SEQ ID NO: 4512 - DNA, 869 bp, Zea mays
gctttatgtcccctctctctctctctctctctctctcccgcccgggattattgctccctactgtctctggctcggggcttattcattcccgcattctggtaggagacgacgaggcgccgatccgtagcggcgccgagggcgatatcgaggagccgctggtctcacgccgcaccgagacaatggcagaccagttagggtcttacacaattagatcccatggaatgatattggcaagattacacatgtatgactggataatacttctcctccttgctgtcatagacgggctgttgaatataattgaaccatttcaccgttttgttggaaaagacatgatgaccgacttgagatatcctatgaagggcaatacagtgccattttgggctgttccactgattggaattatactgccttgggccatctttgttggaatttacttcaagaagaacaatttttatgatctgcaccatggcatactggggattctatactcagtgctcataactgcagtgattactgatgcaattaaggatggtgttggacggcctcgtccagattttttctggcgctgtttccctgatggaaatgatgtttatgataacatcactactggtgttatatgcaatggagtgaagagcgtaatcaaggaaggccacaagagctttcccagtggacacacttcatggtcttttgctggtctaggcttccttgcatggtacttagctgggaaactcacggcttttgatcgcaaaggacatattcggaagctatgcattgtgtttctgcctcttcttactgctgcgcttgtggctgtttctcgagtggatgactactggcatcatttggcagagatgtatttgccgggggtc

SEQ ID NO: 4513 - DNA, 1983 bp, Zea mays
ctggaacaaaaagaaaaaaaacacgagaaaaatcaaatcaggagacggggattccagagagccccgttcgggtagggaagggaaggagaggcgaagcggaggcgagatgggggcggccgaatccgtgccggagacctccatacacgaattcaccgtcaaggattgcaacggcaaggaagtgagcctggaaacctacaaggggaaggtcctccttgttgttaacgtcgcctccaaatgtgggttcacggagaccaattacacgcagctgacggagctttatcagaagtacagggacaaaggtctgttctgggcccctcgtggcccgccggctgttgttgcccctgaaatgtgaatctctctggaagttggtgcgtagaagtgggtaattggagtagtgcacgttgatgcttgttggaacagtggttcttgtcttctgtttgaagtggaatggcaaaaaatcacgaaaaatattctcctgaaaaaagtgtgcgagtagtcttgcccaagggagattttacattgcttgccacacagcattcataccaaaagctttgtttacctgtagctcatttcttcaactattttcagacatgcatgtgttttatgcagcttagattagataggcagctggtgaagtgcgcatacaatttcattgcattcgcttatcaaatctgaatgatctcccgttttctggagtgcttggatagtagttctaacttgcagataccttttgaggatcagcgaagggttctgaaaggagcctgtgagaaccctgtttcccaaagaagatggtttgtttccttgaggattgttttcccaaatttcttcgacaactaaaattagcttccacctaacattttctggctctcagccaacattgcactgtttggtgaaattaaataaaaattgtatgactgtttggcgaaattaaatcaaaacttgtatggagtttaaaatgacgctagaatgataatgtttttcttgctactaaggccgtctgcagtagtctatccatagtttacccaaaaacattgttttgcactgtagactgtattgttcgcagaggggagtttaaatataggtatggggatgtgtaagctacttgagatagtctaaggcatcaagtactgtacccacttacacttgcagcaaatttgctctgttgtgaattcagtatatggctatcaaacaatcccattgtcttttgcaactatgcctgtgtgtactttgattcagtctgcgcttgatattccattgaaatggttttattctctagatctaacagaaactgattttacttccaagcttgctagacttcgagatattggcattcccttgcaatcagttcttgcgacaggagccaggtactgatcagcagatacaagactttgcttgcaccagatttaaagctgaatacccagtttttcagaaggtgcgcgtaaacggaccagatgcggcgccggtttacaagtttctgaaagctagcaagcctggtttgtttgggtcatcaaggatcaaatggaactttaccaagtttctcgtggacaaagatgggaaggtcatcgagagatacggaacctcgacagctccaatggcaattgagaaggacatccagaaggcccttgaggaataattttggtgagcttgtctcgtctcatccaccacacacttgcagcagaaataggcacttgctgaaatattccgtcgtagtaacattcagaccggacgtctttgcttatctgtagtaaaaattctgtgtaatgtttaccctccttttcgccttccgttcgtgtaagtagaggttgtattaagtagccatcatctgctagcttttgccctttctgtgtgaagaagtgaagacatggtatattgatgcgaaaattctgtgtaatgttttgacgctcgttccggatgacggactggtctcatcgaggctggtcagctggtggtacctgcccggacctgcccgggacggacgatcga

SEQ ID NO: 4514 - DNA, 1088 bp, Zea mays
ctcgaggccggccgggaaaccgtccggcgttctatgaataaccgcctttggggcccccgcgccgctgccccccccattattactggaacaaaaagaaaaaaaacacgagaaaaatcaaatcaggagacggggattccagagagcccctttcgggtagggaagggaaggagaggcgaagcggaggcgagatgggggcggccgaatccgtgccggagacctccatacacgaattcaccgtcaaggattgcaacggcaaggaagtgagcctggaaacctacaaggggaaggtcctccttgttgttaacgtcgcctccaaatgtgggttcacggagaccaattacacgcagctgacggagctttatcagaagtacagggacaaagacttcgagatattggcattcccttgcaatcagttcttgcgacaggagccaggtactgatcagcagatacaagactttgcttgcaccagatttaaagctgaatacccagtttttcagaaggtgcgcgtaaacggaccagatgcggcgccggtttacaagtttctgaaagctagcaagcctggtttgtttgggtcatcaaggatcaaatggaactttaccaagtttctggtggacaaagatgggaaggtcatcgagagatacggaacctcgacagctccaatggcaattgagaaggacatccagaaggcccttgaggaataattttttgtgagcttgtctcgtctcatccaccacacacttgcagcagaaataggcacttgctgaaatatttcgtcgtagtaacattcagaccggacgtctttgcttatctgtagtaaaaattctgtgtaatgttaccctccttttcgccttccgttcgtgtaagtagaggttgtattaagtagccatcatctgctagcttttgccctttctgtgtgaagaagtgaagacatggtatattgatgcaaaacttaacgttggtgaagcatgcaaaaaaaaaaaaaaaaaccgggcggcggactggtctcatcgaggctggtggtactggacggccatgttttgcgccatatcacactgggcgggcttgtgttactggcctgtttctcgtgc

SEQ ID NO: 4515 - DNA, 2323 bp, Zea mays
cattgggtacctcgagcccggccgccacgagggacctcaccgagcacaggtagggtttcggccaccagccatggccgactccgcgccgtccatcccgggcgtcatcgcctccctccaggcctactccacggccctctccgcctttaccgccgcatggcgtgccgtcgagacccacgcctccaccctcgactccgccctcgccgcccgcctagccggcttctcggagctcgagctgatctgctcggcgatggacggagccggcctccgcgcgtacctcaccgagcacagggacgagctcaaggatcccacgcgcgccctcgacgcagccctccaagttgcgcccgacccggggcttctggtcctctccgcggcagcgagtttctgccgcacgctgccggaggtggccaagagcgacggtagcgtcaaggcgtcctgccgcctgctcatcgccttgctcgaccggctgcgcgcgattggtgtcaagccgtcgcctgaggcgcgcgaggaggccagagctgttgcgacggactggaagcgaggcaagcggatcgggacggagacgatgtttaagcaggagacgttcgccttcttgcatctcgtgggagtgtttgggctcgtggaggatgtgggcggtaccagcgaggtgcttgatcttgtcgtgtcgatctcaggtcgtgagcgcgccgttgatgcgttcgtcgtcctgggcctggacctcgaccagcatatgccaatcctcattcagaaaatggtaaacaaaaacaaacagctagaggcagtcaaattcattcaagctcttaatatagcgcacaaatacgctttgttgcctattatgagatcgtacattgatcatgccgcagttgctggtaagatgatccgcatcaggggagatgatcttgctactcagaatgcagctgatgcaaaagagcgcacacttattggaacattgcagaagttcattaaggaacagaagctagaagaactgcccatttttgaagaagctaacaagcgaatggcacatttggatcagcaaagtgctgagagaaaaagaactgctgctgcagcggctgcggctgctcgaaaggttagtaagaacattgaggagcagcagaaaaggatacaggagctgatgcagcctgctaagagaccaaggtctgagaatgtggtgaaaggatcttcgggccagaacgtgaactttgctggaacctctactcaacagtttaagccacaacagagcattcataaagctggagtgtcaaatcagtatcaagctgctttaacccagaatgtactgccagcaatcgctcagatttcacagctagttgctgggagccatcgtccagttggcatcccaaatcaggcccttgctgttccgcctcaatatggtagtggtagtgcaaattattatggagtgacgtccaccaggccatacaggcccatcactctacctcctggacctggtgctttgaatggtccaagtgcgcaggcatcttcaagatcaaggctctattctggagatccccttgcggctgtctcccgatcatcagataagaagggatcgtcttacaagtattctttgtccagtatgtcaacttatgatcgtaaatgaggatttgttttatctgccagtggacgaacctagtgaaccttgaaagtttgggtttcagaccagagatttggtccctccgtagatgttaagtcattgtagctaacaatgggccttttttacagtaaaggatgtgggtttgtatctagaagagattctcctacagagtctaataaatattgtaggaattctaacttataaggacaagttaggtgtaatggtgagagttatcttaccgagccaccagatcctaggtttgaagtagcctcttcctattttcattgggtcatgaatttgtagtatctgtatttgcagcggaaagcttaccttgttttatgccgttgtcgtgtgagtcttcggtagtgagtctaccctttagggtttgttcgattatttccattccatatggattggaggggattgatatggattgtgaggagattttgacttattagggattgaaactcccctcaatcatcctcaatccatatggattggcggttgaaacgaacaagtccttaatgtagtatcgggccatatgggggatttctcttttgattttatctgatccatatgccttttcttgtggtataggggaacggctatttctctgccttctgacatagataggtccatatgggcaatttctctcgatctgattcatatgcttttcttgtggtgtacgggcgggaatggttgtatcggactctgcaggtc

SEQ ID NO: 4516 - DNA, 2620 bp, Zea mays
  misc_feature (2006)..(2006): n is a, c, g, or t
ggtccctcgaggcgggccggccggggaacggcggacgcagtgtgcatgcatacaagcaacaagatactggcgcagaggagcaatgcccggcatggatgccttcgctgctgtgtcactactcgccacactctttctggttcgtgcggcagctgcccatcctccggcggcggctgcggacgccatgacgccgacggactattggcgagcggtgcttcctgggaccccgatgccccgggccatactcgacctattattgaccacatctacaggtgaggaaggctcaaggaaggtcaccacgtcatatgggtaccaaggccaggacttaaggacggtcaccacatcatatgtatctcaagatggtgaagaggacccaagaaaggccaccacatcatatggttcccaggatgaggagggatcaagaaaaatcacaatgtcatatgggtctaatggtgaagaggacccaagaaaggccaccacatcatatggttcccaagatgaggagggatcaaggaaagtcacaatgtcatatgggtctaatggtgaagaggacccaagaaaggccacaacatcatatgggttccaaagcatggaacatttaaggaaggccaccacatcatatggaatacaagatgaagagtatccaaggaaggccaccacatcatatggttcccaagatgaggagggatcaaggaaagtcacaatgtcatatgggtctaatggtgaagaggacccaagaaaggccacaacatcatatgggttccaaagcatggaacatttaaggaaggccaccacatcatatggaatacaagatgaagagtatccaaggaaggccaccacatcatatggatttcaaggtgagaaggatccaagggaagctaccatctcatatgggtcccaggatgatgaggattctagaaaagtcaccatgtcatatgggtctaatggtgaggatgatccaagaaaggccaccacatcatatgaaatacaagatgaagagtatcccaggaaggccaccacatcttatggagttcaaggtgagaaggacccaagggaagctaccatctcatatgggtcccaggatgacaaggattctagaaaagtcaccatgtcatatgggtctagtggtgaggacgacccaagaaaggccaccacatcatatgggtcccatggtgagtatgaatcaaataaggtcacaatgtcatatgggttccaaggcatgaaagatttaaggaaggccaccacatcatatggaatacaagatgaagagtatccaaggaaggccaccacatcatatggagttcaaggtgagaaggacccaagggaagctaccatctcatatggatcccaggatgacgaggattctagaaaagtcaccatgtcatatgggtctaatggtgaggacgatccaagaaaggccaccacatcatatgggtcccatggtgagtatgaatcaaataaggtcacagtgtcatatgggttccaagacatggaagatttaaggaaggccaccacatcatatggaatacatgatgaagagtataccaggaaggccaccacatcttatggaattcaaggtgagaaggacccaagggaagctaccatctcatatgggtccaaggatgacaaggattctagaaaagtcaccatgtcatatgggtctagtggtgaggacgacccaagaaaggccaccacatcatatgggtcccatggggacatccatcaccatgaccatgctgccgttcacatccacagcagcggcaacaagctagcagatgttttcttcttccacgacgtcctacgcccagggtccgtaatcacgccgaccatcccaccgaccaccaccttaccacctctgctgcctcgccgcgaggccgacgcgctcccgttctccaccaagcgcttcgccgacatcctcgccatgttcgcgccgacgacatccgacgccatgggcgaagagatacggtggacgctcgacacctgcgagaaacacgcgcccgctcccccgncgagaaggccgcctgcgccaccttccctcgagtctctcgccaggatacccgccgtcctcctcgggacacgcaacgtccgcgctttttccggcgacatgcccaccgatcctgccggcacgtcggcgaagcgggggcggtataacgtaacggctgtgcagaagctctccgagtcactgacggcggcggcgtgccatgacctgacgtacccctacgccgtgttctactgccacacgaccaacccggcggccacgtacctggtgaagctggcagcccaggatggcggggcgccggacatggaggcgttggtcgtgtgccccctcgacccgtcgttgtggagtcccagacccccattcttggtggcgcacagtctcaagccaggggaccacgcagtcgtgtgccattttctctctaagctcagcatcgtctgggtcccccctggcgagcaggggtggcgtgcgtgaagtgaagcccaatagcgttaagtacccgtgctcagagctctatctgtaacctgtgtggacctaacgtggctctgtaatgctaaataaaacctgcgtcaatccatgtatcgtgtaaaaaaaaaaaaaaaaaaaaaaaaaaaaactcgagagggg

SEQ ID NO: 4517 - DNA, 873 bp, Zea mays
  misc_feature (801)..(801): n is a, c, g, or t
  misc_feature (848)..(848): n is a, c, g, or t
cggacgctggaattccggcagggcggacgcagtgtgcatgcatataagagcaacaagatactggcgcagaggagcaatgcccggcatggatgccttcgctgctgtgtcactactcgccacactctttctggttcgtgcggcagctgcccatcctccggcggcggctgcggacgccatgacgccgacggactattggcgagcggtgcttcctgagaccccgatgccccgagccatactcgacctattgaccacatctacaggtgaggaaggctcaaggaaggtcaccacgtcaaatgggtaccaaggccatgacttaaggacggtcagcacatcatatgcatctcaagatggggacaactcatggaaggctaccatgtcatatgggttccaaagtggtgagggctcgaggaaggtcaccacatcatatccgtaccgaggccaggacttaaggatggtcagcacatcatatgtatctcaagatgaggacaactcatggaaggtctcgatgccatctaggttccaagttggtgagggctcaaggaaggtcaccacgtcaaatgggtaccaaggccatgacttaaggacggtcagcacatcatatgcatctcaagatggggacaactcatggaaggccaccatgtcatatgggttccaaagtggtgagggctcgaggaaggtcaccacatcatatccgtaccgaggccaggacttaaggatggtcagcacatcatatgtatctcaagatgaggacaactcatggaaggtctcgatgccatctaggttccaagttggtgagggctncaggaagctcaccacacattcgaatcacagggaggactcagggaggncacgcatctatggaatccagatgat

SEQ ID NO: 4518 - DNA, 2403 bp, Zea mays
atgaacggcggacgcagtgtgcatgcatacaagagcaacaagatactggccgcagaggagcaatgcccggcatggatgccttcgctgctgtgtcactactcgccacactctttctggttcgtgcggcagctgcccatcctccggcggcggctgcggacgccatgacgccgacggactattggcgagcggtgcttcctgagaccccgatgccccgagccatactcgacctattgaccacatctacaggtgaggaaggctcaaggaaggtcaccacgtcaaatgggtaccaaggccatgacttaaggacggtcagcacatcatatgcatctcaagatggggacaactcatggaaggccaccatgtcatatgggttccaaagtggtgagggctcgaggaaggtcaccacatcatatccgtaccgaggccaggacttaaggatggtcagcacatcatatgtatctcaagatgaggacaactcatggaaggtctcgatgccatctaggttccaagttggtgagggctcaaggaagctcaccacaccattcgaatcacaaaggaaggactcaaggaaggccaccgcatcatatggaatccaagatgatgaggacacaaggaaggccactacatcatatggaatccatggggaggacccaagaaaggccaccacgtcatatggttcccaggatgagaagggatcaaggaaggtcataatgtcatatgggtctaatggtgaggatgatccaagaaaggccaccacatcatatggaatacaagataaagagtatcccaggaaggccaccacatcttatggagttcaaggtgagaaggacccaagggaagctaccatctcatatgggtcccaggatgatgaggattctagaaaagtcaacatgtcatatgggtctaatggtgaggacgacccaagaaaggccaccacatcatatgggtcccatggtgagtatgaatcaaataaggccacaatgtcatatgggttccaaggcatggaagatttaaggaaggccaccacatcatatggaatacaagatgaagagtatccaaggaaggccaccacatcatatggagttcaaggtgaggaggacccaaagaaagataccatgtcatatgggtcacaagatgacgaggaatctagaaaaatcagcatctcatatgggtctaatggtgagaacgactcaagaacgtccaccacatcatatgggtcccaaggtaaggagatcctaagaaaggtcaccacgtcatgtgataggtaccacagttgtgaagatgatgcgcggaaggccaccgcatcacatagagctgaaggtaagcaggacatgaagaagatcagcatatcatatggatctcatcgaagtggggagcactcattgagaaccaccagtacaagagagaaaggtgacacaagtaaaggggacatccatcaccatgaccatgctgccgttcacatccacagcagcggcaacaagctagtagcagatgttttcttcttccacgacgtcctacgcccagggtccgtaatcacgccgatcatcccaccgaccaccaccctaccacctctgctgcctctccgcgaggccgacgcgctcccgttctccaccgggcgcttcgccgacatcctcgccatgttcgcgccgacgacatccgacgccatgggcgaagagatacggtcgacgctcgacacctgcgagaacacgcgcccgctccccggcgagaaggccgcctgcgccacctccctcgagtctctcgccaggatacccgccgtcctcctcgggacacgcaacgtccgcgctttctccggcgacatgcccaccgatcctgccggcacgtcggcgaagcgggggcggtataacgtaacggccgtgcagaagctctccgagtcactgacggcggcggcgtgccatgacctgacgtacccctacgccgtgttctactgccacacgaccaacccggcggccacgtacctggtgaagctggcagcccaggatggcgggacgccggacatggaggcgttggtcgtgtgccacctcgacacgtcgttgtggagtcccagacacccattcttggtggcgcacagtctcaagccaggggacgacgcagtcgtgtgccattttctctctaagctcagcatcgtctgggtccccgctggcgagcaggggtggcgtgcgtgaagtgaagcctaatagcgttaagtacccgtgctcagagctctatctgtaacctgtatggacctaatgtggctctgtaatgctaaataaaacctgcgtcaatcatgtatcgtgatattttatttgttttagcaaaatggtgtccaaaactatagtccaaagtggaggaattcatgttgtgagcactatatttggcacctgaacatggttggacggttcgacc

SEQ ID NO: 4519 - DNA, 3542 bp, Zea mays
  misc_feature (2436)..(2436): n is a, c, g, or t
ctttaaaatggacgcgcacctccacctgggtctgtctgcgcagggacgcggacgcggcggcaccggcaagcaattgtctcatctgctccactccatctccatttaacgcactctccactccttcgcggcgggggtttaggcgcacggcggcaggccaattaacgccgctgcggcgagcgccgggggggaaatgggcggcgacggcacgagggcgctggaccagacgccgacgtgggccgtggccgccgtctgcgctgtcatcgtcgcggcgtccatactcctcgagggcttcctccaccacctcggtcagttgctcaacaagaagcggaagaaggcgctgtttgacgctctggagaaggttaaatcggagctgatgactctggggttcatatcgctgctgctgaccgtgacgggaaggtacatcgcgcgcatctgcatcccggagggagccgcaaacaccatgctgccctgccgcctgtccggtcactcggtggcggaagagcccaagggccatggccgacggcacctatctgaagatccaaccaaccttttttcctgccgcaaaggcatggtgtcgcttgtttcagccgacggcatgcatcagctgcacattttcgtgttcttcttggccgtcttccatgttaccttcagtttcttcacaatgtccttgggtagagcaaagactcgtatatggaaggtgtgggaaaaggaaacttgctcccctcagtataattatttaaatgacccctcaaagttcaggcttacgcaccaaacatcttttgtgaggcaacatgcaagttgttggagcaaaagcacaatcacgctctattttgtgagcttctttaggcagttcttcagatccgtccgtaagacagactactttactttgcgacatggattcatttcagctcatttatctccggggactaggttcaattttcgaaagtacattaaaaggtccttggaggatgatttcaagacagttgttggcattagtccaccactatgggcttctgctttggctgtcatgctgttcaatgttcatggatggcacaacttattctggttctctgcaattccccttgtagttattctagcagttggaacaaagctgcaggctataattgctatgatggctattgaaattgcagagaggcatacagttatccaaggcatgccggtggtaaaactaagtgatgatcatttctggttcgggaagcctcgtttggttctccacctcattcatttcgcatcatttcagaacgcatttgaaattacatatttcttttggatctggtacgaatttggcctgaggtcctgcttccatgacaactttgagtttatcattgcaagagtctgccttggggctatcgtccagtttatgtgcagctacatcacccttccactctatgcccttgtttctcagatgggttcagaaatgaagcgaacaattttcgacgagcagacagcgaaggccctgaagaaatggcacaaggccgtggtgaagaagaaacaccacaaggattcctcacacaattcttccgagactcctagcactgacacaacaggacctgcaggggaagcgggtgagtggcagcggctgcacgaggtgccggtccggcacctccaccggtacaagaccatcgcgcacgtcggcggcgtgaggagcccgttgtcggacccggactacagcgacacggacgacaccgagccgctgtcgttgcagactaggcacctgataccgccggcgaagcagcggagcctcgacaccgagcgcgcggaggtgcgcgtgaacgtcgtagagacagcggcggcgccaagcgacgtcctccaagacagcttctcgttcccaaggctgcttcctcctcgccatgtgccggacaagtaaagtggccagcagtctgcttagtactacagactgtcctatatagagatagtagaatagtagtttcaagttataagtcgatttggctagttatacaacttttgttatttatttagataaaggctatgtctatatagcaaaagttgtaaaactagaaaaatcaaaatgatttataatttgaattgtagtagtatagtagattagtagtcgaatctaacatgcatgagagcattttcttagtacgtacagctgcctgtaagtgatgcctgggtcgatgacttggaatgtctgtcttctggggctaattcagggtttaaagcctatagcctggtacgtagcaaagcctgcataataaaatatcaaaacaagttaaagttaaaaaaaatcaaaccgacgtataataaaatatcaaaacgatttataatttaaaaaaataatcaaagcgagttataatttacaactgaggggatgtgtcgttttgttctgccaagaactattttcaataaaatttgtggtcttagacctctttggaatgcagtaatttaagaggnaccatacagtaatttcacaggaatcaattcattttcgcaataaaaacacacgaaataaaaaattatcctgcattccaaatgagacattaccttttcacggtagatgctgcctttgggatcagcgctaaaacgactcatcttgactcacgtcatcatcagagggaccttttcatagcagaggctgcctttggcatcagcgctaaaacgactcatgtcgactcacgtcattatcagagggaccaacagaccatgactgactaattagggcgtcagatgtatgccttagcaccagcggtccacgatgaccacgattggggtaccaggggcgtgtttggtgtggctttgttccatcttagagcagctctacactaaaactttaggatagaacagttcttttctagagtctagaatgttttctcataaccagtggcggaggcagatagataccttcaaactctatgtctaagtatttttaaggatttcagagtagcaaaaagtattctaaaaatttatactatagctctcaaaactacataaaatatgcaactctagagttaaattgtttgtatgctttagacagctccccttaaagtttggctctagagccatgccaaacacccctagatatatgataatctgattggatccattattagactaggatggaatatggttcacatggcttctaaagtcttaagggtcataagtgttgacaaccattagtagtgtgagggggaagagagcgtttagggtagagttagaaataatgcagtcattgacatagtacatgtaaggaaaatggaccttgaccatttatttagtgattttggtgtttgatgatcaacataaccttttgaactaatgagtttgctagtgtttatgtttacaattcaaaggatgcagagtggacttggaatgaggcaattgaggaaagcaacacctcaaagaagacattagaagacgcattaaagacttaccaacattatgcaaaagttcaaggcacaagacaagaaaatcccaagaaaaatataaagaaaagaagattaggctgaagctaggtgcaccagaccagtcctgtggtgcacccgacctagcaccagactcaa

SEQ ID NO: 4520 - DNA, 1551 bp, Zea mays
  misc_feature (13)..(15): n is a, c, g, or t
  misc_feature (20)..(20): n is a, c, g, or t
gccggcccggaannnaaaanaaaaaaaatgactgagtatgagaacatgaaaaaacctttctcttttctctctctctagtctctccccccggcgcctctgcctctatttcttctcgtcctcccaggacctcaagtccccccctcctcctccccatccccagtccccacacccacccacccggacccggtgccgcgctctgcaggcggaggaagaccagcgacgggcggacgtgcttcatgaggagtgtgccgtgagacaactctgcgagtcaagaacaactggtgaggcgaagcgaagaaagccgagaggggagaccaaatggcaactgattcctcagctctgcaggcttcctctgagtcgattgcgcaaaagatggggttcttcagagtccctgaccttcttgtaaaactgagcgccaaatgtttgagcgatctggatgtggttcgcagcccaacatcgcccttggacctcaagtttttcactggccttggcaacaaatcacccggtgacgccagccagaaccagaagatcttgcttggtgacagggttgggcttggacttgtggattccctcactgatgacaaccccgcaccactaggtggtagaaaggttctttttcttggatctgagatgaggattattgataacctgtctcgcaagaacagctccaccgctcctgatcaagctggggaagttgaacagaaggatgataatatgtctgacggactgatgggcagtgccatgtcccttggtgacatcatcaactcagaggattacactcgtgttgtctcccgtggccctaatcctaggactacccacttttttggagatcgtgtttttgagcttcaagctgagcagctgatgcctgttgagagtaaggtcgatcagagtacgtctcctgtggaagacggtctgatgagcttctgttatttttgcagtgagaagctcaaagaagcggaagacatctacatctatcagggtgacaaatccttttgcagcgtggagtgcagggaaaatttcatggtagattatgagatggaagaagcatatcatcctgcgtctcctaggagcccaccctctgacggtggtcggattttccaactgatccgttgagtcagcatcagtaacaactcgatatggtcatatctgaagtgctgtctgaggttaataagttgcagccatggatgtgatcatgtttgcagtagttgttgcccggagattttgtttgtcgcggcactgatgaatttacctcacctattgatttcttttgttttgcgtacttggatcctcgaatttttggaggagtccaaaaaatgactacctccggtcataatattatcttgatcggagatgagtgtgtgtgtgtgtcctcgcgtctcaacttgagttgtttgcttcgaccgcattttcagtggctcactcatatgtggacgcctcttattaatatcatgtatctgaacctatgttttgatattttctgaaatgaaatggtaaagaataaagttttatgtcaaaaaaaaaaaaaaaaaaaaaaaaaaggcccctagggcc

SEQ ID NO: 4521 - DNA, 1694 bp, Zea mays
cattgggtacctcgaggccggccgggaaaaaagggtatagattaagttcgtcgaaaaaaaaaaaaaaccctcctccgccccctccccagtccccacacccacccacccggacccggtgccgcgctctgcaggcggaggaagaccagcgacgggcggacgtgcttcatgaggagtgtgccgtgagacaactctgcgagtcaagaacaactggtgaggcgaagtgaagaaagccgagaggggagaccaaatggcaactgattcctcagctctgcaggcttcctctgagtcgattgcgcaaaagatggggttcttcagagtccctgaccttcttgtaaaactgagcgccaaatgtttgagcgaactggatgtggttcgcagcccaacatcgcccttggacctcaagtttttcactggccttggcaacaaatcacccggatcatcctccgttgacgccagccagaaccagaagatcttgcttggtgacagggttgggcttggacttgtggattccctcactgatgacaaccccgcaccactgggtggtagaaaggttctttttcttggatctgagatgaggattattgataacctgtctcgcaagaacagctccaccgctcctgatcaagctggggaagttgaacagaaggatgataatatgtctgacgaactgatgggcagtgccatgtcccttggtgacatcatcaactcagaggattacactcgtgttgtctcccgtggccctaatcctaggactacccacttttttggagatcgtgtttttgagcttcaagctgagcagctggtgcctgttgagagtaaggtcgatcagagtacgtctccctgtggaagacggtctgatgagcttctgttatttttgcagtgagaagctcaaagaagccgaagacatctacatctatcagtaagtgatccagtttagtagatgaatcactgctatggatgttgttttttttcattcttgcataggcctgccgttctatggatggttgtttgatgtttggtatcctgtgtgtcgattgcaggggtgacaaatccttttgcagcgtggagtgcagggaaaatttcatggtagattatgagatggaagaagcatatcatcctgcgtctcctaggagcccaccctctgacggtggtcggattttccaactgatccgttgagtcagcatcagtaacaactcgatatggtcatatctgaagtgctgtctgaggttaataagttgcagccatggatgtgatcatgtttgcagttgttgttgcccggagattttgtttgtcgaggcactgatgaatttacctcacctattgatttcttttgttttgcgtacttggatcctcgaatttttggaggagtccaaaaaatgactacctccggtcataatattatcttgatcggagatgagtgtgtgtgtgtgtgtcctcgcgtctcaacttgagttgtttgcttggaccgcattttcagtggctcactcatatgtggacgcctcttattaatatcatgtatctgaacctatgttttgatattttctgaaatgaaatggtaaagaataaagttttatgtcacttgttgtgtgacttgtgtcacttgatttcacgatatggggcctacattattaaataaggcgtctcttgacaagtttcttagttgatggcaaaatcaaaagacagatttttttacg

SEQ ID NO: 4522 - DNA, 1983 bp, Zea mays
cagctagcgtggtcgcggccgaggtacgcggggcaagagttcaagctgaaatgaaggctgctaatgttcagcatccaatagtttgcattgatgttattaaagaaggaataatctctggccctcgtgcaggcctcatgaaggaagtgctctctgggaaaatgcttgagcagtctcaaacaagcaaaagcttaaggcactttttttttgctcagcgtgccacttcaaagattccaaatattaccaacataggtttgacagcacggaaaattaaaaaggcagctatcgttgggggtggtctaatgggatccggaattgcaacaatactgatattgaacaactttaatgttgtcttgaaagaagtaaatgaacagttcttatctgctggcattaacagaattaaagtgaatttgcaaagtcttgtcagaaagggtcaacttactgaagaagattatgaaaagaagctttctctgctatgtggtgctcttgactatgaacagttcagagatacagatgtagtaattgaggcggtaattgaggatatggtgctgaagcagcaaatattttctgaccttgagaagtattgccatcataattgcatatttgcaacaaacacttcaacaatagacctgaacataattggtcagaagacagcttctcaggaccgcattgttggtgcacacttctttagtccagctcatgtcatgtcactgttggaaatagtttgtactcatcatacttcctctcaagttattgtggacctgattgatttggcaaagaaaatacagaaaacaccaatagttgttggcaactgcacaggtttcgctgtcaaccggatgttctttccttacgctcaggcagcttcttttcttgttgattatggtctggatgtgtatcacatagatcatgtgatcacacaatttggaatgccaatggggcccttccgattagccgatcttgttggttttggtgttgctattgctacaagaaagcaatattaccaaagttatcctgagcgaagttacaaatcaatgcttcttcagattcttgttgaggataataggacaggtgaatcttcttgtaagggcttctatgtatatgatgataaacgcaaagcctctcgagatcctgattttgggaagtacattgaaaaatcaaggaacatggcaggtgttatgcaagatcctaagctgatgaaactaacagataatgacatcgtggagatgatcttctttcctgtggtgaatgaagcctgccgagtgcttgatgagggaattgctctcaaagcatctgaccttgatgtagcttccattatggggatgggtttcccttcttacaggggtggagtaatgttttgggctgactcgcttggtgcgaaatatgtgtatgacaaactggatgcatggtcgaaggattatggggagttcttcagaccctgtgaatatttagctgtgagagctcgtcagggtgcatccctggctgccaaggttgatggtgtcaaatcgcgactctagggttttgttgttcatttgtccggacatgcttatacggactttggcctcaatgacattgagatgttgtgaaaacccttgagcaccaactgttacaatcatgcagttgcaaaacctgcacaagtgaattatacggaggcctagcgaagtggaaattgcatgtgccttcgtgggattgctgaggatctgcagcaggaatttctctgaaatattatgtgcagttttctgaagtgatgctgacaactttgcatagaatagttacagggagtttctcctagacgttttgcgggaatatactttgttgcagtggattcttatttttttaaaaataaaactcgtgaaatccatggtcgtatgtaccacacaagccccctcccttttgaatatttgtcattcgctagttaattttttaactaaaacacgataaataaaaaataacggagggaatacaacatttcagttcgatcatctgctc

SEQ ID NO: 4523 - DNA, 2558 bp, Zea mays
gtatccagccggcatgttcgtcctgcgaatccagtccgtcgacttccccgacgccgccgtggcagcagtcgccgccgacgaagtcggcaccagcagcggcggcgttaccacctctcgtccgctctccagccaccctcccccctctaccaccacatcgtccatacttactctcgagctccccggcgcaaaccccgtcgcgcccagccgaagccctaggatcctccacacccgcggcgtcatccacctctaccactcgtcgtcctccacttccacctcctcctcctacgcctcggcggtcgcagccacctcttcctcctcatccgggccggccaccccgcagcccgcctccgactcgcacctgcccctatgtcgcggcacgcgcctcctggtgctcgccgttccgacgcgcgtttcgccggaggactttgttcgcttctgcggcccccacctcgagtgtgcagccgacattcgtttcatcagggatgatggagtggaggaccgggacagcgttctagtggagcttgaggaccagagtagcgctgaatggttctacgccgatctcaatggctggaggttctcaacctctgaggtgtcttatcttcttaattgaattctagtttattcgctgatcatatttgagatcgttgctaaattggcgattaactctcgtttccatggtgtagagtgaggtgtgccatgttctgtttatagctgctgtgcagtatacaccttcctcagaggttgccacaactccaccggctggatccactgaacttccaatgtgtcctgtttgcattggtgaacttactgttttgtattttttttttgtattttggggcctctgcaatacaatttatagtcatatgtacgtgtcaccatggtgtcacatttgaattcaatttgtgatctccgttgaagagatttaggcacctctgttctatcctggccatagttttaactttaaataccattctgtttgatgcaacagcaacccttcatctattattttcacttttcatattttgttggttgtttaagttgtctgccttgtttctggtacacctaactattttctgccatcttaatatgttaatttgtcagaaagattggatcaggacatcagtgggattttggcaactacttgtgatcactctttccgttgctcatgtgtttcagtgtggaccaattcatcctgtccggtatgccagttttgtcagaagcagtctgaaaattctacatgttctgtttgccaaaccactggaaacctctggatatgtgtgatatgtggttttgttggatgcggacggtatcaagaaggacatgcgaaacagcactggaaagatactcagcattgctattcgctagatttggaaacacaacgtgtttgggactatgttggtgacagttttgtacatcggctgaatcaatccaagagtgacgcaaagcatgctaagttcaaatcaaaaagtaaatattctggggatgaatgtgtaaactgctcgtgcaatgatgactctgatatgggtggagctatgttcagcagcaaagctgaaacaattgtggacgagtacaatcgtctcctggcaagccaacttgaaactcagagagagtattatgagggcctgttgtctgaggctaaaagaaacaaggagcaccagatttctgaagctgctgataaagctgtaagtgataagcttgaagagatgcaacttaagctcgagaatcttattgtggagaaaaagaaagttgcagatatgaacgaaaaactcactaggagccaagacatgtggcgccagacactaagagatatagaggaaagggaaagagcacagttgaagtcgaaggatgaaatgattctcgatctggaagaacagataaaggatttcaaattttccatcaaactgcagaagtcaatagagaagaacgatggtgtcaagggtggtacgctggttccactccctacggtttcagattctggaggcaagggtaaaaggtcatcaagaacaagcaagaggaggaattagtatcctttgctgagtagcaattagtcttgactggaacagacgtatacgaaccttattggcatgtatttactagcctgttatgatgaactacagcgtgatgtttgatttgtcacgaaaattagtacgatcataaactgcttcgaagatttgaacttggatactacatgtggaaaatcccctctaaatcgaagtacagccagttatttcgtaaccacatatagccaaatcttgaagcgtttcctgtcaaacggtagaatacaaacaagattgcacatgaaactttgacagccagttagtcactccatggtttcagaacaagcacataaccatggtttcagaacaagcacatgaaggatgggatcatcagatgtctgagtcgtgcgtcgttcctgccccctccgcgcgggcgcgcgccgctcacctgcacccagtaaatattagggacaatccctgtatggcatcaggaattatattttgtgccactggctctacatgtcatccacgtaataaatatctcctatatgctattcaatg

SEQ ID NO: 4524 - DNA, 1949 bp, Zea mays
  misc_feature (26)..(26): n is a, c, g, or t
  misc_feature (36)..(36): n is a, c, g, or t
ccacgcgtccggcagcaggagtggcnacatatcagngtccagcaggtgtagttgctgctgcgggagatgccttacgtattttcaccattgaacgcctgggagagactttcaatgcgaccgcccgcccgcgccggtacaccccaaggaagtttgtgattctaccaaagaaaaaatacattgctgtcattgagagtgacaaaggtgcattcagcgcagaagagcgagaagctgctaagaaagagtgccttgatgcttctggtgcagcggagaatggaaatgcgaataatggcgatcctatggagaatggtgatggtcaagatggtgccgaggagggcaacacatttcctgatgaacaatatggttatccaaaagctgaatctgagaggtgggtttcctgcattaggatcttggatccaaggagtagggacacaacctgtctgctggaattgcaggacaatgaggctgctgtcagtatctgcactgtgaatttccatgataaggagcatggaactctactggctattggcactgccaagggtttgcagttctggccaaggaggacccttgctggtggattcatccacgtatataagtttgtggatgaagggaggtcacttgaacttctacacaagacacaggtggaggaagtacctcttgcattgtgccaattccaggggcgattacttgcaggtgttggttcagtgctcagactatatgatctgggtaaaagaaaattgctcagaaaatgtgaaaacaagctttttccgaggacattagtatctattcatacctaccgtgatagaatctatgttggcgatatgcaagagtcatttcactattgcaagtacagacgagatgaaaaccaactctatatatttgctgatgacagtgttcccaggtggcttacaacagcacaacacatagattttgacactatggctggagcagataagtttgggaatatatattttgctcgtcttcctcaggatatctcagatgagattgaagaagacccaactggaggcaagattaagtgggagcaagggaagttaaatggtgcccctaacaaagttgaggagattgtgcagtttcatgtgggtgatgttgtaacgtgtttgcagaaggcctctttgattcctggtggaggtgaatgtcttatttatgggactgtgatgggcagtgtgggagcactgcttgcatttacctccagggaagatgttgatttcttctctcacttggagatgcatctgcgtcaggagcatccaccattgtgtggaagagatcacatggcttacagatctgcctattttccagtgaaggatgtgatagatggtgatctctgcgagcagtatccctccctcccagctgatatgcagaggaagattgctgatgagctggacagaactccgggtgaaatcctgaagaagctagaagacatcaggaacaaaatcatctaaaacagcggcttagtgtgaagaaactaggcagggcagtgccggtgctctttgctttaagactgtatccagttcgagctgttgccgcacttcaagatgtgacagcagcgcatccaacaagtttggagcacgctgatctgtacgatctttcctgatgctatctggtccagtcggcgatttattgctgagatagagcatgtacggcaccagaatgagtttttttgtatctcgtagaagtgatttagctgatgtcgttgactgtttacttggcttgatgtaattgagtgaagttattcatgttggattattcgtgtagtacggggttaccttggtaatgtactaccacaagggcttggttgctaggaagggaattggagggttccaattaagccttcaatcctctctaatttcctcccaaacaagccctaacagatttttgaagcgcagagcgttgctcccgcgcagatgcgttgctgtcaaaaaaaaaaaaaaaaa

SEQ ID NO: 4525 - DNA, 3734 bp, Zea mays
gagggccacttctgtttctctgctcctttgccccctccttcctgccttcccgtcccgctgcgtggcgtctgccgtctccgtctggcgtggctcggtacgggtagcggggtaggtaggctaggccgaacgcagtctcgcaccgcgccggcatccgaatccgacgcacacaataatatgcacggatcggacgggagcgtgcggccgtgacaactgtgtccgtcacacttacacatgggtcgcgccagtacagtgcacagcacagcttgcaagcgcgtcccgggaccatgtgatagtagttattaacgtgcgtttcgtttccaaataaaattatatccactttttcgtgtgaccgcaaatgaaaagcacgtcccccattttataaagttatttatctatttaaaatgcaatacctttttaaagtaagcgtttattttgggttctgtttgtaccattgtgtgttcattatgttgagatctataaaagtaggtccacagtgcctatgttttgaagcagtttaaatgtgattataaagttttgtatggtacattttttttgaaatatgatagtaactataaagtcctagaaccaggtgtgtccaaagtttcgaatcacaaaaatctcattttagatgtacagagttttggatgttagggtgaaattggaatagactaatactacccccttcttaaatatatgacgccgttaactgtttttttttaaaactttgactactcgtcttattcgaaaaaattgtgaattatcatttattttgttatgatttattttatcacttaaggtttctgagcatgatttaaaattttacatttttgaataaatattttaaataaaacgagtgtcaaagttttttttaaaaaaaagtgaatggccttatttatttaagaagggatggagtttaaacttcctgaatttaggtgcgaagttttagattatctaagatgcaatataaaaattcatggatctgttggcccaagcatttccacgtttatttatggttgacaggtaataatagatcacaatttaatagaagaaatgatttacgtctattacttgtgcattaataattatactccacatttaactgtgcctgtatgtcgctccgcatttaaccgggtcagggcgcaactcatgcgtcgctatgagcgtacgtacaagcgcggagtaatagagtcggttccggtgccgcgtgcggcgtgcctgcccgagccgtgaagccgtgtcgcgccgacaagttgggtcacggccagctcgccccctgaccttccgcctccctgccaggtgccagctcgcacagttgcacacccacaaaacgcgccggagacaacgcacgtaactgccgagaagccgaagtccgaacgccgcccaccggcatccgccaagtgcggccgtttatatacttgcacgcctcccctcccctccagcctccccttgcacgacgtctccaccactacaccacacctcaagtccacaacaccaccagcctcgtctcagccgcttcagcataccacaccgcacgcaaacccaccgcgcgctacgaccaccaccgtcaccatggccgccgcgcgctacgacgtggagaagggcgggaggaataacggggatgggaagccttcgccgccgccgccgggccacctgtacccgcagcgcgacggggagagggagtgggtgccgtggttggtgccgctcgtcgtggccgtcaacatcgtgctcttcgccgtggcgatgtacgtcaacaactgcccggcccacgccgcctcgtctcgccgcggcggcgccggatcatgcgtcgcccgcgggttcctccaccgcttctcgttccagccgctcagcgagaacccgctcctcgggccctcgtcggccacgtgagtgctcaaggccccctagatccgtttcctgccttttcttcagttatcagtgttgcgcatcttctccgttagatcggtcggtatcacatagatagagaaaaaagattccataaccgactccgccctagtatctctgattgttcttccattcaaggattacaagtttatttttcccacagtaaacgctactcgaaattgttcgcatgccatgtgtacgatttctcatatcagaccaccgccaccttcttccccgcaggctgcagaagctgggagcgcttgtatgggacacagttgtgcgggagcaccaggggtggaggctcgtcacctgcatctggctgcacgccggtgttgcccacctcctggccaacatgatcagcctcgtgctcatcgggctcagactggagcaacagtttggatacggtaatgcgcagctagctgtaggaacttattaacctactcatccccacccagtatggccggatcatgtactaggagggctttatctgatctggatgtgcgttcccgttttcgttgcagtgagagttggcatcatctaccttgtctctggcgtcggaggcagcgtgctttcgtctctgttcatcaggaacaacatctctgtcggcgcttccggagctctgttcgggctccttggggccatgctgtcggagctcttcaccaactggaccatctatgcaaacaaggtgatgcatagcttccctcctcggtcctaaacatcgcaatgtggatctttgggcagaaaatgtgggttgggaattaaatcgcagctcactgaagttgtaacgtccaatctgcaggctgcagccctggtgaccctgctggtcgtcatcgccatcaacctcgccatcggcatcctcccgcacgtcgacaacttcgcgcacatcggagggttcctcaccggcttcctcctcgggttcgtcttactgatgcgcccgcactacggctggatgcagcgctacgccctgccctccgacgtcaagtacaccaccaagaagtacctggcctaccagtgggctctgctggccgtggcctcggtcctcgctgtcatcgggtaagcatcgcatcacatgctggtgcctcctctttctgagagtaggagtacgagtactagctcaaatatcttaatgctcgtgccataatgctaatctaatgccatcactgtcagctttcgtctcaccaccccaaaaggaaaaaaataaagttctctcactttggtcggtttgactgaatttaaactcatgtgttgcacaggttcgccgtacggctggggatgcttttcagaggagtgaacgcgaatgatcactgcggctggtgccactacctcagctgcgttccgacctccagatggagctgtgggaagtgaagatcggcgtgctgacaaaatggacttgaagccaggatagagcccatggccgcccatggggccttttcgagcaagcatttccatgaatagatagatatacagctcgcagtcttactgtacataatgtcaccaggatgtggtttatatatgacattatttatgctatctgattgatcgatgattcattctatttattcagcgagtgaaaattgaaatgccttcaatctttcgcctgccaggctgccagctatatttcaaaactagatgcagttgtgttgttatcaactcccccgttcttttttatttatcgtcatttagttaaaaaataaactagtgagccacaaagaaggtagacctgtcaaccacaatcggccttccatgattactgtggttatttcataatataagttatgtgatgctggttttcatctctggtacttcatttggtgttctattatttattgttttgg

SEQ ID NO: 4526 - DNA, 1425 bp, Zea mays
acctcgaggcccggcccgcccgacgtctccatcactacaccacaagtccacaagtccacaacaccaccaggcaccagcctcgtcacagccgcttcagcataccacaccgcacgcaaacccaccgcgcgctacgaccaccaccgtcaccatggccgccgcgcgctacgacgtggagaagggcgggaggaataacggggatgggaagccttcgccgccgccgccgggccacctgtacccgcagcgcgacggggagagggagtgggtgccgtggttggtgccgctcgtcgtggccgtcaacatcgtgctcttcgccgtggcgatgtacgtcaacaactgcccggcccacgccgcctcgtctcgccgcggtggcgccggatcatgcgtcgcccgcgggttcctccaccgcttctcgttccagccgctcagcgagaacccgctcctcgggccctcgtcggccacgctgcagaagctgggagcgcttgtatgggacaaagttgtgcgggagcaccaggggtggaggctcgtcacctgcatctggctgcacgccggtgttgcccaccttctggccaacatgatcagcctcgtgctcatcgggctcagactggagcaacagtttggatacgtgagagttggcatcatctaccttgtctctggcgtcggaggcagcgtgctttcgtctctgttcatccggaacaacatctctgtcggcgcttccggagctctgttcgggctccttggggccatgctgtcggagctcttcaccaactggaccatctacgcaaacaaggctgcagccctggtgaccctgctggtcgtcatcgccatcaacctcgccatcggcatcctcccgcacgtcgacaacttcgcgcacatcggagggttcctcaccggcttcctcctcgggttcgtcttcctgatgcgcccgcactacggctggatgcagcgctacgccctgccctccgacgtcaagtacaccaccaagaagtacctggtctaccagtgggctctgctggccgtggcctcggtcctcgctgtcatcgggttcgccattgggctggggatgcttttcagaggagtgaacgcgaatgatcactgcggctggtgccactacctcagctgcgttccgacctccagatggagctgtgggaagtgaagatcggcgtgctgacaaaatggactgaagccaggagagagcccatggccgcccatggggccttttcgagcaagcatttccatgaatagatagatatatagctcgcacagtcttactgtacataatgtcaccaggatgtggtttatatatgacattattttgctatctgattgatcgatggttcattctatttattcagcgagtgaaaattgaaatgccttcaatctttcgcttgccagctatatttgaaaactagacgcagttgtgttgtt

SEQ ID NO: 4527 - DNA, 1675 bp, Zea mays
cccgaatgtggaggagaacctcaagcaccgcaaggaagaagagtccccgcagtctcggggctcgcaggaagggtgctcgtcgtcgtcgtctccttccgcctccgccgctggcaaggagatctcgcctccgcccgccactccgcggccacagcagcaggcgcagtcggcagccctgccgccgccgccgtcgccgtcgccggcttccaccagccgcgaggacgacccgtgccggaccgcgcactcaggctcgtccggcaaccagtcccccgaacccgctgcgagaaacgctccaccgtcagaggctagctccccaggaccgtcggagtacagagtctgcagacccgtcggggctcaggacgcggccacacagacagacgacagcgagagggacgctgctgaaaaccatagtactcgcgtggccggagcgtccaccatggacacgacgtcggatgccgagatccaggaatgccaccggaggagctcgccgctgtcacccaaggtacccgagaccgttcgtgagtcaccgccggccgtgtgctcctccgatgctgcttcgcctggtggcagagtcgagacgttggagtccctgataagagcagaggccagcaggaggagtagcttcaggacattggaggagggacacatgcttggcccggtgggtgtcaaactgaagccggccaacttgctgatgcagcttatcacgtgtgggttcgtgtctgtgaaagaacaccgaggcttcgggttcatcccgacgtacaggcctcggtttacgcaggtcgagttcccttctccggtgttctccactcccgtggcgttgcggcaccttgacagaatcccttgcaatacaaaagcaactgggtcgacgagagctccggagccggaatgtttcagcgggagcttggttgttgagacgaagcagcaggacgagcccgggagagggatcgcctcactcaaacgctcgtcatcttacgacgaggatagagtgtacagagcagcacatcccaaaagcaacacggaaagctcctgtgaggcaggtagtttcaggtgcctcccacagaccatcaggatcatatcgtgtaagcagtcgaggagtggaacagtactctccccccctgcctctgacgtgagaaacggctctatccaacaagaacacagtaccatgtcctcaccgctgggctcatcgaagagcgcgagcaacaggatggccgatccgtcgccgccgggcaaactgtcttgtgcgagagccgagtcgttgttccgcgaggagaaggacatgatcaagatcgaagaaaggcttccttctggagctcgggtcataatccagtccgcgccgttgtgtgaagaagaaagcgacgacagcagcgaatgaatcacattgtaagggtccgtgttacatatgtttttgttttcttttgttctttttttttcatttcgttttgctgaggatgatggcatctgcgtgcgtagcttttggagtagagggttcaaaggtattgattgattctgtaaaccgtgtgaatgtgatagtccgggcgttttctcacacctcgaagaagagaatagtttgcctttgcttatttttttttttataaaaaaggggcccgcttttgtgtatcttaggcatacagttttacttgctttgtttttcttcaagtaaataagcatggattgtttt

SEQ ID NO: 4528 - DNA, 2002 bp, Zea mays
gccagcaggaggagtagcttcaggacattggaggagggacacatgcttggcccggtgggtgtcaaactgaagccggccaacttgctgatgcagcttatcacgtgtgggttcgtgtctgtgaaagaacaccgaggcttcgggcgccgcccgacgcgcccgccgcggtttacgcaggtcgagttcccttctccggtgttctccactcccgtggcgttgcggcaccttgacagaatcccttgcaatacaaaagcaactgggtcgacgagagctccggagccggaatgtttcagcgggagcttggttgttgagacgaagcagcaggacgagcccgggagagggatcgcctcactcaaacgctcgtcatcttacgacgaggatagagtgtacagagcagcacatcccaagagcgacacggaaagctcctgcgagccaggtagtttcaggtgcctcccacagaccatcaggatcatatcgtgtaagcagtcgaggagtggaacagtactctccccccctgcctctgacgtgagaaacggctctagccaacaagaacacagtaccgtgtcctcaccgctgggctcatcgaagagcgcgagcaacaggatggccgatccgtcgccgccgggcaaactgtcttgtgcgagagccgagtcgttgttccacgaggagaaggacatgatcaagatcgaagaaaggcttccttctggagctcgggtcataatccagtccgcgccgttgtgtgaagaaagtgacgacagcagcgaatgaatcacactgtaagggtccgtgttgcatatgttttttttttcttcttttgttctttttttcatttcgttttgctgagggatgatggcatctgcgtgcgtagcttttggagtagagggttcaaaggtattgattctgtaaaaccgtgtgaatgtgatagtccgggcgattttctcacacctcgaagaagagaatagtttgcctttgcttaattttttgtttttttaaaaaaaggggcctgcttttgtgtatcttaggcagacagttttacttgctttgttttttttcttcaagtaaataagcatggattgtttttttcttcttcttcccaaatatcaagcaaatagaaaaacaaaaacaagtcgccctttccggactacaaaccctagaccataaaaaaaaacaagctgaaaactgttgctatgctaagcagcaccgtaccaatatctctggatcggtccttgttgtgaaggtggtagcatggccagatagatatctaaatccttttcacgagagcttggtacgtgaaaccttgatagtactgtactagtacgtacagtgttacactattcctggaccacttgaaacggccttcgattgggcagcgcgtacacgtccggatctgagtgagaagtgggtgggggaggatgccgttgcttctgttcttatgtgggacacacacacacacttggcctgctgccattgttgaccttgctgcagtgaatccctaaaggcaaatcgtaaatgctgctactgaactggtcgtttttacttgtcgtgatgctgcatggtggtcgttttcagtttcagtcacggatggcctgttgttagttgttaccgactgtactgtctgtggttggcgttctggatggtagtagtgttgttgtatccccctttggattggctgggcactcatctcatcagttgattttttttgttttcttcattcgttgggacttgagagggtgtatgcatctgtctgcgggcagtggatctgatctgataatgctgctatggcgtggagagcgacgtgcccttaggaaacgccagatgtgtatgctcttgctgaagaaacaggcagttaagtattcttgtgcctgtgttgctctgctaggggtggtaggagcgtggcatcctttgtctgtgttgagtgtgagatgtatgtgcttgcgtcttccagctgtagacggtgaatacctaaacagaggccgtggaaagctgctgcagtatcgctgacccc

SEQ ID NO: 4529 - DNA, 1154 bp, Zea mays
gcacgagggttttctgggaatttacgtcgggatgaccgtgatagcagtcgtgactgctggagaatgtctgatggaaataatttcagagttcgaagcaagaattttgtatatgataaaagcaagattcctgcaggaaagcctcttatggagcttgtcgctgttgactggtttaaagatgcaaagcgaatggatcatgttgctagaagaaaaggctgtgcagttcaagtagcggctgagaaggggctctttgcattggctataaatctacaagttcctggcactacaaactacagtatggttttctactttgttacgaagaaactgataccaaactccttattgcaacgctttgtggatggtgatgacgaatttcggaatagtaggttcaagttgataccatcagttcctaagggctcatggattgttcgacaaagtgttggcagcactccttgtctattaggaaaagctgttgacattacctatatacgtggctcaaattatttagaaatagatgtggatattggctcgtctacagtggcgaatggagtcttggggcttgtgtgcggtgtcataacgacactagttgtcgatatggctttccttgtccaggctaatacatacgacgagctcccagaaaggctgattggggcagttcgtatgtcgcatattgagctgtcatctgcaatagttcccgtgctcgaggattaatcataatacgcgatactgcatgcattgggcccgacaggattatgccggtctgctgagatcactgacagtgtacacaatgtagtaggaaacatagttctcgacttctcgtgccatcttcctgaggacctttctatgcgatcatgcatgcattgcgtatttagacgtgaactatgtaggctttagaatgggttgtgttggggaaaagaaaggagagattagaagaggtaggaatagaggcactagtgacccaaactgaggtttcaataaatggtacgtacatgcttaacttgagagaccacaccattcttcattgatagtatttcccttgtgtgtaatgttgtgacagccgtatccctgatatgtatttatgtaactcaaaagtgtttattggaatcttgtgactactataaggttggttggtgccgcgtttctcgaaaaaaaaaaaa

SEQ ID NO: 4530 - DNA, 1192 bp, Zea mays
  misc_feature (4)..(4): n is a, c, g, or t
  misc_feature (1161)..(1161): n is a, c, g, or t
  misc_feature (1164)..(1164): n is a, c, g, or t
accntttttttttttttttccttttcctttttttttttttttttttttttttttttttttttttttttttttttaccaagaatcacttgctattaattaataatcaaatacatttttcccatgagtaataatgtacaatgcatctatatatattatgtttaaagctagaacagagaaagttaaactgcttgctagtcctaatccaatgtcagcaggagaaacaagactttcagtcttcaggtagtacttacaccgattagagatccctagacccattctgacaaggtaaacaaaacttggtcgcactcgcaaagaacagcgaatctatactcccttccacccccatatgagtttagttgatgaagtatgccgcaccaagagcatcttgtgcagaaatcctctgtgaaggattaaggatcaacattcgttcaattaattcaacagcaggacagtcaaagttctgcaagatatctctcaggcttcgtttggtaggagtcgcaggacggatagtcattgtcttatacaatggtagcttggaaacacctggccagctttcctcgtttggagatccacacagttcaaatatttttgataactgctcttgctcagttctgccaggaaataatggtttcttaagtaaaaattctgcaaatatgcaaccgacagaccaaatatccacaggttcagcataacttgtggcaccaagaagcaactcagggggtcggtaccataaagtgatgacatgatttgttaaagttccgtctctagtgaacagccttgcaaggccaaaatctgcgagttttaacaacttaccaccagttattagaagattagcccctttgatatcccgatgaagtacattgttggcatggcagtactgcaatccaaatagcagctgccccatataaaccttgacttgggatggggcactatggtgcaatactttcttcaaatcatggtccatgtattcaaacaccatgtagatatctcccctatagatgtgatcatctgatccgcctgttccatgtgcagaaccaggagatactacaatctctttcaatctgatgatgttctcatgatccagcttttgtaatagtttaatctcacgcaagatttggcgtggaaacccttctttgccatcattcaggtatatttcttaanttntccgcggttttgtatttgggaacgtgga

SEQ ID NO: 4531 - DNA, 1411 bp, Zea mays
aactcctttcccccctcccccgttcccactttattgtgtttaaacatgagtaataatgtacaatgcatctatatatatattatgtttaaagctagaacagagaaagttaaactgcttgctagtcctaatccaatgtcagcaggagaaacaagactttcagtcttcaggtagtacttacaccaattagagatccctagacccattctgacaaggtaaacaaaacttagtcgcactcgcaaagaacagcgaatctatactccccccacccccatatgagtttagttgatgaagtatgccgcaccaagagcatcttgtgcagaaatcctctgtgaaggattaaggatcaacattcgttcaattaattcaacagcaggacagtcaaagttctgcaagatatctctcaggcttcgtttggtaggagtcgcaggacggatagtcattgtcttatacaatggtagcttggaaacacctggccagctttcctcgtttggagatccacacagttcaaatatttttgataactgctcttgctcagttctgccaggaaataatggtttcttaagtaaaaattctgcaaatatgcaaccgacagaccaaatatccacaggttcagcataacttgtggcaccaagaagcaactcagggggtcggtaccataaagtgatgacatgatttgttaaagttccgtctctagtgaacagccttgcaaggccaaaatctgcgagttttaacaacttaccaccagttattagaagattagcccctttgatatcccgatgaagtacattgttggcatggcagtactgcaatccttttagcagctgccccatataaaccttgacttgggatggggcactatggtgcaatactttcttcaaatcatggtccatgtattcaaacaccatgtagatatctcccctatagatgtgatcatctgatccgcctgttccatgtgcagaaccaggagatactacaatctctttcaatctgatgatgttctcatgatccagcttttttaatagtttaatctcacgcaagatttggcgtggaaacccttctttgccatcatccagttttattttcttaagtgctgctctttccccagtaataatatccacagcttcaaatacctcaccgtaggtgccctcgccgatcttgcggatacgcctgtagcagtcgacggtgcgggcgccggcgggggcgtactcagccaggttgagcgcgccaaggggcgcctcctcgccgtccatatatagccggaggccgcggcggtgtcgcgagagtgagccggctccggtagaacctccggaggcttgggcagcagggcagacgacacgaagcggaggatgcggaagccgcaggaggctagagtcgggagtgtcctacgcaagtcaaagcgacccagtcgtat

SEQ ID NO: 4532 - DNA, 851 bp, Zea mays
tgacactatagaagagctatgacgtcgcgtgcccccggaggtgggcgagacaccgacacatgtgacaagcctcatctcagccgtgcaggaccaagtagttttgcttcactccggcattccatccatatccatccatcagaattctcagtctccacagcagcaaggcgcacgaccagcaccagcagccggcaacaaaagacacagcagcgatggcgttcgtgccggtgtgcgtgcagtgcgggacgcggagcaacccgtgccggtgcaaggtggtcgggccgacgctggggttcgtcgcgttcgtggtggccggggtcatcgagtggccgctgggggccgccgtgtacctgttccgccaccgcaagggacgacgcatcatggcgcacccggccaccgtcgtgtacccgcgcgttaccagggccatcccgatctaatcggccgaccgatcagccaggtcgcggtttcatgtccgggtttgtgtcgccaacgtactgagatgtcgtcagtccaaatttgtgaatccttttacacccgcctgcctttctttctcaataagagtcgcaaatgtgtgtggtttcagtttgcgtacatttgtactccgattgtaagcatcgccgtcaatgtacgtaatactatgtatgtcatctcagtctatccgagtaactttctattactaactccattcttgagttaaaccaccgcgacgaataagacagaacggagggagcgtgctgtctagtttgccctgaggtcctttcatcggaggatctttttaccgacctaaagctcagatagcaagaaacagaatcccgtcccgttatacagaagaggatcaacttaagagcctgcag

SEQ ID NO: 4533 - DNA, 1586 bp, Zea mays
attcctcccccgactctcccctcttctgcctagtcctcctgtcctcccctccccctccgacctccacggtttcgcaggcaaagatgaagaaggcgtctgcggcgtcgcgctacgcggcctacgactccccgtccccgtctccttcgtcgcgccgtgcggcgccttccgcggccgccgcgaccccgggaggagcgcacggcagcagccgcgcattggtggtcgcggggagatctggccgcgatctactgggcgccaagccgcagccgcaagcccacggcaacctgggttccgtactacggcggctcatctccatggacaagaagccgcccaagaaccagctcccggtccctcctgccgccgccagcgcagcgaagaacaacggcggcgggaagctgccggggctgtcgcggaaactattccagaaagcctcgtccacagcggcggcggcgccaaggaagacgaaggccctgacagaagtcaagaacagcggcaacaacgccaacacgcggacgctcgccatggtgctgcgcaccgagcgggagctcctggcgcagaccaaggcgcaggaggacgagatcgccgcgcttcgcctgcagctcgagaacaaggacagggaggtggagcgtctcaaggacctgtgcctgcggcagcgagaggagatcaggacgctcaaagacgccgtcctgttcccggacgcggagccggagcccgaccgccgcctccgggacgagatttccacgctcaccgatcagatccagtgcctcgcgcaggagctcactcaggttaaggctgagaagcactcgacaagatcgtgctttgacgaggatggatactgctcttcccctcggacgccggggtttaacgaggagaccgctttctctctggagtgcagcattggggaagcagagacgccgaactatggtagcccagatgaaatgttcagcaaggatcttaatccttgtctgaccccatgcattgccaagagcaaatctgacgtatccgcacaattccagtcttcctcccagttcacaaaggaatctagcagttcttatcgcagcagcggcaaggcaagggcagaccgctcttacagttcttttggcaggccaatgtcaaagagctctgatcatcacaaacctgcctcaggaaccagcaacaagcgacgagtatacaaatccaaccaagacaaaatcaaccagaacctgttttgagctcaccatcatcgtgaacttgccaccgaaggcagcctccagcttctgctatgtgaaatatttagaagaatgtggacttttatggtctatggataccgcgtgagaaataacaatgctcatggtctatcagtgaatgcaatctttggtttgtgcttttttttgtgttgttctagcttgcccagctgtttggaataccagtttggctctgccatgccatgattagatgaatgtgcagaatcttttttattttcaaaactggttacgaagatatttgggtcacggcctatgtcttattagctgcatatggaccatatggcaatgtgatatatcatactatgcatgctatagcatgtggttttgtgaaaaaaaaaaaaaaaa

SEQ ID NO: 4534 - DNA, 954 bp, Zea mays
  misc_feature (20)..(20): n is a, c, g, or t
  misc_feature (936)..(936): n is a, c, g, or t
gtaccctcgagtcggccggnagacctgggggccctccgggccggccgcgctgcctcgtccggtcctctcggctctcggtgtgggaagggaaccaaaccgagacggaggcggagtacgacgcctgccttccctcttccgccgagcgcccgctgcgtcattctcgtccctcctcttcatcttcatcggccaaccgattgccgctgaccccggccatcggcgactgtcccccggtttttctttaacgatttccgattcgattccatggccggctggaccgattccaccggcagcggcggccgaggatcaggaggaagaggcttcacgacaccccgctatactactaattccaccaatgacatgatccatggaggtaccagcggcggaggcggaggtagcggcaggtggagaggaggcaggtcaagggggtggccgcccccgcagcctcaccatcgctaccgccgtgtggatgccgttcatcgtgactccgcgcctgtctctctatcggagctacaggcggcctcctccacatccagccgccaccggtaccttactcgttccatctcagcggacaagtcttccgcctcgggaaccgcgggttcaacagataccagggagcctgacgacaaggctaaccgcagcgctgccaactttgagtgcaacgtctgctttgacatggccgctgaacctgtggtcaccaggtgcggccatctcttctgctgggagtgcctctatcagtggctccatgtccattctcaccaccgtgagtgccctgtctgcaagggtcaggtagctgatgatgctatcatacccatctatggggcgtgggggatccgcagcctctgtggacaacgctccccccggggccactggagccagagtagagagcacaaggcagcaacaacaccggctgccaattttccatcctccccaagggtntttgaattcataaggcct

SEQ ID NO: 4535 - DNA, 3553 bp, Zea mays
gctggagacagtattataccgtatattaggattgatggtcggccaatacctaactcatatatcgtggcgtacctggcctagcttgccgccagcttcgggccttgtcgtgctcggacttttagcgcggcccagaagtcacgcctatagaaacagccggcctcgagcggtcgcctccctgcctcgtccggtcctctcggctctcggtgtgggaagggaaccaaaccgagacggaggcggagtacgacgcctgccttccctcttccgccgagcgcccgctgcgtcattctcgtccctcctcttcatcttcatcggccaaccgattgccgctgaccccggccatcggcgactgtcccccggttcgtaccttctcctccttgatccccttttcttttattgctcctcgattccaaaaatctaatttagtacccccaatctccgaaccctaatcccccgcatccctcctcctcgatcaccacgtaagcaggcagatggatggaggatacgtatacgcgcagattacaccacaacataatttcctttttaggcttagatgtttcgtgttcacctcagctcagctctaacgaatcttgtttctcttccctaggtttttctttaacgatttccgattcgattccatggccggctggaccgattccaccggcagcggcggccgaggatcaggaggaagaggcttcacgacaccccgctatactactaattccaccaatgacatgatccatggaggtaccagcggcggaggcggaggtagcggcaggtggagaggaggcaggtcaagggggtggccgcccccgcagcctcaccatcgctaccgccgtgtggatgccgttcatcgtgactccgcgcctgtctctctatcggagctacaggcggcctcctccacatccagccgccaccggtaccttactcgttccatctcagcggacaagtcttccccctcggggaaccgcgggttcaacagataccagggagcctgacgacccggcgggcccccgcgctgccaactttgagtgcaacgtctgctttgacatggccgctgaacctgtggtcaccaggtgcggccatctcttctgctgggagtgcccctatcagtggctccatgtccattctcaccaccgtgagtgccctgtctgcaagggtcaggtagctgatgatgctatcatacccatctatgggcgtggtggatccgcagcctctgtggacaacgctcccccaaggcccactggagccagagtagagagcacaaggcagcaacaacaacagctgccaattttccatcctcccaatgtttttgaattcataggccttggcttggccgctgcagccagaggagagcactccaccgagcagctgctgctgccaactttctcccaccccacggtgtttgatgatgacgacgggcatgaatgggacatggatcttgtgaacaacggcattgatcctttggacctcataactcccggcacccaagacttggacatggatgattatgatggcactattgatttcgatgatgatgattatgaatatgactaccatttggcgggtgctacgttgtttgcttctgctgggactgaggccagcaatcccagctcttcacaagcacatgctggtatgatcaatattagggacaacattcttggcactgccaccagcatctatcatcagcaagagtttggctactctggcgtgagacctcataataacaggggacggcgccggcaccgtaatcgcgcaagggcatcagcaaatcactcaggcgctgatgaaatggtgatcgaggataccagtcatttctaccttcagaacggtggcagttctaacattagtgcaggcgctgcttttcggcccaacggtggctggactgggagaagaggaagaagcaacctgaactcgaattcaggtggtggaagcaacctgaactcaaactcaggtggtggaagcaacatgaactcgaattcaggtggtggaagaggagggattcagggtaccagaagacagaggacaaattacaactgatagtgatgttgggacatgcttcgaaataggagcgataactgatgagataaacaaacttaatcctttgtcttccattttttttctttgtttctctcgtattattaatccttttgtagcctgtggctattggcaccttgtcaaacatcttctctccgtttcccctgaattgttatgcctggttaatgttacttatttttagtaccatcatccacaaagtatctgttaaatatagtattctggttaagttgcggaaaaaaaaaaaaaaaaaagcggccattgatgctggcggcagtgctgaaactgtctaagcaattgtatcaagaagcatgagtattcaaatatttgtagtatgctataatgttggaattaagaaacagtttatttctcttgcacgcgtatcatagccaatttagaagtttggaggaactaataagttatataataaaattcgcaaacattggaatgattggtttatttcggtgcctgactacgccacaccaatacattacagaggaacattacaacgcatgcattgccggtagatggatactctagggtctaggcaaagctgcttgaaatgcagatgtactaactagttgtcgtctccgtaggcgagaaaccggtagcgctcctcgtacgggccgtcgaagtagaggtcggcctcgaaccagcgcgggtacctgaccagatccccggccacgaagtgcatgtagtcgtcgccgtggacagcgccggcggggatgaccttcacctccccggacacgatgtacacgagctggtcgacctgccagtcccacggcatccggcaccggccacccgtgcgccacgacgaccacgtctccatgacccgcagcgcctccatccgtgcccgcgccacctcgcctcgctccacgcgcaccttgtacacgtcctccatgggacgccccagcagcgcgccgccaccgcctgctgccgccgccgctcgtatccttacacctcttcggctactgatgctaggaagactaggaggcagcctgtgcgccgcggggagcacgagatggaacccgccggtactggcggcggcgggcctcatcgcgggtaccctatccgtctcctatcctttcctcttcggcttgggctttgggttgggtttggcctccgtccctgtcctgtctgtttcccgagtagagaacaagaaaatcgtaggccaccggcggccctgcttgtcagtgaagtattttctctttttttatagaatattatagtattgaagatactgtagtatttttttcttatacagtgtttggtagtttttttaaaaaaactctgttttcaaaactgtagttttgactaaaatgcagtactttcacaattttgtaaatatagcttctgaccaaagattttaatgctacggtaaaaaattgtgggtatgtattggcattttaaaactattgtattacaaaactgtagttttcaaatactttattcccaaacatggccttatcctctattcctcatatccatgctctgcttagag

SEQ ID NO: 4536 - DNA, 764 bp, Zea mays
acgattggccgcggcccacacacactacagcaactaggtccaacaggtaggcaaggccctctccggtcacaagcctccacagaactctccccgactttgccgtccactcccccgccgcagccgcgccgttcgccgggacaggagggatagtagagcaccaggatgccggcgacgccgacgatcatcggtgccctcctggggctgggcacccagatgtactcaaacgctctccgcaagctcccctacatgcgccatccatgggagcatttgttggggatgggtctcggtgcagtgtttgtgaaccagctggtaaagtttgatgagaagctcaaggaggacctcgacaagatgcttgagcgcgccaggctagccaacgagcagcgctacattgacgatgatgaatagatgcccagatttatttgccagcgacctgtattttttttgcaacatgttgtcagtacacatggccaggactgatgatcccccatcgtcttagttctctcagctttccgcatttcaactgtgatcttgtaataagatgtcggatctcatggattaccaatgtaatacaccaattatgggttcttgatctgatggttggctttctctgataaaattactcaattaaaatgattgtgtttttgcaaaaaaaaaaaaaaaaaaagcccctaaaaaaaactcaacgcgttcgccgccatgtacggccacatgccgctcgtagccaccacagtcaaggccgtggacagccgcgggagctggttctg

SEQ ID NO: 4537 - DNA, 667 bp, Zea mays
gcccccgcggcagctcgcgccccggtgacaactgacaagtccccacagcactctccccgaccttgccgtccagtcgtccaccccaccgccgcagcctcgccccgaggagacaggagaacagcaggatgccggcgacgccgacgatcatcggcgccctcctgggactgggcactcagatgtactccaacgccctccgcaagcttccctacatgcgccatccttgggagcatgtgttggggatgggtctcggtgcagtatttgtgaaccagctggtaaaatttgacgagaagctcaaggaggacctcgacaagatgcttgagcgcgccaggctagccaacgagcaacgctacattgatgatgatgaatagctgttcagatttgtttgtcagtgacctgtatttttttgcaacatgttgtcagtacacatggtcaggactgtggatcccccatgacttagttgttgcctcagcttccacatttcaactgtggccttgtaataaaatgtcgttgcccaatggatctgatggatcacaattgtaagctacaaattatgggctttgaatatgatcgcttactttctctgatgcaaaattactcagttatagtgactgtgcttttgcaatgccaacttttttcttccaaaaaaaaaaaaaaaaaaaccccccta

SEQ ID NO: 4538 - DNA, 2168 bp, Zea mays
cttgctgcctgcagcagtcccctgaaacttgtctacggttgtagtacatattaatcagcaaattatttggacaaactgacgccgcgaccctttttttaacgggttgtcgcgatatacagggtcgttcctgacttttcggaggaccagtgcgaaatccgatttcgaggtctatccacacacaaatatatataattatacatatattatcaaatattcgacatataaaaattattatgtactattttgaagtttacaagataacaaatataaaatatagcaaaaaacacttgttatatgatattattaaaaatatcttttaatattttatgatacaaagtcatctcttatatcattgagattaatctcatccaacaaatttttttcgatatatagaatcaccaagccatttaacatctcttgagttattgttgataaaaaaatagttcacaaaaatatttcaattttaaaaagcttctctctgccaaagcaaccatcatatgtatagtttataatactctccctatatcaaaatagaatttgttttgcttctttagtggatttatcatcatcaatataaacataaaaattaagaactaaaacaaatactattttgaaacggatgggtattggataagtaattgagacagtttaagaatataaacgagactagttgatagctcgataacgcatcacactttacgtatttgtgtctataatagataagtttaataggaaaaaatactaccgtacagtggctacggggccctctatttttgggggcccggtgcggctgcacccttggcacccccacagggacggccctgcttccgggcagcgtactggccatccagttccggcacggcggcaccctctttatataccccgcccgaccctcgacgccggccgggagtcgccctcttgggccttggcttggcttctaccctaccctgcaaacacacgctctctcctccctcgtggcctcgtcacttcttctcgcactcgtgaaacaacaacaaaaaaaggttcgattttttcccccttcgatcgatggagaacgcgccgacgtcacacgctcatggcgtcagcctcgacctgcgcctggacccatctccgctccatcgctccgccgcggtgcccgtgcccgcgccgcccttcgctgccgaccaccgcccgggggaggccttcgcctgcaactactgccaccgcaagttctgcagctcgcaggcgctgggcggacaccagaacgcgcacaagctcgagcgcaccctcgccaagcgcagccgggacatcctcgccgcgcctccaccgtcgtccccgccaccaccggccccggccgtagccttccatgctgccgcgccggaaagcaacagaaggagcgggctcgtgccgaccgcgtactacggcgccacgaggctcgcgagggaggaggacgccatggcgcagcaggcggcgccaccgggcttcgcgatgggctggggtgcagacactgcggccgccgctgatggtggctgcggccgcctcggcctcggccacggccatggccagagcggggaggagatcgacttgtcgctcaagctctgagcagatgctttgcatgcttagcttgttgattagttggtgcatgcagcatatatctggcgcgcgtacgtccgtccaattcatctcattctcaggccgatccggcgcaagtcgtgttagaatttgctagctagcgggtagccttctcttggatcagcagctggtgctttgagctctgactagaatacgtatgtgtatatatagctggcctctatatataattcatgcaataaccaaaaaaaaaaaaaaaaatagcgaagcgcctaagccattccatatatacggtctcgattgtactatcatttatctatctacatctatatatatatcatgcatggacagcatgctcaaaaacaatgtacatatagtacaagtatattgacgaatctagcatatgtattatgctctgtatctctctatctactcatgctatccagtgcaatctgctctatttgaacgtccatgttcattttttgaggtagctaaatttgtatctccacacgtatacgaacaaaaggcccaccaccaagcaactgaagagtttcaccgggcgtctgtcctggtctgttcacaaggtgctgtggtccatg

SEQ ID NO: 4539 - DNA, 4088 bp, Zea mays
caacttttttccgatatataaaatcgtcaagccatttaacatcttttgagttattgttgaccaaaaatagttaaaaaacatttcaatttttaaaagcttctctctgccgaagcaaccatcatatgtatagtttataatactctccctatatcaaaatagaatttgttttgcttctttagtggattcatcatcatcaatataaacataaaaatcaagaactaaaacaaatactattttgaaacggatgaagtattcgataagtaattgagacagtttaaaaatataagcgagactagtcgataactcgatagcgcatcacttctttacgtatttgtgcctataatagatgtgttcaatagaaaaaatgctaccatacaatagctgggggcctgtatttttttgggcccgtgcggccgcaccctctgcaccccacggccacaggtacggccctggccacccatggccgccatgggatccattatataatgtgtgtgtgtttgtactatccactgcaccggcgagacgcgacggcgagtgctctccacttgtagcatccactcactcaactctccactccgctgatgatgatgcataagaagcggcagctctgagcccaagcgtcgattcagctcagcgcgcagctcacttcatccggcgtcgattcagctcagcgtaccagttggggctgcctctgacgcccgcgatcatgtttcccgccgcgccgttcggggccatcagcctcttgctgctggcgtgcgccgctgcggctgcggcggcggacggtgagcgtcgaccgtacatcgtccgcatggacgcggagaagatgccggcgccgttcgtggagcacgaggggtggtaccgctcggtgctgtcgtcgctgccgtccggcgcggcgccgccggttcacctgtacacgtacacgcacgtcatgcacgggtttagcgcggtgctcaactcgcggcagctggaggagctcaagggcgtggacgggcacgtggccgcgttcccggagacgtacggccggctgcacaccacgcacacgccggcgttcctcgggctggtgagtggcggctcgggcgtctggccggcgtccaagtacggcgacggcgtcatcatcgggatcgtcgacacgggcgtctggcccgagagcgagagcttcagcgacgccggcatgggccccgtcccggcggggtggaagggcgcgtgcgaggccggccaggcgttcagggcctccgcgtgcaaccggaagctcatcggggcgcgctctttcagcaagggcctcaagcagcgcggcatcacggtctcgcccgacgactacgactcgccgcgggactactacggccacggctcgcacacgtcgtccacggcggccggcgccgccgtcggcggcgcgagctacttcggctacgccaacggcacggccaccggcatcgccccgaaggccagggtggccatgtacaaggccgtgttctcgggagacacgctggagtccgcgtccaccgacgtgctggccgccatggaccaggccatcgccgacggcgtccacgtgatgtcgttgtctctggggttccccgacacgtcctacgacaccaatgtgatagccattggggccttcgccgccatgcggaagggcatcttcgtcgcgtgctcggccgggaacgacggctccgacgggtacaccatcatgaacggcgcgccctggatcacgaccgtcggcgccgcgagcatcgacagggacttcaccgcgaccgtcacgctcggcagcggcgcggccgtccagggcaagtcggtgtacccgctgagcacgccgaccgtcagcgcgagcctctactacggccatggcaacaggagcaagcagaggtgcgagtactccagcctgagaagcaaggacgtgagggggaagtacgtgctgtgcaccggcggcccgagcaccgagatcgagcagcagatggacgaggtgcagagcaacggcggcctcggcgccatcatcgcgagcgacatgaaggagttcctccagccgacggagtacaccatgccgctggtgctggtcacccagccggacggcgcggccatcgccaagtacgcgacgacggcggcagggtcagccagagccggaggaggggcgcccagggcgagcatccggttcggcggcacggcgctcggcgtcaagccggcgccgaccgtgtcctacttctccgcccgcgggccgggcctgatcagcccgacgatcctgaagccggacatcgtcgcgccgggggtggacatcctcgcggcgtgggtgcccaacaaggagatcatggagctcggaaggcagaagctctacaccaagtacgcgctcgtgtccgggacgtccatgtcgtcgccgcacgccgccggcgtggccgccctcctgcggtcggtgcaccctgactggagcccggcggccatcaggtccgccatgatgacgacggcgtacgtgaaggacagcgccagcaacgtcatcgtcagcatgccgagcgggtcaccgggaacgccgctggacttcggcagcggccacgtcagccccaacgaggccgtggaccctggcctcgtgtacgacgcggcggccgacgactacgtcgacttgctgtgcgccctacgctacagcggcagccagatatccaccatcaccgggcggccgaaccccagctgcgccggagcaaacctggacctgaactacccgtccttcacgatcatcctcaacaggaccaactcggccacgcacacgttcaagagggtactcacaaacgtcgcggccgcaccggctaagtacagtgtgtccgtgacggcgccggcagggatgaaggtgacggtttcgccgacggcgctgtccttcggcggcaagggcagcaagcagccgttcacagtcacggtgcaggtcagccaggtgaaaaggaactcaaatgactacaactacgctgggaactatgggttcctgagctggaacgaagttggaggcaagcatgttgtcaggagcccgatagtctctgcatttgcccaatgaccggggaagacatgttagcaatgcacgaacaaaaaaaaagactataaggtagaaaagataattattatatttacgattcatcctgatcaggaacattgagaaatatagatagactgaacaaaaggtggggagagcctcgacagatactgcagttgacaagtgtattttatatctgataaatcaaattatagttttctcaaacattatttttacactgataaatcaagtgtattttatacctgataaatcaaaaaaaatgcaaaatcctactcattctaaacttataccgaaggtacgaagtcattgtcccctgaacaacacgtgcaaatggttatccatatcacatcaaagtcgtttgtcacccacagttaggttcttcaccatgttgttgatcatactaacactatagaccgtcaagcatggattaggtattgttctgctgacagcatcaagtctgagatgatagtatgataccaacaggtaatgtctcaccaggtacccaaaggctcatgaagttttctgaagccttaaacactgataccagtacacctgactgatgatgacattgacagtgcactgtgcacggacccatggaatacgatatacgacagtcatcaatcacatgttttcgtggttcatcatggcacattgtttcagttgttactggatccaacatcagccattaccaccataaactgtacagtcatgcactatgttacagtctcagcacatgctattttgcatcagcagttacaaaacttacttgcatggttactttcctggtacccacttgatttcaaatgtttttcatatatgtcccagactagatggtataccagttgatatttatgaccaacactaccttcatgtcaattgcggaaggcgacccaatgattttcttatcatgacataagaggccagatgaagtccaaagcaacagcaaccatgaagtgctcgactagtcactgtggcagatggtgtccatgtactcaagaaccaagcaattttcttatgctaaggctgtatatcaggctcttaaatggtggacataacaagaaattacaca

SEQ ID NO: 4540 - DNA, 1338 bp, Zea mays
agagccccgcgcccctccaggcccgccgtcaacctcgttctacccaccagccggcacaaattctccctttccacaagaacatcacacggcgatagcaaaaccttccgtcggaggatggcttccgccggcgctggagaaggcaaggagacggggacggctgccgggagcagcctccacagcaagactctcctcaagagccaaccactgtaccagtacatactggaatccaccgtcttcccacgcgagccggactgcctgcgggagctccgcgtcgccaccgccacccaccccatggcgggcatggctgcgtcgccggacgaggtgcagctgctgcagctcctgatcgagattcttggcgccaagaacgccatcgaggttggcgtcttcaccgggtactcgctgctcgccaccgccctcgccctccccgacgacggcaagattgtggccatcgacgttacccgcgagagctacgaccagattgggtcgccggtgatcgagaaggccggcgtggcgcacaagatcgacttccgcgtcgggctcgcgctgcccgtgctggaccagatggtggccgaggaggggaacaagggcaagttcgacttcgcgttcgtggacgcggacaaggtgaacttcctcaactaccacgagcggctgctgcagctgctcagggtcgggggcctcatcgcctacgacaacacgctgtggggcggctccgtggccgcgtcccccgacgagccgctctccgagcgggaccgcgcgctcgctgcggccaccagggagttcaacgcggccgtggccgccgatccccgcgttcacgtctgccaggtcgccatcgccgacgggctcacgctgtgccgccgcgtcgcctgatccgtatccggttatccgcctcgaaatacagcagagctgtgggctgtcgctgacactgctgtgagctctgtgcttgaaatggccatggtctgtaataacgaactgggcttgagcgaaaataaatccaccagcgcgctagcgtgtgtcagcgaccaaaaaacaaaaaaaaaaaaaaaattggctggggtaacggcagtccagctacgccagtgacgagccggcaccttcttcccggcggtgagggcctttggcggcttggcgcatggcggcatgggcgatgtgtatgcagtatgtgccgttccgtaccacaattaccgttgttcctgggccgtgaatgtacttgggcttcagaccgttccgtaccacaattaccgttgttcctgggccgtgaatgtacttgggcttcagagtgagcggagcgacggcgagcccaaccacttcttcgtgcgggctgatcgcggtaacagccgt

SEQ ID NO: 4541 - DNA, 3026 bp, Zea mays
gtccatttcctacttgcaccggagcgagcagcgcgcgggcgcgagccaaccgcgagcccccaagaaaaccacaaaaagaagcgagcatgcctcccaacggcagcactgctctgctgctcctcctgccaccgctgctgctgctgcgttccttcgccaatgccggctctctggatgccgacgtcgcggctctgtcggatttcaggctcgtcgcggacccgtccggcgccgcgctggcgacctggaacgtgtccgcgaacccggcgccgtgcgccggggcgtggcgcggtgtcacctgcgccggcggccgcgtcacgaggctggtgctcgagggcctcggcctctccggcgccgccgcgctgccggcgctcgcgaggctggacggcctccgcgtgctcagcctcaagggcaacggtttctcgggcgaaatccccgacctctcgccgctcgcggggctcaagctgctgttcctcgcggggaacgagctgtccggcgcgattccgccgtcgctgggggcgctgtaccgcctgtaccggctcgacctgtcgtccaacaagctgtccggcgccgtgccgcccgagctcagccggctcgacaggctgctcaccctgaggctggactccaaccggctcagcggcggggttgacgccattgcgctgccgaggctgcaggagctgaacgtctccaacaatctcatgtccgggaggattccggcggcgatggcgtcgttcccggccgcggccttcggcgggaacgtcggcctgtgcagcgcgccgctcccgccctgcaaggacgaggcgcctcagccgaacgcgtcggcggcggtgaacgcgtctgcggctgggcgcggccctccggcttctgccatggtggcgtcctcgccttcgggtaagccagcgggcgccgaggcggcgagcggcgtcaaggggaagatgagccgcgccgccgtggtggcaattgtggcgggggacttcgccgtggtggggctcgtggccgggctcctgttctgctacttctggccgcgcctctccggccggcgaagcgcccggcgactccagcagggggagaagatagtgtactcctcgagcccctacggcgccgccggggtggtcgcggcggcggccggtggctcgacgttcgagcgagggaagatggtgttcctcgaggacctgagctgcagcgacggccgcacgaggcggtttgagctggaggagctgctgcgcgcgtccgcggagatgctggggaagggcggatgcggcacggcgtacaaggccgtgctggacgacggcaccgtcgtgaccgtgaagcggctgcgcgacgccgcgacgccggcggccgcgtccaagaaggacttcgagcaccacatggccgtgctcggccgcctccggcaccccaacatcgtgcccctcaacgcctactactacgcccgcgacgagaagctgctggtgtacgagtacatgcccaacggcagcctcttctccgtcctccacggcaagtcatccgcttaacatctccgtcgtgtcttgataaaggaatccccttgataaatgctgactttgaagcgttattatggttggtcaggtaaccggggccccgggcgcacgccgctggagtgggcggcgcggcttcgcatcgcagccggcgccgcgcgcgggctggcctacatccaccactctgggcggcggggcagcggcacgccgaagctggcgcacggcaacatcaagagcaccaacatcctgctggacaggttcggcgtggcgcgtctcgcggactgcgggctggcgcagctggggtcgtccccggccgcggcggcggctcggtcggcgggttaccgcgcgcccgaggcgcccccgccgccccggccctgggcgtcgcacaggggcgacgtgtacgcgttcggcgtggtgctgctggagctcctgacggggcggttcccgggcagcgagctgccgaacggcggcgtcgtggtggagctgccccggtgggtgcagtccgtggtgcgggaggagtggacgtcggaggtgttcgacctggagctgatgaaggacaagggcatcgaggaggagatggtggcgagcctgcagctggcgctgagctgcacggccgcggcgcccgagcagcggcccaaggtcgggtacgtggtgaagatggtcgacgaggtccgcgcgtgcggggagacggcgtcgccgtcgcacgagtccatggacgagtcctccggcgtctcggactcgcccgccgtgtcggagggcggcgcgctcagccagtgagggcgcggcctggcgctgctggtccttcttcggaattgccttgtgatgcgtgcctatttgtttggtttaatctgctcttgttttttttgggggtgggctggattagcgagggccgttggatctggtgatcggcgtgtgcgtgtgtgtacattgttcacgttggctgcttggctctggattcttgttcctgtttttaactgactctagatccctagagtagctgcggctgcggcggcggcggcggttggtttggttgcgataaaaagttgtgctaatttgcgtgagtggatcaagacgctgtgttctggtgcatcttttacggctacagttgtgttgtcacttttggcactagtaaccatgtccttgccttttaaactgcactgattcaatcacggcggctgctaataatgtgttcaactgatgttagcagggcatcgtcagaactcgcatgcctgtgtgattgactagttaagtgcgtaccgtactgagaatgattggatatggtaatgattttattactctgattaatcagtccgggcctccggggtgcagtgcagcaggcccaacgagaacgagggctgctgtgggcggaccgttgggttgggtccgcggaacggacgggacgagtgagaccggcgtcagcgggtaatgatgacgggcgctagggctacgggatgcatgggcgggacccggggccgttgcggcgtgtttttatttttttggcacatcctcatcgacttgtctccatctcatgggctgcag

SEQ ID NO: 4542 - DNA, 1881 bp, Zea mays
ccggccgggaatttgtacgaggcccatcccccacgacaaatgaaaaccctaatctccagcaccccagcggccgccagcgctcccgctccttgctcgcctccacccgcggccaccaccgccctgcggcccccgccgcttgctagcctccaccgcgccgcgagtcacgccgttcatgcaccggctggtcctggagcacgggaggacgagcatgtcctggttcggccccagccccaaggtgaccatcgtcgacccggacctggccaaggacgtgctgtccaacaagttcggccacttcgagaagctcaaggtcccggcgctgtccaagatgctgggctccggcgtggccagccacgagggcgagaagtgggtcaagcaccggaggatcctcaaccatgcgttccatcttgagaagctcaagcgcatgctgccggcgttttctacgtgctgcgaggagctggtgagcaggtgggcggcggagtcccttggctccgacggctcgtgcgagctggacgtctggccggagctgcagaacctgacgggagacatcatttctcgcaccgcgttcagcagcagctacagcgaagggagaaggatcttccagctacaggtcgagcaagcttcgcttgtcatgaccaacattcggaagatcatgatccccggctacatgtacttgcctaccgcgaacaacaggaagatgcgcaggaacaacagggaggtggagtcaatcctgcgagagataatcgggaagaggatccaggcgatggaacaaggcgagggcaccaaagacgacctggtgggtctactgctggagacaaacatgagagacgacatggggatgacgatcgaagacgtgatcgaggagtgcaaggtgttctacttcgtcgggatggagaccacgttggtgctgctcatgtggacgatggtggtgctcagcatgcacccggagtggcaggaccgcgcgagggaggaggtgacggctctgttcggcagggacggcaagcccgagtatgacggcctaagccgcctcaaagtcgtgaccatggtgctctacgaggtgctccgactgtacccgccggccacctccgtcgtccgacaaacgtacaaggagatggaggtcggaggcgtcacctaccccgccggcgtgatcctggagctgcccgtgctgctcatccaccacgacccggacatctggggaggcgacgcgcgcgagtttaggcccgataggttctccgagggcgtgtccagggcctccaaggaccccggcgcgttcctcccgttcggttggggcccgcgcatctgcatcggccagaacttcgcgctgctggaggccaagatggcgctctgcatgatcctccagcggtttgagttcgggctcgcgccatcctatgctcatgcgccgcataccatgataaccttgcatcctatgcacggtgcgcagcttaagctcagagcaatatgatctcgacacgatgggtgtcccatcgttgatgccattgttatgtataaccttacaattcagataggcattcggccctgttaatgtctgaaataagtatcttcgcgttggcattttgtaatgtgcttttcacgtaccattggtgctttattgccttttgtatataaacatgtggatatatgtaactcatacattacacaaacaaacacaaacacaccagagccagagctatagggtggagctataaaccgtggctctacttttgtacacaaaactggctccacatgttcttccaatcctgcaactgcgtttttcgcatccccgtttggtacagcttctccggctcttcctgtgttcttgatccctttgttccctttgatttcatctccgctcactttctttctgttcgattttgacgcctgcag

SEQ ID NO: 4543 - DNA, 2283 bp, Zea mays
gcacgagaccattacctagaacatcctaatcgaaaagaaaaaatcacttcgcctccgccctccaggcttcctcggctcctcgcacccccacccagcggtgcctccgtgccgtctcccaccgctgctcgggcttcccgcggcacagcccggcttgcctccgccactccgtttcccgccgcaccgccatccgaatccgccgcagcctgctccctgctatcaagccacgttgcctcgctcatcttccgccgccgcagggatacagaggagagagagagagggagagaaaatatgtcatcgaagaagaactactataaggagaagttgatgcggcggaaagaggagaaaaaagaagagcctgagacacccaggtaccgcgatcgtgctaaggagcggcgtgaagatcaaaacccagattatgaacctacagaacttggttcgtttcatgcagtggcacctcctgggaatgatttgaggctggcagatgctcacaagatctcaattgagaaaagcaaatatctcggaggtgatttggagcatacacatctggtcaagggcttggactatgctctacttcataaaatacggagtgaaattgaaaagaaacctgaggcagaggatgggaaggatacaacgtcaagggcagcaaaagaagatcaggcagtctccttccgcaccgcaactgcaaagtctgtgtaccaatggatcataaagcctcaaagcataattaaagagaatgaattgtttcttcctggccggatgtcatttatttacaacatggaggagggagtaaccaatgatattccaacaactcttcataggagcaaagctgattgtccagttccagaggagatggtaactgtcagtgtggatggttcagtacttgaaagaattgctaaaattatgacataccttcggcttggatcatcagggaaggtcttgaagaaaaagaaaaaggagagagatataaaagggaagagcaatttggcaagtggtgactatggcgagtcagtaaaaccttcccaaactaatggttctactctgaaacatcaatcagatatgccaccaccaccggctccaccccctcagaacaataatttcaatgggaaggagaaacaaccagtccctgtttctagagaagatgatgatgacatttttgttggagatggagttgactatttagttcctaacaaggaaatgagtcagagccctgtctctgatatggatgaatccccacataaccatcagaagcagtccaatttcactgaaccgctgtatggcccagttccaccatctgaatctgctcaagcttggcaacaaccgaacacgtacgatgctgctgttcaagctcagatggcagctgctggatatcaaggtgactggtcaagctatgtgtatgcggaacagcagttgggttatccagaacagtatgtgcagcaaagcacccaggaatacgatgtgttagcggaccctagtatatcccaggatccgaggttcatgactcaggcggacaaggatcggggtttaggttctgttttcaaacgtgacgatcaaaggcttaatcagctgagggaaaaagatgcaagggagagagatccaaattttatttcagatagttactcagagtgttatcctgggtaccaggagtataataatgagattgcaggaagcgatgatgaagatgatttatcgaagatggatatgggtggacgggcaaagggccgtcttcacaggtgggactttgagactgaagaggagtgggccaagtacaacgaccagaaagaagccatgccaaaggctgccttccagtttggggtgaagatgcaggacggcaggaagacgaggaagcagaacaaggaccagaagctcactaatgacctccacaagatcaacaagatcctggctaggaagaagggcgagaaagatggggcggaagatggcggtcactacgacgatgatttacctagctcgaagaaacagcgtggctgaagctgtcatttttcgtttctcctgctggttatggcattctacgggagagttacgatggtgtttagctggcagctgtatcatgctgctttcatttaaggtggcatcaggacataatacatgtcaaaaactttacaaccgtggtcgatattttaacaggaacagaatgatccttggtgattttgtttgtcttgtaagacatatcgaaattgtataaaatgtcaaaacgagtacactagcacaatagatttctgaaaactatagatttctctagtttaattcagaatcatattctacctt

SEQ ID NO: 4544 - DNA, 3409 bp, Zea mays
gcacgagagagagagagagagctcactagtccccccccccccccctcctcgatgcgtcgccacgtctacctcttcgccttcttctagcacaaccttgttgccagtgtcgccgtctcatcctcgactacttcgtgtactccgctctgacaaccgtgagttgcgacgacaatcccgtcatatcgcaccacaaccgtcgtggatgtcttctctgttggcacctcgacaatggcttgacttccttgcactcggctatctcgacataatcggcacaaagggctatcatatgcatgggctactgcagttgcagcattcgcactggcgttccgactatggggggatatctccattgttctccagtctgtccgttcgtgttgctaacgctatgactaggggggtattagagtatattatgcaactcctgatatgcttggtttaggattgattgtaatcccgagataaccttatctctaggataggcttctttccctccaagtcatgtactcctatatactagaggcttaatgcaatatccatcccacacattatacataatctctactttctacaccaaggtctgctaagagccaacacattcaaataatttcagcagtagtagtggcaggggctcaaagttctgatttagtactagattgagagatggcagcctgcttcttggatttccatgcaataggagaggatccaagaaggatactctaacatgtgatagggcgaggttcagtgggatcactcacccaagtggcattggagtaagcatgaaactgaagggggctgtctgaagcattagagtaaacatctgtagcttgtcccttgtaaataactcaacacatgaagcaaatgaccataatgaacagaggtaggtgtagatacaaattgactcaaaatgtgaacaacatgagcaatatcaggtttggtgatattggaaggtggtgtgataggaatggggacatcaggtgtggatatagtagatgacaaatggaggttcaggaatgggagaaagacacatgaaagaggtggactctgggaaaatatgagtggatgggcgagtagtaaaagaagggtcgagtttcattaaaactcacatcttgtgaaatacgaatgcgactagaagatggatcataacatcgataatttttatgttcaggactatccaagaaaaatgcattcaacagattgattagtcaatttagtccgctcgtcgagtgctaacaaaacacaacatgtacatcaaacaatcgaagatgatcataccatggaggagtcctaaaaaggactttactatgtgttttgccagagagttttgatgacggttgtctattgatgagacaaacaacattagagatagcttcaccaaaaatacaaggaacaaaataagatattagaagagtgcgtgcagtctcaatgatatgacgacgtttgcgttcagcaacaccgttttatgcatcactactaggacaagaaagccgagtaagagtatgaggtaaaaaactagtgaaaattatcagataaaaaataaccaccagaatcagaacgaaaaaatttagtagaaaactgggcgtgagccatgggagaatcactaggctaatatggaagttgtatttcaggagcagtagaggaacatgcacatcagagctagggttcaagtactacccttaagggatctcaaatcgatgcatatgaagaaggtctgcgctatggggtttacgaagaacaacactggaagaccaaaatttagcctgggaagtggcccttgcacaatggccgactggcgtcccatgccatggctgccgggtgagtgggtggccctcatcacgagcattggtgtgggtggccctcattgggcccccatcgcgggcattgctatgggtgcgcctcgtcgggcaaaacacacctctggcctttgacggcggcgcatgggtaggtggaagcagagtggcggcgcatgggcgggcggagcggcggtgcagtctgcgtggtgtgtgtgctcaagacttcaaagactgcgtggcgcggataggataagactgagggtataatggacatttcatgtgccattttactcatcaaagatattaaaatacattttcggtgcaaaaattataacagactgctaaatccaatttaacgttcgaaccttttagtggtgttttaccttagctcgaacttttgatggtattttatgattttggtgatctttcagagctatagaaccaattttccctaactccactcggtgggatggcccgtgctaacatgtcagagacatcagtggcctctggtcagcatacgtagttcagtggcatataacatataatataaggaaccacctgggcagtgcttttgttgtccatatgttaagttatcagcatttcaatggtttaggaacattgttttgatcttattatgaaccaatattttttgtactctttcattcttatatttactttggctgtttcaacgttattcacatttcagtggcctccttatttgtggttctttgtgtctcatctttgacatattattcgtgtaatcttaatctgcatttccatgctcagcaactatgaactcggcccatttttatattacaaagaataatagaactgctctttgttctatgagtgcttattcgagcactaacacaatgttactatattgcagactgttgaatattcagattggtgaggcatcaaggcgagcatggcttggcgaggaagctgatccacagtactcagatcgactgctcagaccatacaagaggcccgtggaggtttatatggaccaacaagattcaaggtggtttatatccaaggatgcaattgtatctggccttggtcttctaggcatcaagcagggtggacctgagacaacgttgtctaagcctcgtcgaaagagagtcgtccgcaaaaaggccgcttcaggttgagtttagtggatttggcagcaatgctggaacgattttgcttctgttccactatgccagagggaggtctacccaaattatggtaaatgagaaaaactacaaacgtcaaccagcacagcacgtggtcaataggcgaaggcatcaaagggggttgtgctgggaagcgttggtcaaaaggtgccctttactattttctaattcaagtgcagtggtttctttattttttggtaagaataatatgttggtttcttgtattgctgaggcaaatagacacgtttagtggtagttctgtaagtttgttaatgtactgactttaacatgagatggattctgcatttttgtatagatcaaatagctgccgcatgcatgtatctatcttttgaggtcaatcaggccagggttcctgctttggtgcaggataggaccatgtttcttttatgaaaacttatttaagtactaaggccagtctcg

SEQ ID NO: 4545 - DNA, 2225 bp, Zea mays
cattgctcctctttcgatagctggcgaaggcgcggcgcgcagggccagtagcaaccctcccatggcctacgctgcgcctcccatggcgtcgtccctcaccgcctcccacccccctctttccccgtcccacctcataacccatccgcatcgctgccctgcgcgccccaaccccaccaccggcctcctccgcctcaccccgtctcgccgccgcggtcgtccccccgtggccgtccgcctcgcaatatctgcctcgtccacctcagccccgcccccgtcggcggatcggtcggaggccgcgtcgtcgctggagagatacctctcggcgacggtgacgggagcggtgatgggaacgggggcggccccaccagcttcggccccgccgcgcgccccgccggcgatgaaggggggacggaagcagtatagcgcgttgggggctgtcacgctcgagaaggccaagctcgatctctcccagcgccgcaagaatatcatgcccgagctggcgacaggtggtggtggtggagatattggaaaaaggatcggtcatggtgggggtgatggtggtgatgatgatggtgacgatgatgactactttgatgattttgatgagggagaggaagaaggtgggcttttcaggaggcgaattgttgtacaagagctattcaatagggagttcgtagaagctgtgttgcaagaatggtacaagacgatgagtgatttgcctaccggtcttcgccaagcttgtgagatgggtttggtgagttctgcacagatggtacgttacttgtcaatatttgcaagacctacaaacgctaggtccttctcaagagctcttccaggctggctttccagaggtcttgttggaaggacacttgcagatccatcattcccacataaaatgtctttggagtttatagctaccattgcgtcatctatttggtgtgaaatgaatattcgcaaagagaggtttaaacaagaatgggatttggtgattgttaatgctttgactgcagcttgttgcaacttgatggttcttggacttttagcaccatgccgttcatatgcgagtacatctcgatttgacttccaaaatgcaattgagaaacttccgaacaacatatttgagaagagctatcctttgagagagtttgatctagcaaaacgaatcagtgcattcttttataaagctgctgagcttagtctggtcgggtttgtagctggctctgtgcaagggggtatgtcaatagtcttgtccgcaagaaaagaaaggaggttatcggtgactattccctctatcagcaccaatgctcttggttatggagctttcctaggactctatgctaacttgcgttatcaattgctatgtggagtagaccaatatatggtcaagcgcttcgatgttttgggtgtggcaatcttcttcagcacagcagcaagactgatgaatattcagattggtgaggcatcaaggaggacttggcttggcgaggaagctgatccacagtactcagatcgactgttgagagcatacaagagacctgtggaggttgacgcggaccaatcaaggtggtttatatccaaggatgcaattgtatctggccttggtcttctaggtatcaagcagggtggacctgaggcaacattttctaagtctcgtcgaaagagagtcatccgcaaaaaggtcacttcaggttgagtttagtggatttggatagcaatgctggaacaattttgcttctgttccactatgccagagggaggtctacccaaattatggtaaatgagaaaaaggtatcaagtcaaccagcacgtggtctgtcggcgaagggatcaaagggtttgttactgggaagggttagttaaaaggtgccaattactattttataatttaattgcagttatttaaggtaagaaaatatgttgttttcttgtattgctgtgaggcaaatagacacgtttagtggtagttttgtaagattgttaatgtactgactttacatgagaaatggattctgcatttttatatagatcaagtagctgccacatgcttgtatctatcttttgaggtcaattaggtcagggtcctgctttgttgctggttaggactacgcttttataaaaacttattttaagtacgaaggccgatctctgtggaagtttcatcgtgctatttccaagactactacattttctaaagaggaatgaacctcaatggaatgttttatttc

SEQ ID NO: 4546 - DNA, 1474 bp, Zea mays
cattgggtacctcgaggccggccggggatgatggagaggaagaagaaggtgggcttttcaggaggcatattgttgtacaagagctattcaatagagagtttgtagaaactgtgttgcaagaatggtgcaagacgatgagtaatttgcctgctggtctccacccagcttgtgagatgggtttggtgagttctgcacagatggtacgttacttgtcaatatttgcaagacctacaaacactaggtccttctcaagagctcttccaggttggctttccaaaggtcttgttggaaggacacttgcagatccatcattcccacataagatgggtttggagtttgtggctacctcttcctcatctatttggtgggaaatgaatattcgtaaggagaggtttaaacaagaatgggacttagtgattgtgaatgctttgactgcatcgtgttgcaacttgatggttcttgggcttttggcgccatgccgttcatatgggagtacatctcgatttgagttccaaaatgcaattgagaaacttccaagcaacatattcgagaagagctatcctttgagagagtttgatctaccaaaacgaatcagtgcattcttttataaagctgctgagcttagtcttgtcgggtttgtggccggctctgttcaaggtggtatgtccaaagtcttgtctgtaagaaaagaaaggaggttatcggtgactattccctctatcagcaccaatgctcttggttacggagctttcctagggctctatgtgaacttgcgatatcaattgctctgtggactagaccaatatatggtcaagcgctttgacgttttgggtgtggcgatcttctttagcacagcagcaagactgttgaatattcagattggtgaggcatcaaggcgagcatggcttggcgaggaagctgatccacagtactcagatcgactgctcagaccatacaagaggcccgtggaggtttatatggaccaacaagattcaaggtggtttatatccaaggatgcaattgtatctggccttggtcttttaggcatcaagcagggtgcacctgagacaacgttgtttaagcctcgtcgaaaaagagtcgtccgcaaaaaggtcgcttcaggttgagtttagtggatttggcagcaatgctggaacgattttgcttctggttcccctatgccagagggaggtctacccaaattatggtaaatgagaaaaactacaaacgtcaaccagcccagcacgtggtcaataggcgaaggcatcaaagggggttgtgctgggaagcgttggtcaaaaggtgccctttactattttctaattcaagtgcagtggtttctttattttttggtaagaataatatgttggtttcttgtattgctgaggcaaataaacccgtttagtggtagttctgtaagtttgttaatgtactgactttaacatgagatggattctgcctttttgtataggcc

SEQ ID NO: 4547 - DNA, 960 bp, Zea mays
cggggtgcttcatcggttccgcctcccgcgaaccgtgatgcttcttctcctcacagctgcaaagcatattcgctttccgccaccgcccgatccccacaccgccacccgccgcctctaaccccgctgtcccgtcttgtgctctgacctcaccgctggtcagtgtcagaccgcatggaccccaccgaccagtcgccggaggaggtgtactccgtgtgggcccttccgccggagcccgtccgtgatcgtttccgccgcatcatggagggcctccgcgctgcatacggcggccccgcctttgagccgcacgttaccgtcgtcggtgacttccgcggacgccgctcggaagctgtcaaggtgctccgcgccgccgccgccagcgtccaaccctacactgcccgtgtcacgggggttgcccgtggcagcttcttctaccagtgcgtctacatccttctcgaccccaccgccgaggtggtgggagctagcgatcactgctgcgccaacttcggttacaatagaaaaactccatacatgccgcatgtcagcctcttatatggagaccttacagatgaggagaaggaggaggcaaggaagaaggcagaggagctggacaaggatatctatgtattagagtttgagatatctgagcttgcgctctatagaacagataccacagataaaaccttggagtcatgggaattggtggaggtgtgccatcttggctcttgagaagaagttattagtttcctctccatggtgattctgctgtaagttaactcttggaatttataatgctttgtagtgtcttgttgactactttctaagaaactggtacgtaccactggcataatactttcaatgggaataaggaatgatgtgttgtgctcttcgaaaaaaaaaaaaaaacgcccgccaatctgtgattctctgttagttttccatgaaatatactttgtattattc

SEQ ID NO: 4548 - DNA, 1025 bp, Zea mays
  misc_feature (829)..(829): n is a, c, g, or t
  misc_feature (864)..(865): n is a, c, g, or t
  misc_feature (883)..(883): n is a, c, g, or t
  misc_feature (892)..(892): n is a, c, g, or t
  misc_feature (939)..(940): n is a, c, g, or t
  misc_feature (942)..(944): n is a, c, g, or t
  misc_feature (954)..(954): n is a, c, g, or t
gctgctactgccagaagactcgtcgatttttttttccagctccacttgagtcatgtgacgagaagatttgcagctagtatatcagaacggtggatttgggcccgagtgatagcgccggaggaagcgtgctccgtgtgggccctccctccggagcccgcccgcgaccgtttctgccgcatggaggaccgccgccgcgtgcggcgttagtcggccgggcggccccgccttccagttccagccgcttggaagccgtcgaggtactccccgccggcgtccaaccttacacagtccgtgttacggggcttgcccgtggcagcttcttctaccagtgcgtgtgcgtctacctccttctggagcccacccccgaggaggtgggagcgagcgatcactgctgtgccgacttcggttataggagaaaaactcactcttatatggagactttacagatgatgatgatgaattgatgaggaggcaaagaagaagatagatgagctgatcaaggatatctgtggaatagagtttgatatcactgagcttgtgctttatagaaggatgccatagatataagcttggagtcatgggaattggtggaggtgtgccatcttgagaagaagtgattagtttcctctccaaggtgattctgctgtaagttaattctgagaatttgtaatgctttatagcgtcttgttgactactttctaagcaactggggcacaatactttgaatgtgaataaggtataatgtgctcttctgattggagcaaggaataatatacactatgtgatgctgtgattgttttccctgaaaaaaaaaaaaaaaaaaaaaaanaaaaaaaaaaaaaaaaaaaaaaaaaaaaaaaaaannaaaaaaaaaaaaaaaaanaaaaaaaanaaaaaaaaaaaaaaaaaaaaaaaaaaaaaaaaaaaaaaaaaaaaaannannnaggggggggngcttttaaaaaaaacaaaatttaaaaaccccggttttgaaaaaaaaaaattttttttaaggggcccccaaa

SEQ ID NO: 4549 - DNA, 862 bp, Zea mays
  misc_feature (742)..(742): n is a, c, g, or t
  misc_feature (760)..(760): n is a, c, g, or t
  misc_feature (825)..(825): n is a, c, g, or t
  misc_feature (828)..(828): n is a, c, g, or t
ctcgaggccggccgggccgggaaaaactcctcaagcaatttccatttccaccacgaccactctcttcctcgcagcgcgtaccaacccgccgccgtctactgccactccgcctgctcatggcctcccctacgcaaggtgatgcccccctcgcggctccggctccggcggctgacgctacggacgcggccttcgccgccgcggccgcggtgccggatccaggcgcagagttcgggttccagcgtccggagctcgggaaggagaagctggtcgggacggtggggttccacgagcgccatgtgttcctctgttacaagggcccggatttgtggccgtcccacctcgaggcctctgagtctgaccgcctcccccgcctcctcgccgccgccatcaaggcccgaaagcccaatctgaagaagaccatcaaattgaccatctgtgaaggagaagatggcactgaatcatcaaatggagatgtgttgatctttccagatatgatcagatataaagggctgacccattttgatgtggacaactttgttgaagaagtgcttgtgaaggatattgactggcttcctagatctcctgagcctatgagtggttcctatatttttgtttgctcccatggaagcagggacaaaagggtgtggtgtttgcggacctgctttgattaaaaggttcaaggaagagataaatgaactgggacttgatgatcaggtggctgtcagtgcatgctcacacgtgngaggtcataagtatgcangaaatgtcatcattttcagttctgatgccaagggagaagtgactggtcatggggaatggttatgntgntcctgatgatgtgcctggtttgctgcataacata

SEQ ID NO: 4550 - DNA, 1263 bp, Zea mays
  misc_feature (1158)..(1249): n is a, c, g, or t
gctgcattttttttccatccagccgtgcggccgcaatgattcctccccgtctccccctcgccctccgaaagcgaagtgagcttctgcagataaggaaggaggccgacattatcgcaacacgccacctcatctaatcgaggcgagagacaggggaggaggaggaaaacggaagaaatcttcatcaagcaacaggaagcgagagcgtgcgatttcttttttcttcctttccggtgacgccaggtgaatcaccagccggccggtgcgccaaaggctagggttccgcggggcgcgggtgcgggctcgactttcgtagcctcgccgccggcgcgcgggaaccggatgctgctaagctgcgggtcgctctcctcctgggtgcgccgcttcgtcgcctgcgttggagcagtggttgttttggttgtgcccagcctactccgataatagctgttgatgagcccacaaaaggtttaagaattcaagggcgctcagtaaaaagacacaatttatctgacgacttttggagttcaagcccgcacgaaatggagaacagtgccttgcaatcccgacacagtatgtcctcaatcagcactgctgcacaacctaatgatcagcatgcttctggaagtagcagctccccaaatgaatttgtaaatcaaggtcttctactatggcaccagactagacagcagtggattggaaaacgaagacataattctcagggtcaacaaagtcaaggaccaaaaataagttgtaatgctacatacgagagcctgctcgggagctcgaaaccatttccacaaccgatccctcttggtgaaatggtgggtttcctcgtgatcagctgggagcaggaaggcctatacgattagagttggttattggaagtgtgctgtttcaagtcatgaatcgctgaaatgtacgcaacttctaggctgcgaaagcttgtgacctcatggatgtggactgtctcggagacaggatgacatccctcttatgcaaatgtaaaatattctttgttattttattactagtaattgtgtttacagcgttcagtgtaggagttcattgttttatacaaaaaacagttctctcacgttagctcgcgtaaaagaaatcagaacgtctgcagggatgccagggaactagatactgggagctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaa

SEQ ID NO: 4551 - DNA, 1105 bp, Zea mays
cggacgcgtgggcggacgcgtgggcagagcagctgcagggaggccgccattatcgcagcacgccgccgcgtcatctaatcgaggcgagggggagacagagaggaggaggaggaggaaaaacgggaaataaatcttcatcaagcaacaggtagcgggagcggacgcgaggtgaaccactagctggccagtgccggccgaggctagggttccggggatcgcgggcgcgggctcgggctcgactttcgtagcctagccgccgccgccggccgcgcgggggaaccggatgctatgctgctgagctgcgggtcgctctcctcctgggtgcgccgcttcgtcgcctgcgttggagcagaggttgttttggttgtgcccagcctactccaataatagctgttgacaagcctacaaaaggtttaagaattcaaggacgctcagtaaaaaggcgcaacgtatcagacgacttttggagctcgagcccacacgaaatggagaatagtgccttgcaatcccggcacagtatgtcctcaatcagcacagcagcacagcctaatgatcagcatgtttctggaactagcagctccccaaatgagtttgtaaatcaaggtcttctactatggcaccagactagacagcagtggattggaaaccgaaggcttaattctcagggtcaacaaagtcaagaaccaaaaataagttgtaatgctacatacgaaagcctgctcggaagctcgaagccgttcccacaaccgacccctcttggtgaaatggtggattttctcgtggtcagctgggagcaggaaggcttgtacggttagagctggttattggaaggtgccgttggttagagctggttattggaaggtgccgtttgtaatcacgttattattcgctgaaatgtacgcagcttgagtaggctgcagaagtctgtgtcgtgttgaatgtggattgcctcggagacaggaacaggatgacaccccttttaagcaaatgtataaaatattcgttgtttttattactagtataattgtttgtgttcacagcgttcagtttaaaaaaaaaaaaaacggcacgtgccaagaaaaatgcatcaagttcgttttcggaa

SEQ ID NO: 4552 - DNA, 547 bp, Zea mays
cgcttgacggaggagctagcttgccaattgccattgcactgcgcgcgcgcacctcacatccgccgccagcaggtgccaccgccatctctgctttctctctctctctctctctctctctctctctctctcaagcaacgcccgcctgcccgcccgccatggcgaccatagccacgatggccctgctgaagcccgccaggatcgtggcgcggtcggcgccgccgtccaccagcggcagcgtctcgctgcgcgtcccggcgcgggccaagaaggccgcggtgtccgcgtccgtgtcgtccgcgctggcgggcgccttcttctcggcgctggcgtcgtcggacgcggcgctggcggcgcagcgcgtggcggacgtcgcggcggcggccgacgccgggagcgacaaccgcgggcagctgctgctcttcgtggtggcgcccgccatcgggtgggtgctctacaacatcctgcagccggcgctgaaccagctcaaccgcatgcgcagccaggccgtggtcgccggcctgggcctcggcgccgccgccgccgggat

SEQ ID NO: 4553 - DNA, 867 bp, Zea mays
gggtaccgccggcccggcccggaccttgccatcacctcctcgcctagctcgcctgccactgccagcaggtgccaccgccatctctgctctgctctcgcaagcacacgcccggccgccttccacagttgccatggcgaccatagccacgatggcgctgctgaagcccgccgccaaggccgcggcgcggtcggcgccgtccaccagcagcggcagcgtctcgctgcgcgtcccggggcaggccgccaagaaggctgcggtctccgcgtccgcgtcgtccacgctggcgggcgccttcttcgcggcgctggcgtcgtcgcccgacgctgcgctggcggacgtggcggcggcggacgccggcggcgacagccgcggccagctgctgctcgtcgtggtggcgcccgccatcgggtgggtgctgtacaacatcctgcagccggcgctgaaccagctgaaccgcatgcgcagcagccaggccgtggccgccggcctgggcctcggcgccgccgccgccgccgggatggcggccccgcccgaggcctccgccgccggggtgccggacctcgcggcaatcgccgccgccgcgcccgccggcgacagccgcggcctcctcctgctcttcgtcgtcccgcccgccatcggctgggtgctcttcaacatcctccagccggcgctcaaccagctcaaccgcatgcggaccgactgaagctagctagcgtccgtttccgtatccgcgccgtgggtgcgtgcgttggttgtagacatgaagcacgtggcttggctgatccacgtacgggggacgaggcttggccttcccacctacttcttggagaaaaaaaaaaaaataaaagcggccaccaactcccgctt

SEQ ID NO: 4554 - DNA, 1028 bp, Zea mays
  misc_feature (926)..(926): n is a, c, g, or t
acggtctagcattcccgggccgacccacgcgtccacggacgcgtgggcggacgcgtgggcggacgcgtgggcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcgctgtccgtgtccgcgtcgtccacgctggcgggcgccttcctcgcggcgctggcgtcgtcgcccgacgctgcgctggcggacgtggcggcggcggacgccggcggcgacagccgcggccagctgctgctcgtggtggtggcgcccgccatcgggtgggtgctgtacaacatcctgcagccggcgctgaaccagctgaaccgcatgcgcagcagccaggccgtggccgccggcctgggcctcggcgccgccgccgccgccgggatggcggccccgcccgaggcctccgccgccgtggtgcaggacctcgcggcaatcgccgccgccgcgcccgccgacgacagccgcggcctcctcctgctcatcgtcgtcgcgccagccatcggctgggtgctcttcaacatcctccagccggcgctcaaccagctcaaccgcatgcggtccgactgaagctagctagcgtccgtttccgtatccgcggcgtgcgtgcgtgcgttgtagacgtgaagcacgtggttggttgatcaacgtacgtggacgtggcttgtctttccatcttcattcttgagcgaaatttgctcgcgctgtggtggttgacagtgagaggtggaatgctcaccatcgccgccgccggncgagtgttcccggcactgctgcatgcgtcgaatcgcctgcactgcactgcactgcacccccgagtcgcttcgtgaatgcgatagatgccatgccatgcccct

SEQ ID NO: 4555 - DNA, 1493 bp, Zea mays
  misc_feature (1476)..(1477): n is a, c, g, or t
  misc_feature (1480)..(1482): n is a, c, g, or t
ttgggaccctcgaggccggccgggaaaaaaaaccaaaacccttctgtggaaaaacgtaaaaccaggcgcgccctcgcaggccgtgccgggcaggagcacctcatccctctcgccttcaggttctactcgccctctccccacccgcagcgcctcctcccattcccccaacggacattgcctaggaggctaggacagaaccacccagagcgcacaaccttatccgaatcgccgttgcatggaggccgtgcgcgcgtcggcggcgtgggtcgccagtcgctcctcccatgtcacggtcgaccttcaagaaattgagaaggtagtggaccaaatccaaggagatgttccaaaagttgagtgggattacgaaggaattcactactttgacaatgggccactcacagtccagtacctgttcgtcttggatgcactaaacttctgcttctggccagataaggacttgagctatgaccatttggcttctggactgaagtcagccttggagaaagacaaaaatgcccttgattcagatcgtctccagaattacactgggccccagctccgccaacttctgaactggccacgaccactgccaattgaggaggaaagagtacgccttctccacgaggttgggcaggaacttaaaagaagctttggaggtcaggctgctaatctagtgaagtctgctggaaactctgctgcgactcttattgaactgattactcgacattttcctggtttccgggaccattcactctacaaggggcaccaggttttcctgtacaagagagcccagatctttgttgctgatttgtggggcgccttcaagggacaaaactatggcgagttccacgatatcaattccatcaccatatttgctgactacattgttccagcggtcctgagggagcttggagtacttaaatatggctcgaatctatcttgcttcatcgactcgaacagtgagatagtgcctggaagcgaggaggaagtggagatacgcgcgtgctccatctatgcagtggagaagatgagggacctgatcagcaagaagtttggaaagcagcttctgagcattgacattgatctctggctctggtcctgcggcgtgcagaacatggcgctgtcacatcaccgcactctgtcgatttactactagacagtcaggcaggcaggaagctgaccctgctggtgcgctcgttcagctggccgggcgttgtcgtcgcttgttcgtcctaaccataacggtgcatgtaggtgtcgagagttttgtctccttgggaatgcacacaggtgcaagatattgtaggcccgtcccatgaggatgcatggtagtacaacacttttttttttgtgatttagagacttgaactgctgcagttttcacatgaatgttatccctaaggacaaggcgggagcgagtgtttctctatctccaaaaaaaaaaaaaaaaaaaaaaaaaaaaaaaaaaatacaacnnaannnaaaaaaaaaaa

SEQ ID NO: 4556 - DNA, 830 bp, Zea mays
cattgggtacctcgaggccggccgggactgccagcaagtgccaccgtcatctctgctctgctctcgcaacgcaagcacacgcccggccgcctgccacagttgccatggcgaccatagccacgatggcgctgctgaagcccgccgccaaagccgcggcgcggtcggcgccgtccaccagcagcggcagcgtctcgctgcgcgtaccggggcaggccgccaagaaggctgcggtagtccgcgtccgcgtcgtccacgctggcgggcgccttcttcgcggcgctggcgtcgtcgcccgacgctgcgctggcgagacgtcgtggcggcggcggacgccggcggcgacagccgcggccagctgctgctcgtcgtcgtggcgcccgccatcgggtgggtgctgtacaacatcctgcagccggcgctgaaccagctgatccgcatgcgcagcagccaggccgtggccgccggcctgggcctcggcgccgccgccgccgccgggatggcggccccgcccgaggcctccgccgccgtggtgcaggacctcgcggcaatcgccgccgccgcgcccgccgacgacagccgcggcctcctcctgctcatcgtcgtcgcgcccgccatcggctgggtgctcttcaacatcctccagccggcgctcaaccagctcaaccgcatgcggtccgactgaagctagctagctagcgtccgtttccgtatccacggcgtgcgtgcgtgcgtgtgttgtagacataaagcacgtggttggttgatcaacgtacgtggacgtggcctgtctttccatcttcattcttgagcgaaaaaaaaaaaaaataaaa

SEQ ID NO: 4557 - DNA, 935 bp, Zea mays
attccgtttggctggacctgcgatctgagggtctctgttcgtgtccaatggccatgcagagccaaggataaggtgtcgattctggagcacacactgggcgcctccggcctcgcagagataagcaaacccgatcccccggttctagaaacacggagacggaggcgctagctagcttaccttgccatcacctcctcgcctagcctgccactgccagcaggtgccaccgccatctctgctttgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcggtgtccgcgtccgcgtcgtccacgctggcgggcgccttcttcgcggcgctggcgtcgtcgcccgacgctgcgctggcggacgtcgtggcggcggcggacgtcggcggcgacagccgcgggcagctgctgctcgtctctgaggcgcccgccatctactggctgctacacagcatgctgttcgagacgctggcgcatccgttcaccaagagaggtctgctgctcaggttcctgctgctgggcggcggctcacttctggcctacgtcagcgcgtcggcgtcaccggacctcctgccgatcaagaagggacctcaggagccgccgcaggcgggcccgcgcggcaagatctaagctcagcttctccatttgcatggtctagtaccttgctttgtactgctagcgccggtcgatccggcgcaatcgtcatggatcatctctctatcttgttgttaccctgttcataatttggtatatttggcattcccgtattgagtactctttggcttacctactataattaaaatg

SEQ ID NO: 4558 - DNA, 2080 bp, Zea mays
atagtgcaaaacaataaccatataggtgagcatgaagtgatacgttcagtacctgcaaaagcaaaaggtagaggaaaagaatacgagcaaggtaaataaataaataaatcaaatacaacagataaagaaccttgtaacatatgtctaatctatttaattgttttgtttctctttttttattgtaacatatgtcgaatctatcgtatttagaagaacgacggcgacgaacgtgcacactttttgttcttgtagccatcgcgcgaacagaccagagcgggaaatcggagccccgtttcttttttctttttctcttttgtataaagcaaaacgaactctctctgtctctctcattccgtttggctggacctgcgatctgagggtctctgttcgtgtccaatggccatgcagagccaaggataaggtgtcgattctggagcacacactgggcgcctccggcctcgcagagataagcaaacccgatcccccggttctagaaacccatggggacctccgcgccggcccggaccttgccatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcgctgtccgtgtccgcgtcgtccacgctggcgggcgccttcctcgcggcgctggcgtcgtcgcccgacgctgcgctggcggacgtggcggcggcggacgccggcggcgacagccgcggccagctgctgctcgtcgtggtggcgcccgccatcgggtgggtgctgtacaacatcctgcagccggcgctgaaccagctgaaccgcatgcgcagcagccaggccgtggccgccggcctgggcctcggcgccgccgccgccgccgggatggcggccccgcccgaagcctccgccgccgtggtgcaggacctcgcggcaatcgccgccgccgcgcccgccgacgacagccgcggcctcctcctgctcatcgtcgtcgcgcccgccatcggctgggtgctcttcaacatcctccagccggcgctcaaccagctcaaccgcatgcggtccgactgaagctagctagctagcgtccgtttccgtatccgcggcgtgcgttgtagacgtgaagcacgtggttggttgatcaacgtacgtggacgtggcctgtctttccatcttcattcttgagcgaaatttgctcgcgctgtggtggttgacagtgaaaggtgaaacgctcatcgccgccgccggcgagtgttcccggcatcaccgagtgccttcgtgaatgcgatagatgccatgccatgacccgaggctcggcacctccgctcagatcgctgtcgtcaccgcgtaggctcagcaaatattaccgtcgaataatgtcctaccgccaatttattcgcgctaaaacaaaaaaggcgccaaacccaaaccgagtggtcaggtctaaagatggcaaaggatccgggtaattattccgttagggaacgagtttaattgcaattatatacctacggatatgttaaatgaaagaaaaagagaacctaacaggtagaactggtgcatatacatactcattaaacgcgtaccgtatactcattaaacacgtatacgtataattccctaaaattttaacctatctcaatgatttatcttgggctcctagctcctgagtacgactacacgctacatagaccttagaagttaggacacacaacaatcagtcaaaacagtaaagcacgtccaagactccaagcttatacgatgcaatccaagtgaccaagccgcggtataaccgcatctgaaagatgcatggaagacagggaggccgaatgttctccctcgacggtcactattcgctctaaactaagtaaatcaaacagggacaactcactcctatatatgtatggggtatccgttggatatagaatacccgacgacagat

SEQ ID NO: 4559 - DNA, 2052 bp, Zea mays
ttctccgagcccgcaatacacaacaaatttttttttttcaaaagctacaacaatcacagcagctttttgacagaccacagcttaatcaaacaggacccaagtgcttttcagagttgtgttacttgagaattgcagagttcactcttcagcgttgtttgattgtttcatttgtttgcctgtaagatttcaagagcaagcttaggaccaagggcctgaccttttcctctggtatattagaattgacctgataactgtctcacttttatgcctttgttttggcacatcatatgtgaggcatttcatattttcagttcaaatgtaaagagcacgtcttaaaaagttaattaatatagatattgctaaagaagatggcaagatgctaagagtttagtgctgtatgtctaaatctatgtatctgtttaaacattatatttcaccacttttttcagtctgaaatttgaggagactctgcaacttgtgaaagctgaatgatactagtacttcacactgaccacctgttatcaccttataaacatagaagctatgatacttcttagttattgatctcttaagtttttgtcttgacatttttgtgtttttttcctcgaacacgaaggagaactgtgcatcattatattaaggagaataagaatggtctaaggtagaccaaagtacaagctgccctagaaggcaggaagaggggggacacaaggaaacaccaaaactaaatagaagagagagacggggggcaccagttccaacaacattcaaattaaggccacagctgcctaagatcctttgcacccgccattctccaaagcttaacatcatcttgaattgttcttgttatgaggaatgcattaatgccataaacgaattcattcctgtactaattctttttgcagggaccttcattgccatcgtgttggatatgacaacagaaaattacctaaagcaacccgtgctattaatcgtgccaatcatatgaacggtggcagttccccagcaagtgctccacctggggtgcttgcagtgtgatcttccaacaagcagatctagtatacctagatgatcagcctgtgcagcaagagaaaagatcagttgtctcgattctctttccaagagcacagggatcggattgaagaggaagattaatcctttcggtgctgggggggccagtgctgatcaggatggactacatcatatggataaaatagatgtttgtcaacgaagacgggttaatgaatacaaaactttgaccctgaagaatgacaagttgctaaatgaatgcttacaataccagggatcagaaaaacaacttgtcctgaaggaacaaaagctccgatctgaaattgctgaggtggaaaagaagtatcaggaattgttgggagagctcagatcattggatgtgaagaaagagaaacaatgaactctccacttcagcgcctgttgtacaattaattgctcttgtttctttcctgacctgtgaagatgatgactggattacttcccgagacgtgcagggaactggtcccttggacaaatgttatctaccgattaccattcgcttggtaatttcgttggatagctgtagaggtgtaatttcgtttcactaatcttcctagggtcctgtgatggtggaagaaagtgagcatgtagtatgttgtaaaattatgcaacttgtatctgaatgtacagcagcggtttcaatgttaatggccctctgtttccagcagcacatctcggtcccgtgtcaaaagaggtggattttgatccggcactctggagtctggactctggagtggatgcttagaattagacttcatatgttgtgcagtatgtaaaattacttttcgtactcgtgacagtcttaaactggttgtgttgtatttgagacgaggggggttagtcaagcctttgttcactccaacagtacattgtaactgtacatgagtgatggtgggtatcagctgtttggttgctgcattaatttattttccaaccctcttaaaaaaaaaaggaaaaaaaaaactagagggggggcccggtacc

SEQ ID NO: 4560 - DNA, 2469 bp, Zea mays
  misc_feature (664)..(664): n is a, c, g, or t
aattcggcacgaggagaaggggaagccagcttgtgcttcgacaggcctcagccctagcgcagcttcccggcgacggcgatgagcctgggagccgaggtgatcgagctctccagcgacgaagacgaggagcctgtgcccagcactaccgctctcgtccgccacgccccctcctcccctcccgacgtcaagccgcacctgctcgccgacgtcgatgtgaagccgctgcttcttctcccgccgccgctccaccccccgggctacggcgcgctcgtgcccgtgaagaccgaggagcccgtgcccgtggccaccgtctcgtctccgcccagggcgctcccgccgccgcgcctctgccgccagttctggaagtccggcgactacgtcgtcgcgcgccgcaaccccgatgcggccggccccggtgggcggaaccggttgcggataaaccccaagtttctgcactccaatgcgacttcccacaagtgggcttttggcgccattgccgagctccttgacaatgcaatcgatgaggtgaacaatggggcaacatttgtccgtgttaataaatttaaaaacccacgagatgggaacccctcattgttggttcaagatgatggagggggggatgggatccctgaggcactgagacgttgcatgagcttcggatttntcagataaacagtctgatgctttcattgggccatatggcaatggtttcaagactagtacgatgcggcttggagcagatgtgattgtttttacacaaaaccaaaataactgggtgccaactagaagtatcggccttctttcttacacatttttgatggaaacaggttgcgatgatgtgctggtgccaacggtgcacgagaccattacctagaacatcctaatcgaaaatcagatgttgcgtcatgatcagaagctcttctcttctaatttggcaatccttctcaaatggtcccctttttctactgaagctgagttgcttaaacaatttgatgatatgggagatcatggaacaaagataattgtattcaacctctggttcaatgatgatggggatatggagcttgatttcaactctgacaaaaaggatatcctcattactggggcccacaagaaggtgaaaacaaacagtttggacaagattgctgcacagaactacgtctcaactcggcttcgctattctcttagaggcatatgcatctatcttgtatcttcatgtacctgatactttcagaattatcctgcggggatgtgatgtggaaccacataatgtagttaatgatttgatgtatcgggagtgcgtgttgtataaaccacaaattgctggacttacagagtcatcggtaatcacaaccattgggtttgttaaaggtgcaccagatatagatgtacaagggtttaatgtatatcacaaaaaccgtctaatattgcccttctggaaagttgcaaacaactcatacgggaaaggacgaggagttgttggcattctggaggccaactttatcaaacctacccatgacaagcaggattttgagaagtcagtcctttatcaaagacttgagttccgcttgaaagaaatgacttacgaatactgggaccttcattgccatcgtgttggatatgacaacaaaaaattacctaaagcaacccgtgctattaatcgtgccaatcatatgaacggtggcagttccccaacaagtgctccacctcggttgcttgcagttgatattccaacaagcagctctagtatacctagattatcagcctctgcagcaagagaaaagatcagtagtctcgattctcttcccaagagcatgattggattgaagaggaagtttaatcctttcggtgctgtggcggccagtgctgatcaggatggactacatcatatggataaaatagatgtttctcaacgaagacggtttaatgaatacaaaactttgaccctggagaatgacaagttgcgaaatgaatgcttacaatacgagggatcagagaaacaacttgtcctgaaggaacaaaagctccgatctgaaattgctgaggtggaaaagaagtatcaggaattgttgggagagctcagatcattggatgtgaagaaagagaaacaatgaactctccacttcagcgcctgttgtacaattaattgctcttttttctttcctgacctgtgaagatgatgactggattacttcccgagacgtgcagggaactggtcccttggacaaatgttatctaccgattaccattcgcttggtagtttcgttggatagctgtagaggtgtaatttcgtttcactaatcttcctagggtcctgtgatggtggaagaaagtgagcatgtagtctgttgtaaaattatgcaacttgtatctgaatgtacagcagcggtttcaatgttaatggccctctgtttccagcagcgaaaaaaaaaaaaaaaacgcacgagcgcgtgcttgatccggcactct

SEQ ID NO: 4561 - DNA, 1550 bp, Zea mays
cattgggacctcgagccggcccggaccggaatcccccaacatttcgtcgaatccgccgtgagatccgcccgactctcgctccgttccggcgctctcggtcgggcgaaggctccaccttcctccgacaagatggcggggaagggagccaaggccacggccgccaagtcggcggacaaggacaaggggaagaagaccggcggccccgtctcgcgctcctcccgcgccgcaccccatgagaagtcagctccgaagaaagatgtttatcaattgtttgctgagaaggtcagggataacaaacaactggaatcaagatgggcgatcatgcaagaaacccgcgtggagtatttccgtggaaaagatttcaataccttcgtcaaaaatcatccagaagtcagggaaattttggggccagataaggatttagaggtggaagacattgttaacactttgctgaccaagaaccttgtgataaggtgtgatcgagtcatgaaaactgtgaggcctggcaagaaaaagctatcgtcatggcctgctcatttggagatacataatgaacaagtgtttactgaaaatgatgggttttttgcttggatgtttctgaaaagaaggaccttgtggcagacaattctttcatttgtttggcctctttttgcactggcagtctgcttatttccagtttacccataccagtgcaagattgttgtactgtactcatgtgctggagctctacttttcattgtctccattcttttgctaagagctgctatctttggtatcctatgggttctccttgggaaacgcgtgtggttcttccccaatataaatgcggaggagacaacttttagagaactcgttcgtttttggcctgaaaaggatgaaggagagcggccaaagtggacatcaagacttttctatgcccttgttgctctattggtgatattactgcttaggcatcatgctcctgacgaagcagctagagccaggtaccaaaagaaggtttctaacataatcgatgacgttcttgaatggtctccgaagttagctatttctggaatgattgaaaagcacactggggctaacattacagaagaaagcaattacaccaccagggcggcgagtagtcacatgcctccatccaccgaaggcaaagcttcagaagatatggacgttgatggggataccgaggctagcttagatgaaacccaagataatgaatatgctgatgatacaagatcaagcggagcttaaaatcagagttttttttgtttgagcaatctttgttgttgtgaatctgcagaattatatagatagcttactgctggcaacaaaagaaatcagggtgtcatgttttgatgttacatccatatattccctgcaattggttgtgttctaaggtccccagagaataattctcatatacgacaaggccatctctgcattgccaaatggtcatccagccctcctgacgccggcgacctcctatatatatatacccaactttttcgacgtaaaaaaaaaaaaaaaaaatacgagggggggcccggtaccca

SEQ ID NO: 4562 - DNA, 1558 bp, Zea mays
  misc_feature (1158)..(1158): n is a, c, g, or t
  misc_feature (1166)..(1166): n is a, c, g, or t
  misc_feature (1204)..(1204): n is a, c, g, or t
cccacgcgtccgcccacgcgtccgcccacgcgtgcgcagttccagtgtgcgaaccgaggtcccccaatcccccaaccgatttcccccaaacatttttttgtcgaatctgtcgtgagatcctccccgacgagatggcggggaagggagccaaggccacggccgccaagtcggcggacaaggacaaggggaagaaggccggcggccccgtctcgcgctcctcccgcgccgcacctcaggagaagtcaactccgaagaaagatgtttatcaattgttcgctgagaaggttagggataacaaacagctggaatcaagatgggcaatcatgcaagaaacccgtgtggagtattttcgtggaaaagatttcaatgccttcatcaagaattatccagaagtcagggaaattttggggccagataaggatttagaagtggaagacattgttaacactttgttgaccaagaaccttgtgataaggtgtgaccgagttatgaaaactgtgaggcctggcaagaaaaagttatcatcatggcctgctcacttggagatacataatgaacaagtgtttactgaaaatgatgggttttatgcttggatgtttctgaaaaggcggaccttgtggcagacagttctttcatttgtttggcctctttttgcactggcagtctgcttatttccagtttacccataccaatgcaagattgttgtactgtactcatgtgctggagctctacttttcattgtctccattcttttgctaagagctgccatctttggcatcttatgggttctccttgggaaacgcgtgtggttcttccccaatataaatgcagaggagacaacatttagagaactggttcgtttttggcctgaaaaagatgaaggagagcggccaaagtggacatcaagacttttctatgctcttgttgctctattggtgatattactgcttaggcaccatgctccggacgaagcagctagagccaggtaccaaaagaaggtttctaacataattgatgatgttcttgaatggtccccgaagttagctatttctggaatgattgaaaaacacactggggctaacattacagaagaaagcaattacactagcagggctgcgagtagtcatgtgcctccttccaccaaagccaaagcttcanaagccggntcagatacagatattgaggctaacttagatgaagcccnagatagtgaatatgctgatgatacaagatcaaacgaagcttaaaatcagctttatcttgtagttttttgagcaatctttgttattgttaatctgcaggatcatgtagatagcttactgctgacaacaaaaatttagggtgtcatgttttgatgttacaaccatatattgcctgcaatggttgtattttaaggttcccaaacaacattttcatagagcgcggcaaatcttcaccttttctctacacgagcatgaatctttttaatttgattttaagtgtgttgacaagttttgtacaaaaaaaaaaaaatgattgttgttaagtaacaatatcgtgtgtgtatatatatatatat

SEQ ID NO: 4563 - DNA, 2252 bp, Zea mays
tgggtacccctcgaggccggccgggacaaatcccccaaacatttcgtcgaatccgccgtgagatccgcccgactctcgctccgttccggcgctctcggtcgggcgaaggctccaccttcctccgacaagatggcggggaagggagccaaggccacggccgccaagtcggcggacaaggacaaggggaagaagaccggcggccccgtctcgcgctcctcccgcgccgcaccccaggagaagtcagctccgaagaaagatgtttatcaattgttcgctgagaaggtcagggataacaaacaactggaatcaagatgggcgatcatgcaagaaacccgcgtggagtatttccgtggaaaagatttcaataccttcgtcaaaaatcatccagaagtcagggaaattttggggccagataaggatttagaggtggaagacattgttaacactttgctgaccaagaaccttgtgataaggtgtgatcgagtcatgaaaactgtgaggcctggcaagaaaaagctatcgtcatggcctgctcatttggagatacataatgaacaagtgtttactgaaaatgatgggttttttgcttggatgtttctgaaaagaaggaccttgtggcagacaattctttcatttgtttggcctctttttgcactggcagtctgcttatttccagtttacccataccagtgcaagattgttgtactgtactcatgtgctggagctctacttttcattgtctccattcttttgctaagagctccccccctctcctaaatgtattttcattcacgacatacattatacttaagtagacactttcaaattacattttagtcattaggcatatttgagtaacaagctacaatttattgcctgtgtagtgttgtgcgcacttccaacgtcatacggtcatacccgtcatatgcatatttgattaatgaatactatttacctgctgtttataagataacagctatcagaagttggttttgacttgctacaagttttgtagtatatattgataaccttgcagtcacatatatttctagtcactgattaaatcctaacatggcacataacaaactatttagtagtcctgtatatgcaagctgctgctttgttagttgactcactatgttgcggagtaaagtatgtttgattattcttctttcatgaatgtaacagttgcattacagagtatacagtggttcaaaaaacaatcgaacaaagattcaaacttcaatttaaaactgcacagcatgctaggtggataggtatcattcacctccagcctccaccaaactttctgagttcggttgtttttgaagtgatgtttcgacaatagtgtggaactcacacttcagtgcatcaatatgaatgtttagagaaaaggaaaaactggggggatgggttcagactcaagagttttggtgtgtgtaggaaccatgagctcaacattagagtatcattcacttgtttcattacaataagttatctgtttttaaacctttccatttcaagcacatcctaacttctcttttttgccctctatagtaatccctgcttgtctaatatttccaatgtaatttcagtaagagctgctatctttggtatcctatgggttctccttgggaaacgcgtgtggttcttccccaatataaatgcggaggagacaacttttagagaactcgttcgtttttggcctgaaaaggatgaaggagagcggccaaagtggacatcaagacttttctatgcccttgttgctctattggtgatattactgcttaggcatcatgctcctgacgaagcagctagagccaggtaccaaaagaaggtttctaacataatcgatgacgttcttgaatggtctccgaagttagctatttctggaatgattgaaaagcacactggggctaacattacagaagaaagcaattacatgcctccatccaccgaaggcaaagcttcagaagatatggacgttgatggggataccgaggctagcttagatgaaacccaagataatgaatatgctgatgatacaagatcaagcggagcttaaaatcagagttttttttttttggtttgagcaatctttgttgttgtgaatctgcagaattatatagatagcttactgctggcaacaaaagaaatcagggtgtcatgttttgatgttacatccatatattccctgcaattgggtgtgttctaaggtcccctttataaataattattttaaatttatttat

SEQ ID NO: 4564 - DNA, 2112 bp, Zea mays
  misc_feature (12)..(12): n is a, c, g, or t
  misc_feature (37)..(37): n is a, c, g, or t
ccgggcgtgagnatcctccccgtcgaggtggcggggnaagggagccaaggccacggccgccaagtcggcggacaaggaccaaggggaagaaggccggcggccccgtctcgcgctcctcccgcgccgcacctcaggagaattcaactccgaagaaagatgtttatcaattgttcgctgagaaggttagggataacaaacagctggaatcaagatgggcaatcatgcaagaaacccgtgtggagtattttcgtggaaaagatttcaatgccttcatcaagaattatccagaagtcagggaaattttggggccagataaggatttagaagtggaagacattgttaacactttgttgaccaagaaccttgtgataaggtgtgaccgagttatgaaaactgtgaggcctggcaagaaaaagttatcatcatggcctgctcacttggagatacataattaaagagctgccatctttggcatcttatgggttctccttgggaaacgcgtgtggttcttccccaatataaatgcagaggagacaacatttagagaactggttcgtttttggcctgaaaaagatgaaggagagcggccaaagtggacatcaagacttttctatgctcttgttgctctattggtgatattactgcttaggcaccatgctccggacgaagcagctagagccaggtaccaaaagaaggtttctaacataattgatgatgttcttgaatggtccccgaagttagctatttctggaatgattgaaaaacacactggggctaacattacagaagaaagcaattacactagcagggctgcgagtagtcatgtgcctccttccaccaaagccaaagcttcagaagccggttcagatacggatattgaggctaacttagatgaagcccaagatagtgaatatgctgatgatacaagatcaaacgaagcttaaaatcagctttatcttgtagttttttgagcaatctttgttattattaatctgcagaatcatgtagatagcttactactgacaacaaaaatttagggtgtcatgttttgatgttacaaccatatattgcctgcaatggttgtattctaaggttcccaaacaacattctcatagagcgcggcaaatcttcaccttttctctacacgagcatgaatctttttaatttgattttaagtgtgttgacaagttctgtacatgattgttgttaagtaacaatatcgtgtgtgtgtgttctcggggggcccggatatatatatatatatatatatatatatatatatatatatatatatatatatatatatatgtcagtgttttgatgttacaaccatatattgcctgcaatggttgtattctaaggttcccaaacaacattctcatagagcgcggcaaatcttcaccttttctctacacgagcatgaatctttttaatttgattttaagtgtgttgacaagttctgtacatgattgttgttaagtaacaatatcgtgtgtgtgtgtctatatatatatatatatatatatatatatgtcatgttttgatgttacaaccatatattgcctgcaatggttgtattctaaggttcccaaacaacattctcatagagcgcggcaaatcttcaccttttctctacacgagcatgaatctttttaatttgattttaagtgtgttgacaagttctgtacatgattgttgttaagtaacaatatcgtgtgtgtgtatatatatatacggcggcattaaaatgcacctgggtgcattctctatattgaatgcacccacctgcaataacaccctcgagcacgccttggccctcctgtatgcgcgcctctctgccccccgccgccgcgcgcctccctgtccccgcaccatcctctcccccaccgtcgccgagcgccaccctctcccccatcgccgccgcgtgcctccctgtccccgcgtcgccgcgcgcctatctatcagcgcgcctccatgtcccccgcattaggtgtgattgcaactgctgtataattccacccaaatatctgttaaaaaatgtaaacaaaatgattgcaactgttggtgtgttgtaattgcaactgctggtgtggtgtggatgcaactgctgag

SEQ ID NO: 4565 - DNA, 1870 bp, Zea mays
tgaagagttcagctaccctaccatccacactttattcatctcagggcagtagccagtagctagctgtagagggagttatcggccatgtcggaggaggcgacgctggaggacacgcctacgtggatcgtggcgtccgtgtgctccgtcatcgtcctcatctccttcgtcttcgagcgcgcgctccaccacctcggcaaggcactggagcgcctgaggaagaccctgtacgaggcgctgctaaagctcaaagaagagctcatgctgctgggcttcgtctcgctgctcctcgtcgtctcccaggacttgatacagaagatctgcatcgacgacagcctcatggagcactggatgccgtgccggggtgcgagcgccaccgcctcggctcattacggtgtctcctcctcctcctcctcctccgcggtcggtggcgggaggaggatgctcaaaggcggcggggcagctttcgggcactgttcaagcaagggaaaagtcccgttgctatcacttcacgccttggagcaggtacacattttcatcttcgtcctagctatcacgcaagtcgttctcagcgtcgccaccgtcctcctgggacttctgcagatgcggatatggatgcactgggagaacaccattcagcaagagggcagctctgctcccaagatgatcgcccgtgtgcagaaaatcaggttcatccaggaccggtgtaaggggtacgagaaggccgcctgggttataatatggctgcgttctttcttcaaacagttctacggatcagtgtccaacgacgactacattgcgatgagactcggtttcgtcatggagcactttagggggcaccccaagttcaacttttacgactacatgatcaaagctctcgagaaagatttcaagcgagtagttagtataaaatggtattactggatttttgtgatgatctttctgctgctcaatgtcaccgggtggcactcctacttctggatctcattagttccactggctctgctgcttctgattgggacgaagctggagcacatcataaacaggctggcctacgaggtggcctcgaagcacgccgccgggcaaggcgaagggggcatcgtggtgagcccttcggacgagctgttctggttccgcagcccacggctggtgctcgtgctcatccacttcatcctgttccagaacgcgttcgagttcgcgtatttcttctggacactggcgatgttcggcgccaactcctgcatcatggacagtctaggatacagcgtctcgcgaatcatcatatgcgtcgtcgtccaggtgctctgcagctacagcacactcccgctctacgccatcgtgtcccatatggggagttcgttcaagagcgctgtgttcgtggacgacgtcgccgacaatctcagagggtgggccgacggcgcccggaggcgcgtgcggagatctgccacgggtgtcgacgccagttgcctgggtacgccggcggcggcgggacggggctgggaaggcgccgccggctggagattgattgccgggaggccgagccgcccaactcagcagcctcggagcatctccttctgagttctgtctagtttctgaagaaggaatcgaaagccgcgcaatctgcagcacgcgtatgctgtcgctgcccgtcttcatttgggtattattgggtttgagttgacactgaccaactgccgaattttgcggaaacttttatggtcatgcctcttgtgccactattacgaccgtggcggtgagcacggagtgtaatagagtagtaaagatatgtagctcgcatatatatatatatactgtacctccgcccgtgatgctagcagtagcagcggcggatggggctctagcggcattgttg

SEQ ID NO: 4566 - DNA, 2280 bp, Zea mays
  misc_feature (20)..(20): n is a, c, g, or t
cctcgaagccggccgggccnggaagagaaagagggcggcggcacggcagagccaaagccgaggcgagccgagcagtacatgcatcccgcttcccgcattcctcatcgaggtccggtccagcagccttttgcgccttcgtgtccctcccctccactccctcaccgggggctgggctggtggggagtggggactgggggcagtcgccacgccgcagtccattctttcgtcacccatcgcagctccaacacctctcgctagtcgtcatggcggcttccgcggcagcgttccccctcccaccgccgacgcctcctcttcgactttcacatgtcttttgatatcacagaaaaggattgcccctgccttcactgctgtgaatgccagggacgtttctgtcgccctacaatatatggacattggacttgatagttggcaaactttcttctatatactggacgttccagctttcgccaacctgctgctttaaccacatcttttccttctttcccgattttgcctctcactatcatcaattaccgctaaaagtgaaacaagtgttctccctatggccaagacatcacttcctcctggattccggtttcatccaactgatgtagaactcacagtctactatttaaagaggaaactactgggaaaacacttacgctgcaatgctatcactgagattgatctatacaagttcgccccttgggatcttccagagagagcttccttggagagtaacgatctagtgtggtatttcttttgcccgcgcgataggaaatattctagtgggttaaggactaatcgctcaactggagttggatattggaaagctaccgggaaggacaggccggtggtatataattctaggactgttgggatgaagagaactttagtgtttcatcttggcaagccaccacgaggtgatagaactgactgggtaatgtatgaatataggctggaggacgaggaaatagctgcttctggtgttaaactggatgcctgcgttctatgcaaaatctttcagaaaagtggcccagggcccaagattggcgcacagtatggtgccccattcaatgaagaagactggaacgatgccagtaatgtagagtgttctccatgtgtgccttctgtggccccttgcgcacctgaatcaagtcgtggtgggttgaattctgctggtcaacgcctggctgtgagttatgatgtcaaggtttccttgggctcctcggcagaaggtatcaacagacctgctgtcaatggagttcatcctgtcagaccttctcctgatgctcctaatgactgcatacacattcaattgctggctgaggttatgagatgttcctcaacctcaatgcatgttttacgtactgctggtgacgatggtttgctggctgattcaactgctgactacagtagtgataatagaatatctttggatgctattgaaactatattctgtgaagtggatgagcttgggccccaggctatggtgaacaatactaaccattgtgactcatgcggtgagtatttgattcaccctacgatggtggcacgaggagctgaacagtacttagagctaaatgacctgtccttttcgctcaccgatggtcctgattcctgtggcgtgcttttctctaatggtgtatctgttgagcaactaccggatcttgagctcaggtttgagcagttctctcctgaccacatctccaataccgctattgcttccacatcaacaacggttggttcatctgcttcagtgcccttattggaggatcacaggacctgattcagaattggagtcatctggcgcacatgttaattgaatctaggaggatctgcaggacaaaggcataatgctccctttttttcaattttcatgaagttagaatttttttttggatgaaggcacggattagtgaccacttggcacagaaatatgtttgtgttgcggcttgtgaatccaggaccatttctctgcctgtagttttgcatggtagaactagatgggcaacaacaaaatgtgttcagtattgaataacgcactcactgcattaactactttgcctagcttagtatagtattctggatcttgaggcagggtagaagtgggggtgtgggacaatgtactcacagcttgttgtcatttagcagcaatatcttgtttcggtaaccaaaaaaaaaaaaaaaaaaggttacctggatttgctagtgtccatgcaagatgatgttttcgttgacgccataataataaatagcaatcgattttaaaaaaaaaaa

SEQ ID NO: 4567 - DNA, 1329 bp, Zea mays
atagataatcttatataaaaataggtttatatatcctggtgctcttgccatggctggtgcatcgctcctctccccatcctgcacgctcctccgcctgattcccagcgcgtcgcacttcaagagattcgatcgggttcgccggttcgcgcccgccgccatggcgacttcctcaggaccaaaggaggcgccagcgaataaccctgggctccagaccgaggtcgaccccgccaccaaaggctacttcttgcaacaaacgatgttacgtgtgaaggacccaaaagtgagccttgacttctactcacgtgtgatgggcatgtcgttgctgaaaaggttggattttgaagagatgaaattcagtttgtattttctaggttacgaggatgtgaccttagcccctgatgatcatatcaagcggactgaatggacttttaggcaaaaagctactcttgagctcacccacaactggggcacggaaaatgaccctgaattcaaaggttaccataatgggaactcagaccctcgtggttttggtcatataggagtaactgtggatgatgtccacaaggcatgtgaacgctttgaacgtcttggggttgagtttgtgaagaaacctgatgatggaaaaatcaaaggcatcgctttcatcaaagatcctgatggttactggatcgaaatatttgaccagacgattgggacggtaacttcttcagcatcatgatgaacagtagtggttccttatatggtgcgcaagatcatacaactctggcataagagcttttcatatgtgtgtctggggtctggactcggattaagggctggaatctgtttacttctagcatcttcttgctttaataatatgcgaactatgttgaggaatgaaataaaataagttcgggtaaaaattcaaaaaaaaaaaaaactgcccggtggtcccgcctgcatgcacactccccagcgcgggcacgtcctgtgccactgccttgtgggcccggccgcatgcaagcgcatgccttggagttacggttggagttggaggttcccccacctggcgacgcgaattagggctgggcaaaaaaaatccgaaatccgaattttgttcgggaattttgggtagtaacttgcaaaacccgaatttattttgggcatcataatcgggtacctgaattacccgaactttcatgtgtcatgtactcacgtcgtgtttaattattaatttgtacatctataattatgtgtacgtgtgcataacttgtgattgtagattgtttgtgttttatatgtccatgtatattaaaattcaaactatatttttatgctaatttaataggt

SEQ ID NO: 4568 - DNA, 996 bp, Zea mays
cattgggtaccccggccccggccataatcttatataaaaataggtttatatatcctggtgctcttgccatggctggtgcatcgctcctctccccatcctgcacgctcctccgcctgattcccagcgcgtcgcacatctgctgctcgtcgcacttcaagagattcgatcgggttcgccggttcgcgcccgccgccatggcgacttcctcaggaccaaaggaggcgccagcgaataaccctgggctccagaccgaggtcgaccccgccaccaaaggctacttcttgcaacaaacgatgttacgtgtgaaggacccaaaagtgagccttgacttctactcacgtgtgatgggcatgtcgttgctgaaaaggttggattttgaagagatgaaattcagtttgtattttctaggttacgaggatgtgaccttagcccctgatgatcatatcaagcggactgaatggacttttaggcaaaaagctactcttgagctcacccacaactggggcacggaaaatgaccctgaattcaaaggttaccataatgggaactcagaccctcgtggttttggtcatataggagtaactgtggatgatgtccacaaggcatgtgaacgctttgaacgtcttggggttgagtttgtgaagaaacctgatgatggaaaaatcaaaggcatcgctttcatcaaagatcctgatggttactggatcgaaatatttgaccagacgattgggacggtaacttcttcagcatcatgatgaacagtagtggttccttatatggtgcgcaagatcatacaactctggcataagagcttttcatatgtgtgtctggagtctggactcggattaagggctggaatctgtttacttctagcatcttcttgctttaatatatgcgaactatgttgaggaatgaaataaaataagttcgggtaaaaaaaaaaaaaaaaaaaaaaaaaaaaaaaaacccacgcgtccgactagttctagatcgcga

SEQ ID NO: 4569 - DNA, 2663 bp, Zea mays
cggccgggaaatacgtcgcttttcctgcaagccctgtctcgaacccgaaccagctcgagcctcgaaccctaacccccaccacgtaactccttggaattaccgaaatgccactcttcttctccaaattcgcaccattggtcccccgcgtccgccgcctttccatcgccgcggcgacagccgccggcgaggaccctaagctgtctcgaatcgcggatgagctcctcgccctatcccccgccgagctggacgactacgcggcgctcctgcgcctcaagctccgcctgtcgctcacctccagcgcagctgctggagcctctccggccggggccggggacgccgcggctgcagccgtggaggccgccgcggcggtgaagacggcgttcgacttgaagatcgagaagtacgaggccgcggcgaagattaagatcatcaaggaggtgcgcgcgatgacggacctgggtctgaaggaggcaaaggagctcgtggagaaggcgcccatagtggtgcgcgcggggttgcctaaagaggaggccgaggcgctcgccgctaagctcaaggccgccggtgccgctgttgcactcgagtgatcccacgaaggtgtcgcctctttttttttttgttcctagtgtttttagacgatgcaacgtatctttgcgccttaatttgtttggaatggaattcaatggattggataggggtataaagaggatgcaacgtatgctctacttgcgttgttgtagcttcggataagcctcaagcctaatcactgatacgagtgacagcattttcctgaatcgcacaataaggtgttcctgcacaatgttctatattactggcctggattggtttgaacagccaaccttcagtagttagtggtggtgttactgtaaaaggtggctagaatatgctagcttggattacttgttcatttcaagtggtgctcaactgaaatgtgtccattatctttattctggtgcatgaaactgtttgtggtcatatcattaagggtaaagcttatgttctcttagtatccaccgtaggttctgtccatttcatgtgctgtttgaaagcgattttttatggttagcctggcaatgaaaacgatgtttgaaaattaccccgaaatgaatgatgatttccgtacatttacattgagatgtattgttgttttaaatggctttgtttggggttgtaggtataaagaatgaagtgatctcaagtatcaaattgaatttaaggtatccgttaccatggatatgtacagattgcatgtttatagttttgtttcacagttctaaatagttctgtccaaagacatagcttatatgaaggtggtgtatcattgataaaggtgaaaaatacaggacatctatcgttacgtgttacataaatgatataatgtgcagggggctccgccgtctcgctagtcatggtttgcttatgcttaatcacgcaatgtttatttcctgaatggtttcaggcagccatacaatatttgtcttaattcaaaattaatgaacaatacgataatataattgatttgtgcttagaaatggctaacccaacatgtttgcttagctgtataattttcccttgatgaaaatcatagttgtattatgtggtttctgttttaaatttgcctattgtgggttgcacgggataacatttatttatgcaaatagaagcccttggtatgcagttttcgtgagtaacatggacaaattaaaccttgtagtatcgcttgtaaagtcttgaaatgtgcatataaagcaggaaaacaggaatattaaatgtgttatttctcgtgctattcaaactattaaaatattagtagagtggttactcagatggtaggtcatgcatggtgaagttattagaacatagagttgcgggcgaatatcgtcagtcatccctacaggctaaattgagctgccaattttcaactgtggaagcctgtaaaatttctttaagtgaactcttggaaattaggggaaattggcatgtttttgcatctctctatttgtagttatagtctgtagtaggttgtgtaatgcacggtaagttcccgctttgtttgcataaactgctctaggatcttaaagggcttgtttgggaacaagtgaaatgaagggggttgagggggctagaatcccttattattcgattttgaatagtaacttagtaagggattctaaccctctcaatcccctccattgcacttcccaaacaggccctaagtgccattgtgctatgttttgtctcctacttagtgcagttacagaggaatgcttaccacgacctgaagaaatgaaagctctgcactgtcatccatgagaccatgatgcatatcatcataagtatcgcacaattgtctgtaaagtctaagacactgagtttatagtttttgaagtctctgtttataaacttgttgtttccttgtttattaattaagtgtttctgaagccagaggaatgaaatgctgcaagccactctgttgttatatttgctctcttctaactgaatctgctaaagctagtgttggtgtttgataatgctgtgcttttgctgatagagaattcgtagttatttatctccattacttattggcgcttatgtggggctgcaagtgtgtcacgtctgaattgctccttttcttaattaag

SEQ ID NO: 4570 - DNA, 1000 bp, Zea mays
ctgggcccatcagaaaagccacaccccactcaaaaccaactaaaacccaaactaaaaaccctgtcctcgtcggcgagccagcccccccaaaccctaggctgccgccaacccgactggctcccccctcactcttctcccgccatgaactaccgcttccagaacctcctcggcgcgccgtaccgcggcggcgacgccgtgttcgcgggagactcacccgttctcctctccgctgttgggaatcgcgtggcctctactgacctcactgcctcctcgtctctcacgcttccgttcgagtcttcatccaacgtcacccgcctcgccacttccccctcgggcgacttcctcctcgcagccgatgacaatggccgcgcgctctacgccaacctccgccgccgcgccgtactccaccgcgtctccttcaagggcgcgccatcagccgtccgcttcagccccgacggtcagctcatcgcggtggccgtcgggaaggtcgtgcagatctggcgctccccggggtttcgcagggagttcttccccttccacctcctccgcactttcccgggcttcgccgctggcgtgacagcattcgattggtcaccggactctgcgttcctcctcgcgtcctgcaaggacctaacagctcggctcttgcctgtcaagaagggactaggaggcaagcctttcctcttccttggccatcgcgcggctgtcgtaggtgccttctttgccacggacaagaagacaaggagagtcaagggggtttatacagtctccaaggatggagctatctttacatgggatttggtggaaggaaatgaggaaaatgatacttcacctccgccatcaccaggtacgccagagcaggggtcagaacagaatgtcgtcgatgccatggaactggatggtgggagcaggaaaaggaagattttgggagaattggagggactagacactatgctgcatttggcaaaatgggagctgcgggaaaagcatttcttcatgc

SEQ ID NO: 4571 - DNA, 721 bp, Zea mays
gtgcggcgctcgagtcctaatcgaaaaacaggctgtacgtagggccgtgccgtcgcccctccttcctttccttcgtcgatctctatctcggcggcgactgggcgaccgctgcctcctgttgccctggtctccattgggccctttgccagattttctttcgcctctccgccggcgacgaacaccactaccaggaatgggcctgtggacgttgctggagggttttttgcttcttgcaaatgcgttggctatattgaatgaagaccgctttctcactccgagggggtggagcatgtctgaagtatcaggaaatgggcaaacgaagtcgttgaagggccagatcgtggggctaatctatgctacacaatttctgaggatgcccttaatagcactcaatgttctgatcattgttgtgaaactggtgtctggctgaggctcattatctagttttcactgttgtgttggattgatatctgttccagcatgatgtaaaagttagtaatactcaaagctgctggaaatatgttcattttttactctaatgtgaatttctgttatttcttctggtaaattaattctggtcagaaaatggctctaaacatttatactatcaaagcattgtgcaatggtgttatcaatttattcgaaataaaacaaaaaaaaagcggccaaaaaaaaaaaaaaaaaaaaaaaaaaaaagaaaaaaaaaaaaaaaaaagcggcc

SEQ ID NO: 4572 - DNA, 2240 bp, Zea mays
accccccgacacgaggcaatcccccccttgctcgcttcgcttcccaaatggctcattccaccactgccactgccactgccactgacggcgagaccgccccggtgccgcgggccctcgcgccggcgcggaaagtggcgctgacggacgcgtgggcggggcaggacgggagctacctcacggagctgctcctgtccaagggatacgaggtgcacggcctcatccgccgctcctccaacttcaacacgcagcggctggaccacatctaccacgacccgcacgcggtgccgtcggccccgcgtcccccgatgcggctccactacgccgacctctccgactcctcctccctccgccgcgcgctcgacgccatctcccccgacgaggtctacaacctcgccgcgcagtcgcacgtcgccgtctccttcgagatccccgactacaccgccgacgtcaccgccacgggggcgctccgcctcctcgaggccgtccgcctgtcgcgcaagcccatgcgctactaccaggccggctcctcggagatgttcggctccacgccgccgccgcagcgcgaggacacgcccttccacccgcgctcgccctacgccgccgccaaggtcgccgcgcactggtacaccgtcaactaccgcgaggcctacggcgtattcgcctgcaacggcgtgctcttcaaccacgagtccccgcgccgcggcgagaacttcgtcacgcgcaagatcacgcgcgccgtcggccgcatcaaggtcggcctgcagaccagggtcttcctcggcaacctctcggccgccagggactgggggttcgcgggggactacgtcgaggcaatgtggctcatgctgcagcaggatcagccggccgactacgtcgtcgccaccgaggagtcccacacagtcgaggagttcttgcaggctgccttcggctacgccggcctcaactggaaggatcatgtggtcattgacaagaagtacttccgccccgcagaggtcgacagcctccagggagactccaccaaggcgaggaagttgctcaaatggaagcccaaggttgggttccagcagctcgttgagatgatggttgatcgcgacgttgagctcgccaagaaggagaaggtcctggtcgatgctgggtaccgtgaccccaagcagcagccatagaagcagcacggctgcttcttgctctgctgcgttccggattcagactgttgctcatacacggtgattctcagagtaaaggttgacccaagttactatcgatacttctccaggtaagaaataaggatggttgcagtatgaccctcacagtatcttcattacttactttttcttccctataaaccaaacacccccttaaacaaaacgatgaataatccatgccagtttggtatttggaagaggatgaaacgcctgtctgattgtagctgttgatgttaagacatactgatagcatcagtttgtattgttctacttcagctactgtcacacatgtactgtttgatcggaaatatatgtttttttaggaaggttaatttccgctgttccgagttcagcacctactcttctgaaagtttaaggttactcttcagtcttcatgtcaaatgatatcatatctgatccaaaaccaatagaaaatcaataccacggtccacggccccacgccgaatataaccttttttttcttcttctccaatataaagccaagagagttaaaatatgctcagtcttatagcataaaatgggtcacatttttcttctccaatatacgtcctcacatttgtttcttctatttgttaccttcttggttaagctgttctggatctggcttggagaatttttccccttgacttcatctatcaacatttttcattttttttcagttcgtgtgccacattgttcagtgcactatgtaaacggaggcttgattatttgtaatatcctgttgtgttcagtgcactttgttcagtgttatagtttcagtcacttagcaactggattattctgagtttatttgtaatatcctgttgtgttgtaaaccgaacctctttgttcagtgcactatgtaaacggaggcttgattatttgtcacatccatatatgttatacattttttaatatataaaataacgtgcttttcttcttgaattggacgatgtcacgttcgttgtatatatacttgattgtacttgagcctgggagcatctgtcaataagcagaagaccggctggactgcttcta

SEQ ID NO: 4573 - DNA, 2890 bp, Zea mays
  misc_feature (218)..(218): n is a, c, g, or t
aaaagacaattgaggcaagagtaggagcagaatgaggcgataagattatctcaagcaccttacccatctccagtcttatattcaaactccactctgcaaacaatgtagtctacaatgcaaaatagtgttttcgatgatcatatgagtgaactgctacacacagtctaaaagaggtcgagcagtcagagcttcaacagttatccaagcaacgatatacnacagatgataactctgatgtgtactgaagtagtgccactgcttccacctccaacacctccatcgaggcaacgagatcctctatagttacctcccctgcagttgggccactaacatgtgggcctggtctagatcaggcccacacgtcattgacccaactgcaggagaagtaactatagaggatttgcttccccatcgagaacccatcaagaccagtttgatgaagcgaccgagcaacaatttatgatagtagagcaacttcgatgagagaccgagcatagagaggagcaacaccagttggtagaggcctaataaggtagactaacatgatgcttacattgtttgagaccatacagacccatcaagaccagttttagcaattgttgctagtggatacatgttcaaaacttttacttacttcccagcaaactagagtagtcgtgtcaccaccatcagttcatatggctcctctggctacactacagactcccatggccctagttatacagtttggaggactttagagttagagtttgtatcactttactttgctagtctatctaacaacacttaacttctctacacctatttagggtataactataggctttgactaggtgtcatggactatatagttactgctcttccaatatcgcctgtcatagtgattatcgttgccacgccacctacgtcgacaacatcaaccaatcaggtcactagagctccattccagatggttgcttcacctatagcactacagccaatagctttctatagcttgaatgataatgttaagccactaccttctttaggccttatttggatactttcgtattcacctcaattcgcatgtattgaattggattgaactgtaacttaaactaatttacacaccatacctcattcaaattgtttttacactaaatgattattaagaaataaataaataaattgttctattataattatgtaactacattgttaaggtaggactccacttgaaacacgcagtagtaaaatacaacccatttcaaagaaattatgggaggtaagactagcttcaaagaaaattaaaggcaaatatttttgtttgcattgctcgtttggcaaatatacacgcacacttgactggtcagaccccgctgcatcggctctgcaggcgggacctacaaatactccctgccccccccgccggccgcccacccaaatttgcttcccagatctgccgccgcacccccaacccgtggcaatcaatccccttcctcgcttcgcaaatggctcattccaatggcgcggccgccactgccactgccggcggcggcgacgtggacgacgagaccgccccggtgccgcgggccctcgcgccggcgcggaaggtggcgctgatcacgggcatcacggggcaggacgggagctacctcacggagctgctcctgtccaagggatacgaggtgcacggcctcatccgccgctcctccaacttcaacacgcagcggctggaccacatctaccacgacccgcacgcggtgccgtcggccccgcgtcccccgatgcggctccactacgccgacctctccgactcctcctccctccgccgcgcgctcgacgccatctcccccgacgaggtctacaacctcgccgcgcagtcgcacgtcgccgtctccttcgagatccccgactacaccgccgacgtcaccgccacgggggcgctccgcctcctcgaggccgtccgcctgtcgcgcaagcccatgcgctactaccaggccggctcctcggagatgttcggctccacgccgccgccgcagcgcgaggacacgcccttccacccgcgctcgccctacgccgccgccaaggtcgccgcgcactggtacaccgtcaactaccgcgaggcctacggcgtcttcgcctgcaacggcgtgctcttcaaccacgagtccccgcgccgcggcgagaacttcgtcacgcgcaagatcacgcgcgccgtcggccgcatcaagctcggcctgcagaccaaggtcttcctgggcaacctctcggcggccagggactgggggttcgcgggggactacgtggaggcaatgtggctcatgctgcagcaggatcagccggccgactacgtcgtcgccaccgaggagtcccacacagtcgaggagttcttgcaggctgccttcggctacgccggcctcaactggaaggatcatgtggtcattgacaagaagtacttccgccccgcagaggtcgacagcctccagggagactccaccaaggcgaggaagttgctcaaatggaagcccaaggttgggttccagcagctcgttgagatgatggttgatcgcgacgttgagctcgccaagaaggagaaggtcctggtcgatgctgggtaccgtgaccccaagcagcagccatagaagcagcacggctgcttcttgctctgctgcgttccggattcagactgttgctcatacacggtgattctcagagtaaaggttgacccaagttactatcgatacttctccaggtaagaaataaggatggttgcagtatgaccctcacagtatcttcattactttttttttcctgactatgttacacgtcttaaggggtgtttggtttctagggactaaactttagtccctccacttaattccattttagtccctaaattactaaatat

SEQ ID NO: 4574 - DNA, 926 bp, Zea mays
accgtgtctgcctcaaagctatgccaggacgccacgtccaagcaaagcacccgatgccattgccacctcccagcactcacgcgtgagcgtgactataaaaaacgcaccctctgcatccgcccccgtctgcctgccctatcgaatctttcgccgccccatcagcccagcaattcttcgctgttcgttgccgttggttccatcggttgatcgaccggccggaagcagagagagagagatgggcaagtcctgggcgctcatcagccacctccacaccgtcgccgggccgagcatcaccctgctgtaccctctgtacgcgtcggtgtgcgcgatggagagcccgtccaaggcggacgacgagcagtggctgtcctactggatcatacactccttcgtcaccctcctggagatgctcgccgagccgctcctccactgggtacccgtgtggtacccggccaaggtgctgttcgcggcgtggctggcgctgccgcagttcaagggcgcctccttcgtctacgagaagctcgtcagggaacagctccggaactaccgcgccaggtacccgcgcaagggcgccgccgccgccgccgccgtcggcgacgacgacgacgaccataaggtgcacatagccaaggtaggctgaggctgagcacgaccatgtgcagtgaaagcgtgtggagacgacgcaggagctgaccggagatcatcacaggaacttctgtagatctggtgttccaaggtgttcatttgatgtatcctacgtgtctctgtagctcttgtggactgccggtgtcgcgtaatgtatctgaactctcttcgcgagtgcgacggaaccccccctccccttgcagcacgagatgcttctgtaagaacgataacatgtagacaagccaagcgcctcagctccttaagtaaaaaaaaaaaaaaaa

SEQ ID NO: 4575 - DNA, 1461 bp, Zea mays
ggtaccggtccggaattttcgggtcgacccattttccgaatggtctctagatctccgggataacttccgtaggattgttgatccagatgttacaacaaaccccaaccataccagaaaacaaattgtcttggatggcccacggagttgtggtaaaagcattgcacttgcgatgcttgtccattgggcgcgtactgaaggatggctggtatttcccacgcgtccggggaaggattggactcatggaggattcttctatagaaacacatacagtgattttttcgatacaccagtacaggctgccaatatcttgcagaattttttgaagtacaatgaaacacgtttacaacagttaccatgccaaatttttgagcctattcccctgggagaaggtgctggtgttggaatgatgaaaggggttgacacaatggaaatgcctgaagggtccacattatatgatctcattcaaactgggataactcaaacacatgcttcagttggtgttatggttcgcttaaggaaggagctgtcccttgttaaagacgtgcctgtactatttgccattgatcagtacaatagctggttcacattcagtgacttccaggaacctgtaactgtccgatcctgtcgatcgatccatgcaaaagagcttacaatggtcaatgcttatagatcaatgctgcacaatgatatgatggtgggggctttttcacactcaacagcagttggcaaactacggcaggagctgccagatgttccttctgatgctcgtttgatctttccacgttacaccttagatgaagctgagactgcatgtcactattatatgaggcaaaagatcattcggcgcgagaatttttcagaagagaaatggaaaaagatatactacttatcaaatggaaatggtgcagagatgagatggcttgctgccttcgtttgaggtagatatactgtccctgaagtttctgatacctggatttgtactcagttttggtggtggtgtagaaaggttgccacctctgtttcagcattccgttacacaccacagttcattgttgtgtacttgtagtccgtctcttgacacctctagaagaaagtttggcgtcaacatcatttgtgctgagtagaacttgaggagataaggcataagtatgtggctcagttacatgattatatccttaggcttctttcagttctcgctcagatgctagatacaaaataatgtagcattgttattggagaagttttcacatgttttggctccgccgagcacgatgagtatgatgagttgatgccaatctactcagcatgcttgctactatgttgctgaattgagctccgttgagtattttttttttaaaattactgtacgaatcgaacaattatttgagttgggaacaatattcttctttgcggaaactcaaacggtcccctggggttacgaggcatatcctcagtttgaat

SEQ ID NO: 4576 - DNA, 1726 bp, Zea mays
gctcttcgctttcactgacacgttcgggtccttcgcccaccgtgacgcgaacatctatgtcgacttcactttggatgaatggaatgccatgttaccagaagggctgccagcagggatgatgaaagagtttcaggagacaagacggtgtgctgtgatggtgaggaaaagcttcctagatctccgggataacttccgtaggattgttgatccagctgttacaacaaacctcaaagatacccagaaaacaaattgtcttggatggcccacggagttgtggtaaaagcattgcacttgcgatgcttgtccattgggcgcgtactgaaggatggctggtattttatgttccacaagggaaggattggactcatggaggattcttctatagaaacacatacagtgattttttcgatacaccagtacaggctgccaatatcttgcagaattttttgaagtacaatgaaacacgtttacaacagttaccatgccaaatttttgagcctattcccctgggagaaggtgctggtgttggaatgatgaaaggggttgacacaatggaaatgcctgaagggtccacattatatgatctcattcaaactgggataactcaaacacatgcttcagttggtgttatggttcgcttaaggaaggagctgtcccttgttaaagacgtgcctgtactatttgccattgatcagtacaatagctggttcacattcagtgacttccaggaacctgtaactgtccgatcctgtcgatcgatccatgcaaaagagcttacaatggtcaatgcttatagatcaatgctgcacaatgatatgatggtgggggctttttcacactcaacagcagttggcaaactacggctggagctgccagatgttccttctgatgctcgtttgatctttccacgttacaccttagatgaagctgagactgtatgtcactattatatgaggcaaaagatcattcggcgcgagaatttttcagaagagaaatggaaaaagatatactacttatcaaatggaaatggtgcagagatgagatggcttgctgccttcgtttgagtttctgatacctggaatgtactcagttttggtggtggtgtagaaaggttgtcacttctatttcagcattccgttagacaccacagttcattgttgtgtacttgtagtccgtctcttgacacctctagaagaaaaattggcttcaacatcatttgcgctgagtagaacttgaggagataaggcataaatatgtggctcagttacatgattatatccttaggcttctttcagttctcgctcagatgctagatacaaaataatgtagcattgttattggagaagtttttacatgttttggctccgccgagcacgatgagtatgatgagttgatgccaatctactcagcatgcttgctactatgttgctgaattgagctccattgagtattttttttttaaaattattgtacgaatcgaacaattatttgagttgggaacaatattcttctttgcggaactcaaaggttacgaggcatatcctcagtttgaatagtttagcttacccttgtatcctcagtttgaatagtttagcttacccttgtttctcggagatgcaacatattgatttagctacattgtctattcctgtgtacctatgccgtttatcgattttccttctgtaacgaataactctttaataaaaaaaaaaaaaaaaaagcggcc

SEQ ID NO: 4577 - DNA, 1697 bp, Zea mays
caacttttgtctcacgagatttcagcttttcgcatactctagtcaactactctactcccctcgtacgtatcaacgtatgttttgcctgtgtcagtgcgtgtgtactggttgtgtagtgtaattgtccgcttgtggcgaggccacgcaaccatcgtcgggcggggccaccgccaccctgatttccgcgtgcgacgggacggtacgagagaggggcatggggtgcgagtacgacaggcgtcacgggaatcccccggttcccgtcgcctcgtcacacggtttccgaagaggggaataaatgacaattgttacgtactccagtattcctctttttatttcttaacggaaaaggttgaaaggattcgtcgtccatttaagtcccgtggcccggccccgtcgcgggcggcgccaaggaaacagtcacgtctcccagatctaactgccccccgactcacgaatcccaaagcctccatggcgacgcaccgccactgcctcccactcctcctcctcgtggccgccgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccgccgcgtggtgcgcggcgagcagcaggtcgtgtccgggatgaactaccgcctctacgtcgacgccgccgaccccgccggccgcaccgtgccctacgtcgccgtcgtgtacgagcaggtctggacccgcacccgccagctcgcctccttcaacccggtgccccgcgcccactgaaaccatacgcacacgggtgggccgaagcgacgttctccgtcaattacgtgtcgagctaatcttattattgtttctattattataataatgcttctccctgttcctatggacctatagtagtatactagtatgttgcgagggagcgagtagaccgtgtgtttcgctatcgtgggactagaataagccatgtcaatgaacatgagccgaatagaggctacgtactgttattgtatcagtactagtaccatatatatatatgggcgcactacagtctgtgatgtaatggattgtgctagtatttgactcttgcttttgtacagaattattattattttatatggtgttctaggatttactgcacggggttttagttaacctgcacacgaaatcttttggaacgcgcttcttactctctgttttgttttagttgtcgctagatagtgcaaaattgaactatccagcgataattaaaggaaacggagtagcatttttgtagatggattctgtcaaacaggacaggaatcctgcagcagctgcggcctcgctggatccctcagtttcctaggcacgtgaacccctgatcatcagatatggtactgtgtgtgtactagcgtcgaacagctggatcgcgctggacggatggagcgatttggatgtgttcacgtggatgcctgctctgcacggctgctatccataaacaattccttggtccttcgatggggagggactgacgaaagaggaaagactccacctgtagccaatcctttttctgtttggttcaaatattaattgtatactgtaagtataatattttattacacatatctggtaagttagac

SEQ ID NO: 4578 - DNA, 886 bp, Zea mays
gcacgagaccattacctagggccccccgggggccgggccggcaaggaaacagtcacgtctcccagatctaactccccccgactcacgaatcccagagagcctccatggcgacgcaccgccactgcctcccactcctcctcgtggccgccgccctcgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccgccgcgtggtgcgcggcgagcagcaggtcgtgtccgggatgaactaccgcctctacgtcgacgccgccgaccccgccggccgcaccgtgccctacgtcgccgtcgtgtacgagcaggtctggacccgcacccgccagctcgcctccttcaacccggtgccccgcgccccctgaaaccatacggacacgggtgggccgaagcgaccacgacgatgttctccgtcaattacgtgtcgagctaatcttattattgtttctattattataataatgcttctccctgttcctatggacctatagtagtatactagtatgttgcgagggagcgagtagaccgtgtgtttcgctatcgtgggactagaataagccatgccaatgaacatgagccgaatagaggctacgtactgttattgtatcagtactagtaccctatatatatgggcgcactacagttctgtgatgtaatggattctgctagtatttgactcttgtgcttttgtacagaattattattattttatatggtgttctaggatgcacttactgcaaaaaaaaaaaaaaaa

SEQ ID NO: 4579 - DNA, 1393 bp, Zea mays
tcggtaccctgtctcacagttgcaacaattattatttggtcgtctgcgaagagaggcatgttagttataacatttatcaggagctgtcagtccatctatagctatgtggttactccatgcatgctacgtactggtggatgacaagggctggctgctagcggcggtagacgacctgtggaatgtgaatcacctccggccgcccgggtgacagccacgccacgcctaccgcagccagcggccaaattttcaccgcctggaccacgaacctacgtgcgcacgtacgatggaaatgaacgagagccatgtgatgtgatcctcctcttcttcaaatacccaccacacgcacgacgcccgataggtagctcactgtactgtaccctagctagctagtcgcttccagtccagagcgtcccgagaccaatggcctgccacaccgtcatcccgcttcttctcttcctcccttccctcttggcagcggctgcggacgacgtcgcccctgctcctgctcctgccccggcggcaccacccgagcccaccaacaacaacctgaccagcatcctggaaaatggcgggcagtacaccactctgctccgcctcctgaacgccacccggataacggaacagatcagcagccaactcaagaactcgtacgacggcctgaccttcttcgcgcccaacgacaacgccttcgccaagctcaaggccgccggcacgctcaacgccctcgcagaccaagaccagatccagctgctgctctaccacgtcctgccccgctactacagcctcgccacgttccagacggccagcaacccgctgcacaccgaggcgtcgggccccgccggcatgtacagtgtcaacgtcaccgccagcaccacgaaccccctggtgaacctttccactggcgtcgtcgacgtgcccatcagcagcacgctgttcgctcgcttcccgttcgccgtctactccgtcgacagcgtgctgctgcccccgcagctattccacacggcttcttctgcgccggcaccaggacagtctgcagaggcgccggtgcctggaaaggcggcaccagggcacaaggggggcgtcccaaagagcggcgacgatgtggcagcgcagccgtccgctgcggtggatggggcacaagacaccagtgtcgccgcggatggtagagggagcgcggcgtggatgacgccggtggttgttttgggtggcatggccctactgctttgcgcgtgagcagtgtgtgcttcgttctgttttgttttccttggcatctctctgatttctctctcgtggccggtttgtatgtactgcccttaaaaatgtaattctgcatttatgataacgatgatacgatggtccacttgtgtaaaaaaaagaaaaaaaaaggccccta

SEQ ID NO: 4580 - DNA, 1761 bp, Zea mays
aacgactgacagtgaaaaaataggaaatgactcgtcaacgcaactaccccaagtcgccgctgagccactctctccgtccgcgaatccgtaaatggaaggggacgaaatgctcagggtgaagctcggcaggcagggccttgaggtgtccaagcttggcttcgggtgcatgggcctcactggagtgtacaacgcccctgttcctgaccaagctgggatcgacataatcaagcacgcgtttgaggccggcatcaccttcttcgacaccgctgatgcctatgggccacacaccaacgaggtcctgctcggaaaggcattgaaacattttcctcgtgagaaggtgcaaattgccaccaaatgtggcattgcaggatttgatgcaagtggcatgcgtgtgaagggcactccagattatgttcgagcttgttgtgaagcaagccttcagcgccttgctactgactacattgatatatactaccaacatcgcattgatcagtcagtgcctatagaggaaactatgggagagctcaagaagttggttgaagaagggaaagtgaggtatgttggcttatcagaggctagtgccgataccattcgacgggcacatgctgtccatccaattactgcggtgcagttggagtggtcactatggaccagagatatagaggaagatataattccagtctgcagggagcttggtattggaatagttccatatagcccacttggccgtggcttctttgctggcagggcagctgtagaacgtgttccatcagaaagtctattgtctaaacatccaagatattctggggaaaacttggagaagaataaagttctgtatacacgacttgaaatgttgtccaagaagtatgggtgcacacctgctcaactcgctctctcctgggttcttcatcaaggagaagatgtggtccccatccctggaacaacaaaagccaagaaccttgacgaaaatatcggtgctgtaaaggtaaggctgagcaaggaagacctcgaagaaatctcaggcgcattccctgctggtgaggtggctgggtctagactccttggagtcttggagcctttttcctggaggctcgcaaataccccgcctccaaaatagcgagttcagatgcaaattcttggccatcctaccatttaggtcatgttatgttagatcatatctacatgatgcaaatgattgttcctgtgctcgcgcgtgaaaatgcatgtacctgaaacaaagagatgtaacagttggttctctgtgtggaacgtgctgattgctatagttgatcaaagaaatacgttggaattaagctaaatgtccttcatggtgcactttgatgccctttggttcctttatatgcatggtttctactgatattacaagatgcttccttaacgttaattagtacattgacagatgtgtctacccttgctgtttgcaggcaataatctcctctagctacagaaaacaacgttgtgcagacagtgaaacagattaacctgcattgctcgtgcaggacttcgcagatgttccaagcaactcgcaatgcccgagtagggagggctacctagctagcttgctgctggggcccaaacctttttaaaaggcccccggtttttgggggggcccggggtttccccgagccccccccaaaaaatttggggggggggggccccccaattttgggggccccccaaattttttttgggggggttttgggagtttttcccccccccccccccttttttttttttttt

SEQ ID NO: 4581 - DNA, 741 bp, Zea mays
  misc_feature (723)..(723): n is a, c, g, or t
ttgggaccctcgaggggccggccgggaaaaggaaaggaaacgcggggccgcccgggcagtaagtaaggtaggcagtttcccgaagcaacctcccgttcctccgcgacccagcgacgcctccgcggccgtccgatcgccctatccgccgccgcgcgattccggcaggggagtagacggttccagcaaatttggtccaacaattctttgtttggccgcttgggctccggtctctcgattcttcgtagcttggtgggagggcgccggatccagcggccatcatggttgtcgacacggtcagcgcgagcacctccataatagccccccacctgttcgaccacaggtccaggggagccggcgcttcccaccaccacctccgccggacgttccatgtcgttgcctgccgacccctgcccaccgccttcgccggccgccgcctcgtggcccgggtcaccaggcagccgtcgtcgcgcctcgccgattggccggtcagggcgctggctatgggggtcacgaaggaggtcagggccagccctcgcagggagtatcgggggatccccggggatggtggcgacatggggggacgttggggtcaccagccccacgccgtcatggcctccgcggaacagggcagatgaccccaagctgcacaacccgctgctccgcctcgagcgcatgggctgcgggtggctcggcgtcatcttcgagttgggagggggtcatcgnttgaggatgatgccgaat

SEQ ID NO: 4582 - DNA, 822 bp, Zea mays
  misc_feature (806)..(806): n is a, c, g, or t
ccggccgggctccctccttatctccttgcctcgtcccctcccccccgccccgccttcccccacccaatcattgatctcggcttgagcttcaactacggattgattgattgattgggttcctggcgttagtttggtagccgtgcccttcctcttgcttgttggttgccttcctcatcttctttcatgtgttggattggagtctcagctattcgtttctccctcttttcttgcagcgcgattccggcaggggagtagacggttccagcaaatttggtccaacaattctttgtttggccgcttgggctccggtctctcgattcttcgtagcttggtgggagggcgccggatccagcggccatcatggttgtcgacacggtcagcgcgagcacctccataatagccccccacctgttcgaccacaggtccaggggcgccggcgcttcccaccaccacctccgccggacgttccatgtcgtcgcctgccgacccctgcccaccgccttcgccggccgccgcctcgtggcccgggtcaccaggcagccgtcgtcgcgcctcgccgattggccggtcagggcgctggctatgggggtcacgaaggaggtcagggccagccctcgcagggagtaccgggggatccccggggatggtggcgacatgggggacgttggggtcaccagccccacgccgtcatggcctccgcggaacagggcagatgaccccaagctgcacaacccgctgctccgcctcgagcgcatgggctgcgggtgggctcggcgtcatcttcgagtgggaaggggtcatcgttngagatgatgccgaatt

SEQ ID NO: 4583 - DNA, 890 bp, Zea mays
attgggacctcgagccgcccgatttggaaccgatgacacagagaaacggacatcccctctactagttttctctctctgccgccgtccgccggcctcgcgcaccccgtccccgccggcaatcgatcccacttgtcccaggacgcctccgccggccgtcaatcgtgcccctccccagaactcgcactgctctccgtcagttcagttaaaacatgactgctcagacaaagaagagaggcgctacagaaaatggggatggtgttggtttgggtcttgctgccttcattgcaaacaatgaggatgtgggtcccgtagtccggcacgctttcgagtctgggaagcctgaagccctcttgcacagcctccagaacatcgtgaagaataaagaggttgagatcgaagagatttgtagactccactatgaggaattcatccttgctgttgatgagcttcgtggtgtcctggttgatgctgatgagcttaagggcacattatctgatgagaacctgcggttgcaagaggttgctagcgctttgctactgaagcttgatgagctttttgagatttattctgtaaacagtaacgttggggaagccctagctacgttgaagatttgtctgcaagtaaccaacctctgcaaggtatgcaacagggacattaccgaagcaaaattactttctgcattgaaaacattggagttgattgagaaggactacctgcaaaatattccactgaagcttctgaaaaaggtcattcataaacaagttcctatggtaaagctggtacattgagaagaagtgtgtgtagtggagttaatggagtggcttgtgtatatcagaaggactgctaaggatattgggcaggtcgcaataaacagacatctctgactcatc

SEQ ID NO: 4584 - DNA, 1779 bp, Zea mays
cattgggttcttcgcccggccgagccgcggcatcccgaggcaaacgaacaaaggcacagcgcacctcacttattacgaaccccctctgtgccactgcccactgccacctcaaatccccgcgaacctatctttcccttcccccgatccaggcggttctcttcccagaagccagcccagaatggtgggatccgacgcgctgcagtccatcgtttacagccgtgggtcactccgcctcctcgatcagaggaagctgccgctcgagatggagtacatcgacgtcaagagttccgccgatggctggaatgcaataagagacatggttgtccgtggtgctccagcaatagccatagcagcggcactagcattagccgttgaagtttctgatttagattttattggtacgcctgaagaagcagcttcttttgtttcaaagaaattggaataccttgtatccagccgaccaactgcagtgaacctatctgatgctgcaacaaagctccaaactttggtatcaaaggcagctgaaactgcaaaagattccaagtctatctttcaggtctacattgaggccgcagagacgatgcttgttgatgatgtggcagataataaagctattggctcacatggagctgtatttcttcaaaggcagcttgcaaattcaaaaaagatatctgttctaacccattgtaatactggcagtcttgcaactgctggttatggaactgcccttggggttatacgcgctcttcattcggggggagttttagagaaggccttttgcaccgaaactcgtccatttaaccagggatccagacttacagctttcgagttagttcatgaaaaaatacctgcaacactgatagcagattctgctgctgctgcgttgatgaaacaagggcatgttcaggctgtcattgttggtgctgatcgaatagcagcaaatggtgacacagccaacaagattggcacatacaacctcgccatctccgcgaagcatcatagcgtccagttctatgtggcagcgccggtaacttccattgatctctccctcccatctggggatgagatagtcatagaagaaagatcaccaaaggagttgctgaactctgaaggtggtctgggaaagcaagttgctgcatccggtatatcagtctggaacccagctttcgatgttactccagcaaatctgatcactgcaatcataacagaaaagggtgtgatcacaaaaactgatgctgatggatctttcgacatcaaaggattccttctgcccgcaaaataatactctctagcgtggcttccattctgaatgacataaatgtctggatcaacactgttgtattctgttttctctattatacacaataataaagtcatgtcctctcataggattttgaatcctgtgtaagttttatggataggagatcgacgctagggtgtgtacccatagcggcgcgtatgagccgtgttttcacacgagtgggcaagtgaaaaagagatgtggcagatgacctctgaggctagggatgttttgtttctagagactaattttttagtctctttattttattttattttagttcctaaattgctaaatatggaaactaaaatagagttttagttttcgtgtttgataatttaggggctaaaaaaaaataaaataaaatggaaggattaaaattagtctctagaaattaaaccccccctaagcaagatgattgtcttgcttgctttcaaaataataccattatctctatattataaaaaaaaaaaaaaaaa

SEQ ID NO: 4585 - DNA, 1200 bp, Zea mays
cattgggtacctcgaggccggccgggacgtcgctgcctgcctgccttcttctcagcgcgggaacagcgccggaggccccagattttcccgcgttcgtggtctccactctccagttctccgttccccaaccccaacctagcatccttgcatcccggggctcagttagcgttgccgccgcaccgtactacacctccggtggccggtgcgcccatttcccgccgatcaagcgcgatggcctcgacgagggatctagccatagcttctctctcagctgcgaccggcgccgttgttgccgccgctgcactgcgcctcttgtcttcccgcagaacatcctccgtcagaccccagaacctccccgccgccgctaacggatctgcctccgagcgcccgctggctcagtcccccttcgatcctgtcaagagggaaggatatatttcctgggacgactacttcatggcgatcgccttcctttcggctgagcggtctaaggatcctaaccggcaggttggagcatgcttggttagccaagagggaataatcctaggaattggctacaatggcttccctagaggttgttccgatgacaagcttccttgggcaaagaaatctgcaagtggagatccattagagacaaaattcccctacgttgtccatgctgaggttaatgcaattctaaataccaaccatgcttcagcggctggacagaaattatatgtcaccatgttcccatgcaatgaatgtgccaagattattattcagtcaggcgtatctgaggtcatatatttcgttgaaaaaaagattgacaactcagctcacgtttatgttgcctctcacaagctattgtcgatggctggtgtcaaggtcaggaagcatcagccccagatggcgcaaataccgatcaagttccaggagccatgaagccggtactagttccagccttccaggagcactagtgagcgaataaacagtgcaagatacctgttgaccgcggcacctgtgacaatcgacaatggccgacccgcagcggtctcggtatgcggcgtcgatccctctccctccctcagaggctgttgtaaaactatagctagaattcgtactggtaagcgtgtaaagacatttcaattctcctctccgataccagcttatcttttatataaaaaaaaaaaaaaaacgtgcgtttggatcccttcattttagagg

SEQ ID NO: 4586 - DNA, 1650 bp, Zea mays
ccggccgggcttcgacttggtgggatgtgattctccaccacctccgagcttgcaagaggcggactccacctctttcttcctcgcatgcctccttctctttccaaacacaaagccgcagcaaagaaagtgcaaattataaaggaagatcagaattcaaagcagtcgaaaagctgactagctagaagagtaaagagagagaagtatatttcagcaggacctccatggtgttcccttcagtgccagtctacctagatccacatccacctgattggaataaccagcagcagcaaggtcagcagccgagggcgagtgggggagccgatgcaccgctgttgcccgtgggtccgatggctgccacagcggcggcttcggagcccggcggcttgccgagaagctcgtcaacgtccagtgccgccttggccatgcacgcaaggcccaactcgatggcggagcgcgcgcggctggcacgaataccgaatccagagccggcgctcaagtgccctcgttgtgactccaccaacaccaagttctgctactacaacaactactccctctcccagccccgccacttctgcaagacgtgccgtcgctactggacgcgtggtggatctctccgcaacgtccccataggcggaggttgccgccgcaacaagcgctcgtccaagtcctccgccgccgggccttcctcctcctcaaagtcgttctcctcgggcaggctgctcggtggtccatcagctatgtcgtccaccacccagggcgctaccggtgcgatcatcgctccaggtcttagctctttctcccatcacttgccattcttgggctcgatgcacccgccaggacccaacctagggctaggcttctccgtcggattacctctgcttggcatgcaacacctggaaatggtggatcagtttccggtggcaagcggcggcggcaccaccatcggtgcatctctagagcagtggagagtgcagcagcagcagcaacaacaattcccattcatgactaggggaatactggaccttccacaaccatcgacgtaccaactgggcttggaagctagccgagggggcagcggctcagatgcagtggcgttcactttagggcagtccacgaccagtgctgctaccataacgacaaggcaagaagggtcagcaatgaagatgggggacgatagcaaaggacaagacgcgagcttacagaagcagtacacggcagctctacaccacggatcaggatcacacggtgtttgggatgggaatgctggtggcagcggcagtggtggtggtggtggcactggcagtggcaattcaagttggccgatgaacatcgtttctgcattccattcttcgtccaccagcggtggcaatggcgatggcttatcgtagtactccagctgggggttaggccagtgtcctatcaagaatatgaagatattggagatgcatggttgagtttgagcaaatgctagctatagctaggacgatggaggaacaagagatggtcaatcagccggcctattcatcaactgctgttcctcatcagaactgtaaaaaacactgctctagctcatgatggtcacaggtaggagtttaaagtagaccctttaaagtaaggttgctctttggttaaccctttttctgccaaaaa

SEQ ID NO: 4587 - DNA, 2618 bp, Zea mays
agcccgtgatggcatacctcgccgccgggccggccggggtttcggtcctattcgccccccaaactccggacgagccttccgcgcgacgctgcacggctccgccagccacccgtaaaaccctagacggctagccggcgcacggaagcgggcagcggagcggaggtgagcctctcctgcgtcggattgtccccgcccccgctaggcgccatgaagctgacggtgaagaccctcaagggaacgcacttcgagatccgggtgcagcccaacgacacgattatggctgtgaagaagaatattgaagagatacaagggaaagacagctatccatggggccaacaactgctgattttcaatggaaaggtcttgaaagatgaaagtacattggaagagaataaagtcaatgaggatgggtttctagttgtcatgcttagtaagggtaaaacatctggttcaactggaacttcatcttcccagcactcaaacactcctgcaacaaggcaggcacctcctctagaggccccacaacaagctcctcaacccccggtggcaccaattacaacttctcagcctgaaggacttcctgcacaggcacctaacacacatgacaatgcggcatcaaatcttctgtctggaaggaatgttgacacaataattaaccagctaatggagatgggtgggggcagttgggacaaagataaagtccaaagggctctccgtgccgcttacaacaaccccgaacgtgctgttgaatacctctactctggtattccagtaacagctgaaattgctgttccaattggtggtcaaggggcaaacacaactgatcgagctcctactggggaagctggtctctctgggattccaaacaccgctccactagatcttttcccgcagggggcttccaatgctggaagtggtgctggtggtggaccacttgattttcttagaaacaatccacaggttctagcagtttcgggatttggtgccatttaagattttttggggtaattctattattacccctgcatacaaaaatatagtattagagaatacggtgcccatagtagtatgctgtagaagcgtcatctagcacacttgttttctcattaattttatgttaacatattgtgcaaggttggaccttatcccattgtggtgtgagcatgagctttgtaaaagtttaatgaaccttttgtttggaatgaaagcccaaatatatgtccatctaaccttctcctaattacaccaaataaaaaaccaaaataactccaacacaactttttacttcattcttccatgtatacccctacttaaatgcacaccgatgattgatgtgcaccatggtcattgtacccctcaggccctcaccttaattttagccccagctccgaatcaacttatatttgggattggcggggtgagattacatcgatttaacctcactgttctaattatgaattaatagcttatcaattattttgcagtttcaagcagttcgggaaatggtccatacaaatccacaaattttgcaggttttgtattctttgttttggcttacattctatggcttcttatgtagcacctgcctgaactttttgctggtaccatgttatagcctatgctcgttgagttgagcaagcagaatcctcaaattctaaggttgattgaggagaatcatgatgagtttcttcagttactaaatgagccctttgaaggcggagagggggatttcttagaccaacctgaggaggatgaaatgcctcacgccattagtgttacaccagaggagcaggaggccattggacggcttgagtccatggggttcgacagagcacgcgttatcgaagcattcttagcctgcgataggaacgaggagctagcagcaaactatctccttgagcatgctggtgaggaagattaagcgggagtagttttcatacggtgagaactctgctatcctctggttggttaccctccttaacatatatggcaagtggctcactgtggggtgatttcctttttttttcttcttttgaaccttgtctctcgtcgacatctgaccgacattgatcaagattttttttagtaccgagtgacgaagagttgatatggagctgacgatcatttgaattgatttcgttgtgcaagacttgtattacataaacatttaaatacatgtagctgaacatttcagtagaaatgctacggttgtggtctcccatcgttgactttcattagcgtggtggtaaacatcggttctgctcctgtcctgtattcatcggacgcaagtataacacaagcttggcttgggaggaggaagcacaaggagctattgccacctagcaaaaggataaaagggaggatgacgaattggcgatgtgtttgtgacacgctgccctcaagtgtggatgatgagtgcagatatgttggtgactgtgccaaggctgtcaagtgtgtaaacgaacgctgccttcgtagttctgacaactgcgactgttctgtagctaaacctatttgctatctttatgataaagttatctaaatgggacggtccttgaccgattaattgcccgatctaatgtgagaaaaagtacataatcgcttggattgcatcaggt

SEQ ID NO: 4588 - DNA, 1077 bp, Zea mays
gggcccgctccctatacttttcccgcaggggcttccatgctggaggtggtgctggtggtggaccacttgattttcttagaaacaatccacagtttcaagcagttcgggaaatggtccatacaaatccacaaattttgcaggttttgtattctttgttttggcttacattctatggcttcttatgtagcacctgcctgaactttttgctggtaccatgttatagcctatgctcgttgagttgagcaagcagaatcctcaaattctaaggttgattgaggagaatcatgatgagtttcttcagttactaaatgagccctttgaaggcggagagggggatttcttagaccaacctgaggaggatgaaatgcctcatgccattagtgttacaccagaggagcaggaggccattggacggcttgagtccatggggttcgacagagcacgcgttatcgaagcattcttagcctgcgataggaacgaggagctagcagcaaactatctccttgagcatgctggtgaggaagattaagcgggagtagttttcatacgattttttttagtaccgagtgacgaagagttgatatggagctgacgatcatttgaattgatttcgttgtgcaagacttgtattacataaacatttaaatacatgtagctgaacatttcagtagaaatgctacggttgtggtctcccatcgttgactttcattagcgtggtggtaaacatcggttctgctcctgtcctgtattcatcggacgcaagtataacacaagcttggcttgggaggaggaagcacaaggagctattgccacctagcaaaaggataaaagggaggatgacgaattggcgatgtgtttgtgacacgctgccctcaagtgtggatgatgagtgcagatatgttggtgactgtgccaaggctgtcaagtgtgtaaacgaacgctgccttcgtagttctgacaactgcgactgttctgtagctaaacctatttgctatctttatgataaagttatctaaatgggacggtccttgaccgattaattgcacgatctaatgtgagaaaaaaaaactcgagggg

SEQ ID NO: 4589 - DNA, 1815 bp, Zea mays
gtttttcggtcctattcgacccccaaactccggacgagccttccgcgcgacgctgcacggctccgccagccacccgtaaaaccctagacggctagccggcgcacggaagcgggcagcggagcggaggtgagcctctcctgcgtcggattgtccccgcccccgctaggcgccatgaagctgacggtgaagaccctcaagggaacgcacttcgagatccgggtgcagcccaacgacacgattatggctgtgaagaagaatattgaagagatacaagggaaagacagctatccatggggccaacaactgctgattttcaatggaaaggtcttgaaagatgaaagtacattggaagagaataaagtcaatgaggatgggtttctagttgtcatgcttagtaagggtaaaacatctggttcaactggaacttcatcttcccagcactcaaacactcctgcaacaaggcaggcacctcctctagaggccccacaacaagctcctcaacccccggtggcaccaattacaacttctcagcctgaaggacttcctgcacaggcacctaacacacatgacaatgcggcatcaaatcttctgtctggaaggaatgttgacacaataattaaccagctaatggagatgggtgggggcagttgggacaaagataaagtccaaagggctctccgtgccgcttacaacaaccccgaacgtgctgttgaatacctctactctggtattccagtaacagctgaaattgctgttccaattggtggtcaaggggcaaacacaactgatcgagctcctactggggaagctggtctctctgggattccaaacaccgctccactagatcttttcccgcagggggcttccaatgctggaggtggtgctggtggtggaccacttgattttcttagaaacaatccacagtttcaagcagttcgggaaatggtccatacaaatccacaaattttgcagcctatgctcgttgagttgagcaagcagaatcctcaaattctaaggttgattgaggagaatcatgatgagtttcttcagttactaaatgagccctttgaaggcggagagggggatttcttagaccaacctgaggaggatgaaatgcctcatgccattagtgttacaccagaggagcaggaggccattggacggcttgagtccatggggttcgacagagcacgcgttatcgaagcattcttagcctgcgataggaacgaggagctagcagcaaactatctccttgagcatgctggtgaggaagattaagcgggagtagttttcatacgattttttttagtaccgagtgacgaagagttgatatggagctgacgatcatttgaattgatttcgttgtgcaagacttgtattacataaacatttaaatacatgtagctgaacatttcagtagaaatgctacggttgtggtctcccatcgttgactttcattagcgtggtggtaaacatcggttctgctcctgtcctgtattaacacaagcttggcttgggaggaagcacaaggagctattgctacctagcaaaaggataaaagggaggatgatgaattggcgatgtgtttgtgacacgctgccctcaagtgtggatgatgagtgcagatatgttgatgactgttccaaggctgtcaagtgtgtaaacgaacgctgccttcgtagttctgacaactgcgacagttctgtagctagacctatttgctatctttatgataaaattatctaaatgggacggtccttgaccgattaaaaaaaaaaaaaaaagtgagaaaaagtacataatcgcttggattgc

SEQ ID NO: 4590 - DNA, 2921 bp, Zea mays
  misc_feature (2121)..(2121): n is a, c, g, or t
  misc_feature (2295)..(2295): n is a, c, g, or t
ccaaggctgtcattgcccaagtgtattgcctttgtagttctaacagaatgttagataaatgcaacagttgcgtagctagactatttgctatttttatgataaaaatatttgcttgaccgattacccgacgttgaagttacaaaatgatagtagcatattacatgatctgaaactggaattacataatcgaatagattacatcagctgtgaaaacactttgcatcccatttcgcagggtacaaacatagctttgcgtcaatcggtgctaggcgaatgcagaacgcttggtagccggtcagcgctatgtgtagaacacatactccagagatgaaattggatcacgagcactggaataattgttgtcaggtttttctcattacctgaactccattatgtgattgggttaaccctaccaagatgtaacactgtctgtctcccgttttcttaccaagcaaagttagctccaaatgaaatgttatgttctctgaattctaatgcatataagccacacaaatgaaattttacatccaaagtcacctgaccatgaatctgttgagtttttattgctcttttatgccagctgcattgaaacaggcagatcctattaacaactccgcattggctctctgccccagccatggacccatggcagcggcggtttcgcgcacctcaaagacatgggtggggaggcatcgcggctgctgcacgccctctagagaatgcttatcgatcatcaggtgcattcgattacgctttcggttgctgcattgagaaatgaatcagtcgaactgtgaaccaactacttgaaatttcacgtgatgtggggtatagtggcaatgcataagcccacatggagcactgggtcttcgaggtgacacgctgacattgcaactgaacacacttgtctatgtggctatggctacggtatacatagagtcgtacattaggtagcttattcaatcaaataatgtctggttttgtcatgaaaatgataataatcttctatataaacttggtcaaacataagacatttcacttaaaataaaaccagaacgtctctctttttgggtgtagatagtattaatataatttcgaaaattctgatctatgagttggtactttgataattccaatccatgttgccaactaaaagctaactgatataatactttcttcaagagtaactatcatactatctgcatcttctatgatctattaaagtacctcacaagagatccaattaatgattcacacctgcaagataacacctgtagtggaaatccagttttctggtgtgagtctgaatatttcacaaacaatgaaagcatagaagaaaatgctgcagtagagtagtacctaattatcatctgcatgcccctagaccctccatttttctcttagcgaggaatcagaaaaccaaactcaaatacaagaaatattagtcaatacaaagtggcaaaatttctcgagatagaaaaagacaggtgggatgtgcagaaagggacttgaaagttgaaaccattggctgcatgtactgcggtaaaatatttctcatcttctggcagtacagtagcctgcatcatatctgacatcctctttatagtacaggaagtcaggaatagcccgagtgctcagcacatatgctacatgctcccaactacattaccccttctttgaagtggtgggcaaagccaaaagtttgagtggggcccaaaacctgagtgggggcctaaatagaaacctacttactaatggacctttatagctataatgaataaaataaaaactccactggaaccagaaaattgagtgggacccgtgccccagtcagcccaacgtgagcccgcccttgcttctctgctgagacatgcacataaaccaaatttgtctcatttatttatgtttaaggtgtgtcgtttattcacttgctccagctgctgctatcaccccaaccaaatcggttttggaggcggaattatctaacaacatttccaaagggaatatttcaagttcacctacacggccgcaccttctcccgaacaacatggaggaagcaatcatttcctgtagaataatatgcaaataatgaagtcataacaccttttgatttgaacaaagggnaaacaataaatatgagaaatagggtgcaaataagatgtctaataaaggtataaatcgaagaccaagttctcatgctgcaaatgtagatgatagtacaaatgaagtctggagcttacagttctgcagagtttgtttattaatcgaggttcttttattaatgttgaagttgttggnactttagttcggtagagtttgttgccttttcttttggctatcaaacccatttgtatctttattgttttcatcaagtggtattgtatctcgaacttgtgctttgatgatttctcttttaccttttgaacataggtataggaacggttttctgaattggatcacattagcaggacatcgttatgtttgatagatgcacaaagcactactggattcgaggtttcagttaaggttgaacagttcgactctgacacgtcaaggcgctagaagtttggacaagaagaattatgatcattatagtttggggcaaccaatatcattattacgacaatggctagggtccaaatgattctcatcttcaattttcgtaatgatttggttatagaattacaattttttattgtcttgacattttttaacactaccctgaatggttgaatggatgctagaattatgtcaagatttttctgtgccgtcgcaacgcacgagcactgtactagtcaacacattaaaagccatacctgctagccctttgtctgcgatatggatctgaaagcatcaatctctaatgtcctagaacctccggatataatcataaccgattctttgcgtccctatcgaactgaaac

SEQ ID NO: 4591 - DNA, 1028 bp, Zea mays
  misc_feature (1000)..(1000): n is a, c, g, or t
cggggtagtcgtagccgactggtcgccgcgtccccctttccccgcgcagcagcagagcaccatccggtgaccgagcaatggaggcggggggcgtgggcctggcgctgcagacgcgggcggcggccttcggctccggccagcgccggggcggcctacagtcgcccatcgggaggctgagagtcgctgaaccggcgggagctgcggttgccgtgcgggctcgcgggtccaagcccgtcgtaccgctccgtgcgaagaaatcatccgaccagttaactggaaatatatgaagaagggcctatccgtttggttagatgtgcccttggatgctcttgctaggcgtattgctaaagtgggaaccgcttctcgtcctcttctggaccaaccgtccggtgatccatacacaatggccttttctaagctcagcatgcttgcagagcaaaggggtgatgcttatgcaaatgcggatgtaagggtttctctggaagagattgcatctaaacaaggtcatggcgatgtctctaagctgatgccgactgatatcgcaattgagtcacttcataagatcgagagtttcgtcatcgagcacgctgctgataatccagctagcgactcgcaagctgagtcacagatccaaaggatacagaccttgtaatatcttaatccttctgttttgtaccgaagcgtaccccctagagcatcgttggtttatttgttcgttgaagtgtcacgagggagagaaaaaaaaccctgaagtatttcttcttgtaagttgtaaaggaatggaataaaggagctaataatccgaagtgtaccgttggctgaaacatcagtttgatactttggtgaatacctatgctggttgctggacatctcatctcagcaaaacgtaaacaacgtggacttgttgaaccggcgtgggctggctggaaccgtgtaacaccccctttgtaataatagagaaacaatttctcctgaaaaaaaaaaaaaaaaaaaaaaaaanaaagtactctgcgttgttaccactgctt

SEQ ID NO: 4592 - DNA, 1567 bp, Zea mays
ccggccggggcacccgtcactttttacgtgcccacatttccgccaccgccaccgccaccggctaccacctgccgcctgcgccctgccctccctctgtttttctagacccccggatcgctcagagattgagtcgtagtcgtacccgactagtcgccgcgtcctcctttccccgcgcagcagcagagcaccacccggtgaccgagcaatggaggcggggggcgtgggcctggcgctgcagacgcgggcggcggccttcggctccggccagcgccggggcggcctacagtcgcccatcgggaggctgagagtcgctgaaccggcgggagctgcggttgccgtgcgggttcgcgggtccaagcccgtcgtaccgctccgtgcgaagaaatcatccggaggtcatgaaaacttgcataactccgttgacgaagctctcctgttgaagagaaaatcagaagaagttctgttctacttaaacgggaggtgtatttacttagtgggaatgatgggttctggaaaaagtactgtggggaagatcatgtctgaagtcttgggttattcgttctttgatagtgacaaattagtggagcaagctgttggaatgccttcagttgctcaaatattcaaagttcacagtgaagccttctttcgggataatgagagtagcgtcttgagggatctgtcctccatgcgacgattagttgttgccaccggaggtggtgctgtcatccgaccagttaactggaaatatatgaagaagggcctatccgtttggttagatgtgcccttggatgctcttgctaggcgcattgctaaagtgggaaccgcttctcgtcctcttctggaccaaccgtccggtgatccatacacaatggccttttctaagctcagcatgcttgcagagcaaaggggtgatgcttatgcaaatgcggatgtaagggtttctctggaagagattgcatctaaacaaggtcatggcgatgtctctaagctgatgccgactgatatcgcaattgagtcacttcataagatcgagagtttcgtcatcgagcacgctgctgataatccagctagcgactcgcaagctgagtcacagatccaaaggatacagaccttgtaatatcttaatccttctgttttgtaccgaagcgtaccccctagagcatcgttggtttatttgttcgttgaagtgtcacgagggagagaaaaaaaaaaccctgaagtatttcttcttgtaagttgtaaaggaatggaataaaggagctaataatccgaagtgtaccgttggctgaaacatcagtttgatactttggtgaatacctatgctggttgctggacatctcatctcagcaaaacgtaaacaacgtggacttgttgaaccggcgtgggctggctggaaccgtgtaacacccactttgtaataatagagaaacaatttctccttatgtcaaaaaaaaaaaagggcggccaaatttccagtcttgtgtaaattttaaacaagaacacaataccaagcaatatacatggcatgcccgcggacgcgtgggcggacgctggggtcctagtccgc

SEQ ID NO: 4593 - DNA, 883 bp, Zea mays
  misc_feature (797)..(797): n is a, c, g, or t
  misc_feature (835)..(835): n is a, c, g, or t
ttgggtacctcgaggccggccgggacgggctcctcgtccccgccgccccgccaccggctaccacctgccgcctgcgccctgccctccctctgtttttctagacctccggatcgctcagagattgagtcgtagtcgcgactggtcgccgcgtccccctttccccgcgcagcagcagagcaccatccggtgaccgagcaatggaggcggggggcgtgggcctggcgctgcagacgcgggcggcgggcttcggctccggccagcgccggggcggcctacaatcgcccatcgggaggctgagagtcgctgaaccggcgggagctgcggttgccgtgcgggttcgcgggtccaagcccgtcgtaccgctccgtgcgaagaaatcatccggaggtcatgaaaacttgcataactccgttgacgaagcactcctgttgaagagaaaatcagaagaagttctgttctacttaaacgggaggtgtatttacttagtgggaatgatgggttctggaaaaagtactgtggggaagatcatgtctgaagtcttgggttattcgttctttgatagtgacaaattagtggagcaagctgttggaatgccttcagttgctcaaatattcaaagttcacagcgaagccttctttcgggataatgagagtagcgtcttgagggatctgtccctccatgcgacgattagttgttgccaccggaggtggtgctgtcatccgaccagttaactggaaatttatgatggaagggcctatgggcctatcccgtttgggtagatgtgcccttggatgctnctgctaggcgtatttgctaagtgggaaccgcttctcgntctcttctggacaaaccgtccggtgatcatacacatggccttttctag

SEQ ID NO: 4594 - DNA, 1646 bp, Zea mays
attccagcttctggaaccttcctttcgctatacgacctgagttcgcttcaggcagccgccgctctctctctctcccgcgtccgtcccaccgtcgcaagccagccacctccctgagaggcctgaccgtgatttcggcgtggcatccaaaggcggtcaagattcgagaggccggaggaaccaagcgtagggcctccgaccccacgtcgtcgtccgcgcgcgccgcccgccgccgcagggagatgggggccgattactacaaggtcctcggcgtcgaccgcggcgccagcgacgacgacctcaagaaggcctatcggaagctcgccatgcgatggcaccccgacaagaactccaccaataagaaggaggcagaaaccaagttcaaggagatctctgtggcatacgaggtccttagcgatcccaagaaacgtgcaatctatgatcagctaggggaagaagggctcaaggggcagccgcccccaggagcaggaggtcctggcacatctcccttcttccctggcggggctcattccaccgctcaccattttaacccgaggagcgcggacgatatatttaaagagttctttggatcccctggcatgggtggcatgagaacggaaccaggatttcaaaggtcaatgtttggcaacgatatcttctcttcgcgcttccgcgctgagggttccaccagtatgcagcagccattgcgcaaggcagctgcaattgagaatccacttccagtcggccttgcagatctctacaagggtgtgacaaaaaagatgaaaatctcaagagagactattgatgccagcgggagaatctcaaacacagaggatattctgacaatacaagtaaaggctggttggaagaagggaacaaggattacatttcctgacaagggaaatgaagctccaaatatgaaacctgctgatattgttttcatcattgatgagaagccccatgatgttttcactcgggaggggaatgatcttgtcgtgactgagaagatctcactggtggaagcactgactggctataccgcacgtgtcactacgcttgacgggcggagcctatcactgcacatcaactcaataatccatccaaagtacgaagaggtgatgcctggagagggcatgccaatgcccaaggaccccacaaagaagggaaatctgcggattaagttcaacataatgttcccctctaggctgacttctgatcagaaggccgggatcaagaggctattgggttcttaggccgccgcctcaaatgacatcttctttatgatgaaagttgtttgtaaatattgccagtgatttgtttgtaacgggatggtcacaatttagtttttttttaaggtggtgcccttggttttgctgttgttctcatttttaaccttagtcgtatttttttggctcaattttgcctttccagtgctatacagcagaatggtaaaactgataaaaaaatacgactaagggtaaaaataaagaagatggtaaaactaagggtatgaatttaaataggttttctggtgggtgggtagttgatgaattgtaaatcccaaacaaaccggccggcccttagcaaccacaacaaggctgaaccttcaccattttattttagtcaggcagagtgttgtgccctttgcc

SEQ ID NO: 4595 - DNA, 1465 bp, Zea mays
ttgggtacctcgaggccggccgggaaccttctttccgctcacgacctgagtcccctctcccaggcccaggcagccgccgcccgtctctctctctcctccgagtcccttctcccaccgccgcaagcgctcgcccgagccacctccctctctccctgtggcctgaccgtgatttgggcgtggcatcctaaggcggtcaagattcgagaggctggaggaaccaagcgtagggcctccgccaccacgtcgtcgtccgcgcgcgccgcccgccggcgcaaggaggcgccacagcctccgacgcctagggagatgggggccgattactacaaggtcctcggcgtcgaccgcggcgccggcgacgacgacctcaagaaggcctaccggaagctcgccatgcgatggcaccccgacaagaacaccaccaacaagaaggaggcagaaaccaagttcaaggatatctctgttgcatatgaggtccttagtgatcccaagaaacgtgcaatctatgatcagctaggagaagaaggcctcaaggggcagccgcccccaggagcaggaggttctggcgcattccccttcttccctggcggggctcattccaccgctccccattttaatcacaggagtgcggatgatatatttaaggagttctttggatcccctggcatgggtggcatgagagcggaaccaggattccagaggtcaatgtttggcaacgatatcttctcttcacgctttggcgctgagggttccaccagtatgcagcagccaccacgcaaggcagctgcaattgagaacccacttccagtcagccttgcagatctgtacaagggcgtcacgaaaaagatgaaaatctcaagagaggctatagatgccagcgggagaatctcaaacgcagaggatattctgacaatagaagtaaggcctggttggaagaagggaacaaagattacatttcccgacaaggggaatgaagctccaaacatgaaagctgctgatattgttttcatcctcgatgagaagccccatgatgttttcactcgggatgggaatgatcttgtggtgactgagaaaatctcgctggtggaagcgctgattggatatactgcacgtgtcactacgcttgatgggcggagcctatcattgcccatcaactcgataatccatccgagctacgaagaggtagttcctagagagggcatgccaatacccaaggacccctctaagaagggaaatctgcggattaagttcaacataatgttcccttctaggctgacgtctgatcagaaggctggtctcaaaaggatattgggttcttaggccgcctcaaatgacattttatagtgaaaggtattgtgaatatcgccagtaattggctaggtagattatttatttatttatgtaacatatctgtaacggatggttataatgtgtcagatttttatctcattattatttacaaaaaaaa

SEQ ID NO: 4596 - DNA, 3378 bp, Zea mays
gttatttagattgagattgaaatagacaaaagtacagggaagttagtgcaggcccgccgcttcttacaccagccaacggggcgccaggacatcgccaatccctagcaggagacacagctccggcttgcggcctgggatccggtccagtatggagccaccccggcgatccttgtgcgtcgttgcctctgaagtctcctcagcggccggatcggacgccgaggacgacaggtactgcagcgccaactctgccctcggcacgcccagctcgatcgctacccttctcccctcctccgacttctgggaccaccagatggacctcctcgacgaccatcccgccaccgccggcttccccaagaaacaccagctcaggtgcctccaaacgctggcatcggcgcagtcgtggccggaaacggtttctcctccggcgactgccggagtcgacgacctcgcgccgcaggggtcgagtcctgcttcaccatatattcctccgctccctcgtcacaaccaggtgcatggatttggtggcaatgatttatttgatgatatggtccaagagatggaacatattctgctcaattcaggggagccacatggaaatggatcttttatgaatgatcgtagaaataatgctctccaggctcaccatttcagagatggcagcactactgcctctacttctggtacagatgatgcctttgtatctcctgttccacagtattcttcaagaatcgattgggtgggaggttgtgggggcaaagcaaagatctggtgatgtttcttttggtgaacgaattgttggtgtcaaaaaatacactgtttatttgtttaaagtaaggagtggtgaagacgaatgggaaattgagcggcgataccgtgaattttacgcgctttatcggctacttaagggcttcttttatgagagaggtttaagtcttcccgctgcatgggaaaatgttgaaagagagtcaagtaaaatatttgggaatgcgtcaccagatgttggccatgacagaagtgccctcattcaagactgtttgcgttctttactggtctcaagttatccatttggaattcccacccctctggttaattttttgtcaccagggaggcctggatacgaatatagttttttgaaaactctcattccacgatctttgcaaagacgtagcaatgatttaaattcaaaagattcagattgcaatggaggtcaacatgatgattctacctcaatgggcaagacaatatcacttattgtagaggataggcctcagaagtcgaccagacagttgttggaattacaacattacaactgtgcggggtgccataggcatttggatgctggtcgaacattgctgcaagaacttgcacagactattggatggaacaaacctcggttttgttcttacactggacaattgttttgtgcttcttgtcacacaaatgatactgcagttcttccagcaagagttctacaccactgggatttttcactgtatccaatttcccagttagcaaaagcatatttagactccatatatgaccaggtaatgataaacttaaactgtatggtgcttatttatttgttagttccaaaatgcactacaaaatataaatctactttcatacatttttttggacctgaagcaaatgatgatttgcattttcagcctatgctctgtgtaagtgcagtcaatcctttcctattctcgaaagtaccagctctgcttaacatcatgagtgtccggaagaaaatagcagctatgcttccttgtgtccaatgtcctttccggaattccatacttaaaggactaggagttcgaagataccttctagatgggaatgacttctttgcgcttcgtgacctcgttgatctctcaaaaggagcttttgcaggtaccattctgttttagcaagatatttctgaagtgcacaatccaatctgggtgtagacttatgtgcaacttgttatatggtaactgcatctatacatgttgctccattgttcagcacggacagatatctgtactacactagtgcacaatctaatctgggtgtagacttatgtgcaacttgttatatggtaactgcatctatacatgctgctctattattcagcacaacagaaatctgtactacactgatatttccacatatgtacatcacaaaccgcgattgaagaattgtgtctcatccttttgagctaatttagcaaattattttttaaacagtttttaggtataattgttgctttacgctgtccttctggttgctgttcaagactggttaatgcttgatgatatagaaaactggaaccaaaattataaaaccttaagatgatagtcaaaataacaaatcacattgttgaggagttagttgcactactgacaaattatgtttgcttcaaacagcacttccagttaaggtgctgaccatatcaaacaggatacttgagcacattactgagcaatgccttgtgtgctacgatggtggcgtaccttgtgctgctcgacaagcttgtgatgacccgctgtcccttatattcccatttcaggtgccgtgccaagtctttgttttctaattcctttcagcgtaatataacatatactaagtgttgagaaaatctgttacggctgttataggaggatgaagctacaaagtgtagcttgtgtgggtcaatcttccacaagcaatgctttagaaagatcagtgtttgtccttgtggtaaggcttctaatggcaggaagatcgcggcgcttgagcaagctgtacatgatggcacgggcatgccatcaacggaatctattcagcctccacctctctcttcatcttatgggtttttctctgatattctctccaaagcaaggccggacaagcttctgaggccgagaaatagcagtcctgtgatccttatgggttctttgccagatatgtctatatgagctgagttgtatttttgtgttccattgattgtgtatttttgtacacggtaggaaagacgctcctagttttgaatgaatgtaatcctgcagtgttattacttgaggtgtgcgtgtagatttatttttcgtggacaacgaagaattgtgtcatttgacatttcatctgtgaggaaataatgaaacgagagactaagggactgtttggtagaacttaaggcctgtttagtttgccatgtctaacctgtcacactttgcctaacttttctgtctaaggttagttcttcaatttgaacgactaacattaggcaaagtgtggcacatttagtcacgaaccaagagctaattcttaagtagagtgattctgagtgattctctagcggcagtgaatctatcaaatggaaaatgtttgacagcttgtgaagtgattccctgaggtgga

SEQ ID NO: 4597 - DNA, 2057 bp, Zea mays
tcttcgccccattctttgcgcccctcgggggcggcccgcgcgcaccgtccctcaccgccggcctctgctcctcttccgccgccgcaggatctcgtatcgccggagaccatgtaccgcgccgccgggagccacctccgctccctcaagcatcatggtgcttctaggcttgccagtacaagtgttgcgaagcagtcctcaggtggtctgttcagctggcttcttggtggaaaatcaagcgaactccctccccttgatgttccactcccaggcattagcattccctcacctctaccagattttgtagagccatctaagacaaaagtcactactcttccaaatggcgtcaagatcgcctcggagacatcatcgagcccagcagcatctgtgggtctgtacattgactgtggttccatttacgaaacacctgcttcatctggagtatcacatctgttggagagaatggccttcaagagcacagtgaatcggactcacttacggttagttcgtgaggtagaagccattggaggaaatgtctctgcatcagcttcccgtgaacaaatgagctatacctatgatgcattgaagagctatacaccagaaatggttgaagttctcattgacagtgtgaggaatccagcattcctcgattgggaggtcaaagagcagctccagaacataaaatctgaaatagctgatgcgtctgctaatcctcaaggtctacttctggaggcccttcattcggttggatattccggggcactggcaaaacctttgatggcttcagaatctgctgtaaaccggttggatgttagcagcttggaggaatttgttgctgaacattacactgctcccaggatggttcttgcagcatcaggagttgatcatgatgcgctgatttcagttgtagaaccacttctgtctgaccttccgtgcgtgaaacgtcctgaagagccaaaatctgtgtacgtgggaggagactatcgctgccaagcagattctccaaacacacacatcgcacttgcttttgaggtgccaggtggttggaatcaagagaaaactgcaatggttgtgacagtgcttcagatgctcatgggaggaggagggtccttctctgctggtgggcctggaaagggaatgcattctcgattgtatctccgtgtcttgaccaacttccaacagattgaatcattctctgctttcaatagcgtctataacaattcgggcctttttggaatttatgcagtcactagcccagacttttcatcgaaggctgtggatttggcagcaggggaactcctggagattgcgacacctggaaaagttacacaagaacaacttgatcgtgctaaagaggcaaccaaatctgcagttctgatgaacttggaatcaaggtctatagcatctgaagatattggaagacaggttcttacttatggggaaaggaagcccatcgagtatttcctgaaaacagttgaggagatcactttgaatgacattttgtcaaccgcaaaggagatgatgtctacaccactcacaatggcatcgtggggcgacgttattcatgttcctagctacgagtctgttagccgcaagtttcactcgaagtgagaggatccagcatcggacttgcatgacctgttccaacaactgatgtgaagcctgcaacggccctcagctgggacagttactccccccacagaataaaaaagcatgtggtttctagcgccccccctaattactccctctgcatgtatacgccaaacatgtttttttttttgtggtaagaatcatcaagccccttggcgactcgtttctgagtttcgcagcggcgctagattttattttatgtggacaagcgagctttcggggtgcgctcgtgcagaaatattttgccaacgtattttgcagtttagaccagaagcagaaaggaccagcgtatcacttttcctgttgttggatgcatgagttcatgacgtccacatttttgcaattttggctgttaccgtttccaaaaaaaaaaaaaaaaaaaaaaaaaaaaaaaaaaaaaaaaagggggg

SEQ ID NO: 4598 - DNA, 2995 bp, Zea mays
cacgacctttgatcctatatctacagatctccgtgtcttgaccaacttccaacagattgaatcattctctgctttcaatagcgtctataacaattcgggcctttttggaatttatgcagtcactgtaagcttctctcctggagcatcctttttattaaaacctcatgccttttcagggcacgtccgtgtttcacgtcatttagcatagctccggaccctgacgcgtgttcatggctgctcaatttttatctgttcttttgcgcgtttcaaagcgggccgttcgtctctagtaatctaaattgtgtacgcccttgtgttcaaacaattaatgcagcggtcccgttttttaatgttatcattcaacagagcccagacttttcatcgaaggctgtggatttggcagcaggggaactcctggagattgcgacccctggaaaaaggtttctttcttgccagtttcctgtttctattctgggttgatcattatcagtcacagtcctttgtcctccatgttttacctcctgtagttacacaagaacaacttgatcgtgctaaagaggcaaccaaatctgcagttctgatgaacttggaatcaagggtacactgttcttgctcctgatcaaatcctaactgtatgacccgttttcctaaagtgttctttacagtacacacttttcctcttctgcagtctatagcatctgaagatattggaagacaggttcttacttatggggaaaggtacgagagtattgctgtgctagtacataaattaggtctattttctgctacatttatgcaccgtatccttgcaaaaatatcaatatagtcatgctggaagattttctatttgggtcccaacaagtacaagcacatccaaagatctgagtctcgctcagtttgttgaggggtgtggatgtatgcttagacaacctagttactcctaagttggtatagtctttttgagtccaatcagatccaaagcatccatgcagcagttgtgtccatttctccagagtccagtagatctgttgtcatcttcaactgattctatgtttctgaaatttcaggaagcccatcgagtatttcctgaaaacagttgaggagatcactttgaatgacattttgtcaaccgcaaaggagatgatgtctacaccactcacaatggcatcgtggggcgacggtatgttcagcagtttcgagtagtcatggtgcattggtgcccgacaaggtatggcgactaactgaattgcttttattgcagttattcatgttcctagctacgagtctgttagccgcaagtttcactcgaagtgagaggatccagcatcggacttgcatgacctgttccaacaactgatgtgaagcctgcaacggccctcagctgggacagttactccccccacagaataaaaaagcatgtggtttctagcgccccccctaattactccctctgcatgtatacgccaaacatgttttttttttgtggtaagaatcatcaagccccttggcgactcgtttctgagtttcgcagcggcgctagattttattttatgtggacaagcgagctttcggggtgcgctcgtgcagaaatattttgccaacgtattttgcagtttagaccagaagcagaaaggaccagcgtatcacttttcctgttgttggatgcatgagttcatgacgtccacatttttgcaattttggctgttaccgtttccatcgattctggtgtgcgcgcgcgctcgcgcacttgttattattgttgtgataaggctggctattctctacatctattatctgtacgagaaccaattgatgttccaggtaaaacgaaacgattatgactcatttagaacgcaggaatttcaacacaggaattgtgaaggaggttttagagtgtaggtttgatctattgtggatgcgtctttccaggatttcattagcagaagaaaacttgaggaagttctgactgacgccaatctcgtgtagtcgtgtcctcggggggagagccttgctgagtcatcaatgctaaagtaaaaccgtccccaggtgaattttgtacaagagagacaggatggagataatatgcatcaatcagcctgccggactttgacctacgggatgagagcactgtcggaagtcaaagaagacgaactgcaggctccctcctctttgtaagtatacagatacgtagattagatatcgttatagtattatcgtatagactacgaaaaggatacaagtttccaaattccagtttgctgtcctagcacgccgttttcgtgcggcactaggaacttgtgatagcgacacgatcacacgacgcagggaattgaccctccttgccggcttatacgcagagtggcggcggcgagggcgaggcgtacgatttgcctggacccacatcacatgtgagcctgtggctcgatgggtggcggtggcgcggacccacaacatccctgatcctgaaaccagcgaccgcacgggcggctatgggcggaggccgctggaatggaatcaattaggccaggcatcaccgccggctgcgccacgcgccccggttctttctgcagcctacaggacgacacaaaatgccttgatcccacagccccgcgctgcgactgcgaacccaaaacaggcaaacacgcagcggtgcgcgcacaccgcctgctacggccagcatccagaagcgcccggtggaggccaccggacatcgccgttcgccgcatggccgtgcctctcgccaaaaccgcgacgcaactcccccgtatccgccgcaggcattgcgacttgcggaagccacaaaaccacgcacgcgcacacctacctcctccgttcatcaaaaccagcggcaactgccgacgaactgcactctgaccgaccgaccgatcggggccctctcactttccgtgcctcgtcgttattaaaaaaacacaccggaggcgcgaccgcctcgtccgcgtctgcttctgcatctgcttctgctttgtgctgctgc

SEQ ID NO: 4599 - DNA, 1967 bp, Zea mays
ctgctcctcttccgccgccgcaggatctcgtatcgccggagaccatgtaccgcgccgccgggagccacctccgctccctcaagcatcatggtgcttctaggcttgccagtacaagtgttgcgaagcagtcctcaggtggtctgttcagctggcttcttggtggaaaatcaagcgaactccctccccttgatgttccactcccaggcattagcattccctcacctctaccagattttgtagagccatctaagacaaaagtcactactcttccaaatggcgtcaagatcgcctcggagacatcatcgagcccagcagcatctgtgggtctgtacattgactgtggttccatttacgaaacacctgcttcatctggagtatcacatctgttggagagaatggccttcaagagcacagtgaatcggactcacttacggttagttcgtgaggtagaagccattggaggaaatgtctctgcatcagcttcccgtgaacaaatgagctatacctatgatgcattgaagagctatacaccagaaatggttgaagttctcattgacagtgtgaggaatccagcattcctcgattgggaggtcaaagagcagctccagaacataaaatctgaaatagctgatgcgtctgctaatcctcaaggtctacttctggaggcccttcattcggttggatattccggggcactggcaaaacctttgatggcttcagaatctgctgtaaaccggttggatgttagcagcttggaggaatttgttgctgaacattacactgctcccaggatggttcttgcagcatcaggagttgatcatgatgcgctgatttcagttgtagaaccacttctgtctgaccttccgtgcgtgaaacgtcctgaagagccaaaatctgtgtacgtgggaggagactatcgctgccaagcagattctccaaacacacacatcgcacttgcttttgaggtgccaggtggttggaatcaagagaaaactgcaatggttgtgacagtgcttcagatgctcatgggaggaggagggtccttctctgctggtgggcctggaaagggaatgcattctcgattgtatctccgtgtcttgaccaacttccaacagattgaatcattctctgctttcaatagcgtctataacaattcgggcctttttggaatttatgcagtcactagcccagacttttcatcgaaggctgtggatttggcagcaggggaactcctggagattgcgacacctggaaaagttacacaagaacaacttgatcgtgctaaagaggcaaccaaatctgcagttctgatgaacttggaatcaaggtctatagcatctgaagatattggaagacaggttcttacttatggggaaaggaagcccatcgagtatttcctgaaaacagttgaggagatcactttgaatgacattttgtcaaccgcaaaggagatgatgtctacaccactcacaatggcatcgtggggcgacgttattcatgttcctagctacgagtctgttagccgcaagtttcactcgaagtgagaggatccagcatgacctgttccaacaactgatgtgaagcctgcaacggccctcagctgggacagttactctcccacagaataaaaaaccatgtggtttctagcgcccctcctaattactccctctgcatgtatacgccaagcatgtttttttggtaagaatcatcaagccccttggcgactcgtttctgagtttcgcagcggcgctagattttattttatgtggacaagcgagctttctgggtgcgctcgtgcagaaatattttgccaacgtattttgcagtttagaccagaagcagaaaggaccagcgtatcacttttcctgttgttggatgcatgagttcatgacgtccacatttttgcaattttggctgttaccgtttcaaaaaaaaaaaaaaaaaactcgagggggggcccggtaccc

SEQ ID NO: 4600 - DNA, 2292 bp, Zea mays
  misc_feature (1271)..(1271): n is a, c, g, or t
aattcggcacgaggtttttttttttttttttttgcatcgttggaagttgactggtggacgaactccgcgccgccgccgtcctggatgacgccgcacgcacgaggtgcaagtgcaaacgaccgcgtccgagtccggatccgccaccaccgcgccctcgccgcactacaggcacgtggagcccatcggcggtgagccggaggctggagcacgcgcggcggtggcggcagcggctgcgcttgcggcggaaggaacggggtggggattcgaatcgaaggagcagcggcgatctactgttcccttgtattatgcccgcaactttacttctcaaagccaaaggtgtgcctgcccaccctggcctccccttctcccccgtcccgtcccccctcacccggcctctttctgctaaaaaaaaatactctcctatactatactagtgccaaattgcttctgcattctcttcccttcctgcatttcctcctctgtctcatcggggacccctgtccctcgtggcgacggccggtcgaccgccgctgccgaggacttcgccggcgacgaccacccccccgcccactacattatatgttgaagaatggcttggagctaacagtactgacaccaacttttggttatgatcagaagcgactggagtgcagtaatgaatctctaattgtttgcaatataagaaccagatacctcattcaaatggtttttccatgttacagattggtagccaagaacaaagagaaaaacacacaacagtaatgggtcacgaccatatgtctcgtataaagatgcatatggcagaaggttcttttggtgacaggatccggtgccagcaacctgggtgcaatgaggttgtcgatagaagggtagtgtactgcaaaattcacagtggagagttgtcatgccaacagttcagttacctccagagcggactggagagctcaggtttatctgtgcgccctgttaacgacagccaatttaagggatctgtttccattgcagcagtgccatgcactgagcaagagttacatgtcaagcatgaaggtggtgatcgaggtaaactaaaggatagttctgggtacactttgggtcaggctgcacaatttatcttctctggggcaagcatgctttgcaagaacgataactgcagcaagcaagcacacgagaactcaatccactgtaagttgcatagcggcggcgttaacaagggctgcatggcacggggctgtacaagaggtgcgcatggaggcacgcctttgtgcattggngcacggaggtgggaggcggtgtgtggtccctggatgcccaaatgcagcatgtggccaaggccgtagcgaccgctgcgtgaggcacggtggcggcaagagatgtaaattcgaagggtgcgcgaagggcgcgcaagggaacaccgatcactgcataaggcacggtgggggaagcccgcgcggccgcccacgcggcccaaagagtgcgcagggacgcacagatttctgcatcaagcatggtgggggcagccggtgcaggttccaagggtgtggcgcgagcgcaaaatggggaacggatttgtgctctgtgcacaggaagagcctgttgggcggtgacaatgccatccctgaagctttggccgccccttcagaaaaacgacgccgggccaagacgccccaaagggaagcgaagccgtccgaggtcttccaagagaatgtcacaacagcagctactgctggtaacagcacacagcacacgggcttccttctcgtagctgcccctgttgctaaccgtgacatactgaccaatggtatggcagtgacggggcaagctgcaatagccccccaacggatagtggcaccgatgttcatgagatcaccaacgccatctggatcagtggctgcctcggcacagaggtgggaggcgggagcaagcaggggtatgctgggtctgtagaaaggtggtataatttgggaaggcttggagacaccttgcccaagatagttctctgattattggctttcagactgagaaacctctgaaacttgacagccttgtgccgtcaacggactctagtgatgtcctgtgcagctgtgctctctcatttgtattgtaaattgtaatgcaaatctctagttgttcttgtgtatgttctcttgtcgccttgtagtagcgtggaaaccggtcgggggaccatctggaactttggatgataagcaataatattgtggcatggcctagctttgcaggtccagttggacttttttaagtagtggacattttaaaacaaaaaaaaaaaaaaaa

SEQ ID NO: 4601 - DNA, 2121 bp, Zea mays
tcctcctctgtctcatcggggacccctgtccctcgtggcgacggccggtcgaccgccgctgccgaggacttcgccggcgacgaccacccccacgcccactacattatatgttgaagaatggcttggagctaacagtactgacaccaacttttggttatgatcagaagcgactggagtgcagtaatgaatctctaattgtttgcaatataagaaccagatacctcattcaaatggtttttccatgttacagattggtagccaagaacaaagaggttagctagtggtgatatgcgataaagttttcatatatacaacaataaagctgagaattgtggtctgcaaataatacagttttccttctccatatgtattgtacttagagcaaccaatcttagtgattaacatggccagtttaacccgattctcaaacacccaaattgtgctatttcacaaattacttgatcatcaaactatccttttgtctgtttaaacatatccatttaccctccattcgggtctatgtttgggtttgggagccttatttggatcctggcattctccataaccggtcatatatctactgctgctgatattatatctctgtttcattatttcatagttttatatttgaacttctgcagaaaaacacacaacagtaatgggtcacgaccatatgtctcgtataaagatgcatatggcagaaggttcttttggtgacaggatccggtgccagcaacctgggtgcaatgaggttgtcgatagaagggtagtgtactgcaaaattcacagtggagagttgtcatgccaacagttcagttacctccagagcggactggagagctcaggtttatctgtgcgccctgttaacgacagccaatcttcgggatctgttcccattgcagcagtgccatgcactgagcaagagttacatgtcaagcatgaaggtggtgatcgaggtaaactaaaggatagttctgggtacactttgggtcaggctgcacaatttatcttctctggggcaagcatgctttgcaagaacgataactgcagcaagcaagcacacgagaactcaatccactgtaagttgcatagcggcggcgttaacaaggcctgcatggcacggggctgtacaagaggtgcgcatggaggcacacctttgtgcattgggcacggaggtgggaggcggtgtgtggtccctggatgcccaaatgcagcatgtggccaaggccgtagcgaccgctgcgtgaggcacggtggcggcaagagatgtaaattcgaagggtgcgcgaagggcgcgcaagggaacaccgatcactgcataaggcacggtgggggaaggcggtgcaggttccaaggatgtacaaagagtgcgcagggacgcacagatttctgcatcaagcatggtgggggcagccggtgcaggttccaagggtgtggcgcgagcgcaaaatggggaacggatttgtgctctgtgcacaggaagagcctgttgggcggtgacaatgccatccctgaagctttggccgccccttcagaaaaacgacgccgggccaagacgccccaaagggaagcgaagccgtccgaggtcttccaagagaatgtcacaacagcagctactgctggtaacagcacacagcacacgggcttccttctcgtagctgcccctgttgctaaccgtgacatactgaccaatggtatggcagtgacggggcaagctgcaatagccccccaacggatagtggcaccgatgttcatgagatcaccaacgccatctggatcagtggctgcctcggcacagaggtgggaggcgggagcaagcaggggtatgctgggtctgtagaaaggtggtataatttgggaaggcttggagacaccttgcccaagatagttctctgattattggctttcagactgagaaacctctgaaacttgacagccttgtgccgtcaacggactctagtgatgtcctgtgcagctgtgctctctcatttgtattgtaaattgtaatgcaaatctctagttgttcttgtgtatgttctcttgtcgccttgtagtagcgtggaaaccggtcaggggaccatctggaactttggatgataagcaataatactgtcattgcct

SEQ ID NO: 4602 - DNA, 1603 bp, Zea mays
cattgggacctcgagccggccatccgcatctgcgattgtccacgtcacggcccgcgcccgcgccagtccgcattcgccgcaaacggacgcacgcatccccgctccccccgccccttctcgtcgccacgagtgtgtgctagggttccggcgtccggcgcgggcggtggcggccattccgatggaggcggatacggggtgtcggttggaggtggacgacgtcctctccttcgccgacgacctcgtcgtagtgctccgccgcagcgacgacgccgacgccaacgcgcaggtgatcgcgggcgcggggttgctgcggaccgcctgccgctccgagtccgaccacctccacctgcagctgaaagattatcagcaaaaaatatgctcctgcaaggacaagacagacaaagcaaaagctgaaacgattgctgctgatgaactgagtgtactgcaaaataaaatggaagaaaatcttcaggaagataaacaacttcgtgaagaattgagagctacacataatgaccttgaaaacctagaccatcaaagggcttctatacaagacaggaagaatgctatcaagaagaaggatgaaaacatgcggaaagccacatataaactttccatgtgcgtgtcagttacaaatatcataccaaatttggaagatcgggataagatctcaagctatactgtcgacaagaatgggaagaagatacagaagttcgagtttgagaagacgacgccaccagttgagatctgtaacacgctttggaaaacaatttagggcgtgcagatcgttgttactgtctgttaacgaagattgtcaattgtacttgtatatatagctgactagctgaggatggtggacctctcatcttcaattgtgcttgtttataactttatatagctgaggattgtcaattgtgcttgaatttagggcgtgcaaaccgtcattagtgtctgttgatttacagtgttttgatttcagtcagtataagatcggaagatttgcgctttgcagcccctatgcattttctggccccgagtaaccctagtattgttaggatctatttaaccgttgttgttcccgatcgagatgaattggctgtgcttcgctggatcgctattgtaggcctagactgcattagcgtgcttgaattgccctcacgggctgctaggcgacggggacggctccagcaccgcttcacaaactgcatgtccttggcgacggccccactgccccagcacacgccgtgagagttgtgctggagcagcgactgtgttagtttctcagttatcacggactcacgggtgatctcaattcatgaagtgtgcaaccttattcatgaccatattttgttcatggtgacaattattcattgtgccaggtttacaaacatgtctcgtgagcttttcaaatctcagaaagaaaacaaccaatcagcaccggaccaacagaattgaaaataattatactagccgcggcggaaaagctctattagccgaaactcttgataggaagaaatgatgtcttgcctcgtgtatagaaaccaggatacgcaaagtgtcagcctaagtgatgccggaacagagaggccatctcaatctgcag

SEQ ID NO: 4603 - DNA, 907 bp, Zea mays
gtgcccgccgcattcggcgcacgaacctacctgctcctttttatgcttctccctcgctcgcctcgccctcgccgcaacgctttgcgatagagtttctgtctgctaccagcaccatcctagcaccccaccgcgtctagggtttcctgctccaatggccgccgcgggggcagacggggagcgcaggatcggggtggccatcgactactcggagagcgccaagaaggcgctggactgggccatcgacaacctgctccaccacggggacaccctcgtcgtcgtccacgtcctgcaccacggcgcggaggagaccaagcacacgctctgggccaagtccggatccccgctgatcccactctccgagttccgggagcccgaggtgatgcagggctacggcgtgcgccccgacgccgaggtgctcgacgcgatcgacacggcagcgcgccagaagcagctgaaggtggtggcgaagctgtactggggcgacgccagggagaagctctgcgacgccgtcgaggatctcaagatcgattccctcgtcatgggtagtcggggcctcggcccgatccagaggattctcctgggaagcgtgacaaactacgtgctgtcaaacgcatcgtgcccggtgacagtcgtcaaggggaagtagcggcctggacagcgtgccagtgatatgaatgaagatgctagcgtgcagtttgtgtgggttatagctaaacactatgttccgtcttgttgctgcatttcaataaagcatgtgtcttctagatttcacaaatctctctgaggctctgacctctgtctattagctgtgaaactgtccgtgcttcattcctgtccagatcgaaatttgaggattgattcataccccttttacaaaagccccagggccctaaaagccccctagggc

SEQ ID NO: 4604 - DNA, 881 bp, Zea mays
tcaaacaagacaacccacctgctccattttatgcttctccctctcgccgcaacgctttgcgatagagtttctgtctgctaccagcaccatcctagcaccccaccgcgtctagggtttcctgctccaatggccgccgcgggggcagacggggagcgcaggatcggggtggccatcgactactcggagagcgccaagaaggcgctggactgggccatcgacaacctgctccaccacggggacaccctcgtcgtcgtccacgtcctgcaccacggcgcggaggagaccaagcacacgctctgggccaagtccggatccccgctgatcccactctccgagttccgggagcccgaggtgatgcagggctacggcgtgcgccccgacgccgaggtgctcgacgcgatcgacacggcagcgcgccagaagcagctgaaggtggtggcgaagctgtactggggcgacgccagggagaagctctgcgacgccgtcgaggatctcaagatcgattccctcgtcatggggtagtcggggcctcggcccgatccagaggattctcctgggaagcgtgacaaactacgtgctgtcaaacgcatcgtgcccggtgacagtcgtcaagggggaagtagcggcctggacagcgtgccagtgatatgaatgaagatgctagcgtgcagttttgtgtgggttatagctaaacactatgttccgtcttgttgctgcatttcaataaagcatgtgtcttctagatttcacaaatctctctgaggctctgacctcggtctattagctgtgaaactgtccgtgcttcattcctgtccagatcgaaatttgaggattgattcatacccttttaccgtagtgggcgtggtgatctgggccctagg

SEQ ID NO: 4605 - DNA, 4980 bp, Zea mays
  misc_feature (868)..(868): n is a, c, g, or t
gccgaagctcgctgtttggactcgatccgagccttgcacgaataagcgggtcgggctcggacaagaaactaagtatattgggctggtccggcatggcccgtttacctctaaacccgtcaaacccgttttttcaataaaccgtgcttaccggcccgcttagcccgtttttcggtccgatttttctgtgcttaccagaccgacccttttaggctcgctgcggaccggacttagacagggaaatgagcccacgagtttaaataggtcgacccagttttctaaccggcgggacaggcccaaaatgagtcgggctttatcaggccgaaccaggcggcccgtttggccatctctacctggggcagaggaaacataatttatttatgaggggcgtgattagcaatgtcgtgacgacgaggaacgattatcatcttcctgaagaaagggaacccttgattacacgaagccctttggctaacattctgcagcaacctgggggcccgacaaaacgcttccgtccacgcgaaactgatcgaaattcggcagcgctttccgcctcttttctgagtctctgacccacaagaagaagcaatctcccccagtctcaactgttttcacgacgccgaagcaaaccgcttggacgttcgtcgttgtattttgctgccgcaccgcaggccgcagcctgctcttggccacgcgaagttgcgaacgatctataacccaatcccacccaccggtgccggtgcgtcggtgatcggcctgcggcgcccacgaacgaacaggcgtcaggtgcgcttcagcgcgtcgcgcggaggcaccgtgctaagattccgcgggcacgtcccagcaagcgctggagtgcacgcgcgcgcangacgctgcccgttccccacccaaacgcacgcggggaagcgccgcccgcccgaggagaggagcgcttcccgtttccgtgcccgcaagacctgtctgtctgggtccggtgggtctccggaccaggtgtcgagtgccccgctcgctcgcgtagccgcgttgcactttttttgcttccgtccaaacgcaggacgcggaccaacccacctgctccattttatgcttcgccctcgctcgcctcgccctcgccgcaacgctttgcgatagagtttctgtctgctaccagcaccacagcctagcaccccaccgcgtctagggttttctgctccaatggccgccgcgagggcagacggggagcgcaggatcggggtggccatcgactactcggagagcgccaagaaggcgctggactgggccatcgacaacctgctccaccacggggacaccctcgtcgtcgtccacgtcctgcaccacggcgcggaggagaccaagcacacgctctgggccaagtccggatcccgtaagctccccccactcaagctctcgccgcatccatctctaccctacccttacccaaatgctcacccgctgcccgctggtgtctgtttcggtttcctgacggtcttggctcgtcggctcaatctgattcgctcgatcggtctcgcttgcttcgatccccgcagcgctgatcccactctccgagttccgggagcccgaggtgatgcagggctacggcgtgcgccccgacgccgaggtgctcgacgcgatcgacacggcagcgcgccagaagcaggtgcgtgtggtgtgtgtggacggcgttcgtgctacgttctggtcgagcgagttgaggggggataaccgaacacttgcccgtctccgtgctcatcagcggtcccgggtggcgaagctgtactggggcgacgccagggagaagctctgcgacgccgtcgaggatctcaggatcgattccctcgtcatgggtagtcgcggcctcggcccgatccagaggtatagtacaatcctaagactccattactactactatagtactattgaaatgttgcctcatcaggactggaatgcgctgttcagcctctgatagtaagttagtttctcgctttttctttttgttcggataagcgcgtcaattgagtgtctggaataaatggatatagtctagcgtgcatggatggctcgattgatgatagggatagcccgcatgccaagtcagtatgctggtgcagtactgaaatgttcaaacacagcacatctagttcttgttcttaatagcaatacttatctgaaaaatgctcttgttccttgtatcgttgcatccggtgattctgagctgtgaacgtgattactatatacttatttcttagtagccgtgatgagccacgcgatgctgccttgtgagttgggacctttttctaactcgcaagggggcattgtctttagcctgtccaagagttgtgaggttcgagacatcccaacatcatcgtgattgtcatttttttatgcagccatgtgaaactgtcgttgatatttaaatgctctacattagtttaggcatttgaaagattccgtataggatcagtcgaccaatgccgtggctgtgttgttcaacgctcaagttcatatatataaaactatcactagtgggtaactgcgtatacaagggttcaggaagttttttttaaaaattcagctcgatatcttgagttcttgacatttgtgtaacagactaacagctttctaccataagaaatggatcatttgtgtcgagaaacggctagaaaaactccttacaatattaatcagtgattcattttttttattgtcaggaaaaatgtccagccctgccttgctacatatttgtatacttagactgaaagagggcctcagtttttgctactctacctttccagttacatagtactcgttgttgaactctttgccccgcttaataatttagatgtcataaatcaaatttgagtgcaggtctctcccctcacttcttttatttgaaactcacgatatctggcactcaatatgaatgtaaattaccacattccctttttcatgcaacgccagttgctgatgacggtggtcgcggcctaggtactggggcgacgccagggagaagctctgcgacgccgtcgaggacctcaggatcgattccctcgtcatgggtagtcgcggcctcggcccgatccagaggattctcctggggagcgtgacaaactacgtgctgtcaaacgcatcgtgcccggtgacagtcgtcaaggggaagtagtggcctgggcagcgtgccagtgatatgaatgaagatgctagcgtgcagtttgtgtgggttatagctaaacactatgttccgtcttgttgctgcatttcaataaagcatgtgtcttctagatttcacaaatctctctgaggctctgacctctgtcttattagctgtgaaactgtccgtacttcattcctgttcagatcgaattcgaggattggttcataccccttttactgtcgtgtcgtttgaactgctggttagtctgctcaatttgtatttctgattgtcttgcaccacgtttggattgcagcacagagtggtccgatcctaaaaccgactcttatcgttttgtttggtttgagtcacgacatgacgacgacgtcctctgaaatttacacagcagcactgttaattttgccggacacccaaactcaaatatgaaaccacccgaacaccagtttgggtgataatccaaatccgagaccaaacctcatggatccccgaaacctaatctcaaaggccaaaaccacaccaagcacagcacccctacagctcaaacggttaaacccaccaaaaggtccatgtttcacaactcaaaagcatgttccagctccacacatttgatctctctaccatacatactgaccatgatctgttgcggcgtgtagtagcgtgtgttactgacttacagtagcatcccagggcggtttctcttgttgccgcttgttgcggcgtctagtagcgtgtgtcaggattggacaccagatgttgatcggatcaaaggacactgtctgtcggagcgcgagtaaccgtgaccagtccataacgaacggacatagaaagcaagcctggtttacacctcagtcacaacagggccaccaaactccacctcatccttttccatcatactgagagtacgggtaagtaagaatagtaggaacataatttttttttaaaaaagaagggtaaggacagattatgtacaacccaaatctttccgaaagatagcaggaacacgcacatatagcaggtgatcctgcgagctgcagactctttggcaactgcttttatcaaaactacttcaggctgacctaccagttcattagtaagttcagcactgcacggctgcacatctaaaaccacaagaacacacttagcgaaaacaggaacacaaaaggacgcagcctacatccacgtctgtccaggtgtgatgatgcatctaaatactgcctccaccgaccggattacagctattactttcggtccatgcctaacggctcgcatcaacagttccaacactattatgacaaaccaagctcagctccaccccttttttattcctgaaaaacaaaaggagaacaggatgtgaataaaatgatgtgaggccatggagaaagcatcgcaagtaacagcagaaacaggggtagcgcaatagggtgtgaacaaaatgatgaggccactgagaaagcattgcaagtgacaggggggtggcgggctgctaggattcaaggaagtgtaggctgtcatgataagctattcaaaacatgatcaagtcctatgtgtcaccgttatccttaatgcctatgccttatatacctgctaccgttttttctttaacaagtgacacttgccagcatcttaatcataaggtaacacttgcaagagattgtaatactactacttgccatgaaattgagatttagaacaactaatccaccaagatccgcagttcacttcaagttacacaaaaaaaaaagtagtggaggtaaaaactgatggtgtgatataacctgctctaagctgctaagataaactttctactacta

SEQ ID NO: 4606 - DNA, 1552 bp, Zea mays
  misc_feature (1288)..(1293): n is a, c, g, or t
  misc_feature (1297)..(1297): n is a, c, g, or t
  misc_feature (1409)..(1411): n is a, c, g, or t
  misc_feature (1529)..(1529): n is a, c, g, or t
cattgggtacctccggcccggcccccacctgctccattttatgcttcgccctcgcccgcctcgccctcgccgcaacgctttgcgatagagtttctgtctgctaccagcaccacagcctagcaccccaccgcgtctagggttttctgctccaatggccgccgcgggggcagacggggagcgcaggatcggggtggccatcgactactcggagagcgccaagaaggcgctggactgggccatcgacaacctgctccaccacggggacaccctcgtcgtcgtccacgtcctgcaccacggcgcggaggagaccaagcacacgctctgggccaagtccggatccccgctgatcccactctccgagttccgggagcccgaggtgatgcagggctacggcgtgcgccccgacgccgaggtgctcgacgcgatcgacacggcagcgcgccagaagcagctgaaggtggtggcgaagctgtactggggcgacgccagggagaagctctgcgacgccgtcgaggatctcaggatcgattccctcgtcatgggtagtcgcggcctcggcccgatccagaggattctcctgggaagcgtgacaaactacgtgctgtcaaacgcatcgtgcccggtgacagtcgtcaaggggaagtagtggcctgggcagcgtgccagtgatatgaatgaagatgctagcgtgcagtttgtgtgggttatagctaaacactatgttccgtcctgttgctgcatttcaataaagcatgtgtcttctagatttcacaaaaaaaaaaaaaaaacagaaaaaaaaaaaaaaaaaaaaaaaaaaaaaaaaaaaaaaaaaaaagggggggaaaaaaaaaaaaggggggggcccgggggaaaccgggggggctgggggggggtccccccccccccgaaatttgggggaaagggttggtcgggggggggggggaaaaaaaggggggggggggaaaaaggaaaaccccccgggggggccaaggaaaaaaaggggggggaaagggggccccccgggggggaaaaaacggggaaaggggggggggaaaaaattccccgggggggggcccgggccccggtaaaaaaaaggggggggggggaggttaaaaaaattttggaaaaaaaaatggggggggggggaaagggggggggggggggggttttttggggcccggggggacccccatccccaaccggttggggtttttcccctttttggggaaaaaaaaaaattattttcccccaaggccccgggccgcttgtgggggggtttttttttggnnnnnnctcnaaaaaaaaattaaaaaataaattaaatcatcgctgccgccccaaaaaaaaaaaaaaaacagggggggggggggcgggccccacatcccccaaagggggggcactaaaaacgnnnggtgggggggccccccaccaataccccgccgaagctctcccccacgcaaccccattatgacccgcctcgcatatcccgcatgagcgccacacgatatattaaagtggaccgccacaancaaaccaccacacaccaaaaaag

SEQ ID NO: 4607 - DNA, 953 bp, Zea mays
aggatctgctccattttatgcttctcccgcgctattgggaccctcgaggccggccgcgcaacgctttgcgatagagtttctgtctgctaccagcaccagcctagcaccccaccgcgtctagggttttctgctccaatggccgccgcgggggcagacggggagcgcaggatcggggtggccatcgactactcggagagcgccaagaaggcgctggactgggccatcgacaacctgctccaccacggggacaccctcgtcgtcgtccacgtcctgcaccacggcgcggaggagaccaagcacacgctctgggccaagtccggatccccgctgatcccactctccgagttccgggagcccgaggtgatgcagggctacggcgtgcgccccgacgccgaggtgctcgacgcgatcgacacggcagcgcgccagaagcagctgaaggtggtggcgaagctgtactggggcgacgccagggagaagctctgcgacgccgtcgaggacctcaagatcgattccctcgtcatgggtagtcgcggcctcggcccgatccagaggattctcctgggaagcgtgacaaactacgtgctgtcaaacgcatcgtgcccggtgacagtcgtcaaggggaagtagtggcctgggcagcgtgccagtgatatgaatgaagatgctagcgtgcagtttgtgtgggttatagctaaacactatgttccgtctgttgctgcatttcaataaagcatgtgtcttctagatttcacaaatctctctgaggctctgacctctgtcttattagctgtgaaactgtccgtacttcattcctgttcagatcgaattcgaggattggttcataccccttttactgtcgtgtcgtttgaactgctggttagtctgctcaatttgtatttctgattgtcttgcaccaaaaaaaagtaaaaaaacccgagggggggccccgt

SEQ ID NO: 4608 - DNA, 1766 bp, Zea mays
acggatgccagctctctagctaccttgtgcccaaagtgccaaacggccccttaagtcttaaccacctgctttatcatctcccgtgcgcgctctccctcggtctctccctccctccctctctcgctcgtggccacgactgggcgactgcctccgccgcatttcgctaggcgccacacggcccttggccggcgacgagcacccacagaaaaagtgttgctcctacgactagttctttttatgtgtaaccttcaatgaaggattctcaggatattcagagcacgacagagttgcagtcaccagtgcaaggtactaatgaagtgcaaagtcagcaaccaaactcaatggccgctgatgctcctgctggaaattcgggttccttgtctgtagctagtaatgacaataagaaggtgtctcgcgaagatattgaacttgttcagaatttgatagagcgttgtctacagctctacatgaacaaaggagaagttgttagaactctttctactcgtgctagaatagaacctggcttcactactttagtatggcagaaacttgaagaagaaaactccgagttctttagggcttactatatacggttgaagttgaaaaggcagatcatcttgttcaatcatttattgcaacaccagtacaatttgatgaaatatccagcacctccgaatattccattggctccaatacaaaatggaattcatcatatgccagttagcaatttaccaatggggtatccagtacttcagcagcctatcatgcctgctcccggccagcctcacatggatccaatggcctgcggtctgtccagtggtcatgtggttaatggaatacctgcaccaggtggttatcatcccatgcgcatgaactccggaaatgacatggttttggacaatggagtgcctgaagcaccacatgctggtgctaccggtagtgctatgtcatctgagatggctgtgagtccctcgtcggcggcttcaagcaaccatgctccttttacgccgtcagatataccaggcatgaccatggatgtatcggccctagactcggcatttgggtgtgatgtggggaatcctgaatctctgcaattgggaccagatgggtcaagagactctattagatccttagggcagctctggaatttcagcctctctgatctaacagcggatttgacgagtttgggagcagatctggacgtgctggagaactacactggcacccctttcctgccatcggattcggacattttgctggattccccagaccaagatgatatagtcgagtattttgctgacgccatcaacgggtctccgtcagacgaagagaaaccgtagtttttccggggtggcatggcaatggcatgcattcaggttcatcatcaggcagggctgccatctcatctcatgtagtgtaaagcagccaatctaactgtgtattcggctcgcgcgcggtgatccggtaatcgggcctctgccactaaaagaattttgtagcggttaattgaaatcctaattctttggaataagtagctgggactggaatgtccagagagtagcggtcgttgttggcttagggattgctgctggtggatgcaaacctcacagctagctggtgactctgaaaccacaggaactccttttcttttctttttctttttacttgtatttgtatttgctgctacataagtaaacagaagtggggtgtacctagttttctggtttttagtgtcttgaaagatcaaaataaaaaaaaaaaaaaaa

SEQ ID NO: 4609 - DNA, 1941 bp, Zea mays
gcgcgctctctctctctcccctccctgtctccctccccctctcggagtctcggtcgtggcgacgacgactgggcaggccgacgagcacccaccaggaaaagtattgctcctagcctcctacagctagttctttttatgattaagctccaatgaaggattctcaggatattcagagcacaacagagttgcagtcatcagcacagggtactaatgaagtgcaaagtcagcaaccaaacccgatgaccactgatgctcctgcaggaaattcgggttccttgtctatagctagtaatgacagtaagaaggtgtctcgcgaagacattgaacttgttcagaatttaatagagcgttgtcttcagctatacatgaacaaaggagaagttgttagaactctttctactcgtgctagaatagaacctggcttcactactttagtatggcagaaactcgaagaagagaactccgagttctttagggcttactatatccggttgaaattgaaacggcaaatcatcttgttcaatcatttattgcaacaccagtacaatttgatgaaatatccagcacctccaaatgttccattggctccaatacaaaatggaattcatcatatgccagttagcaatttaccaatggggtatccagtacttccgcagcctatcatgccggctcccggccagcctcacatggacccaatggcctgtggtctgtccaatggtcatgtggtcaatggaatacctgcaccaggtggttatcatccgatgcgcatgaactctggaaatgacatggttgtggacaacggagcgcccgaagcaccacatgctggtgctaccggcagcgtcatgtcatccgagatggccgtgagcccctcatcagcggcttcaagcaaccatgctccatttatgccgccggagatcccaggcatggccatggacgtgccaggcctagactcgacattcggatctgacgtagggaatggacctctgcaattaggaccagatggctcgtcgagagactccattagatccttggggcagctctggaacttcagcctctctgatctaacggcggatttgacgagtttgggagatttggacgtgctggagaactacaccggcacccctttcctgccttcggactcggacattctgctcgactccccggaccaagatgacatagtcgaatattttgctgacgccatcaacgggtctcagtcagacgaggagaggtcatagcgaagctagctcaaggtttttcaggcagggcgcagggatgtgtcttctcatggcctgctgcgagagatgctgcggctaatgtaatgtaactgtgccttgggcccgcgcccctgtgtgctgcggcaagtgtagctggtttaattagactttttttttaatttgtagctggttaattagaatcctaattctttggaataaaaaagtagtagctggagttatcggtaagaatcgctggatgtaatgcaaagctcgctctcacagtcacagctgggtgaccacaggaggacctcctttttgtttgttgtatatttgctgctacagaagtaaaacggtctcataggtctcaggcttactcggcgcagctcgcagcagaaatcatggccgaccaccacggtgctccgggagtcgggacgcggcggcgctcttttcgtttggaacgtcgggagcggctggctgcttgctgccaagtgccaaaccaggacgggacaacggctgtgagaggtcaaagcgaccgcgagcagagtcagcgatcctccctgcagtgaggtcctggactgaaactgaggcgactaggcgagggctgcgtgcatgcagccgctccggaaaagcaggcctgcctgcctctgcctgcttccggccgcatggcaaccggaaccggcatgctgtcgtggaacgaagtcagctatccggtcagtgtggcacgcga

SEQ ID NO: 4610 - DNA, 2601 bp, Zea mays
tgcatgcctgcagtgggtctttgcatcgttcttgttcgcagtcgcccgcagtggcgagaagaggacatgcgcaacgtacaaagatttcgccatctcgctctgccagccatcactccccgtgatgatggactgaccgacggcgacgggccaagtggcgcatcgcatgggcgccgagccgacggcgacggtggctgggatggggcaaagttgctgtggtaggtttcgccgtcccgtgtcaggtgttggtggagtgcaggtgcagcagagagccgttggcaggccggcgaatctcatatagggcccatgtcaatctggcctgcgcctgaacgtatgggcctcaaaactaatttatccaaataagtttttcctcttctttttttattcgtcaccaccggtgcacgtacacattggactagcgtggaaggcatagcctcgatccattatgccgtcccgtggtgatggtgatggatattgatgccgatgcggacaactggatgtgcagtagcgtacgtgtctcgtggtggttgataggttcgtttccagtaatcagtttaataattagattatatttaatacttctaactagcattgagatatctattgtgacatagactaaaattatattgggtaacttcctatattattaaccttgctctaacggtaatttgagatagggatccatttcatatggaaagattagagatgctagcattaattatgtcggtgtccacgcagggagaaaataaatcacgaatcggataatgctggtggacccagcgcccgccgtccatttgggcccccgatgcttgaaacacccgccgcgggccgcgtcggcgtcggcatccgtcgccccaaaactctcctcgcaagcgtcgccgccccgcacagatcaaccgctcgaaatttgggggaagcaagcgagagcagcagcaagcctcatcgggaagtggagagatggaggcggcgggtcgcctcctcctcctcatcgtctcctccctcctcctgctcctctcgccggagcggccggcggaggccgcgccgccgcgaatccagccgctcgccaccgccgcgctgagccgcctctacgacacctccaactacggcaggctgcagctcaacaacggcctcgcgctcactccgcagatggggtggaacagctggaatttcttcgcctgcaacattaacgagacggtcatccgcgagacagctgatgcgctggtgtccacgggactggctgcgctgggctacaacttcgtaaatatcgatgattgctggtcatacgtgaaacgaggaaagcaggatcaattgctgcctgatccaaagactttcccttcaggcgtcaaagcacttgcagattatgtgcatggaaaaggtctgaaacttggtatatactctgatgctgggaaatttacttgccaagttcgacctggatcactcggtcatgaaaatgacgatgctgcgatctttgcttcatggggtattgattacctgaagtatgataactgctacaatttgggaataaagcctcagaaaagatatcctcctatgcgagatgctcttaattcaactgggcgccaaatattctactctttgtgtgaatggggccagtatgatccagccttatgggctggcaaagtgggcaatagttggcgtacaactgacgacataacggatacatggaaaagcatgacagacattgctgataagaacaacaagtgggcatcatatgctggacctggtggttggaatgacccagatatgctggaagtaggcaatggtggcatgaccttagcagagtatcgctcacattttagcatatgggctctcatgaaggcccctctattaattggctgtgatgtcagaaacatgacttctgaaacaatggaaatactgagcaacaaagaagtaattcaagtaaaccaagatcctcttggagttcaaggaagaaaaattttaggacaaggaaaatatggatgccgtgaggtgtgggctggtcccttgtctgggaatcggcttgttgttgctctgtggaaccgttgttcagatactgctaacgttacaatgaaactgccagcagtaggccttgatgggtatgctgcctattctgttagggatctgtggaagcacgaaactatatcggaaaatgtcgtaggaacttttggcgctcaagttgacgtgcatgacaccaatatgtacatcttttctcctgcaaccattgtcgcttcggtttgatcaggaccggtggatccaagatgacagcaccgctatgattcaaggatatgtcacgacaacaagggccttcgtttttcctgctgcattctgttccacccgagtgcagaagtccacttcgtgcagaactgtctcagtgatgtttgtatttctcacggaatagctctatttatctcaagattgagcaagctcgaggcttactcggtgtaccggcgttgtatccttggggcatccaagatcttgtacgatttgaaacagtctgaaccaatgatgtaaaacaagatagtgaaaatacaacttcacaaattgcagccgtacaatcagcacttgtacaagcactctttttttctgttcaaaaaaaaaaaaaaaaaa

SEQ ID NO: 4611 - DNA, 1748 bp, Zea mays
  misc_feature (1724)..(1724): n is a, c, g, or t
cccacgcgtcccccgacgccggccgggccggctagcgtcggctaccgcgactgcagcgtcggcggctgggaccagcggatgtgcgttcctctctctagaagctccgtcccgtcttcacagccttttcctcccaacaacgcataatattagctagggtttcaacgcatctgacggcggaagctagggcgtcgccaccgtcaatgtcttggcactcccgctctgttcatcaatcgcatcgacaggtgctccatgattctctataatatccgaaataaattaggattaaagcaagaataggaagttattcaaaactcaaaagtaaagggtttccggtcttccagttaaatgaccaaatgacctgtagaatgacagcaagcaagcaaaataaacggcagacaaattgcaccaactcagagcagtgcaggccagcgaagaaagcaaaatttgacacatctcattgtctagtaagtttgaagcctcatatcagtcttaaatgggatcaatatctgaggaaagttgtgccagagaaggaacaagttggaattttgtggtcagacttggccccttttcatggaaagccagaaacactgttcaggccttgctgatgttatgtatgttcctccagagattttctctcttaagagcctgaaaggtgtgctatcctatgaggcatggtctacatctcttacagaagccgagagaaaatttctcatacaattccttccaagcgagactgatgcagaagaaaatgtaaaattgttgcttacgggacaaaatcatcactttggaaatcctttccttagctggtcatcttctctttgctatggtgatattcatccggatgcactacttaacaaggagaagcacataaaaaaggatgagaaggcatatcatgttaacttgcttaattaccattccaacatggttgaaaccttgaagagttggaggaagagatggctaagttgcggtgatacagagaatttgttcagggataaccctagtaatcagatgcaaggagttatgcagctgaaagctactaacagtggaatgcccatgaaggttgcacaaagaatcgatgtttcaaagtttatgtcatacatcaaagttagtagaacacagctcaaccatataaagagactgaagcaatctggggatggtattcagaccaagcatgtttcacgtgtaattggcggccttgataaatctcatgtgaaaccttatggagctttattagaggatgaacagaggagactgcgcgagcattggctggaaatgtcttgcaatgatttacctgctgcctttgaggttcttagggaaaggaaggtgctgatggagaaatcaataaagttattaggccttgagcttcagcagaagaatgtatctgtcttgagaaaggttcgctgtgacttgtccttcaattctttttcttaagtctctaatttttgtcttgagggaagtgatttacttgaatgtgtaaaaaatacagtggatgagaataccgttgtatgcttacttctgttatgtatcttccccatttacaatgtatcatagcattcgccactatagatgagaataccatgactataaagatactgaattgtaatagaggcatctagtatgaaagccataggcagtatttcattaaaaaaaaaaaaaaaaaagggcggccgcgccggtgatcgacgaggtgcagcgcgggctcggcctgtccgacgaggacgtgnaggcgtcgcggatgacgctgcacc

SEQ ID NO: 4612 - DNA, 4491 bp, Zea mays
  misc_feature (3765)..(3765): n is a, c, g, or t
aattcggcacgaggcagcgtcggcggctgggaccagcggatgtgcgttcctctctctagaagctccggcccgtctcgagccccgccggcccccaacaacgcataatattagctagggtttcaacgcatctgacggcggaagctagggcgtcgccaccgtcaatgtcttggcactcccgctctgttcatcaatcgcatcgacaggtgctccatgattctctataacatccgaaataaattaggattaaagcaagaataggaagttattcaaaactcaaaagtaaagggtttccggtcttccagttaaatgaccaaatgacctgtagaatgacagcaagcaagcaaaataaacggcagacaaattgcaccaactcagagcagtgcaggccagggaagaaagcaaaatttgacacatctcattgtctagtaagtttgaagcctcatatcagtcttaaatgggatcaatatctgaggaaagttgtgccagagaaggaacaagttggaattttgtggtcagacttggcccctttcatggaaagccagaaacactgttcaggccttgctgatgttatgtatgttcctccagagattttctctcttaagagcctgaaaggtgtgctatcctatgaggcatggtctacatctcttacagaagccgagagaaaatttctcatacaattccttccaagcgagactgatgcagaagaaaatgtaaaattgttgcttacgggacaaaatcatcactttggaaatcctttccttagctggtcatcttctctttgctatggtgatattcatccggatgcactacttaacaaggagaagcacataaaaaaggatgagaaggcatatcatgttaacttgcttaattaccattccaacatggttgaaaccttgaagagttggaggaagagatggctaagttgcggtgatacagagaatttgttcagggataaccctagtaatcagatgcaaggagttatgcagctgaaagctactaacagtggaatgcccatgaaggttgcacaaagaatcgatgtttcaaagtttatgtcatacatcaaagttagtagaacacagctcaaccatataaagagactgaagcaatctggggatggtattcagaccaagcatgtttcacgtgtaattggcggccttgataaatctcatgtgaaaccttatggagctttattagaggatgaacagaggagactgcgcgagcattggctggaaatgtcttgcaatgatttacctgctgcctttgaggttcttagggaaaggaaggtgctgatggagaaatcaataaagttattaggccttgagcttcagcagaagaatgtatctgtcttgagaaaggcagaccagttaacagacataatgaaagggctaggacaacctggtgctagtgaaaatgatggtaccccagtttttcaaaatgaccaggtagaatgctcaccccaaagtatattgcaaggtgggcatgttcagagcacatctcttcaccatcaggatgatgagcagtctgtttaccatattcaccgtatgaatgtggaagatcatgatctcatggtagtcaggggtatagacataactagtcagagtgagaaaaactctgatgtgccagatcaaagtcgtaatggtatcagctgcgtagataaaggcatttactgctgtgccaacaaccctgataagcagagtgatgttctcatggacatcaaattatgtaaaggtggactggttgtttacaatcctgactgcaaaaatacgcaactagaagatcttgatggagtttcttacaaaggtccatcagttcatgcttgtgaccaagatcaggacctggaaagcattggccatgctgttgtgaaccacaattgtcacaatagtccaaatatttcttcggaaatgagtcatccgacgacgaacgctgtaattgaccaggaaactgagaatgttatggaaccatcttgcagttcttcacaactacctaagtcgtctggagaacaaatgcatgtggaagattttctgtatctaaatgaccaagcagcaaaatttgagaaagtcagtgggcagttggcaggccctcttggccctccagagaatatgatgtataatgactcaggtgacttgcagattaaacagacttatctctcttcaggacaacatttttcttcagtttacttgaataatggcattttaagccatcagcaacctcaacttgccacaccagcttttgctttggacaatccagcatcatttattgagcctttctcaaatctgcagagcaatcgtcagcccgagacagaaaaggacattggagcagtcttctatccctttcgacacgcaactaacatcaaacagtcagcgagtttgcattgtttagtgaataaaggcttggctcaatctgcttcatttcccaggttgttgcaagagcggcatcagttaatcgatcagagtgacagtgacctctatgcacaacctcatgaggattactgcacagatgtgagttgtccaactaaagtgaaccttcatatctccgaacagcattcttatactgcttttgcttcgatggatcataggtataactggttccccgagggctgtcagtcacataataataatgataatctgttggggttgcagtcaggtaacttcttaccccaggccttaccaagtggaagcagcaccgatggagctctgttcagcaccgcatcccagtacaatcagccatcagtacacatgggacatggtgggtcaaaccgcagccaactcattgagccaaggaatcaatttggcccacctcagaattttctttctaagagtcaagacacaaaccctatgtttccggatatgtatggcttcacccagaatatagccagtggcacaagcagtcaggtagcacctatagggtctctggattgctcacattggacaaatttcatacaacaaaattctggaatgccgtctgactttacaaacaggccatctcgagggccttggaccagataactctatgacaccctggactggatgtactagattggttggttttaggcgccacctaagttggttaataaggaaactggggcaggttggaacagaatgttttccagcatccatgacttatgtcatgtagtggttttgatctgtttgaatggtgtggtttcaggaattgcttttgcaccatacctgtctgaacgcaagcgctgggaatctggagtcaaagctgaggattcccgcttttgctgtcttgccctgctgatttttttttttattttgataataagctgtgccccagtttccatgtgtagtctgcctatggtgccctcagcaaaacatgatgctgtgttgttctcaattattttgttatttttttttgggttgacatgccagttatatatgaagacaagatatgtataccagtcgggatgccattttaggtatcaagagcgggcagttcgaaatgaacaagtacctttccttttggttgggaggcactaggatttctttattcaggcgtgtttacattccgtttgattagttggccgcaccgtttcgtcctaggtcacttagtgtattgactttatctaaatgtttgtttggttgtctgtacatagtgatgtataaagcgtatagcgtagatttagcgtttgattatttcaagttgaaatgatatttgtcatgatcaatacatatcactaaagattgagtttttattaacctttcgttataaccctatattaaaataaatcattttgagacattttgnctgtattcgctcatacgccaaaaacaccagcttcccgctggctttgttagctagtttcccgctggctttgttagctaggatcgcacgagcgtggctgtccacgcccactcaaccaatcaggtggattggcacaagtacgagaaccatattttctcatgatattttcattttacaagggaaattaaaattagttcattttctcttaggaaaatagatttttttttgaaaaattgagcttcccaaactagcatttactatcaatagaaacacagtgagattctcggtctcggagagtggccacgttgttcgaactctcacgaggatgtcctcctctcgtctttgtctctcacccctttggatctgttgtcatcgctttgctgtcgctagggctatataaaatacttgtggctcgataactcactccactcgttagtagcttgactcgactcgtttgaaatgagttgtaagctaagccaacattttagctcggttcttaacgagccaaaactcgggctggctcgtgagttgctcacgagcttaatgagctgcacaactgccttgtggcccaatgaggcccacatgccacacccactcctagcgccgagttggaagcggcccaacccacggttgactcggcgactccatttagaaaggcagaaaccctagagaacatgagtccatgacagacgccgcaaactcgatcacccgctgtcgactagctgccac

SEQ ID NO: 4613 - DNA, 1949 bp, Zea mays
aattcggcacgaggattagctagggtttcaacgcatctgacggcggaagctagggcgtcgccaccgtcaatgtcttggcactcccgctctgttcatcaatcgcatcgacaggagccctatcctcaatcatgtctttcccgccgagctacacaccttcaggagcccatcccctcctccctcaaacgacgccgggtgacaagcaggaaaagtagtaatgacgacatgcttccaaatcactttcaacagtttcttctacttctttttgtttgccttatgatgattatctactgtcagttactcagttttatgatttgactagttactttggtttgtggagctggatggaacaatctttcagggtgcttcaccattagattgtgcttatatattgagctgaaaatttaacctatatatgtcctgttttaggtgctccatgattctctataacatccgaaataaattaggattaaagcaagaataggaagttattcaaaactcaaaagtaaagggtttccggtcttccagttaaatgaccaaatgacctgtagaatgacagcaagcaagcaaaataaacggcagacaaattgcaccaactcagagcagtgcaggccagggaagaaagcaaaatttgacacatctcattgtctagtaagtttgaagcctcatatcagtcttaaatgggatcaatatctgaggaaagttgtgccagagaaggaacaagttggaattttgtggtcagacttggcccctttcatggaaagccagaaacactgttcaggccttgctgatgttatgtatgttcctccagagattttctctcttaagagcctgaaaggtgtgctatcctatgaggcatggtctacatctcttacagaagccgagagaaaatttctcatacaattccttccaagcgagactgatgcagaagaaaatgtaaaattgttgcttacgggacaaaatcatcactttggaaatcctttccttagctggtcatcttctctttgctatggtgatattcatccggatgcactacttaacaaggagaagcacataaaaaaggatgagaaggcatatcatgttaacttgcttaattaccattccaacatggttgaaaccttgaagagttggaggaagagatggctaagttgcggtgatacagagaatttgttcagggataaccctagtaatcagatgcaaggagttatgcagctgaaagctactaacagtggaatgcccatgaaggttgcacaaagaatcgatgtttcaaagtttatgtcatacatcaaagttagtagaacacagctcaaccatataaagagactgaagcaatctggggatggtattcagaccaagcatgtttcacgtgtaattggcggccttgataaatctcatgtgaaaccttatggagctttattagaggatgaacagaggagactgcgcgagcattggctggaaatgtcttgcaatgatttacctgctgcctttgaggttcttagggaaaggaaggtgctgatggagaaatcaataaagttattaggccttgagcttcagcagaagaatgtatctgtcttgagaaaggttcgctgtgacttgtccttcaattctttttcttaagtctctaatttttgtcttgagggaagtgatttacttgaatgtgtaaaaaatacagtggatgagaataccgttgtatgcttacttctgttatgtatcttccccatttacaatgtatcatagcattcgccactatagatgagaataccatgactataaagatactgaattgtaatagaggcatctagtatgaaagccataggcagtatttcattatgaatggtgaattgccctgcagtgttatcttatttgtataagctaatatattgtcacatttttgtaagtatactttgttgtaatcttcataatgaaaataaattcttataaaaaacaatctt

SEQ ID NO: 4614 - DNA, 2830 bp, Zea mays
  misc_feature (507)..(507): n is a, c, g, or t
agccttaacattagtaccgggtgtagccgccaacaataggagatttttgtgttaaaaccaaaagaagaaaccgttaacatgatttcctcccattatttttttaccggtctctacgaaacccggtactaaaattaagggatggaagctctcttttttaggctacgtttctcataaagctctctttggcggggcgtctcgcagctattatttatattattataaatggatctaaagacatctttaaattagagccacatctttgaaaaatgtatttccagaagctactaatttcattggagccgctggtgagctctataaatgctgttgtcagttaagcaaaaaaaaaaaacatgtccctgccctctacagatcttttctatactagtgcaaaattataattggacagactagggactagaaatgaaaacgggattcatgggggcgggaaagaaaatgacttcacatgctgaagtaagaaacacctgctgagtgtgacatcttaatctnattttcatggtattattagctaggtgctgagatgacacggatgggtcaccagtcgccatatctttcttgctcgccagctatggaaaagcgcaaagcgacagacgccttgtctcaattcatcaagtggtagatgttctgcacttttttgaatacagagatgaagggaaaagtacagttctacggctgctgtcaaaacatgagcctatattcgggggtcggccctgggggccccccggatattcaacgtagggtacattatataataataagctaatagcagcgccacgcaccgacaccaatacgccatgggttccatcatggagcaacgctgcaacaacgatccgcaggcgctgctcgacgctcagctcgagctctggcacagcacgttcgcgttcatcaagtccatggcgttcaagtcggcgctggagctcggcatcgccgacgccatccactgccacggcggcaccgccacgctcacccagatagccaccaaggccgcgctccacccgtccaagacaccgtgcctgcgcaggctcatgcgcgcgctcacagtcgccggcatcttcagcgtcgccaagaactcgtccgacgatgacagcgatcagcacgtctacggcctcactccggcctcccgacttcttgtcggctcgtcacagaacttggctccaacactgagcctcatccttaacaacgtcttcgtggccccgttccttgacctcggcacgtggttcgagagcgcgctgccagctacagacctgccgctcttcgagctgtcccaccggaagaacgtgtgggacgtcgtcggccacgacccgtccgtgagccagctcttcaacgccgggatggtcgcggatacccgcttcctcatggacatcgccgtcagggagtgcggcgacgtgtttcaggggatacgctccctggtcgacgttggcggcggccatggcgcggcggcgcaggccatctctgcggcgttccctgccatacagtgcaccgtgctggaccttgcacacgtggtcgccaccgctcccgcttgcgccgggctcagcttcgttgctggcgacatgtttgaggccattccgccagcgaatgctgtcttcctcaagtatatatatatgtcttctacttgtttgatatggacatgcatttctgttttttagcccaagagttgacactaaccaggagttaacactgccttctgatttcttattccagtggatcatgcacgactggggtgacactgagtgtgtcacgatactaaagaactgcaagaaagctatacctccacgagatgcaggcggcaaggtgataatagtagataccgtggttggtgcagggcctccaaaccttaagaacaaagagacacaggtcatgtctgatctcttctttatgatcgtcaacggccttgagagagatgagcaggaatggaggaacgtcatctttgaagctggtttcagtgactacataatcataccagttttaggtgttcgatcaatcatcgagctatacccctgaaatataatccagcttcctcagccggcggccagctcatcacctacatgttgaatcctggcgccccgccgcctcggggtcccttttttcctttaagaacagtgtgcatgtgtgtttaataaattggtatatatagttatatactcactaaaaggatggtttatgtatgcatgtatgcaagtgttccaaccattattatgtctccaaagtgaagaagttgcgtttttcaattttaaggaatgaactccaggattttcagaaccatgtattcagcttactttccagaattggtgagaaatacacatggacatggggatcaactttctataattcacctttttaggggaggacaggaggggccttagagcatctacaacggtaccttaaatcaaagctccatcttaaaatatagagctcaactctaaaatagtctcaacagtgccctattttacaaatttttaaaaaatctatagaaaaatgccatgaagtgacttaaatataatacactccatattagtgtcatatccttgttttctacatcatcctcaacctttatttcggtgcaggcaatcgagcaagctggattcctcctgtggggttaggccttccccgattagcatagaatgattgggtagggccatgtcgaggggcaatttcgtggcccctttgtcactttggatcgaatttgaaaggatcacgatgcccaagaggggggtgaattgggcttctctaaaaatcaacactaattaaaacctaaacaagtgctaagcaagagcccaacttcaccccaacaactagcactaagaatataata

SEQ ID NO: 4615 - DNA, 1517 bp, Zea mays
cattgggtacctcgaggccggccgggatattcaacgtagggtacattatataataataagctaatagcagcgccacgcaccgacaccaatacgccatgggttccatcatggagcaacgctgcaacaacgatccgcaggcgctgctcgacgctcagctcgagctctggcacagcacgttcgcgttcatcaagtccatggcgttcaagtcggcgctggagctcggcatcgccgacgccatccactgccacggcggcaccgccacgctcacccagatagccaccaaggccgcgctccacccgtccaagacaccgtgcctgcgcaggctcatgcgcgcgctcacagtcgccggcatcttcagcgtcgccaagaactcgtccgacgatgacagcgatcagcacgtctacggcctcactccggcctcccgacttcttgtcggctcgtcacagaacttggctccaacactgagcctcatccttaacaacgtcttcgtggccccgttccttgacctcggcacgtggttcgagagcgcgctgccagctacagacctgccgctcttcgagctgtcccaccggaagaacgtgtgggacgtcgtcggccacgacccgtccgtgagccagctcttcaacgccgggatggtcgcggatacccgcttcctcatggacatcgccgtcagggagtgcggcgacgtgtttcaggggatacgctccctggtcgacgttggcggcggccatggcgcggcggcgcaggccatctctgcggcgttccctgccatacagtgcaccgtgctggaccttgcacacgtggtcgccaccgctcccgcttgcgccgggctcagcttcgttgctggcgacatgtttgaggccattccgccagcgaatgctgtcttcctcaagtggatcatgcacgactggggtgacactgagtgtgtcacgatactaaagaactgcaagaaagctatacctccacgagatgcaggcggcaaggtgataatagtagataccgtggttggtgcagggcctccaaaccttaagaacaaagagacacaggtcatgtctgatctcttctttatgatcgtcaacggccttgagagagatgagcaggaatggaggaacgtcatctttgaagctggtttcagtgactacataatcataccagttttaggtgttcgatcaatcatcgagctatacccctgaaatataatccagcttcctcagccggcggccgctcatcacctacatgttgaatgctttggcgtgtggatctgtgtgtgtgttttttcctttaagaacagtgtgcatgtgtgtttaataaattggtatatatagttatatactcactaaaaggatggtttatgtatgcatgtatgcaagtgttccaaccattattatgtctccaaagtgaagaagttgcgtttttcaattttaaggaatgaactccaggattttctaaaaaaaaaaaaaaaattactttccccccttggtgagaaatacacatggacatggggatcaactttctat

SEQ ID NO: 4616 - DNA, 1464 bp, Zea mays
aaatgataccgctcttctctctaaaaatcctcctcaagcacagcacggacgtctggttcttccccccacgcgtcattctctctctccttatcctgtcgtactcagatttttttttgtggccgtcggcttatcttcctgcgcgcgctccttccctgcaagctccatggccatcggcccttcctgctgagctcggttccatggacggcgttcctcttccttcctttgacgcgcgcatctccctcggcgccctcccagtcgcgcctgctccctctgcttcatcttccttgtggtgccttcttcagctcgcggcgctcggtccctgatccagctccccggcgtgcgcccatcttccctgctcgtcgttcctatttccactgccatggatcgtcagtccgagctttcccatccgagctctatacatgaccgagtttttttcccagtgcagcagctccgctccaagccgaacggagctcctccatgggcttcctcgagctccgacctgggcggcccttggatgctgcttccatcaacgccggccatcgttcctcaactccggcagtcgctgtggtctcagaagttagccccttttcagtatctatctctctccctgctcggacctccgcgttcccaactgtgcgcgctgtcgggtggccgtcagccatgccttccctgcttgctcgccagcacttgttcagtcgtctcggctcgctcagcctcaatctccagcgtcttgccctgctccttggttccggccgagctcgcgcccagctccatttcctcctctccggctgctccccatgaccaccaggccgaacttcttcctgctgtccgtgacgcgcgagcgatggacgcgatgaagaccctatgtgtgcttgtgtcgagctccacggcaccagtcatgcctctggtctttggtcgtcgtgctgtgcgccagaactgttcgtagctcgcctgtgtgcccagctgtctcgaaccatgtcgtcgactatcgtcaccacgagctcaccttctcttgcgcacatctccgcagacccggtcttatcacgtgtatacgttatcgatctcgtccttgttccgtgcgttttcaggaaattccaaaagttgggtgaagacaaagctagcagcgtgatgttcaccaagtgctctacgcaaaggtcgaactagaatccttgccgtgttcgcggatagcgcgtcaaatttagtcgtcaaatttagtcgtgggtaagccaattcatatttctgttagcttaattattggattgatgaatgaatgcgtctagtattattgaattagttcgatgaatacaatgtgattgttttcataactttggaatagtcgcgttggggtgctattgttaggtttgagatgttaattatgtgacatatggtaaattagtgaataaagtttaaatttagcatttttaaagggtctaaacaataatattattaaaaaaaaaaaaaaaa

SEQ ID NO: 4617 - DNA, 1353 bp, Zea mays
ccggccgggacgagtcattctctctccttatcccatcatactcagatttttttttttgcggccgtcggccttatcttcctgcgcgcgctccttccctcccagcaagctccatggccatcggcccttcctgctgagctcggttccatggacggcgttcctctacctttgacgcgcgcatctccctcggcgccgtcccagccgcgcctggtccctctgcttcatctacctcgcggtgccttcttcagctcgcggcgctcggtccctgctccagctccccggcgcgcgcccatcttccttgctcgctgttcctatttcccctgccatggatcgtcagttcgagctttcccatccgagctctattcatgaccgagtttttttccccagtgcagcagctccgccccaagccgaacggagctcctccatgggcttcctcgagctccgacctgggcggcccttggatgatacttccatcaacgccggccaccgttcctcaactccggcagtcgctgtggtctcggaagttagccccttttcagtatctattgctctccctgctcggacctctgcgtttcccaaccatgctcgctgtcgagtggccgtcagccatgccttctctgctcaccagcacttgttcagtcgtctcggctcgctcggcctcaatcttcagcatcttgccctgctctttggttccagccgagctcgcgcctagctccatttcctcctctccggctgctccccatgaccaccgcgctgaacttcttcctgctgtccgtgatgtgtgcgcgatggacgcgatgaagacgctgtgtgtgcttgtgtcgagctctacagcaccagccatgcctctggtctttggtcgtcgtgctgtgcgtcagaactgtttgtagctcgcctgtgtgcccagctgtctcgaaccatgtcgtcgactctcggcaccacgagctcaccttcccttgcgcacatctccacagaccctgccttatcacgcgtgtgcgttatcgatatcgtcgtcgtttcgtacgtcatcaataaatcctaaaagttggctgaagacgaagctagcagcgtgatattcaccaagtgctcgacgcaagggccgaactggaatccttgccgtgttcgcggatagcgcatcaaatttagtgggtaaaccaattcatatttctgttagcttaattattgaattgatcaatggatgcgtctagtattattgaattagttcgatgaatacgatgtgattgttttcatgactttggaatagtcgcgttggggtgctattgttaggtttaaaatgttaattatgtgatgtaaggtaaattagtgaatgaagtttaacttcagcccttttaaaaa

SEQ ID NO: 4618 - DNA, 1098 bp, Zea mays
aaaaaaagaaaagagggctaaaaacctagcaatcccctcctcgccgttgctgtcggacgaggcaaccatggccgcggggggcaccgccgacttcttctaccgcgagtcgcagcgtctgggctacgtcgcccgctctgcgtttaagctgatccagatgcagaagcagcacaagctcatcgcgccgggcgccgctgtactcgacctcggctgcgcccccggcgcgtggcttcaggtggcttgtcagaacctgggtcccctcgagaagggtggcattgtcgtcggcgtcgatgttaagaaggtgaaagtgccctctgcgcactgtgactcacgggtcaggacggtctgtgcagatgtcatgacgctgatgaagcggcaggctcgggcaatgtcgccacaggaacgaggattctctgtgatactgtcagacatgtgccccccagtttcagggatcacgactaaagatggagctatatcttgtgagttgggcatgcacgctctctcgttggcagtagggaagataaagttaaaagattctaattacagtgataccctagagaagtatctgagctccactgagcctgagtctgacgaggatggcgttcttcgacgtggaggcaacctggtagtgaagtttcttgagaatgaggacatatcagggtttggcaaattctgcaaggtgaagttcaagaaagtatcgttgttgagacccaaggcgactcgacctagctcgagggagatctacatgatctgcgaaggtttgcggtagaaaggagggctcttcagaaggcaagcgaagactccaagaagctaggtcagttgagttgccctgaactgggcgctgttagttctagctgctggtgcaggtgctggctgattggcaatgtgatacagctgtttgatgctgatagcctcccagagcaagttaccacaaagctttgtgtgattgaaccatgctagtagttcgtctagatgttacctgtaataattttgttgaactgtgatactagttcgtctaggagaaacaagcatttgacttgagccctttctgagaacctgaaacacccttgctttttatgttgcagaaaaaaaaaaaaaaaa

SEQ ID NO: 4619 - DNA, 1170 bp, Zea mays
acacaaacaagaagcttgcattgttcgtttgctcgatcgttgcagataatggagaaccctgctccgagtatcgtagtgccccccattgccgcacctgtatcagcgaacttcagcagactcgccttccgcaacctgtacatccgacggacgggtccagacagcagggagatggtgactgtggagggaagaagaggctctagtgatcagacaggcgacatgagggcgtcacaaccacgttcgggaactccaaccagttcttcaccgtcgccttcgaggccggcaggctcaagggctccacgctccttaccgaaggagtggtgacggatggatcagatgaatgggcaatctacggcgggaccggagagtttgctatggcgagaggtgtcgtcaaaagaaggtaccttgccgatagggatggcgccgggaacactgacgagctcagcatgcaggttttctgcccggtgtttggctcatcacagcaaccaaacaagcaggactccaccatctctgtcaccaagattgggttatggggtggcgaaggagggtcggcgcaggacatcacgacgacggagccaccgcagcgctgcacagcctcaccgttcgtgccagtcccgccgtcgactccatcgagttcacgtatactgacagaggtggccagaggcgccccgctgggcgatggggtggacttggcggcaaccttcgaacgatcgatcttggcgacgccgaggatgtcagggaggtctcaggaacgtacggcccatttgaaggagcccccacgctgacctcgttcagaattctccccagcagcaggacatgggggccatggggcgtcgagaacgggacgcgtttctgcatccccgcgccggtcggcagcagcatcgtggggttctatggacgcgcgaccagcaggctcgtcgctgcgcttggtgtttacctgcgccgactttgatttgatctgaacagagcaggctacctactagcaattgcctgctcgatcaattatctttcgcaccctttattattaatataatctcgatcggtcatcgtactcctatgtcaatgtcaaataaaggtcatatgtagtcatcgatattgttggatttattggcatggtctaattaagaaattcatttaattcctgaaaaaaaaaaaaaaaaaaaaccgacgatc

SEQ ID NO: 4620 - DNA, 1303 bp, Zea mays
acccagggcccgcgggcgttctagaagaaaaagagcaggtgcatggtcacgctagctgtagcttgcagagcgtcgtctgtaaatacgtagcccttccacaagcgaggcaaggggggagagcgtatcgtcagctagcagagagagtgcgtagcaactagcaatggcggagaaccctgctccgagttccccgctagtgacttctcccgacgccgctgcgccgcctctgccagcggagttcaccaagctcaccttccgtagcctgtacatccgtcggacaggtccaggcagccgggagatgactgtggacgggaggccgtctgaccagctgggacgacggttcgtgagcgactttcccatatacgatggccgtggctccggcgcccgcctcgtcgctcgcttgcagggagtcactgtccaaatcggcagctcgcaccagctagtcagcatcgtcttcgaggccgagaggcttaagggctccacgctgctcaccaacggagtgataacggatgggtcagacgagtgggccatctacggtggcaccggggtgttcgccatggccaccggtgtcatacgaagaaggtttctcgccggtagcaacgacggcaactctgatgagcttaccagcatcgaagttttctgcccggcgtttggctcggcacaacaacagccaaacaagcaggactccgtctctgtcaccaggattggggtatggggtggaggaggagggtcggcgcaggacatcccgacgacggagccaccacagcgtctgcacagcatcaccgttcgaactggttttgccgtcgactccatcgagttcacgtatactgacagaggtggccagaggcgcactgctgggcgatggggtggacttggcggcaaccttcgaacgatcgatcttggcgacgccgaggttgtcagggaggtctcaggaacatacggcatgtttgaaggcgccaccacgctgacctcgatcagaattctcaccagcagcagaacctgggggccatgggggatcgaggacgggacacgtttctgcatcaccgcgccgatcggcagcagcatcgtggggttctatggacgctcgaccagcaggctcgtcgctgcgatcggtgtttacctgcgtcaacaactctgatctggtcatctagctatcatcgtcgtccggtgctgtcgtatgtgtgttcatgtcaaataaataaaagtggtcttgtgtctacggctgccatcctcatgtgccaaataaatgacatgcatgcatgtgtctaaatttaaaaaaaaaaaaaaaaaaaaaaagggcggccgc

SEQ ID NO: 4621 - DNA, 1229 bp, Zea mays
ggtacaaaaagacacgagccccaacacaaacaagaagcttgcattgttcgtttgctcgatcgttgcagataatggagaaccctgctccgagtatcgtagtgccccccattgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggccggcaggctcaagggctccacgctccttaccgaaggagtggtgacggatggatcagatgaatgggcaatctacggcgggaccggagagtttgctatggcgagaggtgtcgtcaaaagaaggtaccttgccgatagggacggcgccgggaacactgacgagctcagcatgcaggttttctgcccggtgtttggctcatcacagcaaccaaacaagcaggactccagcatctctgtcaccaagattgggttatggggtggcgaaggagggtcggcgcaggacatcacgacgacggagccaccgcagcgcctgcacagcctcaccgttcgtgccggtggcgccgtcgactccatcgagttcacgtatactgacagaggtggccagaggcgcgccgctgggcgatggggtggacttggcggcaaccttcgaacgatcgatcttggcgacgccgaggatgtcagggaggtctcaggaacgtacggcacatttgaaggcgccaccacgctgacctcgttcagaattctcaccagcagcaggacatgggggccatggggcgtcgagaacgggacgcggttctgcatcaccgcgccggtcggcagcagcatcgtggggttctatggacgcgcgaccagcaggctcgtcgctgcgcttggtgtttacctgcgccgactttgatttgatctgaacagcaggctacctactagcaattgcctgctcgatcaattatctttcgtaccctttattattaatataatctcgatcggtcatcgtcctcctatgtcaatgtcaaataaaggtcatgtggtcatcgatattgttggatttatgcgcttggtctaattaagaaattcaattaatttctag

SEQ ID NO: 4622 - DNA, 3201 bp, Zea mays
  misc_feature (1025)..(1025): n is a, c, g, or t
ttggttttttgataatttgtttatctcacatgatggttctaacaatatgcgcagatcttatacatctctctcgtagtttttcataaactacgagaaagatataggttttatgaacaaatttacttttattttgtcatataatgaaatggtcaaaatataaattgtacatcatgatgagttatacaaatttgtagtccaaaatcttttcatttaaattaatttactgctttaaaatgtgatttttaattgtctttgcctagtgttgaaaaaaagcactcggcaaagaaactctttgccgagtgttaaaaaaacactcggcaaagaatctctttgccgagtgtcaaaaataaaatatttggcaaatagcttctttgctgagtgtttttttgcttagcacttggtaaagaacttctttgccgagtgtccgaaaaagcactcgataaaatatttggcactcagcaaagaaccgaattccagtagcgtgagtcagaagttggcatttgaaccctttgaaataatcaaacaaatcaacgcagttgcatatgaattggctttgccacatggtagtgcagtccatcgagtgttccatgtttcacagcttaaactaacccatggttttggtaacagaacacacaccagtgactccatcgttaccggattttgatactacactgaaggttccggaacaaatactggattctagattgattctagattgcttcgatcaaatggggatcatcaacctaacacagcttaaattatacatgcatgcgtacatttggtccttcaagaggaggcaggtgatgatcaaggtctctctagcggcctggtgtgcagccacgtacccatccacgcgtcgccgcgggcgacgacaggtgttggccaacctggacatcagacaagcacgacaatgacaggcgttcgccaagcgtacgtacaggagacgaacacgacaagtagcaccgtcctggccgagagcccgtcatgctcatgcatgcatgcatgctgatcatgcatactcgatnaatatacagcagagagctgagctacgtacacaaccaagaagcttgcattgttcgttggctcgatcgtccagctaggagcagggtaatggagaaccctgctccgagtatcgtagtgccccccatcgccgcacctgtatcagcgaacttcagcagactcgccttccgcaacctgtacatccgacggacgggtccaggcagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggcctggcaggttcttcttcgtttagacagatatatagctagatagatgctagcttgtggttcatatatagcagatagatatatgcatgcatctgccattgatcgtccatcgtcatcgatcagcaggctaaagggctccacgctccttaccgaaggagtggtgacggatggatccgatgaatgggcaatctacggcgggaccggagagtttgctatggcgagaggtgtcgtcaaaagaaggtaccttgccgatagggacggcgccgggaacactgacgagctcagcatgcaggttttctgcccggtgtttggctcatcacagcaaccaaacaagcaggcacgtgctgtactgtatatatgtccgagagagagaaacagacagtagaatcctcatcagtagtataatcagctgcatgtatgtaggactccaccatctctgtcaccaagattgggttatggggtggcgaaggagggtcggcgcaggacatcacgacgacggagccaccgcagcgcctgcacagcctcaccgttcgtgccagtgccgccgtcgactccatcgagttcacgtatactgacagaggtggccagaggcgcgccgctgggcgatggggtggacttggcggcaaccttcgaacggtgagcagcaagctctagcccctacctacctacattgattcatgaagcatgtatatagcttcctcatgcatgcatgcacatgcatatgcgcgcagatcgatcttggcgacgccgaggatgtcagggaggtctcaggaacgtacggcacatttgaaggagccaccacgctgacctcgttcagaattctcaccagcagcaggacatgggggccatggggcgtcgagaacgggacgcgtttctgcatcaccgcgccggtcggcagcagcatcgtggggttctatggacgcgcgaccagcaggctcgtcgctgcgcttggtgtttacctgcgccgactttgatttgatctgaacagagcaggctacctactagcaattgcctgctcgatcaattatctttcgcaccctttattattaatataatctcgatcggtcatcgtactcctatgtcaatgtcaaataaaggtcatatgtagtcatcgatattgttggatttattggcatggtctaattaagaaattcatttaattcctgaaaaatcataaaagctgaatccgacgatcagatcgcaacctaatcggatcgtgagcttatcgcttcttgatcgtgagcttatcgcttcgtgaacgtggatctatataaagtgtctaccagcctttgtcacataccatcttgtcacataccatctcatttcaaccgagttaggttttgtctctgcttactgttgcctcgttgccagaggcggacataggtagagcgggtatagtttcctcgctcatttatatattgtaaatagtagagcttaaattttcatcataagatatcctgctcagtttaacttagatgtctatgctatgctatggtactttggtgttcgccctacaaatatgccttcaatcccattttgtcttaggtccacccttagccgtcgttgtggccttcttcatcccgagctccgacgtacatctacgacagggagagcatgtctctagaacctgacaccttggatatcctgcaccgggagagggcaaataaggtttctgggaagtgtcttcacacgactgctcgcgttcttctcatcaccttgtcgccgacgtgagggcaaataaggtttctgagaagtgtcttcacacgactgctcgcgttcttctcatcacctgtcgccg

SEQ ID NO: 4623 - DNA, 2617 bp, Zea mays
gtacacatttgctggtaaattttaaaggtaaaagaccttctacgaattcttcaggtttcgggggatgacgggcctgaaattctacacctacacctgcacctgccggtgcctgacgttcccactcccaaaatcccaaaaggaaaaaaaaaaaaagaggcagcgtgactgctgcctgctggcacctaactaaagccagcgcgcgcgttaagacttaagacatcaccgaccgtttcttcgctccccccgcggtttatacacattcaaactcgcgttcaacgtcaacgttccgattcaaaccctttactcgtccgttgccttccctcccatcctatttcaacccgtcatcctcccccaagcctcaacccagtcttcgcattgaactctccacacctcacccaccaagagaccaatccagcagcacacgcctctccgtcgtcgtctccgataactcatcgtcgaaatcctgcccttctagcttcgcttccttcagctaactggtttcgatggcgctgctggtgcggagggcacggagggcggcgaccaaggccgcggtgtccctcgccggcagaaccggcagcgtggagcttgccatcccggcgcacttccggtgcccgatctcgctggacctcatgcgggaccccgtcacggcgccggcgggaatcacgtacgaccgcgagagcatcgaggcgtggctggacacgggccgcgccacctgccccgtcacccacgcgccgctccgccacgaggacctcgtccccaaccacgccatccgtcgcgtcatccaggactggtgcgtcgccaaccgctcccgcggcgtcgagcgcatccccacgcccaagatccccgtcacgcccgtccaggcctccgagctcctcttcgacctcgccgggtccgcgcgccgccgcgacgccgctgcgcggtgcgtcgaggtggtcaccaagataaaggtcctcgccagggacagcgagcgaaacaggagctgcttcgcgtccatcggcacgggccgcgtgctagccgccgcgtacgagtcgctcgctgctgctgctgctgacgccgccgcaccggcggggcgcgtccttgaggacatcctggcggcattggtctgcatgatgccgttggacgaggaggccgccaggacgttggccttgccgacctcgctggggtctctggtcgccattgctgagaacggcagcttggcaggaaggctgaacgccgtgctggcgatcaaggaggtcgtctcatgcgacggggcggccactgatctgagcgggaaggtcgacgagatcgtagacgcgctggcaaagatcatcaagtctccaatctgtcctcaggcaaccaaggccggcatggtcgccacctatcacctggcgctatacgacgagcgtgtcgcggcgcgccttgccgctgccgggctcgtccccgtgctcgttgaggtccttgtagacgccgacaagagcatgtccgagaaggcactggccgtgctcgacgcggtgctcgcctcggaggaaggccgcgcgagcgcgcgggcgcacgcgctcgccgtgcccatgctcatcaagaagatgttccgcgtgtccgacctggccacccagcttgccgtgtcggcgatgtggcggctcggaaaggcgcacagcgacggcgaggatgacggtgcggtgacgcggtgtcttgtcgaggcgctgggggttggggcgttccagaagcttctcctgctcttgcaggtcggctgcagggacgcaaccaaggagaaggccaccgagctgctcaagttgctcaacaagtacaagagcgtaggcgaatgcgtcgacgctgtggatttcagagggctgaataagctgtcatcttaaatcaatgggggctgcgatgtaaaaaatgtgtattttgtaaaacagagagacgatttaacttgtaagtagatgcagataggctagttgcaattttgttgggcgtgcttgcatgctatttcagcagcttagtttcaaacggaaacttagatccgaattccgttttatgaagaacttcagtgtaaatttcttgttttaaaagatgtttttttttcttttagataatggaagcaggagcatgttctctaaagaagttttagaataaccacatctaagtttgactatataacatatttgcatctactacaactttttatagtatgtttgaagtacgggatgtctgtctatttagaaagcaaaaaacttctccaaaatgaaaatggaccctatttggaaagcgaaaaactaaaccaaaataccgtttttttcatggactcttttacataacaaagttttgactgctgacaatctttagcaatggccgtgcaatccagtttgttgtctttgcaactcatcaccagagacggtatctaacttatgcaaagattgtcctttcagcagggaggtgtgggataaaattttgttatggggaaacctttctttcctgagagggaaccatggatccgagtcgttgtatggttggtgcatgaaactaaaaagccttcgcagcagatagtcaaggagaaatttggccttctgatttatttttagtggagtttatggttagaaaaaaaacaacatgattttccagagccaacaaagagatgcagatc

SEQ ID NO: 4624 - DNA, 967 bp, Zea mays
  misc_feature (8)..(8): n is a, c, g, or t
  misc_feature (17)..(17): n is a, c, g, or t
cggtccgnattcccggntaacttttcaatgaccagcccaagtgaacgcgtgaccccccctgtctctggggtttccctcttttaattcccccgccgccgcccctcgccacgctccgccagccgctgccactcgccacgttccaccagccggcgccccttttccttctcactccgctggcgccggcgccgccttatccatggcgtcggagaagaagcaatccaacccgatgagggagatcaaggtgcagaagctggtgctcaacatctccgtcggagagagtggggatcgcctcacccgcgccgccaaggtcctggagcaactgagtggccagtcaccagtgttctctaaggctaggtacactgtccgttcctttggtatcaggcgtaatgagaagattgcctgctatgttactgtaaggggtgagaaggcaatgcagcttctggagagtggacttaaggtcaaggaatatgaactgctaaggaggaacttcagtgacacagggtgctttggtttcggaatccaggagcacattgatcttggcatcaagtatgatccttcaaccggtatctacggaatggatttctacgtcgtccttgagcgcgctgggtaccgtgtcgcccgacgccgaaggtgcaagtcccgtgttgggatccagcacagggtgaccaaggaggatgctatgaaatggttccaggtcaagtacgagggtgtcatcctcaacaaggctcagggcaacacttcttagagacgcacatgttacagcccagccgttagacatgtttaccagtagcaacagagttttcacctctactgaagttttgtcgatctcggatgatattatttgccaagactgtttggacagaggagcttatgatctctatactttgaaagctgaatgcgccgattcatttggttctgcaaaaaaaaaaaaaaaagggcccccgactcgttctctctctcctcgtgc

SEQ ID NO: 4625 - DNA, 4870 bp, Zea mays
gttaagatgaagcgtggccaacctaggaaataaaaaaagtagacggtacgctgttttaccccactgacatgccagaccccacagctatatgctcgcggtcacggctgagtggctttgacccgggctgctccgctcggttcgggggccgccagcccgccacgctattatcaccgccactccactcagctccgttcaggaggtcagctgcctgcgccccagccccattcggccattccattcctttccgagccctcacacctgcacgcgcccacgcacccgcaccaagaaccacgcgcgggcctgtccctgtcgcagctcacacgcgcaacggggggcgcgccgcgcaggcgatggtctccgcccgcctcgtcgcgctggccgccttccacctcctcgtcctcttggccatgggcccgggcgaggcgcgcgcggcggacggcggcgaggtgcgcgcgctgctggcgctgggggccgcgctggacccgacgggccgcctgctcccgtcgtgggcgcccggccgcgacccctgcgcgccgccgccgtccgggggcttcgatggcgtcgcgtgcgacgacagcggcgccgtcgccaacgtctcgcttcaggggaaggggctcgccggcacgctcccgcccgccgtcgccgggctccgctccctcacgggcctctacctccactacaacgcgctccgcggtggcatcccgcgggagctggcggcgctcgccgcgctcaccgacctctacctcgatgtcaacaacttctcggggcccgtcccgccggagatcggcgccatggcatcactgcaaggtacacaactctgcctctctcgctagctcagattgccagatcctgctcgtgccgcacgctcgctgactcgcatcgccatgcatgtgaccatgccgtagacttggctctgcattgctccttgggtcgatgattggtttgcccccctgtgtttttaattccttgccggtcgacttgcttggcgtttctccactccaagtcaaaaactaaaatgcggctttacctaactaccatacggagtaccctttggatttttttttctttctgaagatgttgccgtcgcaactcgcaagtggcaactaaaacaggcaactcctgctgctcagattgcaacattgtgaacatttccttctttgattctttgttgccccactatactactcattcagtcacaccaaattagtactacccccaatcagacggtttggtaatgctgctgatgttggtactccgatccaaatgtttgtagccacaaccgctagccggtactactgcttgtccttgctttgcatctccatctcctgcctgattctgaatgaatgctgctgatgttgatatgtccatggcggtgcagtggtgcagctctgctacaaccagctcactgggagcatccccacccagctgggcaacctcagcaggctcaccgtgctggccctgcagtccaaccgcctcaacggcgccatccccgccagcctcggcgacctgccgctgcttgcgcgcctggatctcagcttcaaccgcctcttcggctccatccccgtcaggctcgcgcagctgcccagccttgtcgcgctcgacgtcaggaacaactcactcactggcagcgtgcccgccggtaaagactccatccatttgtctgcgtcgaccgatttttgagagcgataataaagctgactggtttcctgcttgctgcgtcccaagaactggccgccaagttgcaggccggcttccagtacgggaataacagcgacctgtgcggcgcggggctgcccgcgctccgtccgtgcaccccggcggacctcatcgacccggacaggccgcagcccttcagcgctggcatcgcgccgcaggtcaggccctccgacgggcgcgcgccatctaccagggcgctcgcggcagtggtcgtcgtcgccgtggccctcctcgcggccacgggggtcggccttctcgcgctctcatggcgtcggtggcgccgacagagggtcgcggggggatcgccgtcgacggtctccggcggccggtgcagcagcagcaccgaggctgcgccgtccgcggcgaaggcgtcgtcggctcgcaagagcgcgtcgtcggcgctggcgagcctcgagtactccaacgcctgggacccgctggccgacgcgcgcggcgggctgggcctcttctcgcaggacgcgctggcacagagcctccgcatcagcacggaggaggtggagtccgcgacgcgctacttctcggagctcaacctcctcgggaggcgcggcaagaaggccggcggcctggcgggcacgtacaggggcacgctccgcgacggcacctccgtggccgtgaagcggctgggcaagacgtgctgccgccaggaggaggccgacttcctgagcgggctgaggctgctcgcggagctccgccacgacaatgtggtcgcgctgagggggttctgctgctccagggcgcgcggggagtgcttcctcgtctacgacttcgtgcccaacggcagcctgtccgcagttcctcgacgtcgacgccgacaacgccggcggcggcagcggccgtgtcctccagtggtccacgaggatctccatcatcaagggcatcgccaaaggtaggtaccccgagtggaaaagcacatcctgtcactctcttgctatcagttggttagcagtgagtgtcactactgatcccccactagtggtttgctgatgcccacattttcccctggattcacacgtactgtgcatacttgttcacatggtatgcgcatgcaagcatttggcacattgattcactcaatcactggatggatagtacatcgattcatccgtgctgcgctggtcgctcacatgggtgtgcgaaaccctgtgactgtgcagcaggcagggacgcagcaatattcacattctgaagtctgaacactgtatgcactgaaaagctctctgcatgacatgtctcaaaaaccttttggtgctacttctatcagagtaaccgtttctatcagtgtgctgtgagataccggtaatttttagctcctgcgcaaccggctaaatcgtgcatcctttttttttggtgtgtgtgtgtgttccaggaattgagtatctgcacagcacaaggacgaacaagccggccctcgtccaccaaaacatctcagcggacaaggtcctgctggactacgcgtacaggcccctcatctccgggtgcggcctgcacaagctcctcgtggacgacctcgtcttctcgacgctcaaagccagcgccgccatggggtacctggcgccggagtacaccaccgtgggccgcttctcggagaagagcgacgtgtacgcgttcggggtcatcgtgctccaggtgctcaccggcaagagcaaggtgacgacgacgcatgcgcagctgccggacaaggacgtcgatgagctcgtcgacggcaacctgcagggggataattactcggcggccgaggccgcccagctggcgaagatcggctcggcttgcaccagcgagaacccggaccagaggccgacgatggcggagctgctccaagaactgagcaccgtctgaaatctaatggaggtccaacaatcatccgctgtaactgtttcatgcaagagtcacatgccttttgtaacctagctacgtacgtaccctgtctaggatcaccagtcagtaatcgctgatcttagaaagaatctgagctagtaggctctactagttagctagtaatcgctgatcttaggaagcacatgtgcccatgatcatgagatcttgtatgctaatgatgtgtcgttaccaccgcttttgaaaagtgtgcattgtttgaaaaaaaaaatgtgctctagtacatggtagtaatgtgaatgcagccatttcctgcaacactatttttttctttcctggaggccttgtgaccgcaagggtacctgcaaccctctgtgccaaatttggctgcatctcgggcctggggtgaaatgcatggctagcaccatcccagggaggaaggagccaagagtcctggaaggcatgtgagctatagattgttgtgttgtcttgtttgttgttcgtgtttgggtcctggcttgtgatcgcgcacagggggcagtcaggcgatggtatctgacagagggtgaaagcgcacgggcacggtggtcctagctgggcttcatttgctagaggccgagaggcgggacaaaatagactctaccgagcaatagaatactaaaattatagcagtgaagaacaagaacgcagctgatccaaaagaacgccacccaaggtgaggctgccttgctatgtgacactgcttattttgtgggatagtggattctgaaatggggtatttggagctagcatagcaaggttcatatgctagccgcaggtctacaaaaccaggtcatgcggcactagtaatgcactggcgtacgtctctacagaacctaggcaatttacctagataaattcatagaatcatggtaatgtagcaactaaaaagcaccaaataaataatcccatagtttgtaaagttggttggatagatcttatgttcttgtgctcatgcatccacctatttggaatcctaagagctaatagttgatcagctaacacgtgtagaaaagagctctaagctagcagtacacataaatttttactggcggtatcagttaccgcgcgacagtgaaaataaataggtggggcgggcttaaggaaccgtcagtagaaacatatttccacttgcggtttacttaacacaaccgcaagtggaaagaggttatttccactgctggttgatataaaaagaaccgtcagtaaaaataacattttcattggcggttccttaagccaaccgccagtagaaatagct

SEQ ID NO: 4626 - DNA, 3936 bp, Zea mays
gaccccgctgccttgccggaccgagctcccaacccaaccaaaccagttgggcttgggcggcggggccagcgccggaccatgacgccgccgccgcgctttatttctcggcgttccaacgggttgcccgcacgccacagcgggaaggaaggaagaggcctgcaggtgggcggcacgcagggcctccaggttctcggcagcggcggtgtagaattcgctggagaactcattgcggcggttgggatggtgggtgtagatgggtggccagcaagcaccaagccagagcggggcaactcaaactcaaactcaagggctagcgacggccgccagcagcaacagctacacacaactaactgtatcctgccaatgccaatgccaatgccgcactagcaatctactcaagtttctgtggcattaaaatggtccagtcagagaattaaatatgccagtgaactctgtcgttgtgttccccctttttatgttaccttttacttctgttttatgctctgtttatacagtgaaatttgaattagaaaaatgtgataggagagctgctagcatgactgcagcagtgtcgtgggttgtgctcctgccctacctgtatttgtccacgtctccttcgaagcaatgaggccccctcctttcccctcgtgtgtgttgtcttggcatgtgagccttggcctggcctggccgcctggcctggccccctggagcaacacagcggtggtgctggacatttgttttccgggtttcgcttcatgtccgggagataaatccagaggccagtacgtaaagcagcttaaataccacttcagcctttgcgttgcgttccttgccttgccttgcctgcttgcgtgcagtgcagtgcagctcacagcctcacaccatatcgctctgcggtgctagctccaggcctttatcaagccttccctgccccccttgataattccagagagagagaaggcgcgcagctagggaggtgcagagagaggagcggcaaggcgtgggctgtgggcacacatggcgagtgaggaggtcgccaccacagtgtgtgccgacgccgaccaagaagcagcggcggcggcggcggcggccatgaaggaggaaggaggaaggggcaagaggcggcggaggaggcagccgaggaagggagaggaggaaggcgggaggaagaagtacgcgctggtgagctaccacgagctgcccgagtacatgaaggagaacgagttcatcctcaactactaccgctccgagtggcccgtcctcaacgccgtgctcagcctcttctcctggcacaacgagaccatcaacgtctggacgtacgtacggcccgggccgtctcgacgtttcttcttcgttcctgtgcgtgcatggtttcctgcctgctgaaaccagtagtggtctggtactctggtcttgtgggtgcaggcacctgctcgggttcatgctcttcttcggtctcaccctggtgcacctcggccagtacttcccccaggtggctgatctgattgggcatctctcctggtgagctgctgctgctcctcctcctcctcctactcctcttcagattaattcagctactgtgcgaattgctcggcgtttcgaggctcccatccatcccccagccatgccattatccagtggcgattgagatgagaacaccacgcgtagcgttaggctctggtccagaggcacacggttcttgtgcgtttgtactgaaccttcttaatttctgagctagtaacttcagctgtgttctaaaagtctcaccaattcactttcggttccgttccaaaacactttgcttcagctaggatgagattttgtattccataattgagaagttaccttgttacttgtaaaaactgatcttctctgcttttttttgttgggcccctttgttgctgtgcaggccaatctcgaaggtcgctgaaaatgtctccagcaatattggagatgtcctatcagtgagtaaaactcccaccccgtctctctcttgctgctggtagttctagctaggagaatatatatactggattgcagtaaaaaaaaaaaagaagtgccctggttagatccgcatgagcaggaaaggagatcctgtcctgcctgctactctgaatgcatcagttttgttttgtactggtttggtgctgtttgtttgttctgatgtgcatgatatggtaggcaagggtgggtgggtgagcctctgctgtcatgagtcctgacttagtgtagacgaacttagactatctccaacatactttctacctcactacatatccgattccatatttgaaacatcactcttaaaacaataatttaccgtgcaaaacagtaatttgcacgaccgtttacatggtatgctggcatggccttttagtaactttcactgctttgcaactaaattaagtattcaatcagtacaaacctcaatggaaagaatatatatggttggatgtagtattcagggtgtaccttgacagtcacttagagcatgcagcctattatattgctttcagatgttaattccaacatgctactacgtactgctagtagtagggtagtcatctctttttagttgatttttttgatagcctttacatgccatcaaatcaataacgatattaacttgggattcgaattcgatgcatgccatgccatgcgccatatccgtacgtccagggcgcggccatgttcatccagacgaacccgagcctggcctcgcatggcacggcggtggcgtcgcagacgacgcggtggcccttcttcgtgttcctggcgggggccatgttctgcctgctgagcagcagcgcgtgccacctgctgtcgtgccactcgcaccggctgaacctgctgctgatccgcctcgactacacgggcatcgcggtcatgatcgtggtctccttcttcccgcccatctactacatcttccagtgcgagccgcgctggcgggcggcgtacctgtcggcgatcacggcggccggggcgggcacggtgtacgcgctcatgtcgccccgcctgagcgcgccgcgctaccgcgcccgccgcgcgctgctgttcgtcggcatgggcctgtccggggtggtccccgcggcgcacgcggccgccgccaactggcacgagccgcgccgcaacgtcacgctggcgtacgagggcgccatggccgcgtcctacctggtcggcaccgcgttctacctcgcccgggtgcccgagcgctggcgccccggcgccttcgacctcgccggccacagccaccagatcttccacgcgctcgtcatcgccggcgcgctcgcgcactacggcgccgccatcgtgttcctcagggctcgcgacgagatggggtgcccggccagttaggtgctcagacagtacgggcgcgccggccggatgcttgcccgcgacgacattatatttgcgggcggtgtccgtccagtgatcgatacgatatgatgattgggaaagaagaaactaaaccatatttttttttgtttacaccttttccttacagcagcagcagcaagtgtgcgagattcatcgttaatgacagagagttgattggcgtcagtcacagattccttgtcaatttgtacatagacgaagctcatcgagtaatgattgattaatacattctttcgatcggtttgaaaatgcaaatccaaaagttctttttaaaaaaaaaaaaaatcaaaacggaggtttcgcgtcgatctgtctgtgttgccatcgacgataacgcgagcggatgggctactccgatccgtgcagcatccggttgctttcaggtcaggcggagtagcctagacgcgacgtcgagaccggtagcacaggtacagtacaggtggagcgactctcaccggccgggctcgtctcataaatggacggccgacccgtccaacaacccaacggacctggctctgactgacctctcattccgtgcag

SEQ ID NO: 4627 - DNA, 1473 bp, Zea mays
  misc_feature (998)..(998): n is a, c, g, or t
  misc_feature (1431)..(1433): n is a, c, g, or t
  misc_feature (1437)..(1439): n is a, c, g, or t
  misc_feature (1473)..(1473): n is a, c, g, or t
agagagagagagagagagggaggtgcagagagaggcgcgtgggctgtgggcacacacatggcgagtgaggaggtcgccacagtgtgtgccgacgccgaccaagaagcagcggcggcggcggcggcggcggcggccatgaaggaggaaggaggaaggggcaagatggcggaggaggaggcagccgaggaagggagaggaggaaggcgggaggaagaagtacgcgctggtgagctaccacgagctgcccgagtacatgaaggagaacgagttcatcctcaactactaccgctccgagtggcccgtcctcaacgccgtgctcagcctcttctcctggcacaacgagaccatcaacgtctggacgcacctgctcgggttcatgctcttcttcggcctcaccctggtgcacctcggccagtacttcccccaggtggctgatctgattgggcatctctcctggccaatctcgaaggtcgctgaaaatgtctccagcaatattggagatgtcctatcaggcgcggccatgttcatccagacgaacccgagcctggcctcgcacggcacggcggtggcgtcgcagacgacgcggtggcccttcttcgtgttcctggcgggggccatgttctgcctgctgagcagcagcgcgtgccacctgctgtcgtgccactcgcaccggctgaacctgctgctgatccgcctcgactacacgggcatcgcggtcatgatcgtggtctccttcttcccgcccatctactacatcttccagtgcgagccgcgctggcgggcggcgtacctgtcggcgatcacggcggccggggcgggcacggtgtacgcgctcatgtcgccccgcctgagcgcgccgcgctaccgcgcccgccgcgcgctgctgttcgtcggcatgggcctgtccggggtggtccccgcggcgcacgcggccgccgccaattggctcgagccgcgccgcaacgtcacgctggcgtacgagggcgccatggccgcgntcctacctgggtcggcaccgcgttcttacctcgcccgggtgcccgaagcgctggcgccccggcgccttcgacctcgccggccacagccaccagatcttccacgcgctcgtcatcgccggcgcgctcgcgcactacggcgccgccatcgtgttcctcagggctcgcgacgagatggggtgcccggcccagttaggtgctcagacagtacgggcgcgccggccggatgcttgcgcgcgcgacgacattatatttgcgggcggtgtccgtccagtgatcgataacgatatgatgattgggaaagaagaaactaaaccatatttttttttgtttacaccttttccttacagcaccagcagcaagtgtgcgagattcatcgttaatgacagagagttgattggcgtcagtcaaaaaaaaaaaaaaaaaaaaaaaaaannnaaannnaaaaaaaaaaaaaaaaaaaaaaaaaaaaaaaaan

SEQ ID NO: 4628 - DNA, 1762 bp, Zea mays
aaaggggtggagttttaataactccgatagatccaattatttaaaaaaatttgtgaagatcactttcatactgggctgaactggaccgacattctcatgcacaggcagcagcgctaatcgtcgatgggcttcatgtcctcaggcggctgcgccacggagagaggacccatctaataaagccgggcccgcgaggcccgcccccgtcagtttcccggctccctcgctcacgcgccgcggcatcactccggccggctggccagtcgcccactcttcccacccacaccgccgctgcctttccttccacggcgaactctccgcgggcgacgtccagactggcaacggcattccaataaaagaatgcgcccctgctctggccaactctctccacctgcattccccgttccgctaaaccctagccgcctccggcgcgtagtagattcgccatcagagacgacgctcggcggccctgaggagggatgacctacgtcaacccagacccccagccgctcgccgccgctacggcggatgattccgcaacccagcatcaagctgcggtgaccgccgcgccgcagtcgacgcgaggcgctctcgggttttttgcgacggcggagccgaagcagggcgcgaccatggtggcgccatcgtccccgcagggcgttcccgggttcgcggtcgtgccccaggcccagggggtcgagaacatagcgccccccgcgtccccgcaaggccctcccgggttttgcgtgacgcccgggctcgcgccacagcaaggtgctccggtgatggcgccgccgcagggtgtaaccatgatggctccgcaacagcagcatttcgcgcctgcgatggtgcctggctcccagcaagttatgcagatgctccttcaagccctccaagcccaagcccaagcccaagcccaggccatggttgctcaccaacccgctcaaggcatggcgccatcgcaatgtttgcccatgtgccatccgtccacggtggagatgcagcaagctcaagctggacacgtgacggcaccaccacctgtgccactcggccctccattgatgatgcagcagcagcagcaaccttcacaagctgatacagtgataatggcacaaccgcctctgccactcgaccctccattgttgcagcagcagcagccttcacaagctgatacagtgataatggcacaaccgcctctgcctcttggctctgcgatgcttcagcaacagcctccacagggggccacgatgatgatggcacagccacctctgccattattccctccatcagtgatgctgcaacacaatccacagggcaaccaggtgacgatggcacagccacaattcgctgctctaccatgcaagcgccagcgtcttgaccaatatggtttgtgatcaacttctagatgtgcctgatgccctgattactgttttatttagtgataacagtatcatgggtatgactaataaatgttctaccatagatgtattcaggtagaggtaaactaggtttttacatttgttctataaatctagaagaatagaacataagtcatatcataaccataagtagttaacttcaagcctatgtttcgtgctaaagctttgaagcaatcctggggatagtagttcccagtattaaagtttcgtgatactctgtgttgtagcttcttaagtattgagattagggagcctatctttcatattattcttttttgaaaaacaattaggagatacatgtcagtgtagcacatctgcatttttag

SEQ ID NO: 4629 - DNA, 1641 bp, Zea mays
atgtgaaccagacaccaagattgcttgagatagccttactgcggccgcccctttctgctgcgtcgagggtacgaaatcaacccaaaccctagcatcccctttgctcgagggagacgaagatggcgccgaagaggaagacgagtggcgacggcgtggtagaatcgccagctgacgagttcgcaaagccggcggacgacacgaagggatcgccagccgagttcgccaaaccggtttaccttgtggcggcgcgcgacgacgacccggcggcctactccgttctggagatcgacgccgctgccggtggcgacgagccgccgcgcatccgcaccgttgccggtctgacgggcttcatctccgagcctggcatgtccttcgtcgcggcgcattcgaagcacggctcctggattgtcggcgtcggcggtgggttaagagcgggcaccatcatcttcgacccgaggacattgaagactttccgcggcccgcggctcaggtaccccaagcgcgaacccgtcctgatctcgcacggcagcgagatatacgctatctcacgccgccccctggtggtgcgcccgatcgactgcgaaccatggttcgaatgcctcagcttcaacaagggtgtgccctccaaagattgcggcctttgcgtccactggagcatcctgccaccaccacccttcttcccttgcttcctgaacccctatgaatttcgcaatccacccaaaattacagtctcatcctatgctgtcgtgggctcatacatcttgatttccccgcaaccagagctagtggtaggaacctatgcttttcatgtggtgaacaagacgtgggagaagatccacgacgagaacctgccttttgttggccaggctgtgccactctgcggcagcctcttcgccgcctgccccatatccaacaacagtatcactgcttctgcctctgtgttccacatgtccatcaagttccccccatccacccttgttgcggcagtgagcactccctcattatcaatccaagggttcaaagtggtggcatcagagtacaagattccctggccactcttctgcccccgtggaaagggcagcttctgtttcatcaggttggggtcctcttgtcgtcggcagagccgcaaagccttgaagcggcttaaggttagcttgactgccttatggatcgaaaacattgaggctatcatgactcactgtcagtcccagggagccaaggctaaggatctgctagttgcagttcaagtgaaggaacagagtcatacatgcaaatccaagggcctatttggcatggctgtggttgctgccttctccatggacactgaaaatgttgagctgggggatgaaacgatggatacaaatgcaagctgcgccactaatagcactgtcttcgaagcacctgtaattcgcataggctgatgagtgccaacttttgtgttaaacagatgtagatgtcccttctcactctcccatttggtcgtgtctgattcatttaaacaaacttggtcagacataaaatggtagttagttatccatacactgctacggtttctataaactttgattaaataatatatttatcgaaatataattattttttattttccaaaaaaaaaagaaaaaaaagcaaacacgtccg

SEQ ID NO: 4630 - DNA, 1613 bp, Zea mays
tttaaaaaatggaaattcctttgaaaattgggttcctaaactaaccctaaaaggtaaaaaacggtgctggatcaacaaactaatgatctgataatcaagcaataaatgaaatttattgataatcggtaaaataacgatgtttgtcacgcgaagacatgaaactaaaggctactcgctcgtacttgctaatccaattcctaatcctaattcctaacataacatggccatagctaacgttgctagtgtggtacgcagccgctcaagcaacgagtccgacgtactcgagctcgatggagcccagccacagcttccccttcgtctccgccacgtcgctcagcgtgacacccttggccgccgtaagctcctccaccaccacgccgtgggcgtccaggcggaccccgacgaggtgcttcacggggcccgtcgccggagtcgcgtccagccgctgcttctcctggttcagcgccacccagtagccacccctgccatcccgcctcacgttgtccgggtagcccggcaggtccgccagcagctcgtactgccccttccgggcgccccggaggaagtacctgaacgcctggcacggcacggtgtgcgcgaccacgacctgctcgccgtcggggctgaccgccacgccgttcgggtacggcaggccggccttgagcacggagacgctcctcgtgcgcgcgtcgtacctgagcagccgccccgtcgtgtccgcgttcatcatgatctccgtgttgaacctcctcgggtacgtcgcgctcgagtctgtgaagtagacgtcgccggtggcctcgtcgacgtcgaggccgttgacgaagttgaacgggacgccgtcgtccgcaccggtcgccagcacctcggcctcgccgcctcccgggccgacccgcgtgagccccaggtaggcgtcggcgatgtagaggtcgccggtcttggcgtggaactggaggcccagggggcggccgcacatgctctcggtctccgccgacggcactacgccggccgtgcacagggggatcttcctgtagttggcgctgtgcgcgaacgtggtccagccgacggcgctgccgccccacttgaggacacggccgtctgagacgccggcgtagggcccctcgcccttgccgtcgaacgcgaggctctcggcgccgctgaccccgctgggtaaagggagctggaagctccagcgcgtgtcggtcgtcttgacctgcgcggcggaggcacacggcgcggcgagaagcgctaggacgacgacggcgaggagcgacatggtcagattgaaccgctgccccatgctgtgcctgtgcgtcgcccagttagtgctctcctcccgatgatctccgatgaatctgcgtgcagcgagcgccgcgggctcgcgttttatagcctggaaggaacctgccgttgccgtcgcgccttcgaactcggccaacgaaacggcccctgttgggataaggatctaggatcttgggctcctggctcgcgcacaactccgatgtccgatcccaaaacacggcgcctgtttctctcttggcgcacgggcctccaggatttgcggatgtttacctatccacaggatcggtcgaaggtgataaatgaactgcatgacg

SEQ ID NO: 4631 - DNA, 1738 bp, Zea mays
cagaacgatttctttgttgtgctctcagtctcggtgccgaaatgttcagcaatggcaatggccgtggatgaacaccattgccgctccagttcgccgccgtggctcagaacgtctataccaaactgtgggcattggtttgtgaatgcaattgaaggcccgaccttttctcgtctgatgtagctggaacgatctctgcactgtttgcttacgtcatcggtgtggcgatcgaaacttggaaagctttggatggacgtgagaacgggcagggcatacgtgcccgcgagcagtaaataacgtgtaaggactagtttgaaaaccctaattttctgggatttctattttcacatgtaaaaatgaactaattttcctttagaaaatggaaattcctttgaaaattggggttcttaaactaaccctaaaaggtaaaaaaacggtgctggatcaacaaactaatgatctgataatcaagcaataaatgaaatttattgataatcggtaaaataacgatgtttgtcacgcgaagacatgaaactaaaggctactcgctcgtacttgctaatccaattcctaatcctaattcctaatcctaattcctaacataacatgaccatagctaacgttgctagtgtggtacgcagccgctcaagcaacgagtccgacgtactcgagctcgatggagcccagccacagcttccccttcgtctccgccacgtcgctcagcgtgacacccttggccgccgtaagctcctccacctccacgccgtgggcgtccaggcggaccccgacgaggtgcttcacggggcccgtcgccggagtcgcgtccagccgctgcttctcctggttcagcgccacccagtagccacccctgccatcccgcctcacgttgtccgggtagcccggcaggtccgccagcagctcgtactgccccttccgggcgccccggaggaagtacctgaacgcctggcacggcacggtgtgcgcgaccacgacctgctcgccgtcggggctgaccgccacgccgttcgggtacggcaggccagccttgagcacggagacgctcctcgtgcgcgcgtcgtacctgagcagccgccccgtcgcgtccgcgttcatcatgatctccgtgttgaacctcctcgggtacgtcgcgctcgagtcggtgaagtagacgtcgccggtggcctcgtcgacgtcgaggccgttgacgaagttgaacgggacgccgtcgtccgcaccggtcgccagcacctcggcctcgccgcctcccgggccgacccgcgtgagccccaggtaggcgtcggcgatgtagaggtcgccggtcttggcgtggaactggaggcccagggggcggccgcacatgctctcggtctccgccgacggcactacgccggccgtgcacagggggatcttcctgtagttggcgctgtgcgcgaacgtggtccagccgacggcgctgccgccccacttgaggacacggccgtctgagacgccggcgtagggcccctcgcccttgccgtcgaacgcgaggctctcggcgccgctgaccccgctgggtaaagggagctggaagctccagcgcgtgtcggtcgtcttgacctgcgcggcggaggcacacgggcgcggcgagaagcgctaggacgacgacggcgaggagcgacatggtcagattgaaccgctgccccatgctgtgcctgtgcgtcgcccagttagtgctctcctcccgatgatctccgatgaatct

SEQ ID NO: 4632 - DNA, 8065 bp, Zea mays
ctactagctgtagcctgtaaactgcacagacaccttgccaggagattacagatggatgcttcatgcttcagtagcaactcgttgatgtatattgcatgcaatttagaaataatatatgtcccaatgtatttgtcaggaagcatctttaaatcattagcgactccagggtttcatgaatccaggctagatcattataatgtatatttactggcatcggatattgttttactattccctcatttttttatctgtcacattttagttcaaaaataaagtatcgagcaacaaatattcgagaacggatttagtacaattttatttactctatgtaatacatgtatatgaccctgtagtttaaactatcattcagaacgatttctttattgtgctcccagtctcggtgccgaaacgttcagcaatggcaatggccgtggatgaacaccattgccgctcgcgcgaactggtgcgcggttgtggctcagaacgtctataccaaactgtgggcattggtttgcgaatgcaattgaaggcccgaccttttctcatctgatgtagctggaacgatctctgcactgtttgcttacgtcatcggtgtggcgatcgaaacttggaaagctttggatggacgtgagaacgggcagggcatacgtgcccgcgagcagtaattcagtcaggaaaataacgtgtaagcgctagtttggaaatcctaatttttttatggaattctattttcacatgtaaaaataaactaatttccctttaaaaaatggaaattcctagtaattcagtcaggaaaataacgtgtaagcgctagtttggaaaccctaattttttatggatcggatttctattttcacatgtaaaaatgaactaatttcactttaaaaaatggaaattcctttgaaaattgggttcctaaactaaccctaaaaggtaaaaaacggtgctggatcaacaaactaatgatctgataatcaagcaataaatgaaatttattgataatcggtaaaataacgatgtttgtcacgcgaagacatgaaactaaaggctactcgctcgtacttgctaatccaattcctaatcctaattcctaacataacatggccatagctaacgttgctagtgtggtacgcagccgctcaagcaacgagtccgacgtactcgagctcgatggagcccagccacagcttccccttcgtctccgccacgtcgctcagcgtgacacccttggccgccgtaagctcctccaccaccacgccgtgggcgtccaggcggaccccgacgaggtgcttcacggggcccgtcgccggagtcgcgtccagccgctgcttctcctggttcagcgccacccagtagccacccctgccatcccgcctcacgttgtccgggtagcccggcaggtccgccagcagctcgtactgccccttccgggcgccccggaggaagtacctgaacgcctggcacggcacggtgtgcgcgaccacgacctgctcgccgtcggggctgaccgccacgccgttcgggtacggcaggccggccttgagcacggagacgctcctcgtgcgcgcgtcgtacctgagcagccgccccgtcgcgtccgcgttcatcatgatctccgtgttgaacctcctcgggtacgtcgcgctcgagtcggtgaagtagacgtcgccggtggcctcgtcgacgtcgaggccgttgacgaagttgaacgggacgccgtcgtccgcaccggtcgccagcacctcggcctcgccgcctcccgggccgacccgcgtgagccccaggtaggcgtcggcgatgtagaggtcgccggtcttggcgtggaactggaggcccagggggcggccgcacatgctctcggtctccgccgacggcaccacgcccgccgtggctcacctctgccataggctgtgaggatgagccaggtcccgatggggatggtgaaatcaccggggcttgatactggacgtatggggcttggtgcagctcgggaactgttctggatggacctggaggaacatttcgtccaacactacctcccctatgcccaccatagtatggctgtgaaattccacctctggagcgggcaccaccacgcccctggtactgtccctggtactcaccacctcgtccctggtattcacgctggtgatactcaggcagtccaccagggtgatgtggacctggccctccacggccttgataatgtccaccacgaccctggtgttgcccgccaccacggccaccctgctgaggcacccagccacgtcctgccccaggttgttgagtccgttcaggccgctgtgaggaaccttgtccagaagctcctgaagactctccagaagtttctccagagccgccagggccagttctcttcttcctcaccatgatgggcactagcatgacaggaatgcatcaagacttgagattgtaaaaatataatttatcaaaccttaacatgaactgtgtatttgttaaaatttaaaaacagagggttctatattgagaactgaaacagcttagggagtgaagaacattttgattgtttcaccccttctgaggttggctgcaaacttctatttaaacaaaagtggccaagtagaaggttagggaaatgcgagaaagaacatataaaaaaagaatggtcgtactcgtacaggtgtcctctagatatcgattattttattcatttaataacaataaccttataattatacagacaagaagtatacaaaatcaaccattcaccctttctattatatttaaaaaagatttatactagtactgtcattcataatattcatgatacaaacggtatagatgtacaaacaaaaaaagaataaaagaagaaatgtatgaatgagaaatatgcagcactgaacaagtcaccagaagataccgatttcatctacacacaaaatgataaatatcctgccgctaaggtcttgtttgggagcaagtggaatggagagaattgatggggctagaatccctcatcttgaacgctaccttgggtcaccattaagataacatcaaacgactcggtagtcggtaaacattgaaagaaacatgatgttttttttacaatgccatgctgcatccttgagtgtacgaaattgcatactctatggtctccgcttgcacttgtaatcaaggttgagagttcacactaagtgagaacatcgagaagtaggcgtaaactatgcctagaacacatccgaagtcatagcggaggctgcattttcactcgtcataatgtgatgcactaaaaagaaccctcatttgttagccagatacagagacaacaaaaaatagcaccctaaacacagatggataccatggtacagcagggaaaatacacataaacggagtgggggttttaccctaacgtagaggcaaataaccatacaagcatgtagccagtagagggaggtaaggatatatcactatgctgaggctttaacgaagtcgtcagttcaccacgaatatgagaactggacacctgaaagaactttcagatgttctttatctcacagaggaattaatcatcccgttccacattgcgcgcccagcgtagacaagctaaaactatcacaaaaacagctggtaatcgtcaagttctcattggatcagcccacagccagcttagaaccggacaaatcaaccgacagaccccacaaaatccacgagcgcccacctcgagctcgttcacttgaaacaccaacaccggacaccgctgcaacgcagcaacccaccccggaacggaaacgatcgaaagctgaagctacgcacaccgcactgaggcagcatgcgaaaagcagcagatctagtagattacgcgagggagcaatacctgagcaggctcggccgacggctgcgcgcgggatgggaacggaggcggagtgctaagctcctaactccactgccgcagcgctgctgctgtactgggtgctccactgcgtgcccacgagcaccaccacctctccgccttttttgaggaggggagggggggaaggcgacggccgcttgtggttaattagcggcagcggcagtgcgggcgcggctcactggagaaagcgccgaagcgagggcaggcaaggcagcggcagggcagggtgggctgggtgcccgtgtcaggggcagggggcagggggcaggtcgcggggcgggtcgcgtcgccgtggacccgcgtgacccgttctggcactgacggcgtgggaccgagccgtacaaaggaggacacctcgggcgcgacgccaccgatgcgattagtggggctaatcaagcgtttaggcgcaaaggacgggggggacggaacgggtgtccggagtggataatcgtgcccagggcccaaagacctgtttcggctgctgattggatcgcctcgctctcgcgccccgtctgcactacgggctgatttgatgattagggatcctaggaaatctatgaggaaggaattcttttgcaattaaattttgaatagcaagaggatttctttctctcgggatcccgtcaccaaatcagccctacgtgatcattcatgcccgcaggccgcagcatcagaccctcactaccatcgacgcacaggtaggcaaaaaagcgtacggcgtggaagggaaacagacgatgtcggctcggggtacggtggttcgccggtgctgggtcgctgtcaaatgcagtcccgtttcgacaacccgtccaggcccgtaagaggtaaacagaatgagtcaaacgggcgcctcccgacgcacgcaacaaaccgaaaccattagcggcagtagcatttgctctcgcaccaaacatccaacgagcacaggcctactactacggccaccctaccgggtcaatggctcagatcggctccgcatagccggcagtgcgtgggtggggccaccgctaaactgttcaaaacgctggcccacgggacaccgtacggacaccacgcacgcgatgacactccgagcccaccgacctcgcgggcccagcgtgcagctggaggggtgcacatactgcgcgtcgcgcaagttacccgctggatggatacttgtataggacgctgtgtgtccggctgcgagagccgtacagggcgcgcggccacccgttgctctgctgggcccggggcccgatgacggggacggtgtggagcccgcagtcgggggtaggggggtgtggtcgggtgagggctctttcgctcaggctagggcggccagtgtccagtgggctgcctcgggcctcacaaccagaattgacacaaccggccgcggccgccgccgcccgcccgcccttctccaaagcctgcgccctgtagaggctacggccgggacggcgagacagcggcgctctaggtggcgctccgcagacgcagggctgcaggaatcgacgtatcgtaccgttcctcgtagcggtgcccgtgttgctatctaggtactgcgtactatgatacagcgggtatcacgtcgatcgtacgccacggtccctgctgtcttggttttggtggaaggtccagacagttcttctcgtcgcccgtatccgtgcttcagagctcacatcgggggcgcggggagcacagtcaaaaagatttgctgggggcacccgtggtccggtgcaaaaaaagatatgtgtagtccggtcctataactgttaacgggttgtcaccacgatctttgttgcaaagcaataaattcagtgttgacttgacgatatgtctacgtaacaccgaacgccactagctgtccctgcagtagcaccttgcctttagcattaacgaaaaacaaaatccgtaaataatgaaataaagacagttttggtgaccatagttacacagcagatatactcatatccatgtcctatttatagagctaacggacgtatcaggcaggactgctgttgtcgcagcaaaacacaatgacaacaactattatccaagcagtccttctgtacaagcgtacaagcaaatcatctaattaattagattacgatccaaccacagatacaaccatagattgttagaggtttttttataaagattattaagttagtggtggaagagtttaagtgttaaatgtgacctattgttcgatcacgatctaatgaatcagatgatttacttacacgtttgcgcagaatgacttcttgcatagctgtcgttgccacaatggaatttctactcaatatagaggttaagcgggcggccgctagcccgctactatattcgcgaccgtgactcagcgctcggtggtcagagctttgtgaccggccatttcgtctcaaacatttgtatgaaaacggtactagatccacttttgtgttcctgacacgccgacaaacatttttatttggtatatttaatatggtgtttcttaagggaactctaataacttaatttaaaaactatacaagagtttgtctttataagactaccatatttagtctagcgtctaaagtttagtctctaacatatttaattccagagattaaaagtatttagaacacattaaattattcataagaagacaaaatttcctcttatcgttctcccaccattagaactatactagccaagtgcccatgtattgttgcaatttaattaacaaaatcaattattttataactcaagtgaacatgtggtgggatggaagactctttcagtctttttaataccaggtttcgaaccccaccttagagcactctcctctttgagagaattcgttcgatcgtgccacgaagagagggtgacgcaatagcaaactcctactttaaagtacagtattaatttttttttttgaacggatgaaatttttgtgtgggaattaaagccggtgtgcaggattcccggtcaaccgcaagatgtgctttgctgacactacggtgcaagcgggcggacctggcgcgcgacgtgactgttcgcttgagccgatggcacgtggttagggatgtaattagttcgaacagatattaattataccgtatttgttttttttatttttcactttatgttatattggatgtggaattgtgttagataagattaaatatcaattttgagtatacaaatacatatataaatcggatatgcactagatactgagtatttagactccaataagtatcaaatatcagtccacttcgacaaatcgacctcttagaaaaatcaaatttaaatacatacagataatattcgtaatatttacatcctagttccctactgtcatggctcggccagcctacggagtgcggaccggaccgcgtcaaatgacacgtgaacctaagcgcgggacaaggacagtcgtcgccgacgtaccatccggcacggcgcgtgggccctcctctaccccttgccaaaagccgctcggaggtcgaaacgtgtcccacaaagggcggggtgacctcacctgcacgacggcggggctgtgtgtgtgtacagtgtagtactgctgtacagtagctgtactgcacccctgcggccctgcccatggtgccgtccgtgggcccgccgcgcgtggcactggtttggttgctactgtacggcacagcgtgacgcaccacgcacgagcacgaatgcacgatcccccctccctcctctccagcccgacccccaccccacgatgtcacggccttgctgcgcttgccgccatggacgggcccccatcgcgcggcggcccgaggcggaaagatccaccacgtatccaacgcctcttggatatcacagatgggcacgttactgttccgcgcgacgcaagtgccaaatccgcaatggctgtctctcttttttttttctattgtcggcagcttgcacgcgtcggtgccaggtctggttactgttttggctggtgcgttttggatcttgctgttgtgtgttgtcttttgcgaatacagaatctaataagaaggctcacaaattaaagttgctgcatatacagtagtcattacaaaaaaatgctgtagaaactgggtggggaaacaagatttcaaacaagagtttgatgaaccgcgctgtgctcgataatgatgtgctaacacaaaaaaaaggctgtttagatcccttaggctttgttcgtttccgtcg

SEQ ID NO: 4633 - DNA, 4561 bp, Zea mays
taagacggaatttgagatgaaggagtttgggtaaaaccaaattttgcttaggtttgcaacttgagcaccttcccacgggcattctcattcatcagtctacttatgcccagaaagggataaggatccttttcgaccacgagatgaaggagaagagattttgggtcctgagtacccatatcttagtgcaattggaacacttatgtatctagcaaacaatacaagacccgatattgcttttgcggtaaatttacttgctagacatagtgcatcccctaccaaacgtcattggactggaataaaaaatgttctttgaaaccttcatggcacggcagatctcagtctattctacggaagaaatcaagatcctagcctcgtagggtacatagatgttggttatctttcagacccccacaatggaaggtctcaaactgggtttgtatttctaaatggtggaactgctatttcttggaagtcatccaagcaaactctagtaacaacatccactaatcactcatagattattgccttgtatgaagcttcacgtgaatgtgtctggcttcgaagggtgattaatcacattcaatcatcatgtgggattcattccattgaatcacccaccattatctatgaagataatgcaacttgtgttgctcagatgcaacaaggttatatcaagagcaatgttaccaaacatatatctcccaagttattctatcctcatcaacttattgctcccaaccgtggactccaagggacgtgccccttgcacgttctcttcatggtgtcgggtgtgaccccaccaaggaacagacggcgcatggtctacatggctccaagggacgtggccctaacacgttcgcacgtatgctttctctggtgtatgggcgaagggtcacatcctatcggacgcttctctcttccgttgttgaaggacatgtataatacatatgtattgagcaataaagattacacatggttctcattttcactttcaccagtttactttcacaaagttcaccaacaagtatgtgaaggtaggaaccataagaagagcagcgcccgtcgaagtggtttatggcagcatttcgcttgaaatgagggaagaagttattgaacctgttgttgagcctgagcctgagcctgagcccgagcccgagccgcatgacaacgatgcaccatgaataggaaaagcacaaagacatcagttctgataggaagatgaaatggagggcagggcactgcttataatgttctagaggtagtcagaatttagaaataatggaaagcctcgtacttgttgcatggataatactatctaaatttaaaccaacaatagatctgtactctgtagtaggattgaattgtcggatatgtacatgtcatcatccttctatttttgtgaaacgtgtcacttcctgatctctttactccgcaaatgcgcaagaacactatgcatactaaatactttggctgacacaccatatgctcgttccttactttcgatcagctcaggagtaacgcacctaattatatatatgtttaagagatcctgaataattattttcgaacgatgaaaagagactgcatggaagatttcctattactaagttgacctatgtaagtttctgcatcaccaagtaacaaataaatctatcgcttaggcgcagcgatttctacttagctagagccacaagctgatgaactacgcaatctgggatttctctgccaggattttttttgcctgtaagatttcgaagcacttcatcgagctcaatatgtaacgagtcttaccgaacaggtacgaatttgagttcattgacaaataattattttttacagtctataggcgcaagcttgtcgagctcattgacaagcttggtgaaggtacaatagattggacagggtttgcaagtgaggtgaagatgccccatggaaacaggcttggaggtccgtatcagaggctgtctggtcgaagtccaaggcatgaggagtatttttatgcaaatcctcttccagggtgcttgtgcagaagaaacacacaggatcaagtggcatgaaccttacatacgaatagacagttatcatacatcgagctttcctccaactcattgacatacaccaaacagtgaaaatccgagtagactgacagcaaaaggacatgtttttttcttcctataaacagataaaatttatgtagttttccatcttacacgaggatacaggagggaacactcactgaaatgtgcattttcaagagatgtttattcaggttttaaaatagaacaggcaaagatattcaaagaggatacgtgttgtaccacagagtatagaattagcagatttgatgagtttttagtgtatgtttgtatttactccatagtccacatgtagagcctctcatgtgggagattcttctgggagcctctgtcacttggtttgtcctccagatgcacagccttaaatctaaaatttaactttattcattttattatgcacaataatcattagttgtagcggtagtactatggccagtttctcttgtgaggtgaggtgaggtgtttctcttgtattcataggctcatcccttgacacctctatgatatcagcctctttccatgccgtgtttatcacctcctttattttatctctggaagcccacaatggcaatgccaaattgagatcgaagaacactttgattccaaatttcttggacagctcaatggctctgaagagcgtgtcatgcattaagggggtttaacaggacttttgaattgaattgaaacattctagcctgtgtaattgccacatagattagatctgaataaagaggaaaatgtttttttgttgccagcgtgtcaacccgaacggtggattctgctaaaaatgcttacttgaaacagtttggaagatgatctcaccacgattgcgaaagatatagtgattgtgaaatatacttgatggactcgttgttgttttccggtttctttttttatctctctgatatcagtctcacacctctatagttcaattggggatggaaagttcataacgagtagtagttttaaagcaatctctcaccaggatcaactcgggtgtttgcatcagtaatccagaaatattttatcttgataacgagctgaggctcagcctacccactctcatcaatggtgtgactcatcttaagattattcataaaactctccaatacattttaaaaaaatacctcagtatttattatgcaatgaaaaaaatcttcagattagttcttaatgtttgaaattatcatgcaattcctaatcctaagttcctaaatttactaatgcaattcctaatcctaagttcctaaatttacttatgcaattccttcctaagttcctaaatttactcacgcaattcctaatcctaagtttctaattaacatcatagctaatgctggtacgcagacgcagcagctcatgcaacgaggccgacatactcgagctccacggagcctaaccagagcttccccttcatctccgccacgtcgctcagcgtgacgcccttggccgccgtgagctcctcgacttccgccccgtcagcgttcaggcggacgcccaccaggtgcttcacgggagccgtcgccggcgtcgcgtccagccgctgcttctcctggttcagcgccacccagtagccaccattgccgtcccgcctcacgttgtcggggtaccccggcaggtcggccagcaggtcgtactgccccgccctggcgccgctgagaaagtacctgaacgcctggcagggcacggtgtgcgcgaccacgacgtgtgccccgtcgcggcggaccgccacgccgttcgggtacggcaggccggccttcagcacggcgacgctcttggtccgcgcgtcgtacctgaggagccggcccgtcgcgtccgcgttcatcatgatctcggtgttaaacctcctgggatacgtcgcgctggagtcggtgaagtagacgtctccggtggactggtcgacgtcgagaccgttgatgaagtggaacggggcgccgcccgcgccggtcgcgagcacctcggcctcgccgccgcccgggccgaccctcatgagccccaggtaggcgtcggcgatgtagaggtcgccggtcttggcgtggaactggaggcccagcgggcggccgcacatgctctcggtctcctccgacggcaccactcccgccgtgcacaggggtatctttgcggtagtttgcgctatgcgcgaacgtggtccagccgacggttgtgccgccccacttgaggacgcggccgtccgagacaccggcgtagggcccctcgcccttcccgtcgaaggcgaggctctcggcgccgcggaggccgcttggtaaaggaagctggaagctccagcgcgtgtcggtggtcttgatctgtgcggcggcaaacggccgggcgaaaagggctagggctagcacgaccaaagcgaggagccacgtaactagattgctccgacgccccatgctgctagctatatcttcctcgcgatctttctaatgtgcgagatggaacctgcagcccctaccttggat

SEQ ID NO: 4634 - DNA, 1960 bp, Zea mays
agcgctaccatgacacacgatggaccattctctctttatacatagagctcgtaccgaaattcccaactctggtacagtacagttcatgttacgaaagaccagttttaaagggtaacaacaaagctttagcagaggaaagagcgcttttaaagggtaacaacaaagctttggcagagaacggagaagatgggattgctatgttcattctgtttgctaaccaaaaagctcatgtttcctacaggatttgcacctgtgctttcccgattttgcacctgtacttgggggaagggaaagaaagggtgacctgaccgacgggcccgccacggcagtgagcgagggcgatggccgatgacacggctggattgcggcagatgctgggccaggacgcacgtgcagggccctgggccgcagcagcccagtggggctcgcgatactgggccaacgaggaaagcgggctagggcacggccaaagcaggtcgactgcacaagaaagagggagacgaggttttccctttctctctcttccattttccctcgcctccccaaattcaaaagattttgaattcaaaataaatttgaacaaccacacacatcaaaacatagtgtaccagcatctatgcatagcatttgaatcagttcatttaaaaaactaggaaaaaggggggaaaatcctacgttagagggccctgaagtttgcttgctctgcaggctgcagcactgctgcccgggactggcacaccccaagtaattccaatcaaagttgtttaactggcacaaagtgtgtgagcaagatttatgtattttcttccgtttgtatcgaattagttattagggaaggagacattctccactgcctccagcaagtgttcaaaaatctgaatggcatcttgctcctctgtccacgccgcaccatcgctcctcgtctcggcgccgcctagtaggcggcgcacaagtacggccgtatgtcttcagggtgttcgccgcggcagggtcgcgtcctgccgcgtgcggtgtagcgccggggccgggcagggcggggtcaaggtccctgcgaagctggcggagctgtggtcggcggcgaagagcgcgcctcccctggccgtgctcgcgggtgtggcggcggcggtggcgatatacaaggtcgggtccagtctccttgcgccgcgccatcccccgccccgtcggctggaggcccagacggccccgccgcctccagtcccggagccggtgcaggtgggcgagataacggaggaggaactacggcagtacgacgggtccgaccccgagaaaccgctgctgatggccatcaaggggcagatctatgacgtctcagagagcaggatgttctatggacctggcgcagcttatgctctgtttgctggtaaagatgccagtagggcattggctaagatgtcctttgaatcacaggatctgaatggtgatatatctggtctaacgccaatggagctcggcgccttgaatgactgggagtacaagttcgccaccaagtatgcgaaggtaggaaccataagaagagcagcgcccgtcgaagtggtttatggcaacatttcgcctgaaatgagggaagaagttagtgaacctgtggttgaacctgagcttgagcctgagcccgagcctgagccgcatgacgacgatgcaccatgaataggaaaaacacaaagacatcagttcgggtaggaagatgaaatggagggcggcacactgcttataatgttccagaggtagtcagaatttcgaaataatgaaaagcctcataggctcgtacttgttgcgtggatattcagaaagaatagtgtctaaatttaaaccaatagtagatgtgtactctgtagtaggattgaattgttggatatgtacatgtcattcttctattttcgtgaaacgtgtcacttcctgatcaaaatactaaaaaaaaaagcaagaacactctgcatactcc

SEQ ID NO: 4635 - DNA, 1404 bp, Zea mays
ccggccgggaaagacagagcgcctcacgccctcacgtgcctaccgtggaccaggtccaggggtgggttggcaggttgctgagagcagtagagcacgggaccgtgaaggcgcgcgccgagcccacccaccaaccaaattccgcgagaccgcgactgcttctccatccttccacgaactagacgagggaagagcgctgaagcctgaagctgtggaggaaaacgaaggatctccccgtgcttgtgtatgccaggtcgcctgctctccgtccgcatcccgtccctcgcgaaactcggcgctcccaggtgtgcaaaatccatggcttcagacactggcaagaagctcatccagatcgatgtgagctcggacacagtatgcccttggtgctttgtcggcaaaaagaacctcgagaaagcgatggagcaaagcagggacaagtttgacttcgaggtccgctggcatccgttctttctaaaccctgatgcgcctaaggagggcgtcaggaaatctgacttctacaaggcgaagtttggtcctgttcagtatgagcgtgtcatttctcgcatggccgagatatttcgaggactcgggcttgagtatgacatgtcggggctgacaggggatacgatggatagtcataggctcatagcacttgctggacaccaaggctatgacaagcaaaatgctcttgttggagaattattccttaattacttttgtgaaggaaagtatattggtgacaagcaggttttgctggacgctgcaagaaaggtgggcatagaaggggccgaagaactgtttcaagaccctaccaaaggagtcgatgaggttcaggaagaactcaagaagtattcatctggcatctccggggtaccacattttgtgatcaatgataaatatcaactcagtggtggccagcctccaaatgtattcatgagggcgtttgagatggctgcaaaagatggagcttaatggcatttaaaaggagctcctccagtagtcttcgcatatgttaaaaaggaataggagccgaatttaacaataaagttccagcacagctcatcgctgatttgcgaaaaatatgtggaatcagttgtatttccgtagttctgatatggtgataattagtggtgaagatggtgtggatgttcacttttgaataaaattctaggcgatcggatatggcatatgggttagaatgccccataaacagagcccggtctgtatttacatttggttcgataggatgtgtgcaagatatcagaaaacagcaaagttcagatttgatattcgaaaggaataaaaaaaaagctagcatacacagctgcatttagattgaaagaaaaaaaaaaaaaaaaaaccaacaggcgcgccggtaccaagaaaaagaaaaagaaaaaaatataa

SEQ ID NO: 4636 - DNA, 2198 bp, Zea mays
aaattcggcgactgcttctccatccttccacgaattacacgaggaaagaacgctgataaacaaatggcgtaaatctctatcgacgaagctgtggaggaaaacgaaggatctccccgtgcttgtgcatgccagatcgcctgctctacgtccgcatcccgtccctcgcgaaactcggcactcccagggttcgtttctttgtttcacctactctcgttgtttatgctaatttgttaggcgcctttgcttcaggaaatggtgattgtatcgtactattctggggggaaagcgcaattatttgagggcaagttgattcatcatggaggggtgtgcaaaattcatggcttcagacaccggcaagaagctcattcagatcgatgtgagctcggatacagtgtgcccttggtgcttcgtcggtaaaaagaaccttgagaaagcaatggagcaaagcatgggcaagtttgatttcgaggtccgttggcatccattctttctgaaccccgacgcgcctaaggagggcgtcaagaaatctgacttcttcaagatgaagttcggtcctgtccaatatgaggatatttcgaggactcgggcttgaatatgacatgtcaggattgacagggaacacgatggatagtcataggctcataacacatgctggacaccaaggctatgacaagcaaaatgctcttgttgaagaattgttcctcaattaccattgccaaggaaagtacattggtgacaagcaggttttgctggatgctgcaagaaaggtgggcatagaaggggccgaggaactgcttgaagatcctaccaaaggagtccatgaggttcaggaagagctcaagaagtactcatcggacatctccggggtcccacattttgtgatcaataataaatatcaactcagtgggggccagccaccaaatgaattcatgagggcgtttgagatggctgcaaaagatggagcttaatggcgcttatttgcgagaaaaaactgtggaaccagttgtgtttcgtagttttgatgtggtgatattagtgacgaagatggtgtggatgttcacttttgaatagagttctaggtgattggatatggaacatgggttatgtcctgtaaatagaggccagtctgtatatttgatttgatttcaaccgaaagctgtggttttcagaacctgagatttcagcatgaaaacctattgtaagcacccctgcggacattaacatcaagaaaaaatctataaaaataaattttcgcaatgctgtaagtttcagcaaacgatcagcgctatgtacacaacacgcaggatttagcttgggtcttccacttgccgtctgggaagacttccatcggcggggtcattcatcctcattgaacaacatagtctttgcacagaccgggcaagcctggctcctttccatccactcgtaaatgcagctaaggtggaaattatgtttgcattgcagtgcaatcttcggattctcataatcatattcttccaggcatactggacagtcatcctcactgtcagaggaatcacagaattgtactccatcatccattcttgaaccttctgagtgctgttttggtgaggacgcagaaaccttatgagctgtgcaagttgacccagtatgggtattcttagtttctgcaggctgtcctagtttctggacatgcgttggtgctttgtcgtgtcctgatacaagtgggtgttgcaccatgcgagggctggattgaggatcatcgtaaggcaaaggccttggagggagacccaaagtatccaatgaatccacttgatttgcaggaggactccttccaccatcaggtgccacccgtgtatcacatctgtgacaagcagcagagcccgagttcaaattgtggtaataatggaaaggccatagtaggcacaagcagctcacgggcggcgctgccgagacgtcctccgagccccgcatgcagcaaagcagggaccccatcctcgtctccccttcccaagttcgagccgagcagaggattcttctagttctagcacgcaggagcggacccagtgaagaacacccgatcggtactgccgggtgctcgttgcctgagaagtagaaggagccgacgaagacctgcgcatctggcggcggcggtagcctagtcgtatatagggagagagcagagatggaatagcccgaacgagtcggagtcctgttct

SEQ ID NO: 4637 - DNA, 1146 bp, Zea mays
gggccgctccggccccccacgaattacacgagggaagaacgctgataaacaaatggcgtaaatctctatcgacgaagctgtggaggaaaacgaaggatctccccgtgcttgtgcatgccagatcgcctgctctacgtccgcatcccgtccctcgcgaaactcggcactcccagggtgtgcaaaattcatggcttcagacacccgcaagaagctcattcagatcgatgtgagctcggatacagtgtgcccttggtgctttgtcggtaaaaagaaccttgagaaagcaatggagcaaagcaagggcaagtttgatttcgaggtccgttggcatccattctttctgaaccccgacgcgcctaaggagggcgtcaagaaatctgacttcttcaagatgaagttcggtcctgtccaatatgagggtgcgatgtctcgcatgactgagatatttcgaggactcgggcttgaatacgacatgtcaggattgacagggaacacgatggatagtcataggctcataacacttgctggacaccaaggctatgacaagcaaaatgctcttgttgaagaattgttcctcaattaccattgccaaggaaagtacattggtgacaagcaggttttgctggatgctgcaagaaaggtgggcatagaaggggccgaggaactgcttgaagatcctatcaaaggagtcgatgaggttcaggaagagctcaagaagtactcatcggacatctccggggtcccacactttgtgatcaataataaatatcaactcagtgggggccagccaccaaatgaattcacgagggcgtttgagatggctgcaaaagatggaacttaatggcgcttatttgcgagaaaaactgtggaacccgttgtgtttcgtagttttgatgtggtgataattagtggtgaagatggtgtggatgttcactttcgaatagagttctaggtgattggatatggaacatgggttatgtcctgtaaatagaggccagtctgtatatttgatttgatttcaaccgaaagctgtggttttcagaacctgagatttcagcatgaaaacctattgtaagcacccctgcggacattaacatcgagaaagaatctataaaaataaattttcgcaatgctgtaagtttcagc

SEQ ID NO: 4638 - DNA, 1050 bp, Zea mays
gttctagatcggggcggccgctcgcgaaagaacattgtgtttatagtaagtggacgaggacgtgattcccttgatgagtggttttctccgtgtgagaagcttggtctagcggcagaacatggctattttatcagatggagcaaggaagccgcatgggagtcaagctattcaaggccgcagcaggaatggaagcacattgccgaacctgtgatgcaggtatacacagagacaacagatggatcttcaatcgagtcaaaggaaagcgccctagtatggcactatttggacgcggaccatgatttcggttccttccaagcaaaggagctacaaggtcatcttgagagggtgctatcgaatgagcctgttgttgtgaagtgtggccattatattgtagaggtgaaaccacagggagttagcaaggggcttgctgtcaacaagctgattcacacactggtcaagaacgggaaggcaccggatttcctgatgtgcgtcggcaacgacagatctgatgaggacatgtttgaaagcatcaacggtatgacctccaacgctgtcttatcacccacaatgccggagctgtttgcctgttcagtcggtcagaagcccagcaaagcaaaatattatgtggacgacaccagcgaagtaatcagattgctcaagaatgtaacccgcatcccctcgcagcggcaggatgtcagtgccagccatgggcgtgtgaccttcagaggcgtgctcgattacgtggactaggcaccaccacttagttactcgaaaaattattagctgggaagcatgtaaattcccccgtcttctgcctctcaatggttcattctaggagggtgtgttaatccagaattgtagtgtagcctacatgaatcgtccccattacacaaacagcgtaaatgtgttcgccgtttcagggttcaggtgatgtgtgtaggcaattttggtatggaggttcgcggtgtgaaagggaggcctcttgttcaaacagtaattggttgtctgaatctgttctcctgctgctatattgatgattgtgttagttct

SEQ ID NO: 4639 - DNA, 3134 bp, Zea mays
  misc_feature (3116)..(3117): n is a, c, g, or t
cgattcggcacgacgtatattatgaggttccagactaatgcatcatcttcccaaactagcccttacaggaatttattttgtacaggcctcaacgagctagcctgagacaagaacactggaaccatggtttcaaaatcatattcaaatctgctagacatgaccccaggagatgggtttgactttcgacgaccttttaagtctcttcctcgtgttgtaacttctcctagcattatatctgaccatgattgggattccataagtgatggtgattcagttggttcagcattttctatcgagaggaaaataattgtcgccaacttccttccgctgaattgtacaagagatgaaaccggggaactgtccttctcattggatcatgattcactactcatgcaacttaaagatgggttttcaaatgagactgatgctgtgtatgtaggcagtttgaaggttcatgtagatcccagggagcaggaccaagttgcacagaagcttctcagagaatatcgatgcatacctacttttctcccatctgatctgcagcagcagttctatcatggcttctgtaaacaacagttatggccactttttcattatatgcttccaatttgccttgacaagggtgagttgtttgatcgcaccctgtttcaagcctatgtccgagccaacaaactttttgcagataaagttatggaagcaatcaatacagatgatgattatgtttgggttcatgattatcatctcatgctgctccctacattcttgaggaagaggttacaccgaataaagattggtttcttccttcacagcccttttccctcttcagaaatatacaggactctgcctgtaagggatgaaatcctgaagtcactgcttaatgctgatctgattggtttccaaacatttgactatgcccgccacttcctatcttgctgtagcagattgctaggcctgcattatgagtcaaaacgtggttacattggaatagagtattttggccgaacagtgagtttgaagatcctttctgtgggtgtccatgttggtcggcttgaatctgtcttaaagttgcctgctacagttagtaaggttgaagaaattgaacaaaggtataagggcaagatactcatgttaggtgtagatgacatggacatcttcaaaggaataagtctgaaattgcttgcactggagcttcttctggacagaaacccaaagcttagagagaaggttgtccttgtacagatcatcaatcccgcaagaagcacggggaaggatgtgcaggaagctatcacagaagctgtctctgtggctgaaagggttaacacaaagtatggttcttcaagttacaagcctgtcgtcctaattgataatcgcataccgttttatgaaaaggttgcattctatgccgcgtctgactgttgtattgtaaacgctgtgagggatggcatgaacttagtaccatatgagtatactgtttgccgacagggaaacgaggagatcgacagagtcagaggccttgacaaagacacccatcacacaagcacacttattgtttcggagtttgtgggttgctccccatctctgagtggtgctttcagggtaaatccttggagcgtcgatgatgtggcggatgccttgtgccgcgcaactgatctatctgaatctgagaaacggttgcggcacgaaaagcattatcgctatgtcagtactcatgatgttgcttactgggcgcacagctttgctcaagatctggaaagagcatgcagagaccattacagccgaaggtgttgggctattgggtttggcctgaatttcagagtcattgctctttctcctggcttcagaaagctttcttcggagcactttgtttcttcttataacagggcttctagaagggcaatatttctcgactacgacggcacacttgtgccccagtcgtcaatcaacaaggctccaagtgaagaagtcatctccattcttaacaccttgtgtaatgatccaaagaacgttgtgtttatcgtaagtggacgaggacgtgattccctcgacgagtggttttctccatgcgagaagctccgtctagccgcagaacatggctattttatcaggtggagcaaggaagctgcatgggagtcgagctattcgagtccgcggcaagaatggaagcacatcgctgaacctgtcatgcaggtatacaccgagacaacagacggatcttcagtcgagtcgaaggagagcgctctagtgtggcactatttggatgcagaccatgatttcggttccttccaagcgaaggagctaaaggatcatcttgagagggtgctatcaaatgagcccgttgttgtgaagtgtggccattatatcgtagaagtaaagccgcagggagttagcaagggtcgtgctgtcgacaagctgattcaagcactggccaacaacaacgggaaggcacaggatttcctgatgtgcgtcggcaacgacagatctgacgaggacatgttcgaatgcatcaacggtatggcctccaacgatgtctcatcgaccacagtaccggaggtgtttgcctgttcggtcggccagaagcccagcaaagcaaaatactatgtggacgacaccagcgaagtgatcagattgctcagggatgcaacccgcttctcatcgtcgcagcggagggaggacgtcaacgccagccgcgggcgtgtgaccttcagagacgcactcgattacgtggactaggcaccagcagcaattcttagttactcgaaatgattagctgcggagcttgtaaattccgctgtcttctgtctgccaatggttttcgttctagagaattgtagtgtagccgacatcgacatggatcgtcgtcaccgatacacgaacagcggaaatatgagttgaagttcgccgtttcgaggctcagaattggtacatttatagaattgtagtgtaggcaattttttggtagggaatagtaattggtacatttatagaattgtcaattgtttttcttctaccgctgataatactatagcttcgctaaattaatattattgtttcacttagcgatgaaaaaaaaaaaaaaaaaaaaaaaaaaaaaaaaaaaaaaaaaaaaaaaaaaaaanncaaaaaaaaaaaaaaaa

SEQ ID NO: 4640 - DNA, 1006 bp, Zea mays
cgacacattgtaggtcaaacccaaaatttgatttccacaggtacatgatgcgagctttggaggctgactttaagaaggtggttggcataagctggtacttgtggatatttgttgtggtattcatgttgctgaacatcgggccgggcctcccgggcttttggatctctttcattccccttctgcttctgttggccgttggcaccaagctagagcatgtcataactcagttggctcaagaggtcgccgagaagcactccgcagtagagggcgacttggtggtcaatccgtcggatgaccatttctggtttggccggccaaagatcgtcctgtacctgatccacttcatcctcttccagaacgcgtttgagatcgcattcttcttctggattctgactacctacggtttcaactcctgcatcatggaccacgtccccttcattgtgccgaggctcgttgtcggggccatcatccagctcctctgtagctacagcaccctgcctctgtacgcgattgtcacgcagatggggactttcttcaagaaggagatcttcgatgagcacgtgcagcagagccttctgggctgggcgcagaaggccaagaagaggaaagcgctcaggaacaatggcaatggcagcaatggcgccgcggccgggtcgtcacatccatctgcgactgcgaggctcgaactgatgagacgagctgtcgctcttgaagaaggcagtgccggtggcaacgggagtgaggctagtgcggccgagctacacgacacgggcccgaagctctgaacgctgtagaaaacgcccggcagagcgtcagaagatgcagtgtttctgtacgcgagccatatgtcactatgtcgtgtggctgtttagccaggtggtgtagtgtgatactgcgtatcatgatttgtatgcttttctggattgagcttgaagcgtgttatggagtggggagctttgtgtagtgttgtgctcaaaaaaaaaaaaaaaaaaaaaaaaaaaaaaaa

SEQ ID NO: 4641 - DNA, 974 bp, Zea mays
cccacgcgtccgttcacactgatgcaagcccgccgcgtcgcggatttctggcttctattttgctcccttctgctgggctctggatctggtctcactgtgattgataatcttgggcaaatgagccagtcattgggttacgaggaaacccatatatttgtgtcaatgataagcatctggaactttcttggacgtattggtggagggtatttctcagagattattgtcaaagattacgcatatccaagggcgatcgcattagcgatagctcaagtcctgatggcgatcgggcacttcaacttcgcgatggcttggcccgggacaatgtacatcggcacgctgctcgtcggagtaggctacggcgcgcactgggccatcgtgccagccgcagcctcggagctgttcggggtgaagaacttcggagcgctgtacaacttcctcacggtcgcgaacccagcaggctccctggtcttctcgggggtcatcgcgagtggcatctacgacagtgaagcagcgaagcaggctcagcagcgccacaactccacgtcgctggcgatgagtggcagagtggctggcatggtctctggagccgctccgtcgttgaagtgcgagggcgccgtctgcttcttcctctcatcgctgatcatgtccgggttctgcatcatcgcttttggcttgagcttgatcctggtctaccgcacaaagatcgtgtacacaagtctatacgggaaaccgcgtacttgaaggatcaaccctcaagggacacagggttatcaaagcatacttcaatttttaatttattagtctggtacccccatgcctgtacaggtgcagtgtccgacttccacttgctgtgcccaggttctcaagcaacaatttaacttttcaagaatgtggcctcaaacgggagctttagtatagcgacacatgtgagagttgaaagtccgtctgtggctggactgcgacgctgtccttgg

SEQ ID NO: 4642 - DNA, 1726 bp, Zea mays
  misc_feature (773)..(773): n is a, c, g, or t
  misc_feature (775)..(775): n is a, c, g, or t
cccacgcgtccgcccacgcgtccgcccacgtcattcctcttccgctcagcttcttttcggatgatgacgagactttgtatgcactattgttgccatcacctcggaaagaagaagcaagtgcatcaacatcttctgaggagcaacatgaggttatactcagcgaggtggaggatgaaaagccaaaggatgttgatttacttccagcctcagagaggcaaagaaggatagcagaattgcagacatggttatttcaggcagctgctgttggtgctgtcagggttaagaggaggaaaggtccacggagaggagaggatttcacactgatgcaagcgctcatcaaggctgatttctggcttctatttttctcccttctgctgggctctggatctggtctcactgtgattgataatcttgggcaaatgagccagtcattgggttacgaggaaacccacatatttgtgtcaatgattagcatctggaactttcttggacgtattggtggagggtattctcagagattattgtcaagtaagatgctatgcttctttgattaatagaatgtactttgcatgccatcttataaatattttgttttcaaatgctttttttggcagcatagtcatcttccatcttgacctctattatttagtttgcaaactaaacttgcaatactaatgctattcagtttccaatcacgaattaatcaaaagtataacaccgcactgctcagctcttagtttccaaaatttagggtgttgcttattcacgtcagntnttttcttctcttacactttcgcatccttacaccttttttcagagattacgcatatccaagggcgatcgcattagcgatagctcaagtcctgatggcgatcgggcacttcaacttcgcgatggcttggcccgggacaatgtacatcggcacgctgctcgtcggagtaggctacggcgcgcactgggccatcgtgccagccgcagcctcggagctgttcggggtgaagaacttcggagcgctgtacaacttcctcacggtcgcgaacccagcaggctccctggtcttctcgggggtcatcgcgagtggcatctacgacagtgaagcagcgaagcaggctcagcagcgccacaactccacgtcgctggcgatgagtggcagagtggctggcatggtctctggagccgctccgtcgttgaagtgcgagggcgccgtctgcttcttcctctcatcgctgatcatgtccgggttctgcatcatcgcgtttggcttgagcttgattctggtctaccgcacaaagatcgtgtacacaagtctatacgggaaaccgcgtacttgaaggatcaaccctcaagggacacagggttatcaaagcatacttcaattttgaatttattagtctggtacccccatgcctgtacaggtacagtgtcggtcttcccgttgttgtgcacaggttctcaagcagcatttcaacttttcaagtatgtggctgcaaatgggagcttcagtatagcgaagcatgtgagagtagaaagtccgtctgtggctggactgggacgctgtccttggctcaagttttgctgtatttggttgtgaaaaatttgtgtacacatgtaataagctagagacgtttcgacgcatgtcagagtggagaacatattcttttatgatttgttgaaacttgcgtatttgtatctatcacaaagaaaacagtccaacttgtcaaccggc

SEQ ID NO: 4643 - DNA, 1760 bp, Zea mays
  misc_feature (853)..(853): n is a, c, g, or t
ttggatagttgaatatctgatctatttgagcatctttagttcaaatatcgagtgttgatattctttttgttaattttgtactttcaggcctgagtttctggattgcactgctaggacaagtctagatatgctttctaagcactactatcaagctactggcagctgggtcgtattttttgtcccagaaaatgatgcggacatgacagcttataatgatttcatgagttatctaggtgataagcagcgtgcagcagtctgtaagcttggagagagcagcaccttgtttcttgttccaccttcagatttctcagagcaagtactgagagtgcctggaaatgtcagcatatctggagtcattctgaggtttcagcagtcaaatccagattacagctcaccaaatcgcaaaccattggatagagctcacccatcttctgcaagtaattttaacactgatgtaagaaattgtgaagatctgcatgcactgagaaggctcaatccttcagatatcagcacattccctcagggtccagattatgtctgctcatcaggtggaagctataccccagcaaatgcagattttattccgccctataagccagagagtgctcctccatatgtcgtccctcaatcaccgcaagaaaggccgccagcggagctccctatgggtattgcacaaggccaacaccagcaactcccaaacaggctgccctcaggatggtccaataacctggataatccaaatccaaatccaggttctggtaacttcagtttggcacagggtgcaatctctaacaggacacaggatccgtacacatttgctcctggagtagtatcaactgggacagcttcaggntatgcatcaggtgaagcatccaacagcatgtcctgggcttccatgcaatacaactcacagcaggtagctagatctgatcaacctactattccagtatcactgccacctgatcaacttgcacagctagctgcccttcttgcacgacaaaaccaacctagaaaagttggtttgcctgtggacagctcaaacaatctgtctggattcatacagagtcccaatcctcatggacatgctacaatgatgccaggcaactctggctccatccctatccagaactcactgccacctgttccatctatgcaacaattacatgccaatgtgccagtgtcaccaataggctcgctacctgcaaatccattcaatgtgccgaccagtgctcctgtactttgtaacagcacttcgcctatgctgcccagtcatgctttggtcaacccagctcattcttccatgccaatgagaccgttcattcctccacttcctgaaggtcctccaccctttcagcagcaaacatcaagtgctgtcacagtgcagcctttaggtccttctagccagcagtctagccaacaactactggctcaggaccttgatggagatcctcaaaagcgccttcaagcaacactgcaactggcagcaaccctgcttaagcagatacaaaatcaatcaaatcctggtggccagaaataaatataaggtattggtaaatgtctagctgcaaggatcatcatatggtgccatcctgaggagctttaaacttactgttgtggttttataccatcacctcctgtgatttgaatgtttatgatgagtggtttccttgcaaactacaatctccattccgaattctaagacgttttggctttcttatgtacatggttttttgctatgcatccagatatacattggctag

SEQ ID NO: 4644 - DNA, 2203 bp, Zea mays
cttcctcatccgtcccatcgaaccgcaaaccctaacctttcgattgccgccgcccgccgctcgctgctgcccgccgctcgccgcggccaatgatggcgaggggccgccgcggcccgggtggacgggggaggttcggcggcggcccgctgggcgacgagcggccagtccgtcacggcgtccgcgtcgaggagaacccgtacttcccattaccgcgtcgggcgtcgggctggggagtggcaccgccgtcgcggcacctgtgggtgggtggcctggcgcccagcgtcacggcgtccgacctgtcggagctgttcctccggtgcggcgacgtcgagggtgttgcccgcgaacccggccggaacttcgcgttcgtgagcttcctgcgggagggggacgctgtggccgcggtgcgggagctccagggggctcgcctggctggggcgcctgttaggatcgagttttccaagggggcctgagtttctggattgcactgctaggacaagtctagatatgctttctaagcactactatcaagctactggcagctgggtcgtattttttgtcccagaaaatgatgcggacatgacagcttataatgatttcatgagttatctaggtgataagcagcgtgcagcagtctgtaagcttggagagagcagcaccttgtttcttgttccaccttcagatttctcagagcaagtactgagagtgcctggaaatgtcagcatatctggagtcattctgaggtttcagcagtcaaatccagattacagctcaccaaatcgcaaaccattggatagagctcacccatcttctgcaagtaattttaacactgatgtaagaaattgtgaagatctgcatgcactgagaaggctcaatccttcagatatcagcacattccctcagggtccagattatgtctgctcatcaggtggaagctataccccagcaaatgcagattttattccgccctataagccagagagtgctcctccatatgtcgtccctcaatcaccgcaagaaaggccgccagcggagctccctatgggtattgcacaaggccaacaccagcaactcccaaacaggctgccctcaggatggtccaataacctggataatccaaatccaaatccaggttctggtaacttcagtttggcacagggtgcaatctctaacaggacacaggatccgtacacatttgctcctggagtagtatcaactgggacagcttcagggtatgcatcaggtgaagcatccaacagcatgtcctgggcttccatgcaatacaactcacagcaggtagctagatctgatcaacctactattccagtatcactgccacctgatcaacttgcacagctagctgcccttcttgcacgacaaaaccaacctagaaaagttggtttgcctgtggacagctcaaacaatctgtctggattcatacagagtcccaatcctcatggacatgctacaatgatgccaggcaactctggctccatccctatccagaactcactgccacctgttccatctatgcaacaattacatgccaatgtgccagtgtcaccaataggctcgctacctgcaaatccattcaatgtgccgaccagtgctcctgtactttgtaacagcacttcgcctatgctgcccagtcatgctttggtcaacccagctcattcttccatgccaatgagaccgttcattcctccacttcctgaaggtcctccaccctttcagcagcaaacatcaagtgctgtcacagtgcagcctttaggtccttctagccagcagtctagccaacaactactggctcaggaccttgatggagatcctcaaaagcgccttcaagcaacactgcaactggcagcaaccctgcttaagcagatacaaaatcaatcaaatcctggtggccagaaataaatataaggtattggtaaatgtctagctgcaaggatcatcatatggtgccatcctgaggagctttaaacttactgttgtggttttataccatcacctcctgtgatttgaatgtttatgatgagttctaagacgctttggctttcttatgtacatggttttttgctatgcatccagatatacattggctagaaaacgttgaaaggtcttttaagttggaatggagggagttagctgttgcctgcatttgtttgtttgcctggcttgttccaagaggtatgatggtatg

SEQ ID NO: 4645 - DNA, 2696 bp, Zea mays
cgcttggtatgcccttcggcttattatacgtgagcacgtacctttcatgcgtcatcgaatctgtgcaaaacgtcgaaaagtctggtgttaagcataattacagaatcggcaaaatagatctgtgcacctcagcgtcttttcttggtattcttgctttctcaaaagcttcacgacgaagaaagagaaagagaagggttcttcaaactcaaattgtgcgccaatgctgttacggatcaggacggggaaacgatctttttttttgaagaaaagaacaagggtgcccatgctggttgcattgcagctcagcaccagtacattgtttggacgaccaaccacaggagtccaggactcggagaaccacacccacccggcgcccctctctcccaagtccgacgtggcaaagccatcctcccgccagccgcggtcgcctttgaccggaacgtctatcttgtcgccgagagccacgcggagtggttccacctgtcattcagacgccaataacttttctagaaagaagccaataactcagtcccaaattaaaatttgttgtagttttaggtccatcgttatccatttaaatataaataaaaaagctaaaatctattttgggacggagggactattataaagacacatcccaaagcggcctctcgccgcaccaacagccaatccacacctcgcttgcgttgtcctcgccgcggcctcgccctgattcggttcccccgttcctcgcctctgtcatcgtctcctctgacccaaattgagccaagcgaagccgtggccgtgatccggtccatgcgcggagcgtggtagccggattctatcgccgtcgcctccccttcgccgctattttccagtcgccgggatcagccgagttggatctcgaggcataaagcgttgcgggcgcccggcgaggatacgatgcctgcggtgctcgccgcattcgctacccttcgagccgccgctgccatcgcctccggggactcctccttcccctgttcccatcgtctcaagcatcgttttagtagtagtaattttagtagtagtaattgtcattaacctttgcgttccctccgtcgcgcacgctcctcggctcggtcctcaccttcgcatttcggttttggtctggttgtgctcgatccgaggcttactttggttttgcggcttctctccttgtcgaagcttggtgtctggattcgacctgcagatcggaaggaaccaaggtggtcattatcacctacaagatagggggtttctctatcactctgctgttgccatggaaccatttattaggttacaatcgtgaatcgtgggaactggttccgaattctgatgtttagatcattgtataggtgacatttctgtgtgatcctgtcagtacgtaaattggtatatgcaatttcctagatctttcatcaaacaaaataagaaatagttgtctgaaaccagcctatttttctgtgtccatgattgtccctctgatcaacatcccactacttgctgttttaggtgatccaagggtgtagagattccaagcattttaaaaatagtcacaccaaaaaaaacatggctaagacgatacctttttatggatctcatcatcttctggtagctgtgctcctaggttgaaaaacaaatatgcttgaaggctcaaatttcagcaaaatatgttaatgcatatggttgtgacatcatctatttctccattatagttttcataattctatccagtaattgtgcgagaacccttatgcagcccttgtatttgcatacaaattgtttattgcttatgcacatccctcaaaacaagagaaatttctctttgtaatttgggatcaagcttgtggatggacgaaccctcggtggacttcagtgctgaaggtgttagcagcagatcaggtctctgccaaagcacctgtttaaatcctggttgtaagcatgaccgtgcttgctgggaagatgattatgtcaaggctgtaatatctcatgggcaagatgatttggcggtcgatgaaattggattggctcttactgaagtgatgcatgcatatgatgatgacaaatggtcaagtctgtatgaagattttgacgacggtgtcggcgatgaaccaattcttcctctggaatctgattcaactggtgattttgtggacattgactccgcatcacctacctttcctagtgacgatgcaatggaatcatcatttaccaattcatttgctcggaattgttcaattaatggcactccaagtttagtttctgcaatgaaaggaacacgtgtgaagaagggaatcacgacaaagttgagcgtttcttgggcccctgatgtatacgaccctcctattacttctgactcgcacacggtgaaagggcaccatacgagttcaactaagggtaactacaaatacaagacctccaagagcagcagtaccactagaaggaaaaaggacaagaagcattctaggcacagtagtagcaatggaggtggtagcaaaagagacaagaagcattcttaccgcagtagtgccagcagcagcagagctattaccagtggttctcaatattgtgacgcatacagtggtggtggcatcaacagcagaactgttcctgaatctgccaagatatctccattggtggtagctgaaaatgtcacaccgcaagagatggttcctgtacctgcccgggcggccgctcga

SEQ ID NO: 4646 - DNA, 4482 bp, Zea mays
aaaaaaaaaaatacctttctcggccttttggctaagatcaagtgtagtatctgttcttatcagtttaatatctgatatgtggaccatgtgtttacttcgatattaaatttattttttgtgggggagggctcactacagtagcttgctactggggtcctcacgtgttgtttgggcgttcccggccggtcggcccggggcgcgcgggccgcaccaacagccaatccacacctcgcttgcgttgtcctcgccgcggcctcgccctgattcggttcccccgttcctcgcctctgtcatcgtctcctctgacccaaattgagccaagcgaagccgtggccgtgatccggtccatgcgcggagcgtggtagccggattctatcgccgtcgcctccccttcgccgctattttccagtcgccgggatcagccgagttggatctcgaggcataaagcgttgcgggcgcccggcgaggatacgatgcctgcggtgctcgccgcattcgctacccttcgagccgccgctgccatcgcctccggagactcctccttcccctgttcccatcgtctcaagcatcgttttagtagtagtaattttagtagtagtaattgtcattaacctttgcgttccctccgtcgcgcacgctcctcggctcggtcctcaccttcgcatttcggttttggtctggttgtgctcgatccgaggcttactttggctttgcggcttctctccttgtcgaagcttgttgtctggattcgacctgcagatcggaaggaaacaaggtggtcattatcacctacaagataagagaaatttctctttgtaatttgggatcaagcttgtggatggacgaaccctcggtggacttcagtgctgaaggtgttagcagcagatcaggtctctgccaaagcacctgtttaaatcctggttgtaagcatgaccgtgcttgctgggaagatgattatgtcaaggctgtaatatctcatgggcaagatgatttggcggtcgatgaaattggattggctcttactgaagtgatgcatgcatatgatgatgacaaatggtcaagtctgtatgaagattttgacgacggtgtcggcgatgaaccaattcttcctctggaatcagattcaactggtgattttgtggacattgactccgcatcacctacctttcctagtgacgatgcaatggaatcatcaattaccaattcatttgctcggaattgttcaattaatggcactccaagtttagtttctgcaatgaaaggaacacgtgtgaagaagggaatcacgacaaagttgagcgtttcttgggcccctgatgtatacgaccctcctattacttctgactcgcacacggtgaaagggcaccatacgagttcaactaagggtaactacaaatacaagacctccaagagcagcagtaccactagaaggaaaaaggacaagaagcattctaggcacagtagtagcaatggaggtggcagcaaaagagacaagaagcattcttaccgcagtagtgccagcagcagcagagctattaccagtggttctcaatattgtgacgcatacagtggtggtggcatcaacagcagaactgttcctgaatctgccaagatatctccattggtggtagctgaaaatgtcacaccgcaagagatggttcctgtactgaagacactggaaccaatcaaatgtactaccagctgcggcaaagagaagccatttgccttgctgtcgcgccagttttcccctgcaaggtacaaggggatgttcaccttttggaaccaaaaccaactggcttcttgacaatttgctatgcggaagctcacctgaaagtttccttgccaagggctgttcggatcccctccaaactttagagcttcaaaaattttagagcattttagctcacttttgaactctaaagctctaatctaaggttgaccaaagtttagatctaactgagctttacctctaaagtttagagaaggaaatctaaacatgctctaatttgattgtatcaaagattgttgctattgttctcttcgttaccatgtttgtttcgcctgtctgaaacttcagagatcatgttttggaaaattgcttggcaaagtgcttgtgttgtattatttgcacacctacattgtaggggctgattcagtcttctgtgcttttgttatgttgtatcacgacataggttgatttattaggagatttgtttggaactatggaaaacacgcatggaacaacatgtcagtatttgtaaaaaaagagtcgctcattgcggtgaagttgaagaagttatcaagaggcaatagcgcagttagtcaaacatgaaaatagcagcagcagaagaaaattattcttcttatggcaaaaggtgtcctaagaaagaacaaaaccaagaaatattgctactgtcacggctaaagaagctcaagtggtttttgctcgttcgcttaccgttaccgggcaccaccaacgccgaatgatgcttgctgctgccctagtccatcccgatgttatcgttcaagtcgaagaatgaaaacatgccagcgtcggcgaaccagttcacgtcagaattcacatcgccgatgaagtgtgcgtcaagatcggggacataatcggggcagcggagcctcggccggcgctggttgctgattgccatgtcacatgtgacgcggcgacacaatcactcaatcagcgaataaatctccgagccgcaaaccgtcagggtaaccatgcaacaacctaaatatcccgttgcaaatggacggatatatctctactactctataaggaggtaacgtgggcgtccaccgtgcccccgcccgtgcgtccccactcccgcgccgacagcggcacagcgcccctggaccgccgcgcgatctcctgccccgccccgtcgtcaatcccgtccgccgcgcccgccaagtcttgagatcgagcagatccgccatcccgcgccctcgcactccctctccaattggcttggcgtgtgctcgtgcggcggtcgaggcggaggcacctgcgtcgactccaaggaggagcaatgcctcctctagatccaggagtccaaggcggctgtggagtacgtcattgctgtcctcatcatccaccatctcatcgctctcgctctcgcactccctctccctgtagctccacttgcaagtcaccaccagatctcccatcccgcggctgcgaggaggtcgcccccgccccacttcttcctcccccacgacacctctttgccgccgtcaccgcgctcccgacgctccgcttcttcgcgttggaggaaatcgacatcgacgctgccgccgtcgttgggctcggcctgaaggatctgggtcgatagggtacactggtggccgccggactttgctggatggcgcagaacctcgacggcctcaggcttgatagcgtcgaaggagttgatgaggatggcttcggcggcttcgcggcagcgcacgacgaggtgcagcatcaccacgtacgatgggtcgaaccggtcctggagcgacgagacgatgtcgggccctaggatgggcacacagccgggtagacgcaccggctcggccaggtctctgaactcgccgggcaaggaggcagccagctcggagaggtggacgacgagcgagagcatgtggaggttcatgggcatgaagaggcaccgcgcggacacggcaatgtcgcgtgcggtggcgaaggaggtcgtcctgaactggttggcccgaacgcgacaaggtgggttgtgtcgcggaactccacgagcagactcgcgagcgccgggagcgagcgtgcatacttctcagtcatgactcatgagctccatgacgcctcatcttcctcaagctccacggcgccctcgccctcgcgagctagcaacaccctcctccctgtcgtctttgttcatctccatgacacttttggatgcgtacgccaagaccagccgccttgagctggtgctgcaggtgctcggcgaaatgcctagcaggaacgttgtctcgcggaccatgcctgtcgcctcgctggtgagtggtggccagtggcactacacgctctttcctccagtgtggcccacgactcccatgcctacacggtcatgctcacggcaatgtcctcgtcctcgtccaagaagtctaacttctttggccacgcgtgggatagagcacgtggtaaaccatgtctccctgccttgcacacacatgtctagctatcgccatttctgcaaccttttcatttcttttctgtgatctgctcatgagaaatggaatatcgtcacatcgagtttgtccatcctaacaatgagttcactttgcaggcaagtctgacgttgaaaggatctgcaaggaagtcttcgaggacctgtcagacaagaacacggggctcctggacatcacaacttttgtagcatgatttattcatacagttcattttttcttgttcagtagtcagcacgttggtctaaaattccagtttcagtaagc

SEQ ID NO: 4647 - DNA, 1770 bp, Zea mays
  misc_feature (213)..(213): n is a, c, g, or t
gctgggaatcttcattaatgtaggtttctaatttactttatagttggattctttcattttttgcatatatttgtgatcagatatttgctccgcattcatattattctgataccaagttactggtagctatgtgactattttcaatcacagtagctttcacaattagggacttaatcatatatgttgattttgtatagttgttgtctgtgtttnagcaccttatataacggaaggacactttagatttgatttcttttatttgtcctcctgtttggcagattattcttttgaaccaattgatgatgctatttctatttttgtgaagcttaatttgcgggagttgataggttttggtattgttcttatattgcaattatgatttcttactcattatagctagcagcatctttattggttcttttatttgaatgagcaacgagtgtagcatctcatggcatgcggacatggggtggttactctcatattttgtcaactgattatgtgaaagaaattatggatcaatcttgttttgctaacatgtatgtaaattatcttcttgcagggcactccaaggttagtttctgcaatgaaaggaactcgtgccaagaagggaatcaaaacaatctgctgcgttgcccccccccctgatgtatatgacccacctattacttcagactcgcacactgtgaaagggcaccgtaagagttcaactaagggtaactacaaatacaagtgttccaagagcagcagtagcagtaaccacagtaccactggaagcaaaaaggacaagaagcattctaggcaccgtagcagcagtgggggtggcagcaaaagggacaggaaacattcttactgcagtagtgctagcagcaacagtagcagagttgttaccaacggttctctatatggtaacacatgcagtggcggtgggatcagcagcagcagaactacgatatgtgttcctgaatctgccaaggtatctacattgatggtagctgaaaatgcgacaccacaagagagagttcctgtattcaagacaccggaaccaatcaaatgtactaccagctacggcaaagagaagccatttgccttgctgtcgcgccagtttccccctgcaagatacaaggggatgttctccttctggagccaaaaccagctggcttcttgataatctgctatacggaaagctgctatacagaaagctcacctggaagtcttggttgctaattaaattgcactgcatttgtgattgttttttggtgtcgttctcttcgttgccatgtttcttttgcctgcgtctgaaacttcagagatcacgttttcgaaaattgctcagcgaaatgcttgtatatttgagtttatgttgttactatttcctcaccgaatcgtgtaattcgcttatcaatttcatcatgtgttttgtattattccatttgagatcatgcactattatttccacacctacactgtagcaagggactggtttagtcttctgtactttggttattatgttggaattgcaacgattacagtaaatgagaatgacatcacctgatgcttaggacataagacatgttgatttattccaaaacttgtttggaaatctggaaagcattcatggaacaacatggcagtgtatttttaatttgttcaaacctcgttttctaagaaattcacctgttgcggcgaaattaaggaaagtaacaagagcgcgattaagcgaacataaaattagtctaagggctagtttggatttaagtttccaaaatt

SEQ ID NO: 4648 - DNA, 2654 bp, Zea mays
ttatttgataatttctattctattctattcatttcatgcaggatgagctggacaacatggccaaaacctatcctggtcgctttaagatctactacgtgttgaatcaggtttttgtgtcacaattttttttagaaaatgtaaagatattactgtatcaacgttcttggcttcttgtgtaggaatacattattttttgtttataaaaagaacaatgggctctactgtttcaaactttccatttgttggaagtctttagatatgactgtagaattcctgttataactaaaacaatatcccaatgtacatccttgctatgttgttctctattttctgatgttattatgctgagaaatctgctttacattatactaattagcgtattgtttccaaaaaaaacatttgattttacatatgcagcctcctgagaactggaatgggaatggtggtgttgggtttgtgtcgaaggaaatgatccaatctcattgtccagcgcctgctaaggacattaaggtgaatcaggcttattgccttttctttcagttcactatgaggattgtcatgatttctctattcttgtatgattgtatctaacctggaatcttacatgtgtttcctatttcagatcctaaggtgtggtcctccttcgatgaacaaggccatggctgcacaccttgacgagctcaactacacgaaggagatgcagttccagttctaagcaacgctaagtttgcatataataattagtgaccgacatagtttgccggtttttcgttgttttttaattgggttttcattgtttttaacaaaaatgttgattaattttaaaaataaaaataagatatactagaaaaatatttagctatttatcataatttttccagttaaatatttttctttctttttttttttaaatttaaacaaaattttaaaacaagttctgcattcttcgatcggctattatgtaggcatgtgcaatccttctttggggcacgaatgatcaccaggaagcacctcgggtgtttccatatattgctggaagaatctctatccacggatgttgtattgtataccgtccaccggccagcagcggaaaggcggtattattctatcgtggaattgtcttgtcgtatgcttgtccttcacgaagctgtgggctatagagctgaagcttgccagattagactttgaaaactgctagtagttagttacttgcacgcaaccggtttatcatgtataccatcaaccgactcttgtgtattttttgttccttgaaatcgaaataaaacttatccatgtctcgcctgatacgctcttcgccttatttataggtgggtggattgattgtttctatcctcacgtacctttcatgcatcaccggatcggtgcaaaacgtcgaaaaggaaggctgttgctgagcatagtgacatgacagaatcggcaaaaacagatacgagcacctcagcgtctagttcgtcttttttctcaagggcttactcggcaagaaaaaaatgtattataatcttgcttggaactcaaactgtgcgagtttggttttggacagcgccagttttgtttggacgagcaggagtgtagggctcgaagaagcacacccggcactcacctctatcccaaatccgacgtggcgaagcctcccgtgctgcaccctctcgccagccgcagcccgcaggtgcctcctcgaacgctctcgccgccgaggactacgcggagtggccccacctgtcattcagacgccgccgataacttttttagaaaaaaaagaatccgagccccgcctataaaaccacttccgtttgtccggttcctctggtcccagtaccgtctcaccgcctactgggacccaacaatccggacccacatgtcagagaccgaaataaactagcataagacacacccccaaagcggcctctcgccgcaccaacagccaatccggacctctcgcctcctctctcgcgttgtcctcgccgcgccctgctccggttccccaatccttcgcatccttcgttgtgcctaccgtctcctccgagccagatcgatacaagcggagccgtgatccggtcaacgcgcggagcgtgttagccggattctctcgccgtcgcctcccctcccctcccgccgccgtcaccgccgtttctggttgaccgggatcagccgagttggatctcgaggcgtgaagcgttgcgggcgcccggcgaggatacgatgcctgcggtgctcgccgcattcgcttgcctccgactccgagcggccgctgccatcgccttcggggactcctccttcctctgctcccatcgccttaagcatcattttagtagtaattttagtattagtaattatctctgacctttgcgttccctccgtcgcccacactccctcggttcttagctttgctttcgttctggttgtgttcgattcgtggcttctttggctctgtcgcaggatcgaaaggaggcaaggtgttttaacgtggttattactacctacaagataacaggtaccaaactcacaaagctgttactatggaatcatttattaggctacatataatcatgtaaatgttactgaatttttatgtttagagtataattgtatgaaatatttatatgcgcgcgaatattgttcttatatatttcgca

SEQ ID NO: 4649 - DNA, 1907 bp, Zea mays
tctcgcctcctctctcgcgttgtcctcgccgcgccctgctccggttccccaatccttcgccccgcctccgttgcctaccgtctcctccgagccagatcgatacaagcggagccgtgatccggtcaacgcgcggagcgtgttagccggattctctcgccgtcgcctcccctcccctcccgccgccgtcaccgccgtttctggttgcccgggatcagccgagttggatctcgaggcgtgaagcgttgcgggcgcccggcgaggataccatgcctgcggtgctcgccgcattcgcttgcctccgactccgagcggccgctgccatcgccttcggggactcctccttcctctgctcccatcgtcttaagcatcattttagtagtaattttagtattagtaattgtctttgacctttacgtttcctccgtcacccacacccccctccggtttcgttctggttgtgttcgattcgtggcttctttggctctgtcgcaggatcgaaaggaggcaaggtgttttaacgtggttattactacctacaagataacagaaacttgtatttgtaatttgagatcaagcttgtggatgggcgaaccctcagcggacttcagtgctgaagatgttagtagcatctcaggtccttgccccaacacttgtttaaagccttgttgcgagcatggttgtgcctgttgggaagatgaatatgttgaagcagtaatatcttgtgtgcaagatgatttggcggttgaggaaattggaatcgctcttacagaagtgacgacgatcgatctgttggcggttgacgaagggtcaggtctgcatgaagattctgatgacgattacatcgatgatccaattctttctctggaatctgattcaactgatgatttagtgaacgttgattttatatcacctgcctttcctattggtggtgtaacagaatcatcaattagcaattcagttgctgggaattcttcaattaatggcactccaaggttagtttctgcaatgaaaggaactcgtgcgaagaagggaatcaaaacaaagctgagcgtttcatgggccactgatgtatatgacccacctattacttcagactcgcacattgtgaaagggcaccgtaagagttcaactaagggtaactacaaatacaagtgttccaagagcagcagtagcagtaaccacagtaccactggaagcaaaaaggacaagaagcattctaggcaccgtagcagcagtgagggtggcagcaaaagggacaggaaacattcttactgcagtagtgctagcagcaacagtagcagagttgttaccaacggttctctatatggtaacacatgcagtggcgggtgggatcagcagcagcagcagaactacgacatgtgttcctgaatctgccaaggtatctacattgatggtagctgaaaatgcgacaccacaagagagagttcctgtattgaagacaccggaaccaatcaaatgtactaccagctacggcaaagagaagccatttgccttgctgtcgcgccagtttccccctgcaagatacaaggggatgttctccttctggagccaaaaccagctggcttcttgataatctgctatacagaaagctgctatacagaaagctcacctggaagtcttggttgctaattaaattgcactgcatctgtgattgttttttggtgtcctcctcttcgtcgccatgtttcttttgcctgcgtctgaaacttcagagatcacgtttccgaaaattgctcagcgaagtgcttgtatatttgagtttatgttgttactatctcctcaccgaatcgtgtaattcgctttatcaatttcatcatgtgttttgtattacaaacaacatccaataaccctaaaaaaaaaacaccacgcgtccgcggacgcgtgtt

SEQ ID NO: 4650 - DNA, 1994 bp, Zea mays
  misc_feature (159)..(159): n is a, c, g, or t
  misc_feature (1243)..(1243): n is a, c, g, or t
cttgcgccagagccagctcagcagaatttgtccatctgtagcaatcgagacacaagttaggagccgcggaggccaccaccctacgtgcggcacccataaacggcctgaaggggaatgtaggaagaaataagaacactactacgggctgaacggaccgangggaaatattagaaagcatatcagccgatcgattgaccctgacctgactccgaatacactgggctctcccccgatctgtaagtcttcctctcgctcctgcttgcttcctcatgtgttatctgacacactggtatatacatatatcatcatcattatatacatggatgcatgatgtgcagcaagtgccaagtactgatctcactagtgaaaggatatatacaatagtttaatttacagttaataacccaccaactcctagtgatgatcaccgatctgtgtcatcgatcttctctcccagaagagaaatggatcagatgatccatgagaaagaagaacatcatgcatgatatgagtaacaaaaaggtagctaaggtagagagaatggatggtgggtagatatgccaatctaaaccaagctctcacacaaaccttcctatagcaaagctagagctagctagtccctgataattatccataattacaagcaagtccacctcctctctctctccctctacttcctggcctccggcgcgccgtccgtcgagggcctgtccaccttcctgcggcgcgccccgcccacgatcggcttgggctccgaggccgcgtagatctcggcgatcaggcggtagcgcctgttcctgcgtggcctcccgcgcacctcctgctggtccaggtcgtcttcgtcatcctccgccggggcggctaatagcccagcaggaggaggggtcgcaggcggcggcggcgcgttgacggagcgcggggacgaggtggaggaggccgacgcgacggatccccgcgggagggcggcgtaggaggaggagctgctctcgctgaggtggatgagctgctccgccgccgcgagctcccgcgccgtgaaccgcgccggggacggggcctgtgcgtcggccatagccgcgcgtttgacagatcgatcggtcggtcgcccgacgtccggcggaggtagggaggtacggtgtgtgcgaggcacgagggttggcctccggctaacttcgcgtgttccccctctctaatttgctgtgttttttttcgtttctcttttttcctcggccttggttgatttttncgggctacccggcttgcgaaggttaatcgctcgccgcagtagagggcagggcatttgtgatggttggctgctgcggcgcgagcgtgagttggcgcagatcgcgaaaaaataaaaactggagggactttccagaaaacgaatggtttggcagagacgatttgcctatcgtgcggaccaagggcacggattccgtgcgcgcctgtgcggcgacgtatcgacgggttcgtcggggaggggctgtcccattgctttcgcaaattgtgcagagcgtcaggtggtttgtgaaaatgtcggtgcggcggcaggattcgggtagaatttgggccacgtactcgcggggcgcacttgtcgtggtggtggtgcgcggcacccgcacgacgcaaccttcagccagcccaggcgcccagtcagccaaccgctcgccctccgccaggcagcccaggctagctagctgctgctaatagttctcgcggtcacggtgtcacgtgtcagtctagtttcaacgcaaatctacctaggtatcaactttacattaaccctactatcaatttcagtccgcacttatctatcataatttcatagcgctctaattcacaaaatttagtccgttggcataaaatatgtttttttaaataaaacacatccaattacgtaattaaggaaataaaagtattatttataaaaaataatttaaataaatataacgtaactataataataaaaaagatcatagttcagaaaatataactaa

SEQ ID NO: 4651 - DNA, 909 bp, Zea mays
gcacgagaccattacctagaacatcctaatcgaaaaaagagccgtcgaagccgaagcagagcacgacggacaaaaatatggcagggaaagccggcggactcaaaggggttgccctcatcggcggcagcgccaacagcacggtcgctggggtcattcacttcttcgaggacccctccaccaggtacaccgaggtgaggggcaaggtcacgggcttgactccgggaaggcatggattccacatccacgtcttcggcgacactaccaatggctgcaactcaaccggtccccattttaaccctcataataaaccccatggagctccatttgacgacgaacgacatttgggcgacctgggaaatatagtagccaatgaagatggagatgcagaagtgttcataagagacttacagatttcattgagtgggcctcattccattctgggaagggcagttgttgtacatgctgatcctgatgacctagggaggggtggccatgaactgagtaagtcaacaggaaacgcaggagctagaattggatgtggtatcattggaattcagtcatcagtttgacaaataacggcttagtagcaccagaaaaagagggggtcatgattccacagtctgtgcaatgtgctggttcagggacatggaaatggtgttcgttgttctggaccgtttgaagactaaatatctccagccatgtatacaataattttgtcagtgagaggaaattgcttgtaaaatcttgtattgacttatatcactggttaccagcagcaataagtctatatgtaaaacttctcgatttgtatatcagctatgtttcgtgtggagaagggaagcgaacgcaagtcagctttttgtgagtgcattccgttcagttcttacttggtcaaaaaaaaaaaaaaaa

SEQ ID NO: 4652 - DNA, 848 bp, Zea mays
ggaagccgaagcagagcacgacggacaaaaatatggcagggaaagccggcggactcaaaggggttgccctcatcggcggcagcgccaacagcacggtcgctggggtcattcacttcttcgaggacccctccaccaggtacaccgaggtgaggggcaaggtcacgggcttgactccgggaaggcatggattccacatccacgtcttcggcgacactaccaatggctgcaactcaaccgggtccccattttaaccctcataataaaccccatggagctccatttgacgacgaacgacatttgggcgacctgggaaacatagtagccaatgaagatggagatgcagaagtgttcataagagacttacagatttcattgagtgggcctcattccattctgggaagggcagttgttgtacatgctgatcctgatgacctagggaggggtggccatgaactcagtaagtcaacaggaaacgcaggagctagaattggatgtggtatcattggaattcagtcatcagtttgacaaataacggcttagtagcaccagaaaaagagggggacatgattccacagtccgtgcagtgtcgtggtttagggatatggaaatggtgttcgttgttctggaccgtttgaagactaaatatctccagtcatgtatacaataatcttacagtcggtgaggaaattgcttgtaaaatcttgcattgacttatatcactggttaccagcagcaataagtctatatgtaaaacttctcgatttgtatatgctatgcttcctgtggagcagggaagcgaacacaagtcagccttttgtgagtgcattctgtccagtttttacttggtc

SEQ ID NO: 4653 - DNA, 3214 bp, Zea mays
ttttatagggaaaacgaaatattcagaaaattttctctcactgtaaacgcagcccctctcctcaaatacaatatggcaacacatgtactactaataaacagagaaaagacgacggaaacgtcccacgcacgcaataccacttgctgggtacatgcttctcaacagcccaaggtgcaagaaaattttcacagtttttttttgaaggaagggggcagggcacaagcagcaggcaccaaaaaaggccggtcatccatgccctcttccggtcttcccctacctataaataccctccaccaggcccccagactccccaccaccgcaggcaaagcttcgggcaacaacagcttgctcgactcagcgcccttctatctctcttctcccccgcctgtctagccagcggcggccaccaccaccgttcagttattatagcaagcatgacgaagcacggcgtggtgatcggcccggaggacgtcgcggcggcgcggcatttctcgttcccgccgccgaggacggcggcgggcggcgagtcgtgcaggaagctggcggcgcaggtggacctcggccccgccgtcgtggggtcctggctcgactccatgaaggcctcgtcgcccaggcacaggctcatggcgcccgtgcccggcgccgccgacgcggagcacgacgactggatggtacgtgcacgcgggccagcccatgggcggcgccgaaacgaaacaaacgcacgcggaactaagaaatcgacccgtttttggtgcaggagcggcacccgtcggcattggaccgcttcgacgcgctggcggcggcggccaaggggaagcaggtcgcggtgttcctggactacgacggcacgctgtccccgatcgtggaggaccccgaccgcgccgtcatgacggacgaggtgtccgggctcttcttctctcttccgcctctaaccaaataccgcagttattataagatgggacgagaaagcagagcacgctctgcttccaggtcccgacgaccacgccaaagagatgaggattcccttgctctgacgccgacgatgttgtgaacacgcagatgagggacgcggtgcgcggcgtggcggcgcgcttcccgacagcgatcgtcagcgggcggtgccgggacaaggtacacgcactccccccattcgctcgccttcctctcccctcatcctctcaccgccacacaagaggcctagtaaaatccagcggccaccgcccaccgggtagctcgctcgctcatcaggatccgcacgggacaggtgaggcgaggcgacccagctagaagctcctcctccacttggcgtggcgggacgggagctggcctggggcgcgtggcccccgttttctcccctcctctttttttttctttttcttttggcactcaccaactcggcgcgaaagtgacggccacgacggcgacgctgaccgacgtgctctcggctctcgcgcaggtgttcagcttcgtgcggctagcggagctctactacgccgggagccacgggatggacatccgggggcccaccgccgacgccaaccaccaccacggcaacggcaaggtataccgtcgtacgacctttccgaacttacatcaccatcaccccccgccggtcgcccccccttcctcccattctcgtaagctgaccgtccgtccctgcaatgcaccaggcggaggcggaggcggaggcggtgctctgccagccggcgagcgagttcctgccggtgatgcaggaggtgtacgcggcgctggtggccaaggtggagcgcgccatcccgggcgccaaggtggaggacaacaagttctgcctgtcggtccacttccgttgcgtggaggaggcgtgctgggccgcgctcttcgagcaggtccgcgccgtgctgagggaccacccgggcctgcgcctcacccagggccgcaaggtgctggaggtccgccccatgatccgctgggacaagggcaaggcgctggagttcctgctccacgccctcggcttcgccgccgacgccgaccgcgacgacgtcttccccatctacgtcggcgacgaccgcaccgacgaggacgccttcagggtgctgcgcgcgcgcgggcacggcgccgggatcctcgtgtccaggttccccaaggacaccagcgcgtccttcacgctacgcgaccccgccgaggtcaaggagttcctgcgcaagctcgtcggcgccaacgacgacagctgatgatccggcccgcgattcgtttccctttcccgccgtgaccagctccgatccgcctgtgtcaagccgctaactcaacctcggctacctacctgctgcaccggcagagggcttccttgttgttgcaactgcatctccatcgagcagcttgctttgggacaagaacagacctagctagtagtacagtagagcccttttgtatcttcgttttttttttggtttccatctctcttgttcatcatgcatgcctgctgttgtttaccatttgcctcggctgaaaaggcttgtattttcggcgcccttcccgcgaggcactgtaactagttgctttgtctgctgtacgtacgcgtaccatgttgaaataatatgtcatgttgaggagctaaaaaaaaaaaaaaaaaaaaggccccgtgtctcagaattcgatcggcggctagctcccctgctaacgttaattctcgacagattcgattcggccacgacgatcattctgtggacgtcgtctcgtccatcatcagatcttaatctttaacttttcgaagagaggggaaaaaataatgttcactgtggctgctacttttggcatttgtcggtgtacagcggcaagaaaccgaaaacatggaagaggccaatggccacgggccacgggcacagcacagtgctgcagcttatgatttatgaatgcgatgcgacgtgcgtttgtgaaaggctttcagaacagcaggtcccaactcccaaacgaacatcgtatggtgcccacggcgacccgatcggtcgatctccacgccagaaaatggggaaaacaccgtttaaggttagtttggaaactccattttctaatgagatttctgttttcccttgaaaaacatggtttctaaactagccctcagagtttgaagtttatctcgtgtaattacattctcaccccatgtgtaatgggtcaggcctagctaacatgatctattaatataacatccaacccttaataagaattatgatttcccaca

SEQ ID NO: 4654 - DNA, 1880 bp, Zea mays
  misc_feature (75)..(75): n is a, c, g, or t
  misc_feature (134)..(134): n is a, c, g, or t
ctctcactgtaaacgcagcccctctcctcaaatacaatatggcaacacatgtactactaataaacagagaaaagncgacggaaacgtccccacgcacgcaataccacttgctgggtacatgcttctcaacagcncaaggtgcatgaaaattctcacagttttttttaaaggaagggggcagggcagggcacaagcagcaggcaccataaaaggccggtcacccatgccctcttccggtcttcccctacctataaataccccccaccaggcccccggccgccccaccaccccgggcaaagcttcgagcaacaacagcttgctcgactcagcgcccatctatctctcttctcccccgcctgtctagccagcggcggccaccaccaccgttcagttattatagcaagcatgacgaagcacggcgtggtgatcggcccggaggacgtcgcggcggcgcggcatttctcgttcccgccgccgaggacggcggcgggcggcgagtcgtgcaggaagctggcggcgcaggtggacctcggccccgccgtcgtggggtcctggctcgactccatgaaggcctcgtcgcccaggcacaggctcatggcgcccgtgcccggcgccgccgacgcggagcacgacgactggatggagcggcacccgtcggcattggaccgcttcgacgcgctggcggcggcggccaaggggaagcaggtcgcggtgttcctggactacgacggcacgctgtccccgatcgtggaggaccccgaccgcgccgtcatgacggacgagatgagggacgcggtgcgcggcgtggcggcgcgcttcccgacagcgatcgtcagcgggcggtgccgggacaaggtgttcagcttcgtgcggctagcggagctctactacgccgggagccacgggatggacatccgggggcccaccgccgacgccaaccaccaccacggcaacggcaaggcggaggcggaggcggaggcggtgctctgccagccggcgagcgagttcctgccggtgatgcaggaggtgtacgcggcgctggtggccaaggtggagcgcgccatcccgggcgccaaggtggaggacaacaagttctgcctgtcggtccacttccggtgcgtggaggaggcgtgctgggccgcgctcttcgagcaggtccgcgccgtgctgagggaccacccgggcctgcgcctcacccagggccgcaaggtgctggaggtccgccccatgatccgctgggacaagggcaaggcgctggagttcctgctccacgccctcggcttcgccgacgccgacgccgaccgcgacgacgtcttccccatctacgtcggcgacgaccgcaccgacgaggacgccttcagggtgctgcgcgcgcgcgggcagggcgccgggatcctcgtgtccaggttccccaaggagacaagcgcgtccttcacgctacgcgaccccgccgaggtcaaggagttcctgcgcaagctcgtcggcgccaacgacgacagctgatgatcccgcgattcgtttcccgccgtgaccagctccgatccgcctgtgtcaagccgctaactcaacctcggctacctacctgctgcaccggcagagggcttccttgttgttgcaactgcatctccatcgagcagcttgctttgggacaagaacagacctagctagtagtacagtagagcccttttgtatcttcgtttcttttttttggtttccatctctcttgttcatcatgcctgctgttgtttaccatttgcctcggctgaaaaggcttgtattttcggcgcccttcccgcgaggcactgtaactagttgctttgtctgctgaacgtacgcgtaccatgttgaaataatatgtcccgttccccagctcctagtcc

SEQ ID NO: 4655 - DNA, 1689 bp, Zea mays
taattaccggtgataacatagcgatatttagttattaccggtaattactggagacggtcggatgaagtttaacttaggtgatgaatagcatatatattattatgtgtacatatatatatacattttagtaactaatgttttttgctacgttttacacgtggccttccaaaatgccgtgacgctcctgcccccatcgcaaacgacatggccttctggttcagccttgacgtctggcgcacaacttgctggatcctctgcatgcagatcaagaaaccaagacagttatatcggtatcctatccaattaattacaaggtcaaaaaatcctcctggaaacagagagattacggatgggttattttgagctgaatgagtcatgcatccaaccttatcatcgccgaagaactgcagctgaatcttgtgctgctgcgtgtggtgatgatgcagcctgccgccgatgagaaagacgcaggcggtggcggctgcgaccccaaacgagcacagcgcgccgatcagggctccaaccttatcgtcgccgtccttcttgatatcttcttcttcctcctcctcctcttgagcaaacttgctgtcggcggtgacggactcctcggcatcagggctctggatcgccttctcttcctcgccaccctcaggattcattatcggatcggcaacactaggcacggcggatttgcaggtctcatccagcacgccgccgatgcccttgcactcgtcgtgcacgtcaacgtctcctgatgggggcagcagatcatgctcgactgtttctttatctggagtgtaaattaagacggtcgtaatcaaaattacatacgtgaaacagcaagtgatcatccttaccatcaagattcttgccgccatggctcagggagaagctccttaccatcaagattcttgccgccattgctcagggagaagctcctgtggtctggcaggaccagctcccagtcccagtcccacacatcctggcttgcatccatggagacacctgctgctctgctcctcctcgtattgcattgcaagcaagctgatagcctgatacataagggtgaggtgagggcggctgctaaagtcctgactattacaaattagctgcaaattgctcaagggtggaggctgctaaagtcctggctgttactatgagcaactccacgatagttccttgtaattacgcccctaattttacaaaacgcgacagaaaataggtcccaaacaaaatccaaacatccaacagtgtgcgctctgcattgtttgacgccggcaacaactacaaggacatgccgcctttcattctcttccccgtatgctttgtttattctctgtcgtatggcagcattcaacggaacaccggcaggatttgggtctctgtcgtccagccatatccatatctgccgatggggaggggcagcaggcagctgggtaggaaaggacggcgcacctgggtggaaggaagggtgattagcgtgaagtttctgggtagggatactctttaacttatatctttctagcaacgactgctatgcaagcagtgcttctatgcaagcgtgcaagcaaaccatctgatccattagattactatccaaccacaaatacaatcatggtttgttagattttttttataaagattattgagttagtggtgtaagggtttaagtgttaaatgtgccttacg

SEQ ID NO: 4656 - DNA, 754 bp, Zea mays
cggcacgacgataggccgtgccccccgggctgggaagccgatttcgtgtccctgcagccacggccaccgcccaatctccacttctttatcttctccgaggtgagagagcccaggcgatccaattccaccctcgttctcaggcactgtcacacagacacagctgacctgccactgccaggaaagtaggtcgaggatgccccgcagcggcttctcggggtccttcaggtcgcccaagatcgacgtcgtcatcgacatgggaaaccccttcctcaaccgcaccgtcgacggcttcctcaagatcggcgccgtcggcgcctgcaaggtggctgccgaggagaccttcgagtgcctccacaggggggatgtttcgaagcacaaggttgagcatgccctgaggaagatgtgcaaggagggcgcatattggggcactgttgctggagtttatgtgggcatggtgtacggcgtggaaagggtccgtggccgcagtgactggaagaacgcgatgatcgggggcgccttgtccggcgccctgatctccggcgccagcaacagcgacagaggcaaggtcgtcaaggacgccatcaccgccggcgcggtcgccacagccgtcgagttcatcaactgcattacctagccgagcaaggagcaactgcatttgcagtgccattgtcgtgcaaaatatgaataaagtacttcgccatgtccagttcattacccaaaccaccctaaaaaaaaaaaaaggccccgcccccca

SEQ ID NO: 4657 - DNA, 819 bp, Zea mays
acactgcaaatttgtaaatcgtctccgaggagagagagagagagagagagagagagagagagagagagagagggacaggatgccccgcagcggcatttcggggaccctcaggtcgccccagatcgacgtggtcatcgacacggggaaccccttcctgaaccgtaccgtcgacggcttcctcaagatcggcgccgtcggcgcctgcaaggtggcggccgaggagaccttcgactgcctccacaggggggatgtttcaaagcgcaaggttgagcatgccctgaagaagatgtgcaaggagggcacatactgggggactgttgctggcgtctacgtgggcgtggtgtatggcgtggagagggtccgtgggcgcagtgactggaagaacgcgatggtcggaggcgccttgtccggcgcgctggtctccgccgccagcagcaaccacggagacaagatcgtcaaggacgccatcaccgccggcgccgtcgcaacggccgtcgagttcgccaactacctcacctagctgagcaaactgcatctgcagcgccgctgttcataagccagcgtcttcagacttcgtttcttctgacaggcagcagttttgcctctgcggttcgcaaatgcagccgtggggttggagctggagcgtagctacggacaaacaaaaatcacattacgcaattgtttcagacctaataagacactgcctgcaatttgccaaaacttggtttcggagttccaaaataaacttgtaatgttagccacggtgtaggtataaggccttttgtattgccatttttgttatcatgttcaaaaaaaaaa

SEQ ID NO: 4658 - DNA, 766 bp, Zea mays
  misc_feature (74)..(74): n is a, c, g, or t
ggcactccaacgccaaggagagtcgcacgcgccacacgagaggagacgatgacctgtggcccctcgcagcagtngcaaacaaggggtgaataggccgtagcccccggggattgcagccgatttcgtgtccctgcagccacggccaccgcccatctccacttctttatcttctccgaggaaagtaggtcgaggatgccccgcagcggcttctcggggtccttcaggtcgcccaagatcgacgtcgtcatcgacatgggaaaccccttcctcaaccgcaccgtcgacggcttcctcaagatcggcgccgtcggcgcctgcaaggtggctgccgaggagaccttcgagtgcctccacaggggggatgtttcgaagcacaaggttgagcatgccctgaggaagatgtgcaaggagggcgcatattggggcactgttgctggagtttatgtgggcatggtgtacggcgtggaaagggtccgtggccgcagtgactggaagaacgcgatgatcgggggcgccttgtccggcgccctgatctccggcgccagcaacagcgacagaggcaaggtcgtcaaggacgccatcaccgccggcgcggtcgccacagccgtcgagttcatcaactgcattacctagccgagcaaggagcaactgcatttgcagtgccattgtcgtgcaaaaatatgaataaagtacttcgccatgtccagttcataaaccaccccacaccttcagtcttcgtttctggccggcggttttgctttgtgtg

SEQ ID NO: 4659 - DNA, 940 bp, Zea mays
ccggccgggacactgtaaatttgtagatcgtctccgaggcgaggagagagagagacactgcaaatttgtagagcgtctccgagagagagagagagagagagagagagagagagagagaggagagagggggacaggatgccccgcagcggcatttcggggaccctcaggtcgccccagatcgacgtggtcatcgacacggggaaccccttcctgaaccgcaccgtcgacggcttcctcaagatcggcgctgtcggcgcctgcaaggtggcggccgaggagaccttcgactgcctccacaggggggatgtttcaaagcgcaaggttgagcatgccctgaagaagatgtgcaaggagggcgcatattgggggactgttgctggcgtctacgtgggcgtggtgtatggcgtggagagggtccgtgggcgcagtgactggaagaacgcgatggtcggaggcgccttgtccggcgcgctggtctccgccgccagcagcaaccacggagacaagatcgtcaaggacgccatcaccgccggcgccgtcgcaacggccgtcgagttcgccaactacctcacctagctgagcaaactgcatctgcagcgccgctgttcataagccagcgtcttcaggcttcgtttcttctgacaggcaggcagcagtttcgctttgcgtgagtgtctcctgaatccgttgcctctgcggttcgcaaatgcagccgtggggttggagctggagccgtagctacggacaaacaaaaatcacattacgcaattgtttcagacctgataagacactgcctgcaatttgccaaaacttggtttcggagttccaaaataaacttgtaatgttagccacggtgtataaggccttttgtattgccatttttttattatgttttgcttcctcctcttttttatgaaacaggggcgttgtttgttgtttc

SEQ ID NO: 4660 - DNA, 2354 bp, Zea mays
ctgcaggtgggcggcggcggcgggtgggcggcggcgggcacgcgcacgcaggcacgtgcgtcggcggcggcgatggtagagagcagcgcgcggcagagaggaaaacgcgaaatgaaacagcgcgtggggcctgcgggcgttaaaaaactttatgtccgacggctaccagctcggccgtcggacataaacttattttcgagggccagcgggaatgccgtcggacataagttttatttccgaaggccagcagagaccgtcggacataagctaatgtccgacggtcttgtaggtagccgttggacgtaagttggccatcggatgtccattggtttactgtagtgaacgctgtttatagagtggagtgctggagttagccggaaagacgaatggttatccatgtctgagctagcttctgttcgtttgcccccactgccgtggtggataggcgaaccatcttctgtttccgtctttgctggcgtacgtggagggaagacgaagcattatatatcgtgcaaatttgtgcgactttttgtttttgttttttgccccgactgacgtggtggaaagacggatcgttatcgagagcagatttctgctccttccgtgccgtggaaaggcgaggcacaccgaccatgccacgtacacgcgctcatctatctatatatctatctatacaagtgcccttgtttggagcatcgcagttcgcacacagcagcagcagcccttctttttggagcagcaccacaggggagatcgatcaatcaatcaggaagcaaagcgcgcacggcacaggtgggtagctagcaatggcgacgccgccgaaccctcctcctccgagcactcccatagctgcggcggcgcccttattgccagcagagttcaccagattcaccttccgggccttgtacgtccgccggaccggcccaagcagcagggagatgattcagccggggagaccttacgatgagctgggcagaagactcaccagtgactacccggtgtacgatggccgtggctccgacgccgcccttgtcgctcgcatgcaggggatcaccgtcctcgtcggtaacgcgcaccagctgttcaccatcgtgttcgagaccgggaggtacggtatttcatgcatgtgcacttcattctcttgtagccaattcgtcggcgttattgcatgtacgtactgcaaaagctagctaactagtagccaattcgtcgtacgtcgtcgactgatgcatgatcaggttcaagggctccacgctcctcaccaacgggatggtgacggaagggtccgacgagtgggcggtctacggcgggactggagcgtttgcgatggccaccggcgtcatcagaaggaagaaccttcttgccggcggcggtgacagtggcgggaactccgacgagcttagcgtggaagtgttctgcccggtgttcggatcaccgcagcagccgccaaaggtacgtacgtcgtgtttggctcactagctagggactcgaattctatctatggaagagttctatggcaatagttcgggtactgtactgtactgctggatacacatgcgtgcgtgcaggacgacgacgatggctccgccgtcaccaagattggactatggggtgggccgggaggatcggcacaggacatcacgacgacagaggcaccaaggcgtctgaacagcgtcaccattcgcgccggtattgccgtcgactcgattgagttcacttacactggcaaggacaggcagaggcgcacagctgggcgatggggtggacttggcggcaatgttcgaacggtgagtgagtgacttctgatcgatcgatcgatctttggcgacaaccagctggaagaaccaaggcctaacctcatgcatgcctgcagatcgatcttggcgacaacgaacacatcagggaggtgtcaggaacgtacggcacatttgaaggtgctactaccctaacctcgctcaggttcatcaccagcaccagagcctggggcccatggggcaccgagaacgggacacgcttctgcatcaccgcgcccatcggcagcagcgtcgtgggattctacggacgcgcgggaaccaggctcgtcgacgctatcggtgtctacctgcgtcaactttgatttcaacggcatgatgcttgatttcaaatagatatattaattagttcctcgtcacagtcgatcctgtgtcaaataataaagaagctcttgtatgcatgtgtatatgttagtccttcgttctgtatgtgtcaaataaaggttgatcaaaaagacctagaataagctgtacaaaaacaaaaaatacagctgagcatattaagacacgtataataaagacgagatatatagaacaatgaat

SEQ ID NO: 4661 - DNA, 1362 bp, Zea mays
  misc_feature (26)..(26): n is a, c, g, or t
gtaccctcgggctcgccgggccgggnacgcagttcgcacacagcagcagcagcccttctttttggagcagcaccaggggggagatcgatcaatcaatcagcaagcaaagcgcgcacggcacaggtgggtagctagcaatggcgacgccgccgaaccctcctcctccgagcactcccatagctgcggcggcgcccttattgccagcagagttcaccagattcaccttccgggccttgtacgtccgccggaccggcccaagcagcagggagatgattcagccggggagaccttacgatgagctgggcagaagactcaccagtgactacccggtgtacgatggccgtggctccgacgccgcccttgtcgctcgcatgcaggggatcaccgtcctcgtcggtaacgcgcaccagctgttcaccatcgtgttcgagaccgggaggttcaagggctccacgctcctcatcaacgggatggtgacggaagggtccgacgagtgggcggtctacggcgggactggagcgtttgcgatggccaccggcgtcatcagaaggaagaacctttttgccggtggcggtgacagtggcgggaactccgacgagcttagcatggaagtgttctgcccggtgttcggctcaccgcagcagccgccaaaggacgacgaggatggctccgccgtcaccaagattggactatggggtgggccgggaggatcggcacaggacatcacgacgacagaggcaccaaggcgtctgaacagcgtcaccattcgcgccggtattgccgtcgactcgatcgagttcacttacactggcaaggacaggcagaggcgcacagctgggcgatggggtggacttggcggcaatgttcgaacgatcgatcttggcgacaacgaacacatcagggaggtgtcaggaacgtacggcacatttgaaggtgctactaccctaacctcgctcaggttcatcaccagcaccagagcctggggcccatggggcaccgagaacgggacacgcttctgcatcaccgcgcccatcggcagcagcgtcgtgggattctacggacgcgcgggaaccaggctcgtcgacgctatcggtgtctacctgcgtcaactttgatttcaacggcatgatgcttgatttcaaatagatatattaattagttcctcgtcacagtcgatcctgtgtcaaataataaagaagctcttgtatgcatgtgtatatgttagtccttcgttctgtatgtgtcaaataaaggttgatcaaaaagacctagaataagtacatgtcaggagtatttatatatatagatgtagtcgcctttataattacctctaaaataaaatacccccgttttttttactat

SEQ ID NO: 4662 - DNA, 882 bp, Zea mays
cattgggaccctcgaggccgcaccgggtactcgaggccggccgggaacggaggtcgagcaccagacctcatctcactccactaccccctcatcctgccatccaccagcagcagtgcaagcatatggcgcgccgtgccagcctgctcctcgccgcggcgctcctcgtcgccgtcgctgccgcggcggtgccgccgacgtgcgagcgcatcgagtgcccgccgtacgtggtggtggacagcgccaacgggttcgagatccggcggtacacggacgccatgtggatcaccacggcgcccatcgaggacatctccttcgtcgccgccacgcgcaccggcttcctccagctgttcgactacatccagggcaagaacgcgtacaacgagacgatcgagatgacggcgccggtgctgacgcgggtgtcgcccagcgacgggcccttctgcgcctccgccttcgccgtgagcttctacgtgccggccaagaaccaggcggacccgccgccggccgagggcctgcgcgtggaccgctgggccggggccaggtacgcggccgtgcgccgcttcggaggcttcgtggcggacgccgacgtcggggagcaggcggcgcgcctcgaggccagcctccagggcacccggtgggccgccgccgtcaacgacgcgcgcagggccgacccggcctcgccttacaccgtcgcgcagtacaactcgcccttcgagttcaccggcagggtcaacgagatctggatgctcttcgacgccgccgacgcggacgacgacgccagtatgtgatgcgattccaagcgtgctctcggggcactgaggcgtttagggaaggacgcgcatgcacctgtgcagctgtgctacaatgaagtatttcgtgctc

SEQ ID NO: 4663 - DNA, 1681 bp, Zea mays
cgttgctgtcgctcgcggctggcgcagttggaggttgggccacagcgctcgccatgaatgcgcgtcgtctccgttggaccatcaaccatttgcaattgatgaggagacgagacaggagaaacggcgagggcagtagctcgaggtgttctgtagctgaaagctgccgcgaatcgactgccattattggacgccgtcccttgcccgactgagaatcgggcggccgcgtgcactgcactgcactgcactaccgccgcccgccaggcgccagccaacctcgtggtacaaaattcatccagaattcgcacgaggccaccagctcggctccggccagcactccagcagacatatagctgtacgccatgagctccttgctttaccagtgaagctcaccaattatttgtagcctgcaagctgaaactgaaagcaactgcaaataatgtgtctcggtgtacttgaaaacgactcgaccacaatccagaagcaaggaaaaaaatctcagaaaccaccaaaactgggtgctttctacgtgcttctgcagctaacctcacgccggcggactctagcaagagcacgaacgagggccaagcgctcgaaacccagcgacgtggaagcgcctgcgccgcgagcatccttccagagcgcggggccaaggccaagcagaggtatttatcgtgggcctcgaggccgccggcggggaacggaggtcgagcaccagacctcatctcactccgctaccccctcatcctgccatccaccagaagcagtgcaagcatatggcgcgccgtgccagcctgctcctcgccgcggcgctgctcgtcgccgtcgctgccgcggcggtgccgccgacgtgcgagcgcatcgagtgcccggcgtacgaggtggtggacagcgccaacgggttcgagatccggcggtacacggacgccatgtggatcaccacggcgcccatcgaggacatctccttcgtcgccgccacgcgcaccggcttcctacagctgttcgactacatccagggcaagaacgcgtacaaccagacgatcgagatgacggcgccggtgctgacgcgggtgtcgcccagcgacgggcccttctgcgcctccgccttcgccgtgagcttctacgtgccggccaagaaccaggcggacccgccgccggccgagggcctgcgcgtggaccgctgggccggggccaggtacgcggccgtgcgccgcttcgggggcttcgtggcggacgccgacgtcggggagcaggcggcgcggctcgaggccagcctccagggcacccggtgggccgccgccgtcaacgacgcgcgcagggccgacccggcctcgccctacaccgtcgcgcagtacaactcgcccttcgagttcaccggcagggtcaacgagatctggatgctcttcgacgcggacgacgacgccagtatgtgatgcgattccaagcgtgctctcggggcactgaggcgtttagggaaggacgcgcatgcacctgtgcagtgcagctgtgctaccatgaagtatttcgtgctcttgtgcgctagcttcgtttactttcgacttttcgagtaaggaataaggtgcctcttgttgcaataatgataaagctaatcctgcttgtaattacatttcgtggcatggccattccggcaacatgtccagtaaaaaaaaactttttagtcccg

SEQ ID NO: 4664 - DNA, 1920 bp, Zea mays
catttgcaattgatgaggagacgagacaggagaaacggcgagggcagtagctcgaggtgttctgtagctgaaagctgccgcgaatcgactgccattattggacgccgtcccttgcccgactgagaatcgggcggccgcgtgcactgcactgcactgcactaccgccgcccgccaggcgccagccaacctcgtggtacaaaattcatccagaattcgcacgaggccaccagctcggctccggccagcactccagcagacatatagctgtacgccatgagctccttgctttaccagtgaagctcaccaattatttgtagcctgcaagctgaaactgaaagcaactgcaaataatgtgtctcggtgtacttgaaaacgactcgaccacaatccagaagcaaggaaaaaaatctctcagaaaccaccaaaactgggtgctttctacgtgcttctgcagctaacctcacgccggcggactctagcaagagcacgaacgagggccaagcgctcgaaacccagcgacgtggaagcgcctgcgccgcgagcatccttcctgagcgcggggccaaggccaagcagaggtatttatcatcgcagccgatccccagccgcacgaacggaggtcgagcaccagaccgcgtctcactccgctaccccctcatcctgccatccaccagaagcagtgcaagcatatggcgcgccgtgccagcctgctcctcgccgcggcgctgctcgtcgccgtcgctgccgcggcggtgccgccgacgtgcgagcgcatcgagtgcccggcgtacgaggtggtggacagcgccaacgggttcgagatccggcggtacacggacgccatgtggatcaccacggcgcccatcgaggacatctccttcgtcgccgccacgcgcaccggcttcctacagtaagccaccacctctcgcctccacacgcacgcttccgtcccttattgggccgccttcaaatgggccagagccaaagagagaaaataatacgtgctcgcacgtagtccttagctgtggtgggctcacaccggatacgcgcgcgcgattgcaggctgttcgactacatccagggcaagaacgcgtacaaccagacgatcgagatgacggcgccggtgctgacgcgggtgtcgcccagcgacgggcccttctgcgcctccgccttcgccgtgagcttctacgtgccggccaagaaccaggcggacccgccgccggccgagggcctgcgcgtggaccgctgggccggggccaggtacgcggccgtgcgccgcttcgggggcttcgtggcggacgccgacgtcggggagcaggcggcgcggctcgaggccagcctccagggcacccggtgggccgccgccgtcaacgacgcgcgcagggccgacccggcctcgccctacaccgtcgcgcagtacaactcgcccttcgagttcaccggcagggtcaacgagatctggatgctcttcgacgcggacgacgacgccagtatgtgatgcgattccaagcgtgctctcggggcactgaggcgtttagggaaggacgcgcatgcacctgtgcagtgcagctgtgctaccatgaagtatttcgtgctcttgtgcgctagcttcgtttactttcgacttttcgagtaaggaataaggtgcctcttgttgcaataatgataaagctaatcctgcttgtaattacatttcgtggcatggccattccggcaacatgtccagtaaaaaaaaactttttagtttcaacaaaaaaaaaaaaaaaaaagccccctaggtgatcataagagtcaggttcgacttttagttgctgtcgcatctttactcatatatgtttctctcgtgttaaaagagactagtcaaatacccatgcttcgctacggttttctgaacaaaataatttgtcacggtcttgacgg

SEQ ID NO: 4665 - DNA, 1040 bp, Zea mays
tccctcgaggccggccgggggcggtcgggtacctcgaggccggccgggactccgctaccccctcatcctgccatccaccagcagcagtgcaagcagcatatggcgcgccgtgccagcctgctcctcgccgcggcgctcctcgtcgccgtcgctgccgcggcggtgccgccgacgtgcgagcgcatcgagtgcccgccgtacgtggtggtggacagcgccaacgggttcgagatccggcggtacacggacgccatgtggatcaccacggcgcccatcgaggacatctccttcgtcgccgccacgcgcaccggcttcctccagctgttcgactacatccagggcaagaacgcgtacaacgagacgatcgagatgacggcgccggtgctgacgcgggtgtcgcccagcgacgggcccttctgcgcctccgccttcgccgtgagcttctacgtgccggccaagaaccaggcggacccgccgccggccgagggcctgcgcgtggaccgctgggccggggccaggtacgcggccgtgcgccgcttcggaggcttcgtggcggacgccgacgtcggggagcaggcggcgcgcctcgaggccagcctccagggcacccggtgggccgccgccgtcaacgacgcgcgcagggccgacccggcctcgccttacaccgtcgcgcagtacaactcgcccttcgagttcaccggcagggtcaacgagatctggatgctcttcgacgccgccgacgcggacgacgacgccagtatgtgatgcgattccaagcgtgctctcggggcactgaggcgtttagggaaggacgcgcatgcacctgtgcagctgtgctacaatgaagtatttcgtgctcttgtgcgctagcttcgtttactttcgagttttcgagtaaggaataaggtgcctcttgttgcaataatgataaagctaatcctgcttgtaattacatttcgtggcatggccattccggcaacatgtccagtaaaaaaaactttttagtcccaaaaaaaaaaaaaaaaaagccccctagggcc

SEQ ID NO: 4666 - DNA, 642 bp, Zea mays
gggtacctcgaggccggcccgactccgctaccccctcatcctgccatccaccagcagcagtgcaagcagcatatggcgcgccgtgccagcctgctcctcgccgcggcgctgctcgtcgccgtcgctgccgcggcggtgccgccgacgtgcgagcgcatcgaggccagcctccagggcacccggtgggccgccgccgtcaacgacgcgcgcagggccggcccggcctcgccctaaccgtcgcgcagtacaactcgcccttcgagttcaccggcagggtcaacgagatctggatgctcttcgacgccgccgacgcggacgacgacgccagtatgtgatgcgattccaagcgtgctctcggggcactgaggcgtttagggaaggacgcgcatgcacctgtgcagtgcagctgtgctaccatgaagtatttcgtgctcttgtgcgctagcttcgtttactttcgagttttcgagtaaggaataagatgcctcttgttgcaatagtgataaagctaatcctgcttgtaattacatttcgtggaatggccattccggcaacatgtccagtaaaaaaaactttttagtccaaacaaaaaaaaaaaaagcgcccctccctgggtgatcataagagtcaggttcgactttt

SEQ ID NO: 4667 - DNA, 1215 bp, Zea mays
aagagacgaacgagggccaagcgctccaaaaccagcgacgtggaagcgcctgcgccgcgagcatccttcctgagcgcgggaccaagcagaggtatttatcatcgcagccgacattgggttcctccccgccagcccggccctcactccgctaccccctcatcctgccatccaccagcagcagtgcaagcagcatatggcgcgccgtgccagcctgctcctcgccgcggcgctgctcgtcgccgtcgctgccgcggcggtgccgccgacgtgcgagcgcatcgagtgcccggcgtacgaggtggtggacagcgccaacgggttcgagatccggcggtacacggacgccatgtggatcaccacggcgcccatcgaggacatctccttcgtcgccgccacgcgcaccggcttcctccagctgttcgactacatccagggcaagaacgcgtacaacgagacgatcgagatgacggcgccggtgctgacgcgggtgtcgcccagcgacgggcccttctgcgcctccgccttcgccgtgagcttctacgtgccggccaagaaccaggcggacccgccgccggccgagggcctgcgcgtggaccgctgggccggggccaggtacgcggccgtgcgccgcttcgggggcttcgtggcggacgccgacgtcggggagcaggcggcgcgcctcgaggccagcctccagggcacccggtgggccgccgctgtcaacgacgcgcgcagggccgacccggcctcgccctacaccgtcgcgcagtacaactcgcccttcgagttcaccggcagggtcaacgagatctggatgctcttcgacgccgacgacgacgccagtacttcgtgatgcgattccaagcgtgctctgggggcacccactgaggcgtctacgaaaggacgcgcatgcaaccgtgcttgccatgaagtatttcgtagtactcttctgcgctagcttcgtttactttcgagtaaagaataaggtgtcccttgtttcaataatgattctgcatgtaattacattccatggcacggccattccggcaacaggctcagtaaaaatatcttttttagtgccatctctcctggtttcatctcagctccctgttagtaaaagttctgatcataagggtcaggttcgatttctagttgctgtcccattgtactcgtactcgtttgaagtgacctcttcataatagtactatcagacta

SEQ ID NO: 4668 - DNA, 3467 bp, Zea mays
  misc_feature (3319)..(3319): n is a, c, g, or t
aattcggcacgaggcccaccatcctctctacacggcacaggaacccaactactactactacaatcgttgccagggagctcaaccgactcgggaccaaaatcggctgctgttgctgcctgggacgaaatcggaggcatccgcctttctcgagagatcgagctccgcgccggagcaggcgggccaggcggtgccgctgctggtatctggtgggtttacaacatagggatggagtcgagatccatccggattcgacattcgaggtcttctgctttgctgttttaaacctgtagaggcagaggacttgggaatgctgaaaaatgtgcctgcaaaccgacgggggaattttttgtgcaaacaagattcgacctctgttcaagcagatattgttggcttctcatgagtatgggcttcatgctgatactgctcttcttttcaatgatttaaagcacagtagattgaaggcctttatatttgttggccatcaccttggagacgacggttaaaatcttctacattctttgataagtggtgtggcgcttgttcattattctatcgttgcatagtttgatacgatggatgggaggaggacaattttgatgggacgatatgaaattggtaaacagctgggacaaggaacctttgcaaaggtcttttatgctcgtaatcttactactggcctggctgttgccataaagatgattaacaaggacaaggtcatgaaggttgggctcatggagcagataaagagggagatctcaataatgaggttagtgaagcatccaaatattcttcagctttatgaggttatggctagcaagagcaaaatttattttgttctggagtatgctaaaggtggcgagcttttcaacaaaattgctaaggggggaaagctcagtgaggatgttgcgaggaaatatttccaacagttggtcagtgctgttgatttttgccacagccgaggtgtctatcaccgtgatttgaagcctgaaaaccttctacttgatgagaatgaaaaccttaaagtctcagattttggcctaagtgctctagctgagtccaagaggcaagatggtctcctgcatacaacatgtggaactccagcttatgttgctcctgaagtgctgagtagaaaaggttatgatggtgcaaaggcagatgtttggtcttgtggagtaattctttttgtgcttgtggctggttaccttcctttccatgacacaaatttgatagagatgtacaggaagatttccagagccgagtttagatgccctcgttttttctcaactgagctgaaggatctgctacataaaatccttgttccagatccaagcactagaatttctatctcgaggataaagaggagtgcttggtacagaaaaccggttgaagcacatgcaaagaaaaatgaggcagaaacaagcgagaatacttgtacgggtgaaggtacaacttctgtctcaacagagtgcagtacgtctgagggaaatcaagggccattaagcctcccaaacttgaatgcatttgacatcatctgtctctcaacaggttttaatctttctgggttttttgaggataagtatggtcgcagggaagagagatttactaccagacagcctgtaacaacagtatttacaaagctgaaggagcttgccaaacgcctaaagttgagggtcaagaagaaagaaaatgggaccttgaaattggcagctccgaaggaaggaaagaagggtatgcttgagcttgatgcagagatttttgaggttgctccttctttgctcttagttgagttgaaaaaaaccaatggggacacgctggagtatcaaaagctagtgaaagaggagataaggccggcactgaaggatattgtttgggtttggcaagatgatcaacaccagtgctcacaatcaccagagtctctattatcaccaccggagacacaggatgaattgcgattatcattgcctcagcaagagggtcaagacttcttagaagccccattgccatcactatcgcttgaccagttgaaatcaccaactgccccagagcaagcagagcaactgccacaaccagaacagttgcaaacgccaatcgctccagaggagcaaattaactagctctaacagccagctggtaattcatatgcccctctcagtcatagttcatagttctattccggtttttactctttgttccggcttttctatttcttctggaattgtaaagctgtatgcctgtatgtactgcagaaatgccatgtattccagtttgaaatgatataatacatcatacatccgatgttaaaccaaaattttggaaagaataatattcattgaccagcactattgagttgtatgaatttatgaccgaaaagtcttcatgattggtttcctctactatcacagctgtaagcagatttattgctgtggattttggctgttatgatcgtattctaagttcgtcgcggagatttgtttccctcgcgtagtgctctgtgtgtcttaggtttgagccttgctaattgccatgttgattagatagatagtgtggcaaaaattcttcacgcttcggtttgcttactgcagatgccaaaaaagcaaaggaaaaaggtcccgacaaaaaagaaaggatttgcatgtacaatatcagcagtggagtgttgagttaggctcaactcgtgtcatttactatatttctcctttcaccttgcaatccgaaaatttacaattcctgtaccaaaatgcatctatctgttctgtttttttttttgctttctttggattgctgttatccacgaattaaacaaatgatatgaataagttttcattataaattgccattttttgtttctttatagaaatatgtgtggattgtgaagaaaatgataacaaaaatagttgatacttctttgagggaggtggaaatttcttgaggtattcgtgctttgaaatgattcagtaacctcttttacaaacagatcgtagtacacttgctgtccatgtcctgcagaggaacgtctctcctggagacatacaaaggcatccagatatgtccccatcgaagaaacagttaacaaacaacaatgattcgctgtactggtcaaatgaaaaatatgactactcttgctcttggttggatgaccgggcaatgatttcagctttgcttgatgtggtcatagaagaagactctgcaagtctactccccccggtactgtattcagtggcaccatattctctggtttatagctctgggccattctaattccctacatattgttctatctgtttcaggagcgctctcccctcttcctcttgtagctggngtggaggctgagctgcatccggtctctgttggccataagagcatggatgcagaaatgaaacagccacttgaggtaagctaccatgtgatctgttcggatgctttctaagatttcgttgtggatttctagatctgttttagctgttgat

SEQ ID NO: 4669 - DNA, 1784 bp, Zea mays
acccacgcgtccgaaaagagtaagattagatttgctggacatgatgaacaagatgatggtggtgacagggaagatgctataattgagcagatggcacaaaatctggtgattgatggctttggggcgcccgggggagtagtgttggaaaaacctatcctgaggagtaaggatttcagatcagatttttctagagggcatcatgtatcaagtcagagaataagattccagaggagaaacaggccatgtcgatgacatagatcgatttacacctaacttcttgtcaatttttgaatctttggtgccctctgaagaggaaattgcaaatcagaaacagttgttaacatctctaagcagactgataaacacagaatggcctaattcaaaactatacctctatggatcatgtgccaattcttttggtttctcaaatagtgatattgatctttgtctctcgattgataacaaggaaatgagcaaggttgatattatattgaaattggcagatattttccaagctggaaatctccagaatattcagccattaactcgagcaagggtcccaatagtgaagcttatggatccaaaaacagggctttcctgtgatatatgcgtcaataatcttttagcagttgttaacacaaaacttttgcgagattatggacaaatagataaaaggttacagcagttggcattcattgtgaagcattgggctaaaactcgacgtgtaaatgaaacttatcaaggaacactttctagttatgcctatgtgattatgtgcattcacctcctacagctgcgaagaatactcccatgtctacaggaaatggaggccacttattatgtcaaggtggaagaaatcaactgtgcatactttgaccaagtggacaagctaaataattatggtgctcacaacagagatacagtatcaaggctgctctggtcctttttccattactgggcatatgagcacgattacacaagagatgtcatatcaattcgtactggaaggattatcagtaaggaacggaaggactggactagacgagttggaaatgacaggcatctcatatgcatcgaagatccgtttgagatctcccatgatctcggtcgcgtagttgacaagttcaccatcaaaatactcagggaggaattcgagcgagcagctaatatattacagttcgatccaaaccccagcgtaacactctttgagccctacgtgccccctccatcgccgagcctgttgcaagaagaaactgcgaatgctgcagaaattgaactatgatagcgtttggttcgtccccaggtattgtaataggaaatagaatcaactcaaggattttgatccttgcatcactggttgcagcctttggttggatgtgtaaatggtattgtttaccgttacagctgtttggtttctatctcagggatcacaagtcagttcccgaacttaaaaatcattcgtggtatgttctatttcaactcaagggatcacaagtcagctaccatatcacatgtccaaaaaaaaaaaaaaaacaaacttcattcggcaaatagtggtgcgaattctctatttggacagccaaaagtcagcaccatacgtataattttggttcacatatgaaagaggtcaaccaattattgtatgtcgtacaacaaatgggatgaataggatgacatcaagccaatgtatcggaacgttttttttttgttgttgctctgtagctatcgttatgcgaacatgtttagtatagaacttatccatctttaggttcactgcggttgga

SEQ ID NO: 4670 - DNA, 3091 bp, Zea mays
gaaatacgcctcagcttgtgcttgccatttttttcttttacgagtaaaagagactaaaaaatctacaccatctgttctaaatcataagacttttaatttttttagacatgtttgttttttactaatctaaataaagtatatatctaagtatacaatattagcaaaaaaaacctaaaaatctaacaggattttataatttaaaatgaaaggaacatataatggagtcgctaagatctatagattccaatgtgaaactgataaaactcatgagcattattgtataccctacaaatcctgcagagaagctttatacgtcaataacattgtcctatatcatcattagccttatcatgtgacgtaactctggcacaaagctccaaagttccatggatgcaccaaccaatagtgtccaattccaatacatatacaaaatgcagaagtcacctctgtagcatatcatacaagcaacaagcagcacaaagctggaggttatggcatcattatttatccttttttttcctccagcaagatcagtcctccttttttcctttctctctaatcatggaacaaacctaagaaagagctaaagatctcctttggaatgaaggaattgaaagggattatatgtaggataattggattcatataggaacgtttcctgctggaacattttgggggggaaaacatttatttcctccattgaatatttgacttgaattgtatgtttctaaactgagctccaacattgtggttacgattgctttaagatgtccaatgcataatacttctctcttctatgtatgaagttcttcctgccaaaagagaacattcctgtgtttgctctgtaacgcatccaaataaatgcctctcttgtattttctctaaaagtacctttatttttatacaattcatacatttggaactttatagttctaggttgttccgcaagaggcataaacaatttctctagtagaacctatttttatactttttttaataaaagatgcttaactattgcatttgcatcagcctagcttacagagagaaaaaaagttaccatagaaattggaggcgtctttagaccttgtccgtttacatctagattggagagaattaaaacagattaaatattttttatttaattttgagtaggaaggaatttaatcaccaactgctcaccctttatcctccgtcagccaccaacggcaagtgcccccacaaggccacaagatgcctctcctaccgaaaaaggaaacaaatttggccagcgctactgcgctacagcaaagtcgtgtataaaagtcgcccatctgcacagctatccattgggagtagatcgaggaccatcctcgctaccctgcaggccggcactgcactgcactcgtcttcagaactcgtcagtcacagatcggtgcaggcggtctgcacctgcatcacctaaccaattcctcgattagtctgctgttgcgatttgcgaggcaggtcaggtactgacgtattgcatttgcatgcctagctagctgatagatgatctttgtttcttctctgctttgctctgtgtatgtgtttactgcaggagaatttgtaattgcaaatcgtctcacaaattggtactgactgaaagatgatcttgtgtttcttcattctgtttgcacgaagctgcaatctttttgcagcagccactaaacctgtaccaagtcttcttgcctgagggcagaggcaggctccgtcagtcacgccggcggcgtacagatcatggaggactttggcggctggaatatgcagtatgcagcagagctatgcctgccaagccgccgggacgacgacgacgacggcctcctcggtgacttcctaggcggcggcggtttggacatccgttctgaccatggcggcctcaacctgccctcgtcgcaccctgctgtccagaaccttgtgccctgccacggcggcgtgagtctttccgtttccgacgccttcatgggcctggacacggcggatatgctcgctagcgtcaccggcgcactggactgcagcctcctcgacacgtttgcttgcggttcggacgccgtcgtcgtcgccgaggagcccgccgcgcagcccaccgcgtcgagcaacgccttctccggatacagcagcaccacgggcggcaattacggcaacatctcctccggcgagtccaacacgtacggcggcagcggcggaggccatgacacggaggttgcgtcgccgacctgcgcctcgaagcggaagctggccggcaagtaccctgcaatagccgcgtcggcgtcggccacagccacgacgaaaacggcggaggggcaggttgcagccccgcggcgtggcacgaagcgcgactccgcgacgtcgtcttcgtcgaccagcgccacggtcgccgggcatggcggcggcaaccatgcggccggaggaggcgggtcgtcgtcggtcggcgacgggaacgggtacgagccggactcggaggcaatagcgcaggtgaaggagatgatctaccgcgcggcggcgatgcggccggtgcaccagctcgtgtgcggggccgccggcggcgagccgccgtcttcgtcccagaacaagccgcggcgcaggaacgtgcggatctcgagcgacccgcagacggtggcggcgcggctgcggcgggagagggtgagcgagcgcctgcgcgtgctgcagcggctcgtgccgggcggtagccggatggacactgcgtccatgctcgacgaggcggccggctatctcaagttcctcaagtcgcaggtcaaggcactggagagggcaaaccctagtagtaatggtggctacaacgacagcagcttcctgccgcagaattacacggggtgcctctgtgtcgacggtggcaccagtgttgcctttggaagcgatggcgccattgggggctacgtaaaaccaggtaggaacatgcaccggtagcgatgcaataatgtaaccattgatgcgagtgagcgatatatgagagaagtactgcagtactgctactggattttgagtttaataaggctttactgtatttctgagtaataataatcaaaacgatttgatttaaaaaaaaaaaaaaaaa

SEQ ID NO: 4671 - DNA, 2145 bp, Zea mays
  misc_feature (26)..(26): n is a, c, g, or t
gcacgagaccattacctagaacatcntaatcgaaaaataatcgacacacacctaacagagtaacagacaccaaacaacgcccatcactcgcgccgtacatcctgcctcctcccgcgcgcgcgcgtgcgtgcacgctagctagctgccggtcgcctcgccaccatggtgttcgacgcgagcggcagcaggtcggcggcggcggcgtcggggaaccctctccgcgtgatcctgacgcgcgggttcgcgcggcaggtgctcgtggggcggtggttgacggtgttcgcgagcctgctcatcatggcgtcctccggcgcgacgtacatcttcgggagctactccggcacgctcaagtcgtcgctcgggtacgaccagcgcacgctcaacaccgtgtccttcttcaaggacctcggcgccaacctgggcgtcttctcggggctcatcaacgaggtgaccccgccgtgggtggtgctggccatgggcgccgccatgaacctgtccgggtacctcatggtgtacctggccgtgtccgggcgcaccgcgccgccgccgctgtggctcgtctgcctctacttcttcgtgggcgccaactcgcagtcgttcgccaacaccggcgcgctggtgacctgcgtcaagaacttccccgacagccgcggggtggtgctcggcatcctcaagggcttcgtcggcctcagcggcgccgtgtacacgcagctgtacctggccctgtacggcggcgacgacgccgagtcgctgatcctcctcgtcgcctggctccccgcggcggtgtccgtcgtgttcgtccacaccatccggtacatgccgtacccgcgccgccgtgggcaggagacgagctccgactccgaccccttcttctgcttcctctacctctccatcgcgctggcgtgcttcctcctcgtcatgatcgtggtgcagaagcaggtgcccttctcccgcgccgcgtacggcgtggccgccacgccgctgctcatcctcctcctcatgcccctcggcgtcgtcgtcaagcaggagtacaagatctaccgggagcgccagctcgacgccgccgacccgccgccgccgaccatcgtctccgcgtcggcaacggacgccatcaagaaaacagagcagcagccggcgtcgtcgtcgttctgtgggtgcgtgaggaccatgttccgtccgccggctcgtggggaggactacacgatcctgcaggcgctggtgagcgtggacatgctggtgctgttcgtggcgacaatctgcggcgtgggcgggacgctgacggcgatcgacaacatggggcagatcggggagtcgctgggctacccagccaggagcgtcaacacgttcgtgtccctgatcagcatctggaactacgcggggcgcgtgacggcgggctacgcctcggaggcggcgctggcccggtaccgcgtgccgcggccgctgctgctgacgggggtgctggcgctggcgtgcgcggggcacgtgctgatcgcgctgggcgcgccgcggtccctgtacgcggcgtcggtggtcgtcgggttctgcttcggcgcgcagtggccgctggtgttcgccatcatctcggaggtgttcgggctcaagtactactccacgctctacaacttgggcggcatggccagccccgtgggctcctacatcctgaacgtgcgcgtggcggggcggctctacgacgcggcggccgcgcggcagcgcggccgcggcaggatctgcctcggggtggagtgctaccggcggtcgttcctgatcgtcacggcggaccacggtggtcggcgcgctggtgtcgctcgtgctggtgtggcggacgtggacgttctacaggggcgacatctacgcgaggttccgggacggagacgagggcccggggcgggacgggcgcctgccggtcgaccagaaacgggaggaggagcagagggagaaggcggcggccaacggcaggaaggcgtgaggtggtgagcgggagcgggaaggcatggtcagggacgacgacgagtggggtgtacttgtacatgtgaatatagtactttttttgttgcattcacccgtgatgaccgacccttgttacctttcaaatttaaatagcctaaaaaaagccttcttgtccgtttccaaaaaaaaaaaaaaaaa

SEQ ID NO: 4672 - DNA, 2183 bp, Zea mays
gccatggctgcaaagagggatgccatttgcaatgttatgtgggaagggaggggaagctctaggatatgatggactacattattgaatttagtttgtttaccctgctatggaactcatgtttgttcgatgatcatgtaataatatgatggacatggctgtgaccaatttttttcattcccatttgtcttttcttgttgtgctgatattattatcctaatttgtacatgcaaaccagtggtcagatgcctttagtcccagctggtgatcagggtgggtttgtcccagctactgatgtgatgactgagatgataagggttggtgctagtgcagtagctaacgctgatgatgctacttcatctagtgccggtgctgctccagcagcagctagtcttgttgctgctgttctcgggggtttttttttttttttttgaacaacaacacctctggatttattcttaggaggatggctcaacttcttagtgatggtagcaggcctgacaaggtcttcaaggacaaggatgtcaactctgttgccaaagcccttaaggagtacagtggggaggcagtgagcccaactcaggtgtataaccacttgaggaaatggaggcagaaatggtctagggtgtctaagctcaaagaccttagtggggctttatgggatagtgactccaatgctatcttgcttgatcaggagcactaccttggccactgcaaggtagcactatgatttgtttcctatgactccttgtttttttacttgtctaaaacactatcttttcaattacttgatcaggaccatccaaaagatgcagagttcctaaactgccctattaggttctacactgagatggaggccatttttggccatgctatggccactggcaaatttgcacttggttctggtgaagccttaggacagaaccaggttgatagtgttgctgccaaggttgagggacctgccttcacctatatctctgaagagagagcacaaactgatgttggagagggtagcaaggccaccgagaacccctccatagctgtgggtaggaagaggaagagagggaacttcagtgaggatgagatgcttatgttgaccaatatgtctgatgaagtgaacaatgtggctaatgcccttagagagactggacctgcccatgtggatgctaacctctacctagctgtgatggagatgcctggctattctgaggaggcactgattgttgcctacaccttcctcctggacaacaaggctcaaggcaggggctttgttcacatgactgaggcacatagaaacatttggcttaggaccttcctagccaagaactactacatgtaggtgaattacatgttggtgtgcgccaccacccactctctcttcctacccactctctcttttgactatagctgggaatagtttgttgtagacattttggtgtgcagtctggtttactctcaccagtccttttgtctaatttacctaggagggtggctaacaataggtaacatttgggtggacaccatttgaaccctaagctgttgggctcaaacttattgtaaggcactatttgtgttcttactatgattgaagtttttactatgattgaagtttttattgtaaggctcaaacatttcatactatgattgaagtttttacttggccaatgatgcgatatacactaatctgaggagcatttgcattggatgtgttgtagtgcagctgaggcccctgtttacttgtgctttcctttatgcctatgatgacataattgccatggaaccatgttgtcattattgcccgtgttaatgtggatgatctttaaattgtgaggtactgggcatatgctgaaaattatgttgtttccaccatgttgtgattattgccatggaaccatggggcacatccatgcccaatgcaactgttatccaccatagatgacttgatggctgggttggatgaataccatggtttcatggctgcccagctatgttccttatgctccaagttaaaagatcacatgaaaatggcaattatatctgaggaaatatgaaataaagtctaaaaaataaataacatacatgaaaaataaaaaaatttaccgttaaaaaaaccaaaaaaaaaaaaataaaaaaaaaaattctaaaaaaaaaataaaaaaaaaaataacataataaatataaaatct

SEQ ID NO: 4673 - DNA, 1350 bp, Zea mays
aaaagaggtattcggtcaacgatcggtcgggactccggactcgggagtcggcactcgggtctcgacgtctcgtctcgcctgcccgcagccccttggcttcgttccatccggcttctcggcggcggcggagaggagggggatggcgcaccggctgctgcgggacgcgcaggcggacgggtgggagcggtcggacttccccatcatctgcgagtcatgcctcggcgacaacccctacgtccggatgttaagagctgaatatgacaaagaatgcaaaatttgtgcacgtccttttactgtattccggtggcgtcctgggcgagatgcaaggtacaagaagactgagatctgccagacatgttgcaagctaaagaatgtctgccaggtctgcctgctggatcttgaatatggtctgcctgttcaggtccgagatacagcactctctatcaattccaatgatgcaattccaaggagtgatgtcaatcgcgaatattttgcagaagagcatgataggagggccagagctggcatagactatgattcatcctatgggaaggctcgtccaaatgatacaattctgaagctacagaggacagcaccatattacaagaggaacagagctcatgtttgcagtttctttgtgcgaggtgaatgtacaagaggagctgagtgcccttatcgtcatgagatgcctgaaactggggagttatctcagcagaacattaaagatcgctactatggagttaatgatccagttgcactgaaacttttgagcaaggcaggtgagatgccatccctgacaccaccagatgatgagactataaggaccctctacattggcggactcgatagcagaataaccgagcaggatttgagggatcagttttatgcccatggtgagatcgagtccataaggatggtacttcaacgtgcaatcgcatttgtgacgtatactacaagagaaggcgcagagaaggctgcagaagagcttgctaataagctagtcatcaagggcgtgcgcctgaagctgatgtggggcaagccctcaggccccaaagcctgaggaggatgagtctgggaggctggggcaggtttcccacggagggctgctccctagggctgtcatatctcagcagcagccacagcagccaattcagaactgaagtcctgtcaagatgttgggtattggtactgctctaactgctcggcaggagaatgcaacccccgtgggtcaccagctttcgtaatttcttaatttgtggttaacagtaaaaactttgttgtattgcttatcaacgtttgaagaaaaaccgtgagatataccggatgtatccagcttctggattttgtggt

SEQ ID NO: 4674 - DNA, 5166 bp, Zea mays
caatgcattgaagctttttaggtcaagttagtgagttgaactaaattattcattattaaaacctttaggtgaatgtatttattcatttcactaaattttccatgctattcttttctctgccttgggcagaacattaaagatcgctactatggagttaatgatccagttgcactgaaacttttgagcaaggcaggtgagatgccatccctgacaccaccagatgatgagactataaggaccctctacattggcggactcgatagcagaataaccgagcaggatttgagggatcagttttatgcccatggtgagatcgagtccataaggatggtacttcaacgtgcaatcgcatttgtgacgtatactacaagagaaggcgcagagaaggctgcagaagagcttgctaataagctagtcatcaagggcgtgcgcctgaagctgatgtggggcaagcctcaggccccaaagcctgaggaggatgagtctgggaggctggggcaggtttcccacggagggctgctccctagggctgtcatatctcagcagcagagcggtgaccagcctcagccccccgggatggagggccaacagcaacaggctgcaccagcatcgtactacttcaacattccagcaccaccagcaacggagcggactgtgtatccatccatggatccacagaggatgggtgctatagtaaaaccacatgacagtgaaggcaaaccagggccgcagcaagccgggcaagctcaggcatcaagcaacccagcacaagggggcggctatcctgcaccaccgccatactaccatggtcagtatccaccatactatccacccccaccaccatacggtggctacatgcctccaccgcgcatgccctacccaccgcaatatccgccttaccagccgatgctagctcaaccagcacaggtacaggctagttcatctcggcaaccaccgcatgcaggtggagggcagcagcagccgcctgatggccctccagctcagcagcagccacagcagccaattcagaactgaagtcctgtcaagatgttgggtattggtactgctctaactgctcggcaggagaatgcaacccccgtgggtcaccagctttcgtaatttcttaatttgtggttaacagtaaaaactttgttgtattgcttatcaacgtttgaagaaaaaccgtgagatataccggatgtatccagcttctggattttgtggtacctgctgagtttcatcaaaaaaaaaaaaaaaacctaacgactagtaaaaatactgacgcaagctcataattgacgcctgcaacggctaaatgttaattctttatgatatagccaatccatctgatgagagcacaacttcaatgctgattgcttttgttttctgttctatctttgggattctctctccttttttttttaaaaaaaagaggttccttacgaatggtgtgatatgctagacgtacgatcagcaaagccacttggcgtctctctaacgaccaaactccagcaggccgcggccaacgctcctctccatggtcaaaaacgcagtgctcaccgtctccacgccggccaccgacggctctctggcagcgagcaacaagctctccatctccatctcgtcggggtcccgctgcacccacgggtgccggctcactaatttactcagcctgccgagcctctcagcggcgtccctcatcgccggccggttctctccagccatctccaggcactgcctcgcgaggtccgcgacttcctccagcaccccaacgacgttgtcctcgcccttgacgcggtcgtctaccacgtccatgagcctcccctccttgagcgcgcacaggaagctcacggagaggctcctctcgctctcgggcccgtcgaggttgagcgccgtcctgccggtgaccagctccaggagcacgacgccgaagctgtacacgtcgctcttgtccgtgagctggcacgtctgcatgtactcggggtccaggtagccgcaggtcccctgcaccagagtcacgaactgggcttcgtcggccggcgccaccaccgaggccccgaagtccgacaccttcgcggcgtaccggtcgtcgaggagtatgttggaggacttgacgtcgccgtggaggatcggcggcgacgcgcacgagtgcaggtagtccaacgccagcgcggactggtgggcgatcttcagccgagtggagagcggggcgtcgcagcggccaccgtggatgaaatggaacagcgtgccgttgggaacgaactcgtagaccagcatgggcacctccacctcgaggcagcaccccaggagcttgacgatgttcttgtggttgacctgggacaggatgagcatctccctgccgaactccttccggcctgcgccgctcgtccgtcgtcgtcgatacgcaccgcttgatcgccaccacagtgccgtccttgagcgcgcctcggtacacggtcccatggccgccacgcccgagaacgttctcgtcgccgaatcggcccgtcgcctccatgagctccgcctccgtgaagattgtgaacgcttgccccgcgcccgcgctgctgcctatctgctccagaagcagcaggcccccgtgctgacggaagtatctctgcttgatgtcggccagcttcttcctctcgcggatcaaatacgagcaggtgacggctatggccactatgaccacaccgacgcttatgcctgaatatatatattttttttctctccacatgttaactttactggtacagtttaacagtctacacgagaaggtaaaacaaaaagaggccactgtatgtaattgtgattatttaccaatagatagcatcgccgtggcagactgtgacaagccgcgacgcctgcagtagaaaccacctcgcgtgttgatgcaaggcccagctgggcatggagatggagtacggccacactcatcgatgtctgcaaaatgaccacacggtaagaacacgatctcagaaaccggcagtccaaaaacacagaatgacagcttctctgggtgtacgtttgacggaccttggcatccatcaacaaggtaaggattgcccctgtagccttgagagcagttgcaaaggtacccaagaccagtggccgaaccaacgcacacgctgtcgctgctacggcaggcgtaggaggccgcatcctgcctggcgacgtcgcaggttgtgttgcccacggcccagttcaggatagtcgggacatggccgtcgcgctcgtcccagaaggtcgtcgagttcaggtacgccgcgtggaacttgaacctgccagcctccaccaccatggcgtatctgcagcgctgtcgtgtgtcgtcgtcatcgtcaatagtggcgcttgtcgtactgttcttgtcgtccgacgtgtcgccctccttcacggagatgtcgtggtaggacagcttgctgctgagcgcaacctggcagcagccaacgccggtgcacccgtcctgcgctgccggcgtgagggtttcaggagcagcgctctgcgtcagacacccgatcacgtactgcattgtatgggcaggagagaagaatacacttgagtcaccgacaccattatcatattaaaaaataaataatctgggagaggagtagaggactttacgatggcagattgccttgaaccagccatgaggccgatcgcgtcgactccgatgacggtgaacatgttctccttctccgccaacgtgaacggcgtgccggagaggttcaggaggtacgtggtcgagcggttgttggggcacatggaggcgacggagctcatcacccggacctggccatggagcagcagtatgtcggccagtaccggcaggtcgccgtcagagaagtacgcggtgctgcttcggcggccgtcctgagactgagactcgttgcagtgaagctcaaaccccttctccatcgcgcagccagggccgatcccgaacgggtactcgatgctcacgtcgccacacttgctcgggcagtcatggcggggcgaggacgagcacgaggacggagcaggctcggacgaccttaggctgcagcggaagagcaaggctgaggaagaagagcagcatcttgacttttggcagagatttgctcgatcggcgtacacgtttctgtgttccgtgcatgtgcgcacatctatctatgcctctatactatatatatatacacacatttgagttgaatcggtagatttctggtgacgaattcgccatccctgagcgacttggccaagcaacgtgatgtgatgagctcgtcgtcgtctctgaacgcgacttggccaaacacgcgctatgcttctgttgctgcttcctccatttcacatatggctgttcgtagcggactgaaaaacccgtgctgtattgttttgagttgagaagatgtgagttctgacgacattgacgtctcagctaattaactctccagtgggaaatgacaattcgatcgatggcatggaggaaataaaactattgcaactagcaacacaagtagagaagcagagagacgaggcaattcgatgcatgcatggaggaaataaaactgtgcatttgactggatctaatctaacaagagaggccggcatttctttagcacgacgaggagtcaaaattacgccccctgctgaatgcacggaaggtccttggggatagtttcttaattgcagcgcacatgactggaatcccgcctctgtccgatagattgtacatgtaaaacaagaacagcacgcgttttgatcgagagccagcgcttcaatcgctatgtcgtgccatatcaacctatcaggtttgtattatctatcaattctagactttatctgccacaacgctctagtgcatagtctttaccatcagcatatagtcacatcagcatcatatcaacttttgacttttagttaacacaaaacacaatattttttgaaattaaaaacatctggttacattattaaacaaataaaatttacagagtttataaaagttacataagttaaaaaaataaaaaagtggtttataaataaaatctaattgctatggtgcagattctacatatgatccattaaatcattttggagttgatcatatactatactagctagcatagcatagattatggtctcatcttgaaggatgactgcaaagctcgtgggtgctttggaagtgatggttggtgc

SEQ ID NO: 4675 - DNA, 1847 bp, Zea mays
ggcgtgcggactagttctagaggcgagggcgaggtattcggtcaacgatcggtcgggactccggactcgggagtcggcactcgggtctcgacgtctcgtctcgtctcgtctcgcctgcccgcagccccttggcttcgttccatccggcttctcggcggcggcggagaggagggggatggcgcaccggctgctgcgggacgcgcaggcggacgggtgggagcggtcggacttccccatcatctgcgagtcatgcctcggcgacaacccctacgtccggatgttaagagctgaatatgacaaagaatgcaaaatttgtgcacgtccttttactgtattccggtggcgtcctgggcgagatgcaaggtacaagaagactgagatctgccagacatgttgcaagctaaagaatgtctgccaggtctgcctgctggatcttgaatatggtctgcctgttcaggtccgagatacagcactctctatcaattccaatgatgcaattccaaggagtgatgtcaatcgcgaatattttgcagaagagcatgataggagggccagagctggcatagactatgattcatcctatgggaaggctcgcccaaatgataccattctgaagcttcaaaggacagcaccatattacaagaggaacagagctcatgtttgcagtttctttgtgcgaggtgaatgtacaagaggagctgagtgcccttatcgtcatgagatgcctgaaactggggagttatctcagcagaacattaaagatcgctactatggagttaatgatccagttgcactgaaacttttgagcaaggcaggtgagatgccatccctgacaccaccagatgatgagactataaggaccctctacattggcggactcgatagcagaataaccgagcaggatttgagggatcagttttatgcccatggtgagatcgagtccataaggatggtacttcaacgtgcaatcgcatttgtgacgtatactacaagagaaggcgcagagaaggctgcagaagagcttgctaataagctagtcatcaagggcgtgcgcctgaagctgatgtggggcaagcctcaggccccaaagcctgaggaggatgagtctgggaggctggggcaggtttcccacggagggctgctccctagggctgtcatatctcagcagcagagcggtgaccagcctcagccccccgggatggagggccaacagcaacaggctgcaccagcatcgtactacttcaacattccagcaccaccagcaacggagcggactgtgtatccatccatggatccacagaggatgggtgctatagtaaaaccacatgacagtgaaggcaaaccagggccgcagcaagccgggcaagctcaggcatcaagcaacccagcacaagggggcggctatcctgcaccaccgccatactaccatggtcagtatccaccatactatccacccccaccaccatacggtggctacatgcctccaccgcgcatgccctacccaccgcaatatccgccttaccagccgatgctagctcaaccagcacaggtacaggctagttcatctcggcaaccaccgcatgcaggtggagggcagcagcagccgcctgatggccctccagctcagcagcagccacagcagccaattcagaactgaagtcctgtcaagatgttgggtattggtactgctctaactgctcggcaggagaatgcaacccccgtgggtcaccagctttcgtaatttcttaatttgtggttaacagtaaaaactttgttgtattgcttatcaacgtttgaagaaaaaccgtgagatataccggatgtatccagcttctggattttgtggt

SEQ ID NO: 4676 - DNA, 1139 bp, Zea mays
gaactcatcactcccgcttccagcttcccgcagcgagcatcaaaaagagaagagggagagagagcagcaggcatggaaatgggcgacagcttcgagtactactgggagatgcagcagtacctggagtcagaggagctcagcctctacatgggcacccaggacgatgccctgtcctgctacgactccagctcgcctgatggctccatctccaactcgtcctgggcgccggcgggcgtggcggccacggcgtccgagaagcgtgagggccccggcggcgcggcggccgcgaacaagaacatcctcatggagcgcgaccgccggcgcaagctcaacgagaagctctacgcgctgcgcagcgtcgtgcccaacatcacaaagatggacaaggcgtcgatcatcaaggacgcgatcgagtacatcgagcagctgcaggcggaggagcggcgggcgctgcaggcgctcgaggccggcgagggggcgccgctgcggcggccacgggcacggcgaggaggcgcgcgtgctcctgcagcagcccgccgccgccccggcgcccgtggaggtcctggagctgcgcgtgtcggaggtgggcgaccgcgtgctggtggtgaacgtgacgtgcagcaagggccgcgacgccatggcccgcgtgtgccgcgccgtcgaggagctccggctccgcgtcatcaccgccagcgtcacctccgtcgccggctgcctcatgcacaccatcttcgtcgaggtggattcggaccagacgaatcgtatccagatcaagcacatgatcgaggccgctctcgcccagctagatgatgcctccgcgagcccgccgagcgtgatgagctactattagaatcggacaaccgtcacgctgacatgcacgagccggcctagctactgtggccgaccggtactgttccgtgcgcgtatataggaactaggaagaagtgggtgctttgtttgctatatatgaggcactaggtcaggggctttatgcaactttgatgtaatggaccgaaaacgacagattgagtgttggcggctagctcccatatgtttagagtctagggaaggaataaataatcgagacaagtcttatccctgtatttttgtagagaggtatttgaaacaagaagttcatc

SEQ ID NO: 4677 - DNA, 755 bp, Zea mays
agcccacgcgtccgcggacccgtggggccggcggccacgggcacggcgaggaggcccccgtgcttctgcagcagcccgccgccgccgccgccccggcgcccgtggaggtcctggagctgcgcgtgtcggaggtgggcgaccgcgtgctggtggtgaacgtgacgtgcagcaagggccgcgacgccatggcccgcgtgtgccgcgccgtcgaggagctccggctccgcgtcatcaccgccagcgtcacctccgtcgccggctgcctcatgcacaccatcttcgtcgaggtggattcggaccagacgaatcgtatccagatcaagcacatgatcgaggccgctctcgcccagctagatgatgcctccgcgagcccgccgagcgtgatgagctactattagaatcggacaaccgtcacgctgacatgcatgagccggcctagctactgtggccgaccggtactgttccgtgtgctgctctctctttttttctttccccgacgccctgtgcgcgtatataggaactaggaagaagtgggtgctttgtttgctatatatgaggcactaggtcagggggttttgtgatgggggtttatgcaactttgatgtaatggaccgaaaacgacagattgagtgttggcggctagctcccatatgtttagagtctagggaaggaataaataatcgaggcaaaccttatccatgtatttttgtagagaggtatttgaaacaagaagttcaacaaaaaaaaaaaaaaaa

SEQ ID NO: 4678 - DNA, 5064 bp, Zea mays
  misc_feature (3467)..(3467): n is a, c, g, or t
  misc_feature (3900)..(3900): n is a, c, g, or t
ctagtgtaaacatgtttttttgcagtgttcctgtccgaggctcaccctggtgtcgcggacggtccgcgcataggtgtttgttttccaaaaaaagcttctcctgtccggaataatctacggtattccggacaatcgatttagaatagttgtagatgaacttatgcacctgataaatgatcaactaggcaaactagttagtccataaggtttgtgatggttgtcaaacaccaaaatcgattataggaaatgttgatgtcatttccctttcagcggcaccgctccctacaacgctacattccaggtacggacactttaggcaagggtaagactaggaggcacgacactttaggcaagggtaagactaggaggcattgatgtactatctttttcttccatggactctcttgtatggattgtatcgactttttatagacttgtatgacctctatagatttttatgatcttgtatggaattgtatgaacttatatggacttatataaaacaagctctatagtcttgtatatgttggcgcagacattagtgttgtttatcttggcgccgacctctatagtctagtattaagcacaattattattggcgtcgatcgccgtagtatagtataaaacatacataggtatccgcccatgttagacgccaatactattgatgtcgatctaaaggttcatttttaaaatgaaactagaaataatatatttgtaaaaataaaacacaaaaaagaactaaattgcaaaaaaatttggacgagtgagctcgctgtctggggcttgcgtcgtcgacgcggctgccaaggtagggccgtggccgggcgctctagaattcccgcacgtttctctcctggcgtttacacgaagtcacgcagaggaggtcaggaggagaccaggggagccgtgcgcgtgcgcgtcagcgtcgtcgggtgcaattcgcgcacgtttccctcctggtcgtttacacggagttaattagtgcccgcgtccgcgttaggtgtggggccctacttgtaaggctcacatgccggagcctataaaacagctcgagtgagagaccagtgagtgaactcatcactcccgcttccagcttcccgcagcgagcatcaaaaggagaagagcgagagagagcagcaggcatggaaatgggcgacagcttcgagtactactgggagatgcagcagtacctggagtcagaggagctcaggtatgccacgccggacgccaccgctatcatcggatttggcagggagtcgtctgattcgattgttcggaatttgccgtcgctgcagcctctacatgggcacccaggacgatgccctgtcctgctacgactccagctcgccggatggctccatctccaactcgtcctgggcgccggcgggcgtggcggccacggcgtccgagaagcgggagggccccggcggcgcggcggccgcgaacaagaacatcctcatggagcgcgaccgccggcgcaagctcaacgagaagctctacgcgctgcgcagcgtcgtgcccaacatcacaaaggtgagagcccaggtccagtccgtccgtccgtcggcattgcatcgcattgccagagggatcgacggcaggtgaggtcgtccaatccaaccaaatccagtgagaagccatcttgttctgattctgacggcggagacatcgcaaccgcgtcgcagatggacaaggcgtcgatcatcaaggacgcgatcgagtacatcgagcagctacaggcggaggagcggcgggcgctgcaggcgctcgaggccggcgagggggcgcgctgcggcggccacgggcacggcgaggaggcgcgcgtggtcctgcagcagcccgccgccgccccggcgcccgtggaggccctgcccctgcgcgtgtcggaggtgggcgaccgcgtgctggtggtgaacgtgacgtgcagcatgggccgcgacgccatggcccgcgtgtgccgcgccgtcgaggagctccggctccgcgtcatcaccgccagcgtcacctccgtcgccggctgcctcatgcacaccatcttcgtcgaggtacgtcgtcggcaggcaagcactagcagcagcatatatgttcgcattgtgcattgtttgcgaagcaagcacagagtgctctgctttttcttgtcaagttttcgaatgcttaggaatttaggggatgttggttttgaccgtatagtttgacattttttctcctgttcttttctttattagggcttattaagactaatttagaaactttaaaagggatttacatatttctaagagaaattagtttattttttctgggtaagattagaatctactggaagaacagtgttctcaaactagaccttagataaaaaaaaagtggagtgaataaaagatcctgtgtttcataacgaacggcacgaattgaaaagggcagcgacgagtttcctgtactgcacgacgccatggctgccctgcccctcacatgtcgatagcacgtggaaaacgatgggcacgtgttcgagccacccgcaagtcgcgccgtggctgtttccatcatgcatgaattattagtactagcactagcaggaacacaacaaatctattttccacatgcttgatagcgactggtccgagtcctacgccgtcgccgggcacaaactgcacgtgctcggctatctcgcatatgattagtgtgtgtgggttggatcggatgcgagtgactgattggcatttttagcatcgataatattttactatttttggatgaaaaaaaagagacttacaatcctgtggttttctttgccaggtggattcggaccagacgaatcgtatccagatcaagcacatgatcgaggccgctctcgcccagctagatgatgcctccgcgagcccgccgagcgtgatgagctactattagaatcggacaaccgtcacgctgacatgcacgagccggcctagctactgtggccgaccggtactgttccgtgcgcgtatataggaactaggaagaagtgggtgctttgtttgctatatatgaggcactaggtcagggggttttgtgatggggctttatgcaactttgatgtaatggaccgaaaacgacagattgagtgttggcggctagctcccatatgtttagagtctagggaaggaataaataatcgagacaagttttatccctgtatttttgtagagaggtatttgaaacaagaagttcatcaaatacaagggaaaaatgtcatggcgccaaatatgctagaaatctaggtagttctatgtttaatttaatatgaaaatagcataatttgtgacgacacacatgtgtatgtatatacttactagtacttgcaatagtaccttatacatacatgcaattatactcatcataacggaaattatgctagatctaacagatttaaatttaggaggtgaaatatatcgaacaaagggacatgtgactattcacatgagtcaaaaccntatgttgctcgaagtagtagatcatagaagaggatctaaggcagcactggaaaaaagacaacgatcaacgagcagtcacaaagacacttttaaaacctgaccagtccacacaaccgagcaggtgttacagatgcgtgcggtggtttcaaatgcctgctctcctaacactctacgcgtgaagaattttgggatggaaagattaaggtccaactcatgactttgtaatgttttgttgtctcttttgctcgtgccaagagatcaagatataatagtaggagttacagaaagattaaaatgtggatcagtcaccataacatacactcattacctcgtatcttataggttcattacacctctatcaatatagtaattaactcctccattaaccgttccaagtggcaaaacaaggctactcataaaacggcacaatcangaacatataaaaagttctcactacacagtcgtttgatatcctattgtttcaataaagactattgtcgacgtttgatagtcgggggtaaaatggagatgtagaggtttgacaaaggggctcttgaagggctactctactagccttcatggcgaagggcatagcctagttgtcgtaatatggcaatggcaaccctcccaaaactgctagagagccagtgggttttttggaggtttaggccatcacgacataacaccatatgtccttttttggatcagattcaagagaaacgactgagtcctatcatagttggctagccagatcctgagagtatgaatgcgtggagttgtctgatttggtgaacgttgtccctcgggtttcctgccttaggtcgattgagattgtttgagtggtattgactcgggttgtctgcctctatagtggaggcctcccctcccttttatagaccaatggagagagagttacatatgataggtggggcatggggctagattgaatgcctgtattgtcctccatttatgggtgcccccatcccacatttatggaagccctgttgatgtcagtctatcgttctaggagtgttagtggcgcagtaggcactcgcaccacctgtaccagatatcccaggcatcgtgtggagctagtgcaagtttgtcgaaagcataatcgtggtagggagagaagtaggctctccatgcctccacatcggtcttaggaacttgaatattacattattgatgactaagtgtgcttagtcaccgtagagtatgaagtgggtggcctaggacatgatagtccatagagataaccaatcatatcgccatagtggttgtccctataggtgagccctagaacacgcacgctgccacagaccatagtggcacgctggtgccaccctagcttgcctaggcctgacaaccagggagtaagaatgatgctaatatagttgtacgtatcatgttaaacaaggcacaatatgtcttatgactctaccaactcattgatcgaccatgacatcactgacatacaacatggtgagtctggagccctccttttgaccgtggtcactgcaggggggcagaatacgtggcatgatggggcgcacactagaggccgagtacggtggccccctaggcctcacctggc

SEQ ID NO: 4679 - DNA, 2219 bp, Zea mays
cattgggcgcctcgccccactgctgccgattcctctcatcccagcgaacgaccctccagcacgcctaatccgcttagccgccccggagcattgccatcgtcgccatcgtcgccgccaccttctatcccggtgtggagcgggagagaacccgtctgcactcagaagctggtttaatccggtgggagcacaagtcgtgtctaaaatattcagattgctaagatgttgggtcatggtctagtaactgatccctcaagaaccttacgatgtccagttaattcaagggtatcaagtgcacccttggggcttgtttcttcgttgaatttcaacaggggatgcaagggaaagaacaaaattattcaatgtggatagacacaccaagtatagtacttctttctgttatgcgccaagaaatgccagaatcacaccactagcaactgcatcatttggggatatggctgattcttcaactcctatctttccccgaatccatgtaaaagatccatatcagcgtctcggaatcagcagggaagcatcagaagaagaaattcgagctgctaggaactatctgataagcaagtatgcaggccacaagccaagtgttgatgcaattgagtctgcccatgacaggattatcatgcagagtttctttgataggaaaaaaccaaaaatgaatctccagaaaaaatttagggaacttagtcagtcacgtgccgtgaaggctattcaaggcagatttcaaacaccacgtagcaaagtcatttggcagacagctattgcttttgtcttgcttggagtgcttacccttgctttccctaccgaagaagggccaacccttccaggtggccatctcttgtgcagcaaatatctatttcatttatcagagggtcaaaagtggatggcgagcattcttttatgggtatgttttattcttattattggattttagttttaacttttaaggattaaggatatatctgcactggcctatgattagttgctcttagaacgactgcatttgtttcatttattctgtatattagatatggtgtcaccgtttttgttgatatatagcattttcttctgattgggaaagtattttttaatcaattatcctattggtacttgagcccgacaacctacagtactagcatagttggacatcccaccagaagagtatttttctatctctgggcaatggcgctatgtacgtctcctgtgctgacaaaggtttgttcgccactgtgttcaggctgtacaagcagatacgtggtggctcatattttctcgtcgcatatgtatgtaccataaaaggacctttgcgttctcatatcatgcaagcaagcaattgcaaatcgatgatctcctgatctaatccttatctagtaaccatgaatttcttgcattgatagtgttacgactggggtaacctaatagaggcgcctaacgtccaattagatagaattttttaggatcagtcaaaaacataaaggtttgttaggatccttatcaggatttgttagggccttatctcatcagccaaagagatatagaggtttgttaggatccttatagggctggacaaaatactcgtggctcgtgagctcgctcgactcgtggccagctcggctcggctcgactcggctcgtttcaattttatcacgagctgagctagcatctcagctcggttcgttaacgagccagctcgacacgagctcgagccagctcgttagctcgaatgagctagaatttatctgtaaaacaaagtctatacttgtattggatgaattaataagtgatgaactatgttagtttagggtttaaatgatgtgatatataaaattatgagtattgttagtcttttctagtgttaaattagtatgaaattaactagcaattgattatattgttgtatatatacatgtataatattttttgttctggctcgcgagctaaacgagccagctcgagctcgcaaacgagccgagccgagctggttctctggctcggttgcttaacgagccgagctgagccagctcgtttccttaacgagccagctcgagctcggtcgagccgagccgagctggctcgatatccacccctagatccttatcaggattaggtccttatctccaaggcctatataatgcaatcttggcaaggaatgaaagacaagcatgggtgattacagcggactgctccttccaacctttctcgccaaa

SEQ ID NO: 4680 - DNA, 4445 bp, Zea mays
  misc_feature (361)..(361): n is a, c, g, or t
  misc_feature (1172)..(1172): n is a, c, g, or t
ctgatagatccattatttgaaaatatgctgagagatatatttatgttcctgtgactattgcagtggtcaatggtagagcttggacttaacaactaagcactttagtttggaaataaagcttattgtaaacatatatattttagcattgtaggttagcctgcagatatattgttatgatatttacaagttagggttttagctgtgcaatagaagtgaagaggctactgaatgcagtataaaatatagtaaaatgcaccctaagtggatctgagatattcttggactggtgggaagaggcttctgatgttgtaacagggctgatcaagaaggggggtgtactccctaatcattctgggggctngggtaatatggaaacatcgtaacagatgtgtttttgatcatttgcctccaagcctgaacctgcttcttcggcttgctgatgatgaaacaaggaagtgggttgtggttggggccaagggattgtctcaccttgctgctcctctgctagtattctaagtggtggtttagttttttaccttatggattgtttcttgaatgcttgtttttggcctccctaaggggcactttgtgtagttttttgggcggtcttttggccatgtaacacttctgcttaatgataatgatgcgcagttctcctgcgctttcgagagaaaaaatgcaccctaagtccaacttttaatggattctcagttgggtgcttgagctaaaaaaatgactatcttggtcctcaatatactgctaattctcacttgggttctcgaactaaaaagtgaccatatgggtcctcaatctacaatggagctcgactaaaggtccaagctaccaacagctgcctacgtggctgtgtcgattaaagttgcaaaaaaaaaactctctatctctctccccttgtaaccccctctctcttgtagttcatctctctttgtatgttatatggccgctgagtgtgtgcctctagagtgcagatgtagctacatggttggcagaccgtgtaggcaagtcatgcaggcgaagccacgaggcaggtgtgggaatagggatggcgacgggtcgggtggagcaaaaacccgctcgcgatcgcatccgtgaagtctacctaaacccacctacgatcacactcgcgggtgcaattccaaacacccgaacacgtnaagttttgggtggccatccacatgtttttacttagtgtacaatttttaacaataattcaagtatcaacaataattgagttgtatctatggattttaagctttctcacgttgagcaacaacaaaatatttcatgaatcgttagccacgttacttattcaaaataattactattgtatattaatcatttttgtgcaaaataaagaatgaaccaaatttcgagttgggtgtagatcacccgcgggttgaggtagaaacccgcatctgcacccgcgaaacttcaggtcgggtgcgggtgcacccgtggcgtgggtcaaaatcttcacccataccctcacctgtcgggttttcggtttgcggattaaattgccatcccaatgtgggaccaacaggagacagaggagggaccgaacatggaggagatgggtcggtgtttggtaccgacggcacactacgaggtgtaccatgtgctgcttttgggaggacggcgaggtcgattgtaggacatgacagaacaatgatatatacatgttcgggtcgcttgagcgcgtaataccctacgttctgtgagtttgtggatgtgtattgctcggtgattgaggattacagagggttctgaggtggaagatgatgagtacgctattgtggtgtctctcgtttttgtaggggttcccccctcagtcttattgccgagcgaagcggagttacaatacaacgcatgacttggtacgtgatctctattcgcccgcctctgctagagtcgtgccgagtttcttagtggtcggcgaatccttaggaggttcgcacgtcccctacatgtgcggaacgcggctgagaagtcttcacgcccacacaacgtcttcctcgctcgctcccggtagcgcccaactgaagtcccccagggagggacacacacccggcccattaaaggccttttaggcggccgacagaagataaccaagccgtggtgacccgggggatatctatcccccacaatgggggaggaaggggaggttctgcaagttttacatagcctcattcacggtggcacatcctcagacatatagaggtcatgtgatgggatttggacctctacttaggtgcgacattagttgaagtacctatgttgtctctagcagcgtcctctatattcatgatctatatctatttttacaatttcttctaaaaggttctctcctctatatctcgttcctctcctgttgctctccagcagcgccctctaaatctcgtcctatatacataaataactgtattagaggcatgttttattttattatacatacttatttgtcataccctttaatttttaatacatattttagttttcttaatatgttgcttatattgaaatagatgaggaaaggagagagtctttatatatagagggtggacttcctctatatttagaggacactgttggaggggatagggacaaaatctcccttatatttacaacaccctttagggcttgtttggttattcctatcccatgtggattggatgggatcggaaaaaaatatgaaagattttgacttgtttggaatttaaactcactcaatcccatccaatctacatggattaagagcaaaacgaacaagcccttagagggccttgttggagacaacctagatggtaacccacattagattgatgacccagatagtcacctttttagttcgaggacctaagtgagaattgatgaaaagtttaagaacccatggtgcattttactcaaatataaattacagcggcagtagttgcaaagcctaaatggttactccatggagtgggaaatatgttttttccctaatacagtactataatttttgccatgctaggatcaaaccacagacttggcaacttttccatgtaatcaaattcgaatgttttcttaaccagaatattcaagaggatctgttcttatcagctccatgttcccaaacaaactctttgctggtgtaacttatggtgtcacagctcacaggggcggagcgaggcccaatgctgagtgtgctgcagcatgggtccagccaagtttatctttggtaaatatttgtaggtttagtctaaaaaatgctagagtttggttcaaattatggtaatgcagcacctgtctactagcacaggcctggttcgaacccatttctagcactgttccttggtgttcaccgatagatcaaccgcatgcctagtttctcacgagttgtgcggagacctgtcaacttgttaatgtcaataatgctagtccatatttgaactaatgccatttttctgatgcataagcatacgaaagttgtgtgcaaatgcttgtagatgtaggtcgtgtggtctggggcaggtacaccagattggcccagagggtagatctttgtgattgaacactgcagtagctggcattttagaattatttagtttggtttgggccatttggagcttattgtataatcttttggcttggtaataacggtttgggctgaatagcgtcatctaagttggcccaccagcatttcctgtccaatcaccataactgttattgctgagattaacacaatattctcagtgctggctttagttttttttttaaaaaagcagtctttggcatcttaatttgtgtacattgctttaggtgattcttttaaaagagagctttagttgtttttttaatattgttttctgctttaggtggttcctaaccctgagatttatgtgacctttcaggtttggttctttctttgcttcctggttccttggcaccttcttgatggtatctggtaattccccctatactccccggtccaagaaacttggaagtgagcaccgcgtgtgttacttatgtgctccttttcatatcgtcgaccttcttgaagtaagagatctttgtgtttccatgttagcgcaaagtcttgcaggagttataaacatggtatcatgcttcaaatagcttgtacaatccatcggctttttctttgcttgtttcacgtttatggagctggaaatgctagttctttagtgagttgatagtagttttcaggttgcaatgtgagatgtagaacgtttttttgcctaggcccgtgatatcttgagcagggtctaacacctcttgtgggtattttcagttgatgtattaaatacagttgtgttcgaatagatcatatgagataatatctcatcagtcttattttggaaaaacatcacgtcacctgcggccattacagtccgttctccctgaatgctgactgttctgatcgcgtttgc

SEQ ID NO: 4681 - DNA, 1545 bp, Zea mays
cacggccggccacgcgggccggggtccccgccccactgctgcccattcctctcatcccagcgaacgaccctccagcacgccatccgcttagccgccccggagcattgccatcgtcgccgccaccttctatcccagtgtggagcgggagagaacccgtctgcactcagaagctggtttaatccggtgggagcacaagtcgtgtctaaaatattcagattgctaagatgttgggtcatggtctagtaactgatccctcaagaaccttacgatgtccagttaattcaagggtatcaagtgcacccttggggcttgtttcttcgttgaatttcaacaggggatgcaagggaaagaacaaaatattcaatgtggatagacacaccaagtatagtacttctttctgttatgcgccaagaaatgccagaatcacaccactagcaactgcatcatttggggatatggctgattcttcaactcctatctttccccgaatccatgtaaaagatccatatcagcgtctcggaatcagcagggaagcatcagaagaagaaattcgagctgctaggaactatctgataagcaagtatgcaggccacaagccaagtgttgatgcaattgagtctgcccatgacaggattatcatgcagagtttctttgataggaaaaaaccaaaaatgaatctcaagaaaaaatttagggaacttagtcagtcacgtgcagtgaaggctattcaaggcagatttcaaacaccacgtagcaaagtcatttggcagacagctattgcttttgtcttgcttggagtgcttacccttgctttccctaccgaagaagggccaaccctccaggtggccatctcttgtgcagcaaatatctatttcatttatcagagggtcaaaagtggatggcgagcattcttttatgggtttggttctttctttgcttcctggttccttggcaccttcttgatggtatctgtaattccccctatactccccggtccaagaaacttggaagtgagcaccgcgtgtgttacttatgtgctccttttcatatcgtcgaccttcttgaagtaagagatctttgtgtttccatgttagcgcaaagtcttgcaggagttataaacatggtatcatgcttcaaatagcttgtacaatccatcggctttttctttgcttgtttcacgtttatggagttggaaatgctagttccttagtgagttgatagtagttttcaggttgcaatgtgagatgtagaacgttttttttttgctttggcccgtgatatcttgagcagggtctaacacctcaagtaggtattttcggttgatgtattaaatacagttgtgttcgaatagatcatatgagataataaaaaaaatgaaaaaaaaaaaaaaaacatcacgtcaccttggaacatacagtccgttctccctgaatgctgactgttctgatcgcgtttgcaagataggaactggggaagaatccttaggttgctacgcctgatctgggatcctgggatctctcgagtttgttgcgtaagaattgtcgt

SEQ ID NO: 4682 - DNA, 2620 bp, Zea mays
cccacgcgcccgcccgcgcgtctggccgtcgttgacaccagctagtagcagccagcactagtcgctactagctagatagccatatcaccagcatgtggaggctgacggtggccgagggcggcggcccgtggctgcgctcgacgaacggcttcgtggggcgggcggtgtgggagttcgaccctgacctcggtacgccggaggagcgcgacgaggtagagagggtacgccaggagttctccgaccaccgcttccagaggagagagtcggccgacctcctcatgcgcatgcagtgcgcaaagcagaacagatctcaacgtcgtgatctgccacgcatcaagcttggggaggatgagcacgtcactgaagaaattgtactgagctccttgaggtcggctctggaccagttctcttcactgcaagccagcgatgggcactggcctggtgatttcagcgggattatgttcatcatgcctggtttgatatttgccttgtatgtcactggatcactgaatgttgtcatatcaccagaacatcggcatgagatttgccgctacatctacaaccaccagaacgaagatggtggatggggcacacttatcttgggttcgagcaccatgtttggcacatgctcaaactacatcaccttgaggcttctcggtgaggagccatacgccaacaacagtgtgttggctaaagggcgtgcttggattctatcccatggtggtgcaaccttgattcctcagtggggaaaaatatggctttcggtacttggattgtttgattggtcaggaaataatccaattttccctgaactatggtccattccccagtttcttccatttcatccagggaaattctggtgctttgcccgtatggtatatctaccaatggcttatctttatggcaagaaatttgttggaccaattacaccaactatattggcactaagagaggaaatctatgacactccttatggaaagattgactggagtgatgctcgtagtaaatgcgcaaaggaggacctcatctgtccacgcacactgttgcagaatgttatttggacttcactttataggtgtgtggaaccagtattgagcagttggcctatcaacaagctgagagagagagctctgggaaacatcatggagcatatccattatgaagatgagaacacacaatacctatgcatatgtcctgtgaataaggctctaaacatggtctgctgctgggtagaagatccaaattcagatgcattcaagcgtcaccttgcaaggataccagacttcttgtggatttcagaagatggcatgaaggcacaagtatatgatggctgccagagctgggagacatcattcataattcaagcattttgcgctacagatcttgttaatgactatggttcaactcttcagagagcctatgagtttatgaaaaattcacaggtcatgaggaaccatcctggtgaccaacgttattggcatcgccatagatcgaagggttcatggacactttcatctgcagacaatggatgggctgtatctgacactacaggagaagcacttaaggctgtactgttgctgtcaaagatctcaaacaaaaacaaccttgttggggatccaatagaaagagaaaggttgcatgacgctattgattgccttctatcttttgcgaacaaagatggcaccttttctacatatgagtgcaaaagaacttattcttggttagagattctaagtccttgtgagactttcccaaacattgttgtcgattatccttacccagaatgcacttcatcagtgctccaagctctgatattgttcaaagacttatatcctggttaccgcacagaagagatagaagcattagttagaagtgcagcaacgtttattgagaccaaacaacaagaagacggttcatggttaggtaattggggtatatgtttcacctacggggccttcttttcgattaaaggtttagtcgcttctggaagaacgtacaagaacagcccttgcatacggaaagcatgccacttcatattgtcgaagcagctcagtactggtggatggggagaaagccatatcgctattgaaactcaggtgtatgtaaatctcaaaggtgaccgtgctcacgctgtgaataccgcctgggcaatgctcgctttaatttatgctggacagtttgaacgagatccaacgccattacatcgtgctgcaaaggaattgatcaacatgcaactggagacaggagagtttcctcagcaagagcatgtaggatgcttcaactgcagcctctacttcaattacccaagctaccgcaacttgttccccatctgggctctcggtgagtaccatcgtggccttcgtgcaaagaaagacaagtgagtccgtgtgtctatatatatatatatatagagagagagagagtacgtatagcattgtgaggaataaaacaggttgcgtcggtggtgagtgcgcagaaacaagatgtgcttttatgtaggcgtaccacagtgtacaatgttggtcgttgttagactgtaaggctatcatgacgttgtatattgtaatatatatatagtgttccatatgtttcaaattatataagacgttttatcttctct

SEQ ID NO: 4683 - DNA, 2083 bp, Zea mays
tcctttagagtcgacctgcagctaatctgcatagaagatccacccgtctatttccagttccaccactgtgaaccacatgatacggtacaagttgtactaatctgaatcaaaaacttgactagccacacactagtcatagctgtcttcagtctacagtacattcgattccgttctgatccatcccgtgtagtagtagtagtaaacaaatatagccgccacccccgttataaatagccggccggcgacgccaaccccggcctgctcctgcttgtctttcctttctccctccccttcgagccaccaacccgggatgcagcccactacgcgggaaatgcaggccatggccgccgccggccagcagatctccctcgacgacctccgcgcggcagcaggcggcgtgcacgacgacttcctggaccagatgctcggaggcctgccgccgtcggcatggccggagctgtcgtccgcggcgggagggaaggcgccggatggcggcgcgcaggcggagcagatgcagcaccagccgcagcacttgggtgggggtgggggcctgtacgacgactccgccttgctggcgtcgcggctccggcagcaccaaatcagcggcggcggcggcggggaggccgtgaagcagatggtgctgcagcagctggccgatctgaggcaggaacaccatgtgttgctgcagggcatgggccgctcgacctcgacgggcggcagcagagacggcggcctgctcctcccgctctctctcggcagtggcggatcgggcggcgacgtgcaggcgctactcaaagctgtagccgactccgccggaggagaagccgcaggcgtcttcggcggttccttcgccggatcgctccaccaccaccagcagcagcagcagcattttcaatcacatccgcagcagcaaacggcgccgttgccggggcagggcttcggtggaggcgcgggcgcgtccggcggcgtgtcgcagccgcaggccggcgctgcgtgcggaggcgccgccgcgccgcccaggcagcgggtacgggctcggcgcggccaggccaccgacccccacagcatcgcggagcggctccggagagagaggatcgcggagaggatgaaggcgcttcaggagctggtgcccaacgccaacaagacggacaaggcgtcgatgctggacgagatcgtcgactacgtcaagttccttcagctccaagtcaaggtgctgagcatgagccggctaggtggtgccgccttccttttgtggaccgtgcgtgtgtgtgttgtgcttccttttgtggaccgtgcgtgtgtgtgttgtgcagggtcgaggcggcgtggcggtcgcggccgggagcgatgatgggctggcggtgacggagcagcaggtggcgaagctgatggaggaggacatgggcaccgccatgcagtacctgcaagggaagggcctgtgcctcatgccggtctccctcgcctccgccatatcctccgcgacgtgccacatgcgacctccggtgggaggaccgggcctcggggtcgccgccgccgccgcgcaccacatggccgctatgcggttgccgccccacgccatgaacggcggcgccggagccggagccgacgccgtgccggcctcacccagcatgtccgtgctcacggcgcagtcggccatggcgcccaacggcgccgggggtgggactgatggcgagggctcgcactcgcagcagcagcagcggcatcatcccaaggacgccgcgtccgtgtcgaagccgtgatccgctcgtgaacgtgaaggcaacggccgccgtgacactaacggcgcaaccatgacatgacactcggagctgacaaagtgggctctttggcgggcccacccacgggctctcggcactgcagctggccctccgaccttcccccttttcgcattttattcccagtgtaaccattgtttttttttcccttgtttaatattaatcccatgtattatcgattcgcaaatgcaaggctggttctcctctgcttgctttgcgccagctttaccctctcttttcccgccatccgcaccaaaaaaaaaaaaaaaaaaaaaaaaaaaaaaaaa

SEQ ID NO: 4684 - DNA, 1720 bp, Zea mays
cttggtggaaatattcttgggggcagtatcccttcatcattaggacagctggtgaaactgggtacaaccttgaaccttagtagcaatggtctagtgggtgacattccatcacaattcggccttgaatgtttcttacaaccaatttagtggaccagtcccagataatcttctgaagtttctgagttccacaacaaattcttttgatggaaacccaggcctctgtatctcttgcagcaccagtgattcttcttgcatgggagctaatgttctgaaaccttgtggcgggtcaaagaaaagagcagtgcatggccgattcaaaattgttctcattgttcttggctcattatttgtgggagcagttctggtactcatactctggtgcatccttctgaaatctcgagatcagaagaagaatagtgaggaagcagtcagtcatatgtttgaaggttcctcatctaaattaaatgaggttatagaggcaactgaatgttttgatgacaagtatatcattggtaaaggtggtcacggaaccgtttacaaggcaacactgaggtcaggggatgtttatgctataaagaaacttgtgatttctgcacacaaaggttcatacaaaagcatggttggagaactgaagacactaggtaaaatcaagcacaggaacttgattaagctgaaagaatcttggttgagaaatgacaatggattcatactgtatgattttatggaaaaaggtagccttcatgatgttctacatgtagttcagccagcaccagccttggactggtgtgtgcggtatgacatagccctcggcactgcccatgggttagcatatctacatgatgactgccgccctgcgatcattcatcgcgacatcaagccaagtaatatactgctggacaaggacatggtgccacatatttcagattttggcattgcaaagctcttggagcagccttctactgctcctcagaccactggtgtcgttggcaccattggatatatggccccagagttagcgttctccaccaagagcagcatggagtccgacgtgtacagctacggcgtggtgctgctggagctgctcacgaggagggcggcggtggatccctcgtttcccgacggcacggacatagtcagctgggcgtcgtccgccctgaacggcaccgacaaaatcgaggccgtctgcgacccggctctcatggaggaagtcttcggcacggtggagatggaggaggtgagtaaggtcctgtcagtggcgctgcggtgcgcggccagggaggcgagccaaaggccctccatgaccgccgtcgtgaaggagctgacggatgcacggcctgccactggcggcggccggtcgttgtccaagtcgaagcaggggaaaccaggatcgcaatccaacagcagcgcctaccggcagtaggatctctgactctgccgagctgtttggggacaccaactttactcaacttgtagtctctactctataggtaccctcgcttggtgtacatcctgattggttagttggcaaagattagttgtagttcaaatgaaacggagagatgctggactcgtgtcagtgcgagtgaagcaagctgcttgttctgaaatctgtggactgtggcttgtccgtggcttccagggacgggaccaggagagaatgggtattcgaaattgtactaaaggaaaaaaaaattagatggtctgaaaaaaaaaaaaaaaa

SEQ ID NO: 4685 - DNA, 2750 bp, Zea mays
cccactcgctcgccacccccccccccgccgagacccccccccccggggggagctccgcgcgggccctcgcctgcctcgtcaccgtcccgcggcctccgatctccaagggcggccggaggagtcggaggggcagagtgagatggcggcggaggagggggccatgtcgccgacgaggatgcttgcggaggggcacctgcgggtggccaccggcgggggcgcgccggcggacggcgggatcgccgtcagacacctcccgcaccatcaccccactaagaaagacaatgttggtgggaaaactgaaaaagacaatcatgaaggtgtaaattctttactatctgaggagttggaaaaactagctaatgggaatagcaagattcctggtacattagatgagtatagaaagcttgtcgttccaataattgaggagtattttagtacaggagatgtggaattggcagcttctgagctgaagtgtcttggatctgatcagtttcatcattactttgtgaagaagcttatatctatggcaatggatcgccatgacaaagaaaaagaaatggcatcgattctgttatcatctttgtatgctgatctactgagctcctacaggatcagtgaaggttttatgatgcttctggagtctacagaagatctaactgttgatataccggatgctactgatgtattggcagtttttattgcacgggctattgttgatgaaattttgcctcctgttttcctcactcgagctagggcactacttccagaattttccaagggcattcaagttctgcaggttgttgaaaagagctatttgtcagctccccaccatgcagaattagttgaacgcaaatggggtggaagcacacactctactgtagaagaagcaaaaagtaagattaagaatattctaagagaatatattgagaatgaagacatagatgaagcctttaggtgtataagagagctcagccttccatttttccatcatgaggttgtgaagcgtgctctcacctttggtatagagaacgtatcctcgcaaccatcaatccttaagttattgaaggaggcagctgcaagttgcttgatcagtcctaatcaaatctcaaagggtttttctagactagctgagggtgttgacgacttgagtcttgatattccttctgctaaagttctttttgacaagctggtttcaacagctatatctgaaggatggcttgatgcttcttttggtaaatcagctgcccctgatgaagagatacaaagtacaagcgttgtaaaggtgaagcgttttaaagaagaatgtggccacataattcatgagtattttctctcagatgatgtcccagaacttattcgaagccttgaagagctttctgctccagaattcaatcccattttcctcaagaagcttgtgacgcttgctatggatagaaagagcagagagaaggagatggcctcagtactcctttcttcattgagattagaattgttttcaactgatgacatcattgagggttttgtaatgctcttgcagtcagcagaagacactgcactcgacattgtggatgctcctagtgaacttgctctcttcctagctagggcagtgattgatgaagtattaattccgctcaatttggatgaaatcagcattaagcttcggccgaacagcagtggcagccaaactgtccagatggcgcgtgctctactgtcagctcgccattctggtgagcggatactgcggtgctggggcggtggcactggatgggctgtggaagatactaaggacaagatcactaagctattggaggaatacaacactggtggtgacctaggagaagcctgcagatgcatccgtgatcttgggatgcccttcttcaaccatgaggtggtaaagaaggcactggtcatggcgatggagaagcagaatgacaccagcatcttggtcctgctgcaggagtgtttcggcgaggggctcataaccatcaaccagatgaccaaaggctttgcccgtgtcaaggaaggccttgatgatctgatcctcgacatcccaaatgcccaggagaagtttggagagtatgtggagctggcaacagagcgcggctggctgctgccgaccttcgcctccgttccctgagcatccaccactggcgataccttccttatgtgtacatttgtgcccatgatgtcattagctccgtaccaaagttttcctattcctagtttacttatgttaccgtatactggaggattgtaggatggatgtggtgtcggttgttgagatagtgtcctattggtctagtctgggagggtacttttgagagttaaaagaataaagccatttcgtttcaggttatgagatgtacgctgcaacctttgtccctggatggacctggtggtaccatattcttaatatgatttattgccgatctgggaagtggaagtgcttggaactattgcatggatatcaacacaatacatgatgtaattctcgcgatgtactaacttgattcagatttagacagcaaggtctatgaaatggtgtagaaggaccctttagctaatcagcaaaaagtaagttggatttattttgtcttacgatggatgactgagttgtgagccttcaaaattttgatgaagacagtctactgtagttgctctaccatctgtctttatcaaattcttttcggtttcaccatttactgcgattttctttccccaataaatgttaattgtttgtgctaaacaat

SEQ ID NO: 4686 - DNA, 620 bp, Zea mays
ttttttttttttttttgaaaagaaacatatatttattagaaaagggaatattattaatattccagcttcggtatcggttgatacatgtggctattcaaattcacaaacatggtggttccactttggaacgaaaatatcaggttcgacaaagatttcacaaattcaagcactcaatctatgataaaaagactagccattacttgaaaagatctccatccttgtcgtctcaagcacacgacatccccatcttacttgagatctgtcctcctccttctgcaacagtgtccaaaaccttgtccaatgtgttccttgaccatggcgatctcgccaagcttgagcttgtagaggatggtggttttaccagtggtatcgatgccgaccataaggatctgcatatccttatcgacgaagagccggctgaagagcttcccaaacgcgagccccattcctctatgtctgctttctttaccacttgagttgcattgaatgtgaaatccgaaggaggaattggggatcgttgggcgaggtgaagagttgatggggagcagaggggaggagagggaggagagggattaacgtcacgcttcatgccgactggcgaggtcggttacgatccttct

SEQ ID NO: 4687 - DNA, 1213 bp, Zea mays
cggtatcggttgatacatgtggctattcaaattcacaaacatggtggttccactttggaacgaaaatatcaggttcgacaaagatttcacaaattcaagcactcaatctatgataaaaagactagccattacttgaaaagatctccatccttgtcgtctcaagcacacgacatccccatcttacttgagatctgtcctcctccttctgcaacagtgtccaaaaccttgtccaatgtgttccttgacctgcaagggagtggaaactcgggcattatcaaaaaccacatcattacgacttaaccataaagcacaacagagggcacatgctccaacccatatccggctcttaagtccataatttaaaccctttagccaagtgccaaacatatgttggatgcacaaaggcggagtaatgttaaatgaaatttgtacacctctccaaacacatctagccatatgacagtcaaagaagatgtgttgaacggattcatccaagttgagaaagtcgcctcgaggggggtgaataggcgaaacctaaaaattataaactttgaacacgcactttacctggggttagaaataaataatagtcaatttgtagtgcgaaagatagttcttattcctatgagttgctcaatcaatgcagataactttgggagcaaactcaaatcattgtgagcaagagaactttagagtgaggagagggaagaaacaaatcgagtgatggagatcaacacaaattaacacggtgatttgttttccgaggttcggttctaaagaacctactccccgttgaggaggccacaaaggccgggtctattccaacccattccctctccgttgctgtcgccgttgctgtcggtcgagtgcttcttcttaatcacacgggtcactgactgcaccagatcttgtatgctccaactgtgtagaattcccccaaatcattttctttgtatatttatgtgaactgtatgcaccatgacgatctcgccaagcttgagcttgtagaggatggtggttttaccagtggtatcgatgccgaccataaggatctgcatatccttatcgacgaagagccggctgaagagcttcctaaacacgagccccattcctctatgtctgctttctttaccacttgagttgcattgaatgtgaaatccgaaggaggaattggggatcgttgggcgaggtgaagagttgatggcgacagcaa

SEQ ID NO: 4688 - DNA, 983 bp, Zea mays
gctacgtaggccccccccccgtcgcgcaggacgccgacccgctggccacgctcttcatgaacgagtccaacgtcatcgagacctgcgacgaccccttctccaccgtcgacacgtacgtggccaagctcaaggacctccgcaccgccggcgccatcctggaagggatcggcctggagggacacttctccaagcccaacatcccgctcatgagggccatactcgacaagctcgccaccctggggctgcccatctggttcaccgagatcgacatcagcaacaagttcgacgcgcagacgcaggccgcctacctggaacaggtgctgcgggaggcatactcgcacccggccgtcagcggcgtcatgctgtggacggcgctgcaccccagcggctgctaccagatgtgcctcaccgactggaacctcagcaacctgcccacgggggacgtggtcgaccgcctgctcaacgagtggcggacgctgcaggcggccggccagaccgacgcgcacggcgcctacagcttcaccggctacctgggggagtacgtcctcactgtcagctacaacaacaggaccacgcagtccaccttctcgctgtcgccgggagacgagaccaggcacatcaacgttcagatgtgacgcgccaacattatatttagggctcctctcctcacggtccgatccatacctggatcggactacttattactagctaatgtagtgactgttgtggaagaagattgcacagtcaatctatgtttcttacttgtcctgtgtcagatttagtgtaagaactggcgtccttgacagctggtatgtaaaatagtatggccaccactattactatatatataacaagagacttcactccaaaaaaaaaaaaaaaaaaaaaaaaaaaaaaaacgagagaaaaaaaaaaaccacaaacccaaaaaaaaaaaaaaaaaaaaaaaaaagcgtccccggccaccaccctaatgaggaata

SEQ ID NO: 4689 - DNA, 1615 bp, Zea mays
  misc_feature (1)..(1): n is a, c, g, or t
  misc_feature (3)..(3): n is a, c, g, or t
  misc_feature (10)..(10): n is a, c, g, or t
ncnccggacncaccggcgccaggtgcatcgccacggtcgttgccaggagcgactgctgggccttcgtcaagggcggattcgtcctggactggccgacgcagacctcggtcatcttctttcagaatgctgacaagacgcccatgaagatcaccgtggcgagcgggtcgctgcagccgttcaccacggaccagtgggcgatgcaccagcaggataccatccggaagaggaggaagcgcgtggcgaccatccacgtggccgacccgcagggcgcccgcgtggtgggcgcgtccgtgtcggtgcagcagacggccaaggacttcccgatcggttcggcgatcgcgtccaccatccttgggaaccaggcgtaccagcagtggttcgtggaccggttcaacgcggcggtgttcgaggacgagctcaagtggtactcgacggagcccatgtcgggtcagctgcgcttcgacgtgccggaccagatgctggcgttcgtgcggtcgcaccgggtgatggtgcgcggccacaacatcttctgggagaaccaggacgcgacgccccggtgggtgaagaacctgacggcggacgacctccgcgccgccgtcaacacgcgcatccagagcctcatgacccgctaccgcggcgagttcgcgcactgggacgtgaacaacgagatgctgcactacaacttctacgagcagcggctggggcccaacgcgtccgcggagttcttcagcgtcgcgcaggacgccgacccgctggccacgctcttcatgaacgagtacaacgtcatcgagacctgcgacgaccccttctccaccgtcgacacgtacgtgtccaagctcaaggacctccgctccgccggcgccatcctcgaagggatcggcctggagggacacttctccaagcccaacatcccgctcatgagggccatactcgacaagctcgccaccctgggcctgcccatctggttcaccgagatcgacatcagcaacaagttcgacgcgcagacgcaggccgcctacctggaacaggtgctgcgggaggcatactcgcacccggccgtcagcggcgtcatgctgtggacggcgctgcaccccagcggctgctaccagatgtgcctcaccgactggaacctcagcaacctgcccacgggggacgtggtcgaccgcctgctcaacgagtggcggacgctgcaggcggccggccagaccgacgcgcacggcgcctacagcttcaccgggtacttgaaaagatctccatccttgtcgtctcaagcacacgacatccccatcttacttgagatctgtatcctccttctgcaacagtgtccaaaaccttgtccaatgtgttcctctaaaggtgaccatgacgatctcgccaagcttgagcttgtagaggatggtggttttaccagtggtatcgatgccgaccataaggatctgcatatccttatcgacgaagagccggctgaagagcttcctaaacacgagccccattcctctatgtctgctttctttaccacttgagttgcattgaatgtgaaatccgaaggaggaattggggatcgttgggcgaggtgaagagttgatggggagcagaggggaggagagggattaac

SEQ ID NO: 4690 - DNA, 2342 bp, Zea mays
gaccactaacgcagcgcaagcacagtgagccttcgcgtcgcgcgcgtgtcatctgtcgctgtcacgtccacacctatcatacgcttgagctttgatagaataaaataaactatgcgcggcgcagaacatgaacaacagagtagagcgcggcgtgcgctaactccaggtttatttgcgtggcgtccagtgcaggggccagccggagccggcgctgtacaacggaggcattctcaagttcggcagcagcggcggagacccggacggataccgcacgacggagaccggcgtcttctccccggcgttcgtggtgtacaacctcaacaaaaccaccatgtacaccttctcatgtgagctctcctaccctttttgcagtcatgtagtacatacacatgtgaggccgactactagtactactacgctcgtgcatgtgagcttcaataattctcgatccctgtcacacgcatgcatcaggctgggtgaagctggaaggcgcgtactcggctctgatcaccgcgaggctggcgccggacaacaccggcgccaggtgcatcgccacggtcgttgccaggagcgactgctgggccttcgtcaagggcggattcgtcctggactggccgacgcagacctcggtcatcttctttcaggtacgcgcgcaagcacgcatcggatgcatgcgctggctgaattggcaaattgaggttttcattatatattgttcatgcgcgcgccctgcagaatgctgacaagacgcccatgaagatcaccgtggcgagcgcgtccctgcagccgttcaccacggaccagtgggcgatgcaccagcaggataccatccggaaggtaacgaacgaggccggagaagaggaacgcgttcgacgatgcgactaaagtagtacagtacagtactaatcttcttcatctcttgtttatatatgtatacccgatcgatcgagcagaggaggaagcgcgtggcgaccatccacgtggccgacccgcagggcgcccgcgtggtgggcgcgtccgtgtcggtgcagcagacggccaaggacttcccgatcggttcggcgatcgcgtccaccatccttgggaaccaggcgtaccagcagtggttcgtggaccggttcaacgcggcggtgttcgaggacgagctcaagtggtactcgacggagcccatgtcggggcagctgcgcttcgacgtgccggaccagatgctggcgttcgtgcggtcgcaccgcgtgatggtgcgcggccacaacatcttctgggagaaccaggacgcgacgccccggtgggtgaagaacctgacggcggacgacctccgcgccgccgtcaacacgcgcatccagagcctcatgacccgctaccgcggcgagttcgcgcactgggacgtgaacaacgagatgctgcactacaacttctacgagcagcggctggggcccaacgcgtccgcggagttcttcagcgtggcgcaggacgccgacccgctggccacgctcttcatgaacgagtacaacgtcatcgagacctgcgacgaccccttctccaccgtcgacacgtacgtgtccaagctcaaggacctccgctccgccggcgccatcctggaagggatcggcctggagggacacttctccaagcccaacatcccgctcatgagggccatactcgacaagctcgccaccctggggctgcccatctggttcaccgagatcgacatcagcaacaagttcgacgcgcagacgcaggccgcctacctggagcaggtgctgcgggaggcatactcgcacccggccgtcagcggagtcatgctgtggacggcgctgcaccccagcgggtgctaccagatgtgcctcacggactggaacctcagcaacctgcccacgggggacgtggtcgaccgcctgctcaacgagtggcggacgctgcaggcggccggccagaccgacgcgcacggcgcctacagcttcaccggctacctgggggagtacgtcctcactgtcagctacaacaacaggacgacgcaatccaccttctcgctgtcgccgggagacgagaccaggcacatcaacgttcagatgtgatgcgccaacattatatttagggctcctcggatcggactacttattactagctgatgtagtgattgttgtggaagaagattgcacagtcaatctatgtttcttacttgtcctgtgtcaaatttagtgtaagaactggcgtccttgacagctggtatgtaaaatagtatgaccaccactattactatatataacaagagacttcactccaaaaaaaaaaaaaaaaaagccccctaaaaaaaaaaaaaaaaaaaaaaactcgagaggggg

SEQ ID NO: 4691 - DNA, 1922 bp, Zea mays
ccgggattccatccctccttcaattagcagcggcaccgatataatttatcctcctcccctagcctcaagctcaaagctcaccgccgtctcctaccgcagcaacacagcctccgccagtcaccgagctagctagacccacgcgccgcgccatgacgtggaacaggtccgcggccgacggcggcggcagcagcgccgggacgaccgccggcgacgacaccggcctggcgcgactgcgggagctcgggtacaagcaggagctgaagcgcgacctctcggtgctgtccaacttcgccttctccttctccatcatctcggtgctgacggggatcacgacgctctacaacacggggctcaacttcggcgggcccgccaccatgacgttcggctggttcgtcgccggcgccttcaccatggccgtcggcgcctccatggccgagatctgctcctccttccccacctccggcggcctctactactggagcgcgcgcctctccggcaagcgctgggcgcccttcgcctcctggatcaccggatggttcaatgttgtcggacagtgggcggtgaccaccagcgtggactactccctggcgcagctgatccaggtgatcatcctgctcgccaccggcggcaagaacggcggcggctacctggcgtccaagtacatggtgatcggcttccacgccgccatcctgctcagccacgccgtcatcaacagcctccccatcaccttcctctcctttttcggccagttcgccgcggcctggaacatgctaggtgtgtttgtcctgatggttgccgtgccgaccgttgccaccgagagggccagcgccgagttcgtgttcacccacttcaacaccgacaacggcgccggcatccgcagcaacttgtacatctttgtcctgggcctgctcatgagccagtacacgctcacaggatacgacgcctcggcgcatatgaccgaagagacgaagaacgcggacaagaacggccccatcggcatcatcagcgccatcggcatctccatcctcgtgggctggggctacatcctcggcgtcaccttcgcggtcaaggacataccctacctgctgagccccgacaacgacgccggcggctacgccatcgccgaggtgttctacctcgccttcaagagccgctacggcagcggcgccggcgggatcgtctgcctgggggtcgtcgccgtcgccgtctacttctgcggcatgagctccgtcaccagcaactccaggatggcctacgccttctccagggacggcgccatgcccttctcctccgtctggcacaaggtcaacaagcaggaggtgcccatcaacgccgtctggctctcggctctcgtcgcgctctgcatggcgctgccgtctctgggaagcctggtggcgttccaggccatggtttccatcgcgacgatcgggctgtacatctcgtacgcgctgccgatcctgttccgggtgacgctggcgcgcaagtacttcgtgccggggccattcaacctgggccgctacggcgtcctggtcggctgggtcgccgtgctctgggtggccaccatcaccgtgctcttctcgctgccggtcacgtacccggtcaccaaggacacgctcaactacacccccgtcgccgtcggcggcctcctcttcctcgtcctcgcgtcctggctgctcagcgccaggcactggttcaagggccccgtcaccaatctggacggatgaatatgtataattggacatgtatagtagagaggctggcagagacggaagagttgttgccaacgacatgttgtaactactttgttccaaaaattaactagcaaggaaaccgacaggatgaattttcacaaaaaaaaaaaaaaaaagaagccccaatgcgagcaccatgttccgggtgactcaaaaaaaaaacccgcggcc

SEQ ID NO: 4692 - DNA, 1996 bp, Zea mays
ccggccgggtcccccgggacaattatctcgctgcccgccgactgccggtgtcagcttcctccggatcaagaagcggcaggtagagcagagaagccagctagctagcgagctgaggagagatggaagcgcagaacggctacagcccgcttcttgccggggacgaccacgaggcgatccacgccaccggcgccggtgatgaaggcgacgacgtcaagctcaggctgctcggatacaagcagcagctcaagcgcgacctctcggtggtagccaacttctccgtgagcttctccatcgtgtcggtggtaacgggcgtgacgacgctgttcgggacgggcctccagttcggcgggccggcgacgatggtgtacggctggcccatcgccggcgccttcaccgcggccgtgggcctcgccatggccgagatctgctccgcctaccccacctccggcggcctctacttctggagcgccaggctctgcacccaccgccgctggggacccttcgccgcctggctcaccggctggttcaatgttgtcggacagtgggcggtgaccaccagcgtggactactccctggcgcagctgatccaggtgatcatcctgctcgccaccggcggcaagaacggcggcggctacctggcgtccaagtacatggtgatcggcttccacgccgccatcctgctcagccacgccgtcatcaacagcctccccatcaccttcctctcctttttcggccagttcgccgcggcctggaacatgctaggtgtgtttgtcctgatggttgccgtgccgaccgttgccaccgagagggccagcgccgagttcgtgttcacccacttcaacaccgacaacggcgccggcatccgcagcaacttgtacatctttgtcctgggcctgctcatgagccagtacacgctcacaggatacgacgcctcggcgcatatgaccgaagagacgaagaacgcggacaagaacggccccatcggcatcatcagcgccatcggcatctccatcctcgtgggctggggctacatcctcggcgtcaccttcgcggtgaaggacataccctacctgctgagccccgacaacgacgccggcggctacgccatcgccgaggtgttctacctcgccttcaagagccgctacggcagcggcgccggccgggatcgtctgcctgggggtcgtcgccgtcgccgtctacttctgcggcatgagctccgtcaccagcaactccaggatggcctacgccttctccagggacggcgccatgcccttctcctccgtctggcacaaggtcaacaagcaggaggtgcccatcaacgccgtctggctctcggctctcgtcgcgctctgcatggcgctgccgtctctgggcagcctggtggcgttccaggccatggtttccatcgcgacgatcgggctgtacatctcgtacgcgctgccgatcctgttccgggtgacgctggcgcgcaagtacttcgtgccggggccattcaacctgggccgctacggcgtcctggtcggctgggtcgccgtgctctgggtggccaccatcaccgtgctcttctcgctgccggtcacgtacccggtcaccaaggacacgctcaactacacccccgtcgccgtcggcggcctcctcttcctcgtcctcgcgtcctggctgctcagcgccaggcactggttcaagggccccgtcaccaatctggacggatgaatatgtataattggacatgtatagtagagaggctggcagagacggaagagttgttgccaacgacatgttgtaactactttgttccaaaaaattaactagcaaggaaaccgacaggatgaattttctcgatcgtgaaatgcatcagcatgttgattgcgagcaccatgttttgggtgactcaaatcttcatcgtgagggctcaagggtattatgcccagtccgtaggagaagatcatcaaagctagttgaagtgttctttgttgattggattgttgtggcaccc

SEQ ID NO: 4693 - DNA, 780 bp, Zea mays
  misc_feature (704)..(704): n is a, c, g, or t
  misc_feature (721)..(721): n is a, c, g, or t
taccctccccgcccggccgggccgcggctgccgcggtccacaaagacaattatctcgttgtctgccggtgtcagcttcctccagatcaagaagcggcaggtagagcagagaagccagctagctagcgagctgaggagagatggaagcgcagaacggctacagcccgcttcttgccggggacgaccacgaggcgtcggaggtggcgatccacgccaccggcggcgctggtgatgaaggcgacgacgtcaagctcaggctgctcgggtacaagcagcagctcaagcgcgacctctcggtggtagccaacttctccgtgagcttctccatcgtgtcggtggtaacgggcgtgacgacgctgttcgggacgggcctccagttcggcgggccggcgacgatggtgtacggctggcccatcgccggcgccttcaccgcggccgtgggcctcgccatggccgagatctgctccgcctaccccacctccggcggcctctacttctggagcgccaggctctgcacccaccgccgctggggacccttcgccgcctggctcaccggctggttcaatgttgtcggacagtgggcggtgaccaccagcgtggactactccctggcgcagctgatccaggtcatcatcctgctcgccaccggccgcaagaacggcggcggctacctggcgtccaataccatggggatcggcttccacngcgccatcctgctcagncacggcgtcatcaacagcctccccatcaccttcctcttcttttttcggcagtttcgcgc

SEQ ID NO: 4694 - DNA, 1621 bp, Zea mays
  misc_feature (32)..(32): n is a, c, g, or t
ggccgggagtcctaaatcaacgctcacacttnggcgaagcaaacagatcgagattccgagattcgagagaaatggcgatggcgacgccagctgccaaacaatcacttctcaccgtccaaccgtgcacaatgaattgaagcgccacgcggttccaataatctattgccacgggcaggtgcgtcgcgtcgattcctggtcttcgagaggagcggaggaggagggcggcgagtgcggaggagaggcgagttcagctgtagcgtttcgcttcttgcccgtggcggcggcggtgccacctcgaacgctgctccctgttctggggcttactgcggatcctgatctgagcatcattcagagaggaagaaatatgtttaggagaaagcatggctctgatgtcaactcagatgatgctgagcaaagagaagcaaagattagtgaactgaaagctgctcttgggactttgtctgcccgtggcgagaagtactgcagtgaagcatgcttgagaagatatctggaagcccgtaactggaatgttgctaagtcgagaaaaatgttggaagaaagtctcaagtggagggcagcttacaagccagaggatattcgttggcctgatgtttctgtcgaagcggaaacaggtaaaatgtacagggcaagtttccgagacagggagggcagaactgttgttgtcatgaaacctacaaaacaaaatacttcatcccatgaagggcagatacggttcctagtatatactttggagaatgcaatcttcagcctgcctgaaggccaagaaaaaatggtatggctgattgatttcacaggatggacagtgtcccatgcttcgccgataaagacttgtagagaaactgcaaatatactgcaaaatcattttcctgaaaggctggccattggatttctatttaatccccccaaagtatttgaagctttttataaggtcatcaagattttcctcgatccaaaatcagtcgagaaggtgaacttcgtgtacgagaaggatgaggagagcatgaaggtcatgtacaaatacatcgatccggaagtccttcctgtagagtttggggggaagagcaatgtggtgtacaaccacgaggagtactccgagttaatgagacaagatgacatcaaaacagcaagcttttgggcggttgatgcgaaaactaaccatgctaaccctgccatcaatgggaccttggttcctgaggttgcgccacagtcgtcgctggctgctaaagctagttgaagagtatctgcattctctgagaaaattgagaagccgaggactaatggaaccttgagagaaacatatgaaataagaaacatggtatactcgttcatcctcaagagttgtttaagtactggaagtttattcagcacacaataagctactagagaatgtcaccatgtgtgatttgatgcccaaaagagatggtttacaaggtacagccaagtttttgtacttgaattaattactatatgtcagtgattatcacatggataagtaactagcacaagcttaaccgtttacttttctcttattccttttacgatatactttgtcttctcgctaatcaatcgagtgtttctttcgatgatttaaaaaaaaaaa

SEQ ID NO: 4695 - DNA, 1484 bp, Zea mays
cgctcgggttgcccatcccatccgcctctccttgataaactccgtggtccgcagcctccgagccgagcccggcacagacgctactggcacgcacgcacgcaccagcaccagcaccacaccacatgcatggtggagcctagcacgggcagctagctcccggccggcgacgtgacgaccaccaccaccacatgttgcatgagcagcaggcaccgccaccggcagcagcagcgccaccgccatccatcaaccccgacgacgacggcgcccgcgatgtcgaggtcaccacgttccgcgacatccaccctctgacgcccgacgcgccgccgcccgcctccgcgtcctgggacaccgccagccaccgctccttgtcgtcgtccgacgaccagcaatacatgacgatgatgcgcgagttcacggccatggtcgccggcggagcgaccatgcatcccggaggctaccacggagccgacgaccagttcaccaatatacgagaggacgagatgtaggagaccagacccgttgcgcatcgtccccgacagccaccccatcgccacgcccgccaggtccaaagggcgtccccccccgggctggaggtcgtgcccgcgggcccggcgccggcgccgcagccgcagccgcagccgcccgcgcacctggaggccagccaggtcaagaaggaggaggtggagaccaaggtcacggcctggcagacggccgaggtcgccaagatcaacaaccgcttcaagagggaggatgtggtcatcaacggctgggagaccgagcaggtggagaaggcctccgcgtggctcaagaagatcgagaggaagctggacgagcaacgcgccaaggcgctggagaagacgcagaacgacatcgccaaggcgcggcgcaaggcggaggagaagcgggcgtcggcggaggccaagcggggcctcaagctggccaaggtgctggagctcgccaacttcatgaaggccgtcggcagggtgcccaccaagcgctccttcttctagccagccgactaccgctaccacctccgtctctccctgcctgcgtgtgatcgatgtacgctcgctgctgcatccgagaacctaactgtaaagaaaaaaattgtaagctgtatacgtactactgcctgctatggtcccctgtgatgtctgtcatccatcacagggtgccagttgttctcttctctttctcttctcttctcttctcttggcttgtatatcggatccatatgctggtggtgcttgaacgaactgtcgttgtttgcttaaccgtgcaaacatatacagtggtatatagtatatacactacattcaacactgcaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaaaagaaccaaatttacctacccgggcatgcaaaggaaaaactttttttttggggccccc

SEQ ID NO: 4696 - DNA, 2719 bp, Zea mays
gaaaaaagtgccaagttttttttttgtagaaaagaaaaaaaatactagccaattcgcaattattttggttttgcgacagagggagtagttgtaactcccagtctcccgttgcacgggaaggcaggcaatcaagcaggtggaacacgaagacccacgctgtcagtgcgcctgtgcagtgcatgcacgggagggaagggaactttacttgggcgcgattctcccgacaggtacgtgtcaaggtgtcagtgtcacccgcgcgcgccaatgcaaatggacgacgagcctcccatcacttcacttgacccggccagctcgggttgcccatcccacccgcctctccttgataaactccgtggtccgcagccaccgagccgagcccggcacagacactactggcacgcacgcaccagcaccagcaccacaccacatgaatggtggagcctagcacgggcagctagctcccggccggcgacgtgacgaccaccaccaccacatgttgcatgagcagcaggcaccgccaccggcagtagcagcgccaccgccatccatcaaccccgacgacgacggcgcccgcgatgtcgaggtcaccacgttccgcgacatccaccctctgacgcccgacgcgccgccgcccgcctccgcgtcctgggacaccgccagccaccgctccttgtcgtcgtccgacgaccagcagtacatgacgatgagccgcgagttcacggccatggtcgccgccggggcgaccatgcagcccggcggctacgacggcgccgccgaccagctcaccagcatcggcgaggacgagctggaggagaccaacccgctggccatcgtccccgacagccaccccatcgccacgcccgccaggtccagggcgtccgggctggaggtcgtgcccgcgggcccggcgccgcagccgcagccgcccgcgcacctggaggccagccaggtcaagaaggaggaggtggagaccaaggtcacggcctggcagacggccgaggtcgccaagatcaacaaccgcttcaagagggaggatgtggtcatcaacggctgggagaccgagcaggtggagaaggcctccgcgtggctcaagaagatcgaggtaccgactacaccgacgccctcttctttgctccctttcccttcgtcaatttagttatatatcttgctcaactcaaacgcacgagtggaggatctgcgttcttgtctgttccgcagaggaagctggacgagcagcgcgccaaggcgctggagaagacgcagaacgacatcgccaaggcgcggcgcaaggcggaggagaagcgggcgtcggcggaggccaagcggggcctcaagctggccaaggtgctggagctcgccaacttcatgaaggccgtcggcagggtgcccaccaagcgctccttcttctagccagccgactacccctaccacctccgtctctctccctgcctgcgtgtgatcgatgtacgctcgctgctgcatccgagaacctaactgtaaagaaaaaaaactgtaagctgtatacgtactgcgcctgctggttcccctgtgatgtctgtcatcccatccatcacagggtgccagttgctctcttctctttcttttctcttctcttctcttggcttgtatatcggatccatatgctctggtggtgcttgattgaactgtcgttgtttgcttaaccgtgcaaacatatacagtggtatatacactacattcagaacccaatactgcaactgttgttagagctgctacgtacttacttgtgcagagaacagagtatacgggcacgtcgtcacatcactgcgaatagggataggtacagtggacatcgccatgcttggtactgtagtactgcaattcagtcggtctgatcatccatcctgcatcatgatcaggagccatgtctgttaccttctttctcctcgaacgacgaccatgcgtatctctgtaggataggaggacagccagggcactagcagtggtcgtcgcggcatggcgaacgaaccctgctcggcacgtcggccggccggtcgctactcgccacatgccctcgatggatttgcccttgcccttgcccttgccctcgtgacagtgcccacctccatttggatttttggggccatcagccatgcatttttcggagagggggggatcgatccaaaggttacgataggatcctgaaagggacggggcgacaggtgtgactggggccggccggtgggagatgggtctccgcgcggaatcgaccgggcatctttcgtggccgtaacgtcggcgacggcgacggtgagatgcccggccgcgcgcctcgctggcgctcgccatagtccaggcggagcggatggagaccggcacctcacgtcctcacggtcctgaagtgattgtttttgggggttttgatacgagacaaacggctctgaaaacaattgattactaactagtactactttttttttctttaccgatatatgtttttagtatcatctttattaaaacgaaattagaagtgaacaaagatagattaattcactttatagaccggacgtaaagtaaagctaaaaagtaagcaaagacacattggttcactccatagtacgggaagtagaagcaggattaagggctgtttgtttctctagtgctaaagtttagcaccaactaaaatttagcacattctaaactttttctaaactttagcactttgttaacctcttctacc

SEQ ID NO: 4697 - DNA, 1370 bp, Zea mays
ccacgcgtccggataaactccgtggtccgcggccaccgacccgagcccggcacagacgctactggcacgcacgcacgcaccagcaccagcaccacaccacatgcatggtggagcctagcacgggcagctagctcccggccggcgacgtgacgaccaccaccaccacatgttgcatgagcagcaggcaccgccaccggcagtagcagcgccaccgccatccatcaaccccgacgacgacggcgcccgcgatgtcgaggtcaccacgttccgcgacatccaccctctgacgcccgacgcgccgccgcccgcctccgcgtcctgggacaccgccagccaccgctccttgtcgtcgtccgacgaccagcagtacatgacgatgagccgcgagttcacggccatggtcgccgccggggcgaccatgcagaccggcggctacgacggcgccgccgaccagctcaccagcatcggcgaggacgagctggaggagaccaacccgctggccatcgtccccgacagccaccccatcgccacgccagccaggtccaggccgtccgggctggaggtcgtgcccgcgggcccggcgccgcagccgcagccgcagccgcccgcgcacctggaggccagccaggtcaagaaggaggaggtggagaccaaggtcacggcctggcagacggccgaggtcgccaagatcaacaaccgcttcaagagggaggatgtggtcatcaacggctgggagaccgagcaggtggagaaggcctccgcgtggctcaagaagatcgagaggaagctggacgagcagcgcgccaaggcgctggagaagacgcagaacgacatcgccaaggcgcggcgcaaggcggaggagaagcgggcgtcggcggaggccaagcggggcctcaagctggccaaggtgctggagctagccaacttcatgaaggccgtcggcagggtgcccaccaagcgctccttcttctagccagccgactaccccttacgtaccacctccgtctctccctgcctgcgtgtgatcgatgtacgctcgctgctgcatccgagaacctaactgtaaagaaaaaaaaactgtaagctgtatacgtactgcgcctgctggttcccctgtgatgtctgtcagtgtcatccatcacagggtgccagttgttctcttctctttcttttcttttctcttctcttggcttgtatatcggatccatatgctactggtggtgcttgaacgaactgttgttgtttgcttaaccgtgcaaacatatacagtggtatatacactacattcagaacccaacaaaaaaaaaaaaaaaagggcgggccggtcttaaagagatccaagacttaccgtaccccgtgccatgcgcacg

SEQ ID NO: 4698 - DNA, 1296 bp, Zea mays
  misc_feature (1271)..(1271): n is a, c, g, or t
ctcgaggccggccgggtcgggccatccgcctctccttgataaactccgtggtccgcagccaccgcccggagcccggcacagacactactggcacgcacgcaccagcaccagcaccacaccacatgaatggtggagcctagcacgggcagctagctcccggccggcgacgtgacgaccaccaccaccacatgttgcatgagcagcaggcaccgccaccggcagtagcagcgccaccgccatccatcaaccccgacgacgacggcggccgcgatgtcgaggtcaccacgttccgcgacatccaccctctgacgcccgacgcgccgccgcccgcctccgcgtcctgggacacggccagccaccgctccttgtcgtcgtccgacgaccagcagtacatgacgatgagccgcgagttcacggccatggtcgccgccggggcgaccatgcagcccggcggctacgacggcgccgccgaccagctcaccagcatcggcgaggacgagctggaggagaccaacccgctggccatcgtccccgacagccaccccatcgccacgcccgccaggtccagggcgtccgggctggaggtcgtgcccgcgggcccggcgccgcagccgcccgcgcacctggaggccagccaggtcaagaaggaggaggtggagaccaaggtcacggcctggcagacggccgaggtcgccaagatcaacaaccgcttcaagagggaggatgtggtcatcaacggctgggagaccgagcaggtggagaaggcctccgcgtggctcaagaagatcgagaggaagctggacgagcagcgcgccaaggcgctggagaagacgcagaacgacatcgccaaggcgcggcgcaaggcggaggagaagcgggcgtcggcggaggccaagcggggcctcaagctggccaaggtgctggagctcgccaacttcatgaaggccgtcggcagggtgcccaccaagcgctccttcttctagccagccgactacccctaccacctccgtctctctccctgcctgcgtgtgatcgatgtacgctcgctgctgcatccgagaacctaactgtaaagaaaaaaaactgtaagctgtatacgtactgcgcctgctggttcccctgtgatgtctgtcatccatccatcacagggtgccagttgctctcttctctttcttttctcttctcttctcttggcttgtatatcggatccatatgctggtggtgcttgattgaactgtcgttgtttgcttaaccgtgcaaacatatacagnggtatatacactacattcagaaccc

SEQ ID NO: 4699 - DNA, 1380 bp, Zea mays
gatccctggcagcgccgtcgtcgtcctcattgatgttgcggaggcccgcggccgcgctgccggtgatttcggcgtcttcgccaacacacagactagatcatgctcacttgaaggttcagtgaagttgaagaacctgtttggttactgtgagacctgggatgcatcaggtgctcttgaattagataagacagcagaactaagtgctggagttcaaatgcctaggatcggagcaataccaactcccctgatggctagaatatcgtttctgtctggcgactggttaaagtcctcactcaaagaacacctgatgggcgtttctgttggcttgctctctaccatgaaccacaacattgcttacaatttgacatggagaaaatttactgatccaacacgcatgacatccaattccgtacaagaggaattaggacatagccttttgtcctctattaagtacgcgtacaaggttgaccaaagggactcaagtataagacctacacgagggtacgcttttatgtcgacttctcaagttggaggccttgcaccagagagcaaatattcacgatttcttaggcaggaatttgatcttcgagtggctttgcccctgggtgtgctgaatggtgctctcaatgccggagtggctgcgggagtcatccatccattggaaaggggatccacaggatctgtctcaccacttgtagaaaggtttaacttgggtggtaataggcctctcgtgtgccgcttgggtggatcatcttcactgttaggcttcaaaacaagaggactgcgggcaacagaatccagaacacatgaccttgataattctgacagtggcacttcgccgaatggtgacgtagcagtgacagccttcgccgacctctcatttgatctgcctctgaagccgctcagagagctgggaattcatggccacgcttttgtttgtgctggaaatctcggtaaactaacggagtgtgatctagggaagttccctgttaccgacttcctacagacgttcagaagttctgcaggattcggcgtagttgtgccgaccagactgttccgcatagagatgaattattgctgcatcctaaaacagcttgatcatgacagggcgaagacaggcgtacagtttaacttctcgtcgtcctagtttctaagatgaatattcctattttttcccctcctcctcactgttgtcttttcatggaggagcctgtcaagaacttctacatttatgtagaaaaagaaagccgatgacgctgaagtgataaattgttggatttaatgctgtgtgtttgcagaaataactccaacatggtgacgaaacatcacattatgaaactgactagagccttttgccgctaaaaaaaaaaaaaaaaaaaa

SEQ ID NO: 4700 - DNA, 862 bp, Zea mays
gcaccagggagcaaatattcacgttttcttaggcaggaatttgatcttcgagtggctttgcctctgggtgtgctgaatggtgctctcaacgccggagtggctgcgggagtcatccatccattggaaaggggatctgcaggatctgtctcaccacttgtagaaagatttaacttgggtggtaatagggctctcgtgtgccgcttgggtggaccatcttcactattaggcttcaaaacaggaggccgcccggcagcaacagagtccagaacacaagaccccaacactcctggcaatggcacttccccttcccctgagctaaatggtcttggaggtgaagtagcggtgacagccttcgccgacctgtcatttgatctgcctctgaagccgctcagggagctgggaatccatggtcatgcttttgtctgtgctggaaatcttggtagattaacggagtgtgatctgcggaagttccctgctactgaattcctgcagacgttcagaagttgtgcaggatggggcgtagttgtgccgaccagactgttccgcgtagagatgaattactgctacatcctaaaacagcttgatcatgacggggggaagacaggcatacagttgaacttctcatcctcctaatttgtaagatgaaaccaaacagagccctagtggtaacaaagctccttgtaaacatctcaatggcaaacctcaaaaaaccggatttattaataaaaaataaggtcaaaaaccggatgtgaaagattacgtaaaaaaaaaaccggagttctttagactttcatggtccactgtctgcgtttgaatgacagccagaaactcggctttgcattggggatcttgtatgttgact

SEQ ID NO: 4701 - DNA, 1082 bp, Zea mays
cggactcggagctggtggagcggctgcaggaggtgctgcggtcgtcggacctcaacaccacgaccaccgctgccctgcgccgccgcctcgaggaggactttggcgccgacctctcccacaaaaaggccctcattcgggagcaggtcgacctcttcctcgccgaggtcgccgccaaggccgagccgcagaagagcccaaggaggaggaggaggagaatgcgaggatgagaatagcagcggcgcccggaagaagcagcggggtaatgatggcaaaaagaggggtggtggctttacaaaattatgcagtctttcaccggcacttcaagagtttgtcggcgcctctgagttagccaggacagaggttgtcaagaagctttgggcatatattcgagaaaataatcttcaagaccaaaacaataggaggaagattttgccggatgagagattgaagaagatcttcaatgtcaattccattgatatgtttcaaatgaataaagctttgaccaagcatatctggccattgaattctgagggtcctgtctctcctgatagatcaacacccaaagagaagccacaaaagagagacaggagtgaaggaaagaagcaaaagggtggctcttcaggagctggatctggttttctcgtgccccttcaactttcggatgatttagtaaaatttatcggcactggtgagagcatgttatcacgatctgatgtcgtgaagaaaatgtgggattacataaaagggaacaacctgcaggatccttctgaccggaggaaaataatctgcgatgagaagctgaaggacctatttggagtggaaacattcaccggctttactgtttcgaagctgcttgcccctcattttaccaagacgaagtagcaacctgccatccacatcttctaaaaccaaaaaggcttggtaattttgtttttgcagaatgtgtaatcatggaacagttaggagctatgtgggtggtgtgaatttttttttgtttacctatgggagtcgatggcacttttcgaacattaccagtaaagtaggctccttcctcaatgtctaatggaagttatcaactggtc

SEQ ID NO: 4702 - DNA, 3890 bp, Zea mays
  misc_feature (3516)..(3516): n is a, c, g, or t
ggcgcgccgtgtcgcccgcgtgctagggttcatcagttcgacgagcggcggcgtgtgggcacgtgcaggcagccatgtctttttgcgtatagggtactggttgctttactctatgggctggaccgctgggccaaaatttccaaattccaatcaaggcagatggatcgtccatgatttaatcggacgatcaggtttctggtcgctctgattacgtcgttaccgctgatcagcttcacagttacgatgggtcgattaatcatgattaatggacgatctgaaaacactgcaagtaactttgtaatacagactggtgcttgtggcggccacactgcacgacacatcgcacatctatctagttgaactaattcatgagctaccctgttgcactcccttaaaatctctctggaaggtgatggattgaaaatgccacaccactgatctgactccatcgatgcccaacgatacgttgacaccacttgcacatcccaactaaagtttagtcagtttctgcacccactccgcagcaagctgcaatgtttcttaggaagctataattctacttcctcagcacaagcacatacactcactaactggccatgttgaaagagctatctgtcaatcatgatgaaggattataataccaacacttaattcaagatgaaaatttctgtttgcagtgtaccacagacaattgtcatgtctattcttgtgttaaactgttaactagttgatctgttaaaaagaaaaaggtggtctcgatggccaatatggtatattatttctttttttcctgtcttctggatgctactttgcagtccgaccagtttccaatgttgtttttcctaaacttcaatctcagtgatgcgctgatgctgctgagctgcatccttgtttgcatttcaatttccaattaacgaagccctggggaagaagtcatttactaaacgtttcaaatcgaacaaatctgggctcactgattgagttgaacaaatctgtccctggagtttacctgtttctctgtttgtttagctcaccatttgttcatgtatttgcacgtgccccagaattatttggagtttatagtcattgagactgatcctgtggaaatagtagtaaggaagactgaactagtccctatcattatattctatgccttgtgcttattccttctagataatatcaatcctgtttttcattgctttcctccttcctttccttggctgtaggatccttctgaccggaggaaaataatctgcgatgagaagctgaaggacctatttggagtggaaacattcacaggctttactgtttcgaagctgcttgcccctcattttaccaagacgaagtagcaacctgccatccacatcttctaaaacaaaaaaggcttggtaattttgtttttgcagaatgtgtaatcatggaacagttaggagctatgtgggtggtgtgaactttttttttttacctatgggagtcgatggcacttttcgaacattaccagtaaagtaggctccttcctcaatgtctaatggaagttatcaactggtcactaaccatttcgcgctctccaaaatggtagggacataaaattatctgtgcggtgtggcttctagtgcgttcttcccgagttcatggtccaccatttttcatgctcagggttgaggatgacattgctcggtctcctcagatgaccctagtggtcatggaaccgtaaagacaaggggggagcactagcgcttgtcgcctagggtttcagggttctccacttgccagtgaatctttcatcctttttagctcctgatatggatgaagtttgtagcactagcgcaaccgccttttgctgttccttcccactcacttggtaccggttgttcagaggacgccagtttatatttgtatggaccacctaaactgaagctgttttgtcatgtgggtggcatggcgaagtgggtcgatatcgcgacggttctgtaacgcgatcttgcgctgtttccaactgctggtgccatttgcctgtcagttcaaagttaaattgtgttcagattctggttccgagggggtacaggtacgtacacattgcacgagcagaatgtgattcaggggtagggtcggagtccgtttcagcagttgggtcgtcgtgctgcgttggtctccagtcattgtcgtagtcgggtgggtggcggttgccgggatccgtccatttgaggcgtcgggggtcactgcactgggctctgggtagtctggaccgaactcaagcgtcgtcctcgtgcccttgtgcattcggatctccaattcttcatgacccatttgtgttgtatttactctcttggtcggatttgttgataaattgctgcgaagctgacgtgaacggcaggtctctcctcgtgtttgctggcgacctgaggggacccgattttctcgttgtcatgtgaaaaccaacggccccggagagacgcgaggaacagagggagcatagtgacgtccgaccgaatcgagctgcacgggattctagcgtcgcgtcggcgtcggcgtccatcggcgctaaagattgggcgagattccaaccagccgagccgggcgtcagggcggtgtgaatcatatttgcaggggaaaagaaagaaagaaagatctggcgagagatcggcgaagggactggtgccgtgtggcccgggcacccgtccctgtcgccccagatggcctccggattcgcccgcgatcgtctgcttccggtgaaaatgcactcgacgacggcctcaaatcaaatgtctcatattctcaagagccaaggcgaactggcgaagatacaccagagtagtcgttcgcaaggtgacttggcaccaactagggcaaaagagagggtcaaaaatatccggggagggggaccagaacaggattgcagggcaggaggagaggtcaaaggcaaacaaacacctttaggtagaatagaaagataaggataaagcgcaggtcggtgtgctggtgctggtgcgcgccgtggagacttggtggcgttctcccccctcctctatcttgcttcgatggcaaaagtcaaacactgtttattctgggaaagtaataataagaaatgagttcaatggctgggaattggcaactggcccaagcaaccctttttatcgccacctctatcggtcctcgtcccactcccaagtgcagtacagatgtacaggacctgtacttgcttccttcctcttcctctgttctgttctccatgtgaagaagtatcgaggtcagccttttcttttatgctcagtgactgggagggagatgccggaatggtgtgatattcagaagctagtcactgtagaactaggtcgggtgaaaagggtaatgtaaaactatttgtattgtttgtagagtagagtttaaaatatggagtctagattggtgttgttgtaacgacaccatctacgctacctacgccttttaatagccgtgagatatgatttcaactgctttgctcctattccatttccctgtgttgtatagtatagttanacatcaacaaagaccaggaaagaaaaaaaagtatgcgtacacaccgctcctactgcgtcaaaggaccaggctttctatacgttatcaggcatgctatcctccattgttattagctggcgaatcttgcggatatgttcacaagattctgagtgcctgttgataatataaaagttataataaacgctagttgctgtcacaaagaacggcacgttggaaactaagctgctcccccgcgtccgccgagccaatcacgcaggcccgaccgaacgcagcgactagtagagtagtagtggtggcagtggcactaaaaaatggtttgagaagtgcgtccgtgtgcatctctctctcggacacctggatgcgtgcgtggagag

SEQ ID NO: 4703 - DNA, 2588 bp, Zea mays
gaacaaatctgggctggaaaatcaaggcactgattgagttgaacaaatctggccctggatttttccagtttccctgtttttttcgctcaccatttgttcacgtatcgcatgtgcctcagaattatttggagtttatggtcattgagattaatcctgtggaattagtagtaaggaagaaccaattaatcctgtcattatgtttcctatgtcttgtgcttattccttcaaataatatcaattctgctttttaattgctttcgtcctttctatggtggtaggatccttctgcccggaggaaaataatctgcgatgagaaactgaaggccctattaggagttgaaacgttcaccggctttactgtttcaaagctgcttgccccccattttaccaagacgaagtagcaacccgccatccagatcttctaaacccccaaaaggctgggtgatcatgttttgcagaatgtgtaatcatggaacagttaggagctatgtgagtggtgtgaaatttttttacatgtgggagtcggtggcactttccgaatgttaccagtaaagtaggttcctcgatgtctaatgaatctatcaactgtttactaaccgtcacgccctccgaaaactgtttatctgtgtggcttgtagtgcgttccttctgagtttatgggccaccattttcatgctcagggttgcggatgatgttgtctggtcttcctcagatgactcttatagtggacaagaggccggaaaggcaaaggggagcactaacgcatgtctcttaggatttcccggttttccacttctcagtgaatctttcatctttctagctcctgatatggatgaagtttgcagcagtagtgcaaccgctttttgctgcctcttcccagtgacttgagttctgaactggttgctttgctcctccatttgtttagaagacaacggttatatattgtgtgggtcacctaaactgcaagctgtttttgtcatgtgggtcgcatggcaaagtgggtcaatgcggccacgcaatttgcgctgtttcctactggtaccatttgacggatagttcagtttctttctcggttgtcgtggtcagataccgggaattttcggttgcaaggggttagggtaggtacacattgaacgagcagaatgtgaatcaggtagggtcggagtctgtttttaactggtggagataatctttaggacttgtttagttgcatcgaaaggttggaaatgattaaataatccctccttagtcaacaaacaacaattgtgcaatccaatcttcaactctttcttcatggttcatttgtattttatttattctcttggtcggatttcttcataaatttgctgcgaagcttagcttacataaactgccggaagtctcgtgtgacgctagcatcatgaacgggcaggtttctcatgtttgctggcgatttgagtgaagcgagcacccaaaagccgccccacttttctggttctcttgtgaaagccgatggtaacatttccgaaagcgagcgcagtcaggcagccgagcaagaggcacagcgacggcccagtcgagctacacgggactctggcccgcgtcgcgtcgtgtcggtgtccatcgctaaagattaggcagaaagataaggatagagtgagtcatagagcgcaggtcgatgtgctggtgcgtgcgagacttggtggggaaaaactgtttttgtttgtttgtatgtttgttgtaacaacaccatctacgtacgccttttcatagccaaagccatgagacctcaactgctacgctcctattccttgagttgcctacgcatactaagactgtctccaaccatgctacctaaaattggagatgtattcagtaatctgcctcgcgccagagcacaaggtcgcgtacgcatttgtaacattctccaacggcagacgcaaaagagaacccctgcgccaggctgtttcactcgcgcgcttaggcggaagcttcacgcgggaacggcgtatctgggcgggaataagttactgcgtccgcgggaaccacctagacggcgggaaaagttaccgtgttctctccatcgtggcctcgtgaagccccaaggcagcaagtcggcagcagcttggcggcaggaatcaataaagtaatctcgtgccggagtataaagtaatcttttcaatttctttgtgcaatgcgagtataaagtttacgattgtgccttttgtactgcatttttttttggatttaggtagcagccgctgttgtttgcatggcttggaggtatctgaaaacttcgatgctcggggcagctgcggcttcatccaatgacgacgatgaccttgttgctgctgctgctgcagtggtcatccaggaacttggacgcaaacgacgatggggagggtcagtcccaggccacaagacgtacaggcgtgaccgccttgcagcacatcgacagctgcacatggactactttgttgatcgtccattgtacaacaatgaaatgttcagaagaaggtacattttagaaagcattggataaactgtaattttgatgcttatgattagtacgatgatctcattcaaatattggtgaactattttatttg

SEQ ID NO: 4704 - DNA, 2574 bp, Zea mays
gaaaaatctcgacacaaggcgaaacgggatcgcccgcccagtccacgcaccaaatttccattccatcttacctgcttgagtactactctcccgttcaccacgttcactccgtatctctcgtgcctttttcctttcctggttgcgacgagccgacgactgggcggacgccgctgccgccctacgccaggtcttcgtcggccccttcgacgagcacacacaagattcagtcgggaatgttgaatgcatagtgtaatttctgcgcaaaaagatggcatcagacgagttcatcagccttgacgcaccttgtgaggctgatgcgaaagatgaagggggagacgttcaggttaaagctcctgatgtgagtgggatggagcctctggtatcggatctccaaccagaagggaaagctggtgctgtgggtagtaatcccaagacatctgctgggaacctggatcttgaagaggggcaagtggaagatatggacctcgcggatgatgacgtagtggttggaaaggatcagctattagatgcttccattcagcccgagatcagtgttgcagctgtgcagactgtgattggttttgaggtcaagctggacaagggggacgggactgaaaatgaaataatttatgagtcaaacagcatctctattgaagaaagtcgtatcctattgaatggaatattatgtatttcttctaatatacttgtgcaactgcaagtgtctatgttttctgaagattcatttgtttccattgaatccttggaactgtacttgcataagaagtgcagactcttgcttatactcctgggaccctaaacatgttattgtgatctggggggaatttatagttgttgttgttccttgatgtggcatttttagcctcagcacgaggttaaaagagcccgtgtggaatcaaaggaaccttctgttcgtgtcatctacagtgacttgacaagggaaagcaaacgaaagcttatgcaattgatgcaacaatggtctgagtggcaggctagaaggatgcaccatttggaggaagctgtggaagtgaccttagaaagtggtgaagagacttattatcctgcattacatgttggttctgagaaatcttgtgccgtgtccttttgggtggataaccaagcaagggaaagtgatacagtagatgatggttctgttccactgtatgaccgggagtttaccttgcactcgactcctctaggtggttcatcaaacactgaaagggtggataaggacgattcacgctgcttcaattgtggttcttatagccatgctatgaaggattgcccaaagcctcgggacaatgttgcaattagcaatgcacgaaaacagcataatttgaaaagaaaccaatctaatgttaaccgtgtacaaaaccgatactaccagaaaacgcccggcaaatttgatgatttgaaagctggagtactgggacctgaaactagacagtgcttggggatcggggagaatgatcctcctccttggctgcacagaatgcgtgagttaggctatcctccgggctacctagatgtggttgacgatgaagatagaccttctggtatcaccatatttggagatggtgaggtgaaactagagtatgaggagggagagctttcagagcaaggcgaagcatctccgcctaagaaaaagatgacagtggaattccctggaataaacgcccccatcccagaaaatggtgatcagtggctgtggggtagcaccccgccccagtcctcaggccgccaccactcattggattcgagggatttccatgatagagggcctcctggcgctgatcattattcaccgagataccactcccacgattttggacctttgcgcccaagcatagggagatcacactcagacagggggtggagaagcccacctcgttatgataatccgcctgcagatgatggtgcctggaccccgcattcataccccagcaggcagcacttgggccattacagctcgagctctgagatgtcgtcacgccattccagggacaaagacagagataggcatgatagcaggcactaccaccaccgcagatgagtcaagcctgtagctgatttgtatcatattcttttgctgaagaatcctctacctgacgcattcgatctgacatagaaatcagtcctgctatagtttcttaagttaagaaatttcctttccttccaatatatttttgcagcagtgctcccaaacccatggtagacagtgaccttatctcgtctggtccgtgagctgtatctgcattgtatgactgccttcctcacatatgcaactcttcctcattccttgactgttatgggcctgcttggttcagggactaactaatgtttagtcaggggactaaagttatacctgtttgattacagggactaaggtgctgtttggtttagtacttgaagtggtaacgggaatggagtgggctaccgccgctatctgatacattgtttggttaatgtggaaaacgtgatcaactccgtttacagcgttcgataacactgttggctgtcggccaggatagctactagcgatctggaaatgctgca

SEQ ID NO: 4705 - DNA, 2126 bp, Zea mays
cattgcgttccgccactcgggcccggcccgggcaaaaaatctcgcttgcgtttctggggtggtgtctctgactctctggctccgtccccggcaccggcgggcggtggcgtgatggcggactgggaggggatcccgccgcgggagcggcggcagatggaggagatcctgcagctcgacatggaggagctcaacgtggaggtcgtcgacgacaacgaagaagacgaggaggaagaggagggtgacggcaacgaggaggactacgacgtcgatgccttcctcagagataacaatggagatggagtggctagcacctctggaccattcacattcaataggtctctagcttcactgcacacataccttggcgaggttgacgatactcggggtagagttactcttttagatggtggcacaatcctcaacttgccaatgttttatcttcaaggcgttgttctatttcctggagctaccctgcctctcagagtaattcaggatagattagtagtaactattgacaaagctttgagactggtcgatgctccatgcacaattggggtggttctcatgcgacgactcccaaatcatcgacattatgctactgcttcagttggaacaaccgcagagatacgtcaatttggaaggttggaagatggttcattaaatgttgttgcccgtgggcagcaaagatttcgtttaaggaggcattggattgatgttgatcgggtggtgtggggtgaggtacaaattattgaagaagatactcccttgagaactcctagagatgcatttgctcagctagctgcattcaataccttcaatttgcatgcttcgtcatcagtcatcagtttggataggtctcctatgaaacaagatcatatagattcagaactagagtgcgacactccatcaccaaacagtaaaataagcaacccttcatcaatggattcaaggttgtgccatctaggttcacagtcaagtgactcgatgaaatcatcctcagatgaagacgaggatttgatgcccaaacagttttggaagcggaaacaacattctgtgagggaaagtggtgcatcaagtcattccgacaagaagaccaacatgagaaatgataacgatctttgcttgacgcctctccaatcatcgccaatagcaaaaacaagagatgctaagcggcggcgacagtaccatgcttactcaaagcaggcttctcaggcaccattatcattttggcctcggtgggtatatgaaatgtatgattcatatacacttgctcgcagtgctgcagagttatggagacagataattgcaaacccaagcatggacgatcatgtaagaaagccagatattttgtcatttcacatcggaagcaaacttccagtctcagaatctgtgagacaaaaacttctggagattgatggagtttcatatcgcctacagaaagaaattcagcttctcaaggccttcaatcatattaaatgtagaaattgccagtctcatatagcaaaacgtagtgacatggtggtgatgtctaccgacgggcctcttggtgcctatgtcaaccctcacggttgtgtccacgagacgattacagtcagcaatgcaactgggctagcactcattggcaatccttcgaaagtccacagctggtttcctgggtactcgtggacgattgcagcatgcatggcctgcgagtcccacataggctggctattcagagccaccaagaagaatctgcggcctaggtctttctgggggatccgcagctcacaaatcgcagacgacacacaagtagatcagggtgactgatgctccaaacttccatgcgtataaggccatagtagcagtggactactaagccatgtatgacctggtgttcccaatcctccagtcgtctctggttcatacgcactgcctgccttttgtgtgttggcatagtagggacggtggagttccctgtaaaacaatcactctttttctactgttgtagtagtgctctgcactgaagggatttactgaatctctctttttttggtctaaataagatatctgttttccaatagtatatgcatgattttcatttacagatgttccatggtgtggcatgggtgaagaaaactgttctatgt

SEQ ID NO: 4706 - DNA, 1443 bp, Zea mays
aaaccaaactctccgcgcgcgcaggcggccgccctcggattgggctcccctcccctcccctcccgctcactcgccactcgccaccgctcgccgcccacgcgcatggcgtcctcgctcgtctcgcgcccgcacctcacccagcgcccggtccgcgccgccacgctcgcctccgctacccgcccccgcctcgcggccggggcccttagcgggcgctgccaggcgcaggcggcgggggacttggacgacgctcactacatgcggcggtgcgtggagctggcgcgcaaggcggccgggccacaccagccccaaccctatggtgggctgcgtcatcgtccgcgacggccgcgtcgtcggagaaggattccaccccaaggccggccaacctcatgccgaggtatttgcactaagagatgcaggtaatctagctgaaaatgcgacggcctatgttagcttggagccctgcaaccactacgggagaacccctccgtgtactgaagcgctcataaatgcaaaagtgaaggaagttgtcgtggggatgactgacccaaatcctatcgtggcatccaaagggattgagaagctccaaggtgctgggataagtgtgagggtgggtgtggaggaagcgttatgccgcaaactaaacgaggcttatatccatcgtatgctcaccgggaaggcttttgcaactctgagagctacactctcaatgaatggaatcatcacgaaccagattgggaagggagctgatcagtcaggtgggtactactcgcagctgatgaaagaatacgacggagtcataatttcaagcgacctggccaagatgtcggccttacctttgtcgcgtgaagccggcacaaaccaacctctctgtatcatcatagcacagggtgaaagctcccggctacacatcccatctctcagccaagagcatgcatccagggccatagtccttgccgatagtccggtcactgtggagccagcaggagtggaagttgcagtttttcgtcagatagacctggagtctattctccagcttcttgcgcagcgagggctctgcagcgtgctggtggacttcagagaggccggcgaaagcttcgcgtcgcttctgaacgacttccaggaggacaagctggtgcagaaggtcgtcgttgaggtcctgcccttttggctcgcgagcgacgggctcagcaacctggcatttggtggcagccaatcgttcccgttgaagaacttggagctcagggatgtgaatgggagtgtgctgctggaaggctatgtgtaatagcctctcttctgtcggagattggcattgtttgttttccctcgtgtaaacagatagccctgtaatatacttgcagagccgcccacgagccatgtggggttttgcttttttatatatatagttgaaaatcaatgccaaaaaaaaatcattttgcggcccct

SEQ ID NO: 4707 - DNA, 3686 bp, Zea mays
gaaatatgagttggacggtagatcctataactaattgtggtctggagaactgttgaaagcccatgtgcttcatccattcgagtagtaatgttcattgttgttgtctgcttatcgaaaatgttctctatgggccattttttagtaccatgtgcaatgtttgtgatggtatttacttgttgttatatgaataacagagctacactctcaatgaatggaatcatcacgaaccagattgggaagggagctgatcagtcaggtgggtactactcgcagctgatgaaagaatacgacggagtcataatttcaagcgacctggccaagatgtcggccttacctttgtcgcgtgaagccggcacaaaccaacctctctgtatcatcatagcacagggtgaaagctcccggctacacatcccatctctcagccaagagcatgcatccagggccatagtccttgccgatagtccggtcactgtggagccagcaggagtggaagttgcagtttttcgtcagatagacctggagtctattctccagcttcttgcgcagcgagggctctgcagcgtgctggtggacttcagagaggccggcgaaagcttcgcgtcgcttctgaacgacttccaggaggacaagctggtgcagaaggtcgtcgttgaggtcctgcccttttggctcgcgagcgacgggctcagcaacctggcatttggtggcagccaatcgttcccgttgaagaacttggagctcagggatgtgaatgggagtgtgctgctggaaggctatgtgtaatagcctctcttctgtcggagattggcattgtttgttttccctcgtgtaaacagatagccctgtaatatacttgcagagccgcccacgagccatgtggggttttgcttttttatatatatagttgaaaatcaatgccatgcgtccttcattttgctgacatggaactgctgcccggtgatactccctgtctgcaaatcaatgcaaatgtcttattaatctgaatgtcgatgccgtgtattattccgatcacacatgcaactgcgttccctgtctgttgttgccaatggcatgacaggccttcaggtgcatatacttggccggactttgatctcagttatgagatattcggaaagcggtagtggagacagcacaggaggattgagaattaagggcccgtttggcacagctccagttcctgattctaagtgaggatctagaggagccgtgtcaaacgggtatttttttaaactgattctcgtgtggagccgaaagattgggagtcgtttttgtgaagaaaggtgagatctaaaaaaacctgctccaccctcccttaaaacagctcctcaaccaaccaaatatagacctcccctcaaagtttgatcgaaattacccgcaattgccattggacaaaaacataacaagtcaatttatggattaaacatttgagaccattttatgcactactatgatgggaatagtttatatgttattgtttcataattttttatgtatatgcatcctacttattggtttgtaacaaagttgaactgcaaagggtaaaacagacaatcgccacagaccaccaactctcagcagacaagaatctgtttacttgccaaacggttttaaaaataattctgattctctaggagaatcatgaggatcaggatctggagctaaagaagcaggagctggagctttgccaaacatgccctaagtttgtcttgtaattgcgtcggctagctctcactggatcattgtattagttagttttaacctcgggtatcgggtttggcctcagttctaaaactttgtattgcaccggctacactcgttctcaagttgaatctaaaaaatgcctcgacagcctgcagtaaaacgtccagacagtccagttgatttgctattctcttatccgggctccaggcgagaagcaagctggatgttataaaaccatttttaaatcaaatgtttttaaatagtatttactattttcttaatcttagcttctgatcgtgccagctaggatagattatttttaaaatatcgattttaaaaaaggttaaaagaaaaaacagcaagcttctgctgcttcagaggctcgcaggaaagccaacgctagggacagaacgccttggaggcccacgtgccccgcgcggctaacccggcggcttccgcggaccaggcccaacccataaaaccgtcttcgctcccgtcccgcctggaacctgctcgagaccactgtgagtctgtgaccagtcaccacctctgcccagcgctccactcaccagtcaccacaatggcgtctgaatccgaggcctgcagctgggagccgcacctgctccaccccaacggcactgagccgctgcaccggatcgccgtggactactgcccggaggcgtgcctccacgagcgccacgcgggggagatccacgtcacctacgacgaccgcggcggcgcgcgctggcgctcctgctgccggttcctgcccggcagcgccgtggccaccacgatccgcgcgccggcgggggacacgtcgggactcaactacaacatctacttgtcctccctggagggttccgccgaccaggacgagatcgacttcgagttcctcggccacgacaagcgcgctgtccagaccaactactacgtcggcggcaacggcgggcgggagcagatccacgcgctccccttcgactcctctgacggcttccaccactacgccatcgcctgggacgcggccgccatcgagtggcgcgtcgacggcgagctcgtccggcgcgacaagaggcgcgagggggagccgtggccggagaagcccatgtacctgtacgcctccgtctgggacgccagccacatcgccgatggggcgtggaccggcacgtaccacggccgcgacgcgccctacgtctgcagctacaaggacgtcagggtgcccactgctgagcattcagtggaagacgccgctcatgcgcccgctggcgatcctgtcgccgctgacgctgccgcggcggcggaagaagagaaggacgccggagcaggtgaagtttagatcttggtggtgcaatggaatgtcttttgagtgtctctgcaattaaaaagatctatgaataatggatgcggcctcatcggtgaaaaaaaaacatttcagctgctgtatttatgttgttcgttgctcaatggtcaatgtgctctgtttactgttttgcacttttgcttcggttcctgtatttttatgttaaggggatacttggtaaagggctgaaatttaatctctgagacatcgaatgtttagatgtttaattataagtaaaaaaaaaaaaaaaagtccgtgcgttgcaacggctcacaacaatatctacataaattatccaccaaaaagatctcaagattttttattgattgtctctactctccgcataatatttttttgatttgactaaccgagtcaacatcgtgataaaggaaagaccgtgtagacaggtgatgccgagccatcgaatgggtaccataggcagcaaatcagggaccacatccctcgcctctcccacttccaaggtttcgtagagcagaaacagaagagaagagacaatcatagttgttcattgccggagaagtacacgacgaagacatggacatctggagacgacataggtagtataacgctagatacatacagggag

SEQ ID NO: 4708 - DNA, 1476 bp, Zea mays
cctcgaggccggccgggccgggacgtaaaaaaccaacgttaacgagaggggagaagaagagaaataaagtgcgaggtaacccgtaaccgtaaccctacccccttgcgagcacgacccaacccatcatctcgcccgtcacccgtcaggacccggaccaaaccaatcagggcggctcgggcgcggcggcgacacagggcaaggaggccgaacgttggggggaccggggctcgacgccagccgtggatcgcgtgcggagggggacaagcgtctgcctcatgtcccgcgacggcggggaatagggcgacggcgtcggcggcggggatcggttgcggcggcgtgacgaggcggctacggcggcggctcgggagggaggcggcaccatgtctgcggtagtctgtggcaagaggtcctcctccatcttcgccgacgagctcctcccgccgtctccttcctcccctcactcctcccaccagccggcggccaagaggtcccgccgctccccctcgcaccgcggcggctccgacggactccgaccggaggcgctcgtcgactatctacttgccctcttccccgacatggatccacagttacttgaaaaagctctggaagcatctggagatgacttggattctgcaataaaaagtttgaatttgctgcgcttagagtcagcagaagctatcttgtcatcgactggtttcaaacctgaaaattgtctgcaaacagcaattcagccttctcttgaaggtattcctaatggtggtgtggatacggctacagaacatccgcctagcgtagataattaccagacaagttataatggctctgaatgggttgagctattagtcacagagatgagaaatgcttctgacataaacgatgcacgggctcgtgcgtcaagagctctggaggctttggagaaaacgattgtagagcgtgcaggagctgaagctacacaaaacctgcataaggaaaacatgatgctcaaggagcagttgactgttgttctgcgagagaactccgtgctgaagcgggcagtcgccattcagcacgagcgccaaaaggagttcgacgagaggtctcacgaggtccagaacttgaagcaacttgttctgcagtaccaggagcaagttaggactctagagatgaacaactacgccctcacaatgcatctcaagcaggctcaacagaacagctccatacctgggcgtttcaaccctgatgttttctaagcgtagtagctgctgaacggtccgccccagattaataagctatgtatgaatatatcttgttctaccaactgctcctgagatggggatatccgataggtggattcaccgcccaagggtccagaattttcaagtcactatggttttgatttcgatatactccgtatttatttaaacgtgttgctttcatgcaattggctatccgatatattgtgtgcgcccacttttccgggcaaaaaaaaaaaaaaaa

SEQ ID NO: 4709 - DNA, 1462 bp, Zea mays
gcacgagaccattacctagaacatcctagccggaaaaacccaacccatcccgtcaggacccggaccagacaccaatcaagggcgtctcggctcatcacaggcgctgcggcgaccagggcacgcggcacggaggtcgattggccgaaggttgggggaccggcggtcggcaccccagccgtggatcgagtgcggagggggagaagcgtctatcccatgtcccgcgacggcggggaatagggcgacagctgcggcggggatcggctgcggcggctcgacgaggcggcggcggcggcgcgggtgggcggcggcaccatgtctgcggtagtctgtggcaagaggtcctcctccatcttcgccgacgagctcctcccgccatcccctacctcccctcactcctcccaccagccggcgcccaagaggtcccgccggtccccctcgcaccgcggcagctccgacggacaccgacgggaggcgctcgtccaccatctgcttttactcttccccgacatggatccacagttgcttgaaaaagctctggaagcatctggagatgacttggattctgcaataaagagtttgaatttgctacgcttagagtcagcagaggctatcttgtcatctactggtttcaaatctgaaaatggtcagcatactgcaattcagcctcctgttgaaggaattcctaatggtggtgtggatacgactacagaacatcatcctactgtagataattaccagacaagtaaaaatggctctgaatgggttgagctatttgtcagggagatgacaaatgcttctgacatagatgatgcacgggctcgtgcgtccagagctttggaggctttggagaaatcaattgtagagcgtgcaggagctgaagctacacagaaccttcataaggaaaacatgatgctcaaagagcaactgactgttgttctgcgagagaatgctgtgctgaagcgggcggttgccattcaacatgagcgccaaaaggagtttgacgagaggtctcacgaggtccagagcttgaagcaacttgttttgcagtaccaggagcaagttaggacactagagataaacaactatgccctcacaatgcacctcaagcaggctcagcagagcagctccattcctgggcgtttcaaccctgatgttttctgagcagagactaataacctacgaagataccttgttttacaactgcccctgaaatggggatacctgatgggtggattcaccgcccatgggtccaaaattttcaagttacggtttgatttaaacgcgttgctttcacccaattggatatcgatatattatgtgttccctttttcgggatatggtttacttcatccatggctatcatattcgtcaacgtaatatagaaatactactgtatcatattgcagttcagttttacttcagaaaatagttaaagtttctttccccaaaaaaaaaaaaaaaa

SEQ ID NO: 4710 - DNA, 458 bp, Zea mays
aaacaacccaacccatcccgtcaggacccggaccagagaccaatcaagggcgtctcggctcatcacaggcgctgcggcgaccagggcacgcggcacggaggtcgattggccgaaggttgggggaccggcggtcggcaccccagccttggatcgagtgcggagggggagaagcgtctatcccatgtcccgcgacggcggggaatagggcgacagctgcggcggggatcggctgcggcggctcgacgagccggcgcccaagaggtcccgcctgtccccctcgcaccgcggcagctccgacggacaccgacgggaggcgctcgtccaccatctgcttttactcttccccgacatggatccacagttgcttgaaaaagctctggaagcatctggagatgacttggattctgcaataaagagtcttgaattttgctacgcttagagtcagcagaggctatctt

SEQ ID NO: 4711 - DNA, 2034 bp, Zea mays
cacagaggctggctcattgtttcgccatgggactggaggcacggcttgcaggcacggggagccaggcgtaccagtcgctcatggcacaacacacttcggtcgtggaatttctcaaggcatatagcctttacatggcagccagctgcttcatgaaggtgaggttcatcttctccaacatgaccatttgcaatgccgtggcagggaggagcaagttgcacattgtggagtatggtgtgcagcatggattccagtatccaggtctgttccatctactagcaaggagggaaggtggaccgccagaggtgagggtcaccgcgattgctgtcccacaacccgggtttcgcccagcacaccagattgaagaaacaggccgccgtctcagcaacattgcccgtgagatgggtgtgccattcaagttccgcggtattgcagcaaagtgggaggccgtccgtgctaaggatctcaatattgatccagatgaggtgcttgctgtcaacagtgagtgctatatcggcaacttgatggacgagagtgttttggtggacagcccgagccctagggatacggtcctcaacaacatccgcgagatgcggcccaatgtgttcgtccacactgtcgtaaatggaacatatggtgcaccgttctttttgacacggttccgagaggcactcttcttcttctcggcacagtttgacatgatcgatgcaaccatccctagggacaataatgaacggctgctgatcgagcgggatatctttgggacatttgccctgaatgtgattgcttgtgagggtgcagacagggtggaacggcctgaaacttataagcaatggcaagtgcgaaaccacagggctgggctgaggcagcttcctctgaatccagaggttgtcaaggcttccagggacaaggtcaagaactattatcacagagactttctcatcgatgaggataaccgttggttgctgctcggatggaagggacgggtgctctatgccatgtcgacatgggttgctgaggataataagcccatcttttagtgtgcctgaatccaactgtagattatatttgatattttgatcgaagggttatgttgaaccatgatccaccacatgttgtggttcagtggactttgtttctagagagtttattgctgaaacctgtgaggtagaagcaattagatgcttagagctacataggctgtagatatagttcttgatatattcctgcagagttgtaatcatgtgccatgtacactagaattaaaaccctgcagctgacaagtggttacacgtttgacctctgaaggcttaaaccctgaaaagtatctaatgatgcatggtatgaaggtagatgatatatgttcaaactatgtttctagagggtttagtgcagaaacttgtcaggcagaaataagtagatgcttacagctagctacataggttgtggatatagttcttgatatattgcagagttgtaatattatatactatgtacaccagaacttgtaatagtatagtatactatgcacacaggattaaacccagtcgctgagaagcaattttattggctacatgtttgacctcatgttcttttctgaaggcttagtaaactctgaaaagtattctgccttgtgaggttctgtttctgctgtagcatcagactgttggcatctccttcactgttgggtgtgagtaagcgttgtaagttgtactactggttaatcagagtaatccattttacaatatcattccttttggtattaatctgatatgcaaattatcttttccccacagttttgttttgtgtcacaggccgcggttttgcatcatttctctcgattcagacaaggacagctaaaactagtcaaagtattcaagttgagattcacaaacacggacaccgtgaacaagatctggtcgccaactcgccatactggaaccttccccctcctcagcaggcagcagcagctccttcaaattccccagtcaaagctgcggccgccatcctcacttgcctctctgcaggcatgcaagc

SEQ ID NO: 4712 - DNA, 1982 bp, Zea mays
ccggccggaggcattcgtggtctggaattcttgcatgcccgtgctacgtcgtccatcgtctccccggccggctggagctagctaggtccggtgatcatatcgtcgattggaactgaagatcaagcgatcgatagaataaattaaaggcgcgggggcaacaacaagaatggggggcggtggcggtggcggcaactcgcgggagcttgaccagacgccgacatgggcggtggcgtcggtgtgcggcgtgatcgtgctcatctccatcctgctggagaaggggctccaccacgtgggcgagttcttctcccaccgcaagaagaaggccatggtggaggccctggagaaggtgaaggcggagctcatggtgctgggcttcatctcgctcctcctcgtgttcggccagaactacatcatcaaggtctgcatcagcaaccacgccgccaacaccatgctcccctgcaagctcgaggccgccgccgtcgagggcaaggacggccacggcaaggaggccgccgccgtggtcgctggcaagaagaaggtcgccgtcgccgtccctggaaagaagaagaagaaggccgccgccgccgccgaccatcttggcggtgtggtggactggccgccgccctactacgcgcacaacgccaggatgctggcggaggcgagcatggcgaccaagtgccccgaggggaaagtgccgctcatctccatcaacgccctgcaccagctgcacatcttcatcttcttcctcgccgtcttccacgtctcctacagcgcaatcaccatggcgctcggcagggccaagatacgtgcatggaaagagtgggagaaagaagctgcaggacaagactacgagttctcacatgacccgacgcggttcaggttcacccacgagacttccttcgtgaggcagcatatgaatgtgctgaacaagttcccagcatcattctacatcagcaacttcttccggcagttcttcaggtccgtgaggcaggcagactactgcgcgctgcgccacagctttgtcaacgtccatctggcccctggcagcaagtttgatttccagaagtacatcaagcggtctctggaggatgacttcaaggtgatcgtggggatcagtcctcctctgtgggcttctgctctcatcttcctcttcctcaacgtcaatggatggcacaccatgctctggatctccatcatgccggtggtgatcatcctgtcggtggggacgaagctgcagggcatcatctgccgcatggcgatcgacatcacggagcgccacgccgtcatccagggcatcccgatggtgcaagtcagcgactcctacttctggttcgcacgccccaccttcgtgctcttcctcatccacttcaccctcttccagaatggcttccagatcatctacttcctctggattctgtatgagtacggcatggactcgtgcttcaacgactccgaagagttcgtctttgcacgactctgccttggcgtggttgtccaggtgctgtgcagctacgtgacgctcccgctgtacgcgctcgtctcccaaatgggctccaccatgaagcagtccatcttcgacgagcagacctccaaggcgctcaagaactggcgcgccggcgccaagaagaaggctcccaccggcggctccaagcacggcggtggtggctcccccaccgccggcggcagccccaccaaggccgacggcgacgcgtagagaggaacacgctaactttaatttctgtgtgcttaattgcctaggctcgttaagtcagaacatgcatgcatgtaacaccactgctggttttcatatagtgtcgacagatggtcaacgtactttttgcgatcccacttgtattttttttttacaatgaagcacccgtccgcgtccgtggacactgcaagtgcattgccatgtcatgcgccaagtcatgaattacatatttactatgggtttatgggaaaaaaactctttattatataaa

SEQ ID NO: 4713 - DNA, 1220 bp, Zea mays
aacccgtacgtgcggtcagagagctatctggggtggcattggagttggagccggcctgacagcaccagagagagggttgccgacatgggagaagcggcagaccgcgagcggccgccgtggcgctgcacggtagccgtgcaggccgcgctctgcctcgcgctctacgcggccttcagcctcggcgagccgcagctcatcccgcggggcggggtggacgcactcgggcggggcgcgcgcggcggcggcgtcgccttcctcagcgtcgctggcggcgcgcgcggacccatcgaccaggagaggctcctgaggcagatggagaccacagcaaagctttatgaagtcaagttcgtgctggatgttactcaactgggagcggatgatccactctggcaaaatggttccacgtacttccaggctctgaacatcccgtggtactccacttcatcacatgggcggacggttggtaactttttgaagaaagtgaagatgccctacgatcaggttctagatattattggtctgggcacatggcctctgcaggaacctctacatggtggcaggataagcacttcttacaggggacaaattaaatggttggatcgattactagcactcactgaaagcaattggaaaatagttgttggatataatccattacttgtttgcaatgggaaagaaacaacaaagctcgatgtgccatttcaacatatttttgcaaaatatgaagtgaatgcatacataagcatgggcgggtcttgtggctacttccatcgagacaactcgatactgtacattggacaccccaggagccctggtggtgcccaaacaagtgtagatggttttttcttgcacagagttagacccctcgagatggagtcaatgttgataaatgtagaaggcaagctagttcagagatctgatgttcagcagcatggaacgggagccatgtgaacctcacaactttcagtttctgttccattatgtcgtagcgccgaacaaaggcgtgacataatgttgtgttgtattgtattcattcagtttaaaaaaagctgcattagatttttgtcattttgcctgtttcaacatgtttgagtttgtaggtagtctttatcattatttacaaacatacatgtgttcactatctcatgctgtgtgctgcccaagcagggacgagaagttagttaatacattacttttttaaaaaaaaaaaaaaagccggg

SEQ ID NO: 4714 - DNA, 4048 bp, Zea mays
  misc_feature (3216)..(3216): n is a, c, g, or t
aagtgttgcatttcttatttcttccattccttttctaggggaatttggaaggtgcacaggaaggccaagcgaacacaacaagcatgtcgcattacaaggagatccagagaaagatagttgagttcttgagaaagagatatcatcttatggagagagccttgaatatggaatatgctgtggtacggtactaggcttttttccctgaacaggcatgcactcaaagctcacatgggagtgcacagtagctgttcatgtagtatcttgcagcattttttaaagcgtacctttttctcttgcagataaagaaaaaaattcctgttcctgatgatattactgaacaaggtgttccagcaggacatgctccttttattccagatatcagtgaactgttgcgggaattgcccaatcttgagccaatttgtaagtgatctcttattccctatatatatatattccttctctccacctatgcaggaagagacagtcacatagtggcatagaacatgctggggcagatgctcacaatttttaatcatgtgtcatgcatgactcttgtcttactaaactctctctaaagatgtgagttcttgtgaaagagatatcatcttatggagagagccttgaatatggaatatgctgtgataaagaaaaaaattcctgttcctgatgatattactgaacaaggtgttccagcaggacatgctccttttattccagatatcagtgaactgttgcgggaattgcccaatcttgagccaatttctaccaatgaattggtttctgagggcacagctggtcagttacaagttccccatctctacaataagatgtgtggagtgcttgaagagagtggtgcttatgcgctcagttccttctttggagacaagtccgcatcttctagtttggccaatagccttcgacagtttgaaactgtgtgcgagaatgtcgtcgaggccttgcgaccacaccaaaatggtactggcagtgccatcaaagaggaattggtagatgcagccaccaaagcagcagcagcagcagctcctcaacaagattcaggccatgatgcaccgcatgggcagtcttcgacagccaaggcggacatggaaatcgatggttgatttgtaggttccagagtggtaagaaagggaatccccctctaatcattatgtatactgtggtcagaatgtgcgctatatattgtaacatcaaagaaagcacctccaggcctgagggtgttactgctaatgcgtttggtttacttgttgtccttgtaatatgcatacacatttagaactcatgcagccattttgtgtgctcgaaccggtggatcgctgccctgttgtgttgtactgtgtttagggcctgtttggatacgaatggttaattataagacggggctaaagataagtccggattagctatagtggccgcgcttgttggttaacaattagctaaactttggctagctagatggtaaacaattagttaaaagtttagcaaaagaattagttcacctattaactcagtttgttgcctcctttttattatgccaactaatttgcagacctgatgataaattctcatcgatgataataatgataaaatagcaaatatcccacttggcggcgcccctgccgtcgatttcgtcgctggtcgaaccgtctttaccgccaacgcagcggcggcaagcggaggtccacagggccgacggatgcccgcggttatatcgtctgtgaaatcaacatctaccaatcataagcgtggcggcttcgagatcgactgggaccattgaatgattgaatttttaagcgtcactccatcgtcctcatccacatcacccacgacattgatgccaacgttagatcaactccaaaagaatgctaaaaagtttcttttaaaaatgattattgaaggcattctaattttttttagaagtgagttatagcgtgtactccaacagttccctaaagtatataaaaaacctgaaatctgtctatctgtgatttcaggctgatttctgtacaacagaaacaaacagatgaaccaacagtattattggccagacacaaggaaaatcaaaacaaaaaaagcattttatccttcgttgtagcctgtaggcgttctgctccaatttcccgtacgtggaacaaacaaatcaaagaatttcattctctctcctacttccaggcgttctgctcttgctactcgtggctggcagcctggcgccgtgtgcgcgcggcgaaatacgcgggagcctgtgcgtgcggagggcggacagattggggactggggagggatacatgacgcgaaaatatacgggagaagatgatgggacgagggacgccaaatttttagtgaaaggacgagggagctgaacaagaaagaccagttttccttcctaataaggccttgttcgtttctgttggattggtgggtcggaataattcctaaccggattgtttttctaatttatataaactttgattgagtggaacgaatccgggtgcaatccgacacaaacgaacaaggcctaatggttttgggttgatttacatcttttaaagtttctcttagtctccgtcatttcagcttggatctgaggttctctctaaccattgtccccatacattcgtttatctatactttctaatatatttcactctttctctaaaagatttttctcttttacttagtttatcttaaacatttttctctatacaacttcccctatattaattaacatacatatttaccatttttgacttttttaaaaaatcataatattgccatagtgcacattattattatatcatagggcataattaaaattaaaaacgatataattaacctgtaaaagagacaaatacatttttagttatctactggaaattgtagccctattggtggggaaattgtagccccatacctagaggtggcaataaactcaatatcttagactacaaataatcaaattggattctatttctatttatttatgaactaaaagtaattaaaaactcaaacaaattataaaacgacatttggatcgtgatctaccacgccaacccgtacgtgcggtcagagagctatctggggtggcattggagttggagccggcctgacagcaccagagagagggttgccgacatgggagaagcggcagaccgcgagcggccgccgtggcgctgcacggtagccgtgcaaggccgcgctctngcctcgcgctctacgcggccttcagcctcggcgagccgcagctcatcccgcggggcggggtggacgcactcgggcggggcgcgcgcggcggcggcgtcgccttcctcagcgtcgctggcggcgcgcgcggacccatcgaccaggagaggctcctgaggcaggtgcgcgcgtttcgcactcacccacccacctccacaccctataggtccgggatctcttctgcttcacagttcacacgcgccttccggcgcctggttctgctctcctcgtggagtggtgttcttcatttggtttcccctgtttgcgacctggcattgtccccttccccattgcttcgtgatgcgcaggattttcttagaggcgctcttgtcgacctcacctcgtccccacttcgcgttggcaattggcatggtcgtttgtgtggttgcagctcgcacacgcgtgaaacatggtctcgttcaccacggtagccttcttatacaacgcatcacactatccgactcagtcacaggaccgagacgacatcatactcgtgtcttaatcggggcgcaacaacccgttcgttacggctttcattcgtaccgtttaaacaaatagagatgatgtttgtcgtacttatcgctcacactgtcacacacaccaagatttgatcatctctccacggctagtgaaggaatggctgccgccatcgtcttcatcgcgtccgaacgccacaatccgactcccataaccgctactcctaatcgcgaaggtatacctctgttttacgttttctagtgactaagttacgagctaagttcatagactattaacagtggtactagagccaata

SEQ ID NO: 4715 - DNA, 2266 bp, Zea mays
tttcttctttctactagagctggtggtctggcggcacgcggggcaactgcagatactgtaatcatctatgacagtgattggaacccacatgcggatttgcaagctatggcaagagctcatcgcttaggacagactagtaaggtgatgatatacaggcttgttagccgaggtacaattgaggagcgaatgatgcagcttacaaaaaagaagattttattggagcacttagttgttggtcgactcaccaaagctaataatgtcaatcaggaggagttggatgatattatacgctatggatcaaaggagctttttgaagacgagaatgatgaatctcgccaaattcattatgacgaagctgcaattgagaggttgttagaccgtgatcaagttgacggtgatgaatctgtggaagatgaagaagaagatggattcttaaaaggattcaaggttgcaaactttgaatatatcgatgaggcaaaggctcaggcagaaaaagaggaggcacggagaaaggctgcagctgaggctgaaaattctgaaagaaactactgggatgaactattgaaggatagatatgatgtacagaaagttgaagaacatactgctatgggaaaagggaaaagaagccgcaaacagatggctgccgctgatgaagatgacattcatgatttaagttccgaagatgaggattactcattggaggatgacatttcagataatgacacaagtttgcaaggaaatatttctgggaagaggggccaatattctaagagaaaatcacgtaatgttgattctattccattgatggagggcgaaggacgtaccttgagagttcttggattcaaccatgctcaacgagcaatgttcctacagacactcaatagattcggttttcagaattatgactggaaagagtatcttcctcgtcttaaaggaaaaagtgtcgaggaaatccagagatatgctgaacttgtcatggcacatcttgttgaagaaattaatgattctgactatttttcagatggcgttccaaaggaaatgatgcgtgttgatgatgtactagtcaggatagcaaacatatcccttattgaggagaagatggctgccacaggaccaggaaaaattacaaacatttttcctaattacttgctctatgagttccaaggcttatctggtggaagaatatggaaagcggagcatgatctactgttactgagaggcatactgaagcatggatatgcaaggtggcagtatatatcagatgacagagagaatgggctttttgaggctgcacgacgagagcttcatctcccttcggttaatgaaataattggtgctcagttgaacgaggcaaatgggaatttggaaggtgcacaggaaggccaagcgaacacaacaagcatgtcgcattacaaggagatccagagaaagatagttgagttcttgagaaagagatatcatcttatggagagagccttgaatatggaatatgctgtgataaagaaaaaaattcctgttcctgatgatattactgaacaaggtgttccagcaggacatgctccttttattccagatatcagtgaactgttgcgggaattgcccaatcttgagccaatttctaccaatgaattggtttctgagggcacagctggtcagttacaagttccccatctctacaataagatgtgtggagtgcttgaagagagtggtgcttatgcgctcagttccttctttggagacaagtccgcatcttctagtttggccaatagccttcgacagtttgaaactgtgtgcgagaatgtcgtcgaggccttgcgaccacaccaaaatggtactggcagtgccatcaaagaggaattggtagatgcagccaccaaagcagcagcagcagcagctcctcaacaagattcaggccatgatgcaccgcatgggcagtcttcgacagccaaggcggacatggaaatcgatggttgatttgtaggttccagagtggtaagaaagggaatccccctctaatcattatgtatactgtggtcagaatgtgcgctatatattgtaacatcaaagaaagcacctccaggcctgagggtgttactgctaatgcgtttggtttacttgttgtccttgtaatatgcatacacatttagaacccatgcagccattttgtgtgctcgaaccggtggatcgctgccctgttgtcttgtactgtgtttagggcctgtttggatacgaatggttaattataagacggggctaaagataagta

SEQ ID NO: 4716 - DNA, 2164 bp, Zea mays
gcacgagaccattacctagaacatcctaatcgaaaaaaaactgcccacacgcacagccctaggcaccaaactgcccacacgcacagccgcggagccgccagagcctgacgctgccgccgtcggccgtcctccgccctccagttcttaaggaaagatgagtttgatatcccagaacgcggtccagaagcgctgcctcagaaaaagtgaagctgataattgcaatgatgaggacattggctctccgacctctatagatgcagaagttgggaaggaagcaaaattgaagaatcacaataaggaaaggaagaagaaaaagactaagttgttggaatcccagcagaacaaagaggaagaggagatgcggcagctggagagctcattgtttggttccctttatgctccactggagtttggcactgaggtaggggctgcagtagctcctgaccgggatgcgcctttgtttttcacagataggtctgctggtggtggcatggattattttcctacatacgaggaggatatggcccatgaagatgaggaagacatggtgggtatcaagaggaggaagcctgtatgggtggatgaggaggaagaaatgacagaggtggacattgtgaaggttccaaggttgaggaagctgagaaaagaggaagatgagcatttgatttcagggaaagagtatgaggccaggttgcgtggtcagcatgcaaaattgaacccctttactggctgggctgatatggaccagaaaacttctcttcctgctgcgtcagatggtgagtctgatgatgagggttgtgtcgatgatattcttcggaataatgatgagcttgttgccaaggatactgtcaagctcttacctgggatgctggaattctcaaggctcgttgatgccaatatccaggatccatcaagtggtcctatcaattcagtgcagtttcataagaatgggcaactgatgcttgctgcaggtttggacaagcatctgaggtttttccagattgatggaaagagaaaccccaagatccagagcatatttattggggactgtccagtacacaaggcttcttttctacccgatggctctgaggtgatcctatcaggcaggaggaagttcttctactcatttgacctggtgaatgctgctgttagcaagattggacctttgacgggacgcgaggagaaaagcctggagacctttgagatatcacctgattcgagaaccattgcttttgtcggcaatgaagggtacatccttcttatttctgccaagacaaagcagctcatcacaaccctcaagatgaacggaagcgtgcgttcgctggcttttgcggatggtgggaaccagctactgagcagcggtggagatggccatgtttaccactgggaccttggaacaaggaaatgcatccacaaggcaacagatgacggttccctggctggcctctcgctctgcacctcgcgggatagctctttgtttgccacaggctccagcagcggcatcgtgaatgtgtacaagagggacgattttctcggcgggaagaggaagccgctgaagacgatcgagaacctgactactgacatcggcgagatgaagttcaaccatgacgcccagatcctggcgatcagctcgaggaaagagaggaacggcatgaggctcgtgcacgtcccgtcgttcagcgtgttccagaactggccggggcctcggtttagtctccactatccacggtgcctggatttcagccccggcagtggcttcctgtccgtaggacacgcaggtggaaaggtcctgctgtacaagctccaccattacgagaatgcatgatgaggctaggatggttgcttggcgaaaacccattcttgacattatatttgtactcatgaacactccaatactccatgaatcgagtgagtgtatgctggtccgttccagtcattgtgcctttctatttggtgccgctggtgtcaatgctttggtgcaggctggcgatctcgtacatgtcttttactcttttgtagtcgtacgcaagtcgttgtgctgctgtttgctttattatagtggtggactgagttggttgcagaagtttagtttttttttggcaagagattgcagaatcactgttgtgaactgtgcttaaaattggacttgatggcctaccgctat

SEQ ID NO: 4717 - DNA, 2416 bp, Zea mays
ctcttgtattcgcactgcatgcctctcactctccctctccctagcggtctccacatgtgagaaacgcctctctagtaattaagcagcatggcagagaagatgtcgacgctaatcatcgtggttgaccttgattgccgcaagtgctaccacaagatccgcaagattctctgccaactgcaagaccatgagaggatccgcaccatctccttcgacgacaagagcaagacggtcaccatggtgggcccgttcgacccgcagcggctcgcgtgcaagctccgctgcaagggcggcaaggtggtgcgggacgtctacatcgtcgacgccaacggcggcggcggccggcggcggcaagcctcctcctccacagaacgtgccggacgacgggccacccgcgccggcgccggcgccagtgaggagcggcgggaagagcaagaacaagaacaagaacaaggacaagcagcagcagccgccgccgaccgagcggcctccgtcgcctccgccgccgccgccgccggagacagcgccgggacctccgccgcccgaggcgatgatgccgccgtccccggtccacgtccaccaccacccgcctcctccgcctgaccgcgggatggcggcggtggtgccccagccgcagtacgtggaggagaggccgcccagagcggagctggagcctcagccacccatgtcgcccccgcccaaggagatgaggccccccatggacctgcctcccgcgccgccgtcgccgcagccacagcaccacccgccgatgcctgggaacgagaggccgccgccaccgccgatgccgacgccgatgccggcagagtgcgtgatcccgacggtggagatcccgtcgtggccggcggcgccgcccgtgggcgtggggccgtgcgggtgcccgtgctgcgcgccgtgctaccagggctactacgagggctgcaggtgctactgctgcggcaggctgtacggcacgaccgtccgcccgttgccagcgccgtgcggggcctacaggggctgccggacgttcagcgacgacgacccgtcggcggcgtgtagcgtcatgtgaagaatggtggtgttgctttggatttgacaggaacatgcatggtgaactaatagctggtgatgcgttgaacgaataaatgaatgtgttcattaggcagggggttgcgttttgctgtccattttgttcgtgtctctccatgactgctctgcacggatcggagcatatgttcttgctgtcaacgtgtgattggccatagctagttactatatgagtgttcagtgctgttcaagacaaatgggatcggattcttcagctaataaagtctgtaatttatatatgattgttgagggctctgtgtagctagcatggagtttgaaacgaacaagaacagaggaaccgtgtgctctcgtcctgtgaggctcagcgcgcgcgcaggggagagggagatcaaagaaagtgcggttgcatctgttcctgctgtactgtggttccattacgatggaaaaggttaggccgatgtatatataatttatatgattatgctgtgggctagctagctgtgtgtagtgtgtaccatgaaaacgacctggtggcacaaactaaggtaggcagacgaaccgtgtgctgtcctcctgtgaggctagctcaaggcgtaaaaagctcttcaaaacaagcatccagtgatcacgcacgtcttgtgtcttagaacgctgcgactactggcatcttcctttatgagcttttttttctcttccctgctgactccaaatgaagaatcgactcaaacgtatatcgtattaatgtcactttgatgcaagtacgaagaacacatgcatgtacagtacataagccacgctgacagcttgtaatcgttatttaatctcagaaagtagaggacgacgatgttcaccacgtagcttcaagaaagcaaaagagagctactaacaatataaacagaatggtgtactttctgcagataggcttaaggcagcgcattatatgagacgtgggatgtcttttgatactcataaaaggcttatgagcttgacttatgtactccacatggagggaagaattttaggcaacatagtattagtaaaaaaaacttaactgaaatttatgtcacgcaaaactatcgatttaaagcataggatattgttcaatcgtgaaaaagtacaattatttctatgtggatgtccaatttaacggtctccatcgaaacactggtacgtcagacaatagagagctgagagcatttcatatgtatcatagaatatggtgggggttgttgtatttaccatctgcttggcccatgctttattttattaaatcgaataaattctgcggaggaagcatatcatcgaagggcagtagttgagtagaagaagtcgacggtggcgtgcaggctaccag

SEQ ID NO: 4718 - DNA, 1793 bp, Zea mays
gacccccgaggccggccgggactcgatcctccgtcttatcaccggtgaggtactgaggtgagacgatctccgccaccatggcctccagcacctccctctccctttgcttgcacgcctcgtcgccctcgtcctcgtctcctggactccgccgaccctccctcgcctcctcctcgtcctccaggtccgagagaacgcgcaagatcagggccaaggcggtcagggaggactggaggcagaaatccaagcccatccctcctggcgccgtctaccctgccaaggaccactgcagccgttgtgggctctgcgacacatactacgttgcgcatgtcaagactgcctgtgccttcctgggagacggcatgtcccgtgtcgaggatcttgagcgacaagtccacgggagaggccggaaggaaggcatggatgaaatgtactttggagtctatgaccaactcttgtatgccaggaagaccgaacctgttgaaggagcccagtggacgggaatagtgacaacaatcgctgtcgagatgctgaaagcaaacatggttgatgctgtggtttgtgtacaaagtgatcctgacgacaggcttgctccaagacctgttttggccaggacaccagacgaagtaattgcagccaaaggtgtgaagccaacattatcaccaaatctcaatacacttgccttagtcgaggcagctggtgtaaagcggcttcttttctgcggtgtgggctgtcaagtgcaagctttgagatctgtagaaaagtaccttggtttggaaaagctttatgtgcttggaacaaactgtgttgacaatggtacgcgtgaagggcttgataaattcttgaaagcggcaagcagtgagccagaaactgttatgcattatgaatttatgcaagactataaggtgcatctaaagcatttagatgggcacattgaagaggttccttatttttgcctgccagcaaacgacctggtagatgttattgcaccgtcatgctatagctgctttgactacacaaatggcttggcggatttagtggtggggtatatgggagtaccgaaatatgctggggtctccatgacacagcatcctcagtacattacagtcaggaacgatcgtggacaggagatgctgaacctggtagctggccttctggaaagcacacctacaattagcagtggctccaggcaaccgtttgttatggagacagtgaaagctgacgatgccgcaaaactggggaaaggcccttcgaaaccagccccccacgcgtccggcgacattctggccttcctgctgaacttggttggacccaagggtctggagttcgcacgctactctctggactatcacaccattcggaattatctgcatgttaggcgggcatggggaaagcaaagagctgagcagcacatcccggggtatgccaagaagatcgtggaggcctacgacaaggacggacggatcgaggcaatggttacgcagtcaggtgactgactcacaccattcacactctactagctggtagtatttgtactgcattgtagtaaagattaaggaatgtagaagcattgtttgtaatgtgacgtagtggccatgtatacagtagaatgtataggctgcatggcagcagctcagatctgtatgtacatcctgcgcttgccagtttctagtttgcatttgcttttctgagcatgccttttgttttaattatattgtatttgataaggcaaagataaaagaagccacagagtcccctaatgttgaaatcggaaaaggcccctaaaaaaagcggcc

SEQ ID NO: 4719 - DNA, 1460 bp, Zea mays
gcaagatcagggccaaggcggtcacggaggactggaggcagaaatccaagcccatccctcctggcgccgtctaccctgccaaggaccactgcaggatcttgagcgacaagtccacgggagaggccggaaggaaggcatggatgaaatgtactttggagtctatgaccaactcttgtatgccaggaagaccgaacctgttgaaggagcccagtggacgggaatagtgacaacaatcgctgtcgagatgctgaaagcaaacatggttgatgctgtgtgatcctgacgacaggcttgctccaagacctgttttggccaggacaccagacgaagtaattgcagccaaaggtgtgaagccaacattatcaccaaatctcaatacacttgccttagtcgaggcagctggtgtaaagcggcttcttttctgcggtgtgggctgtcaagtgcaagctttgagatctgtagaaaagtaccttggtttggaaaagctttatgtgcttggaacaaactgtgttgacaatggtacgcgtgaagggcttgataaattcttgaaagcggcaagcagtgagccagaaactgttatgcattatgaatttatgcaagactataaggtgcatctaaagcatttagatgggcacattgaagaggttccttatttttgcctgccagcaaacgacctggtagatgttattgcaccgtcatgctatagcggctttgactacacaaatggcttggcggatttagtggtggggtatatgggagtaccgaaatatgctggggtctccatgacacagcatcctcagtacattacagtcaggaacgatcgtggacaggagatgctgaacctggtagctggccttctggaaagcacacctacaattagcagtggctccaggcaaccgtttgttatggagacagtgaaagctgacgatgccgcaaaactggggaaaggcccttcgaaaccagctcctagattcgtcggcgacattctggccttcctgctgaacttggttggacccaagggtctggagttcgcacgctactctctggactatcacaccattcggaattatctgcatgttaggcgggcatggggaaagcaaagagctgagcagcacatcccggggtatgccaagaagatcgtggaggcctacgacaaagacggacggatcgaggcaatggttacgcagtcaggtgactgactcacaccattcacactctactagctggtagtatttgtatactagctggtagtatttgtactgcattgtagtaaagattaaggaatgtagaagaattgtttgtgatgtgacgtagtggcgatgtatacagtagaatgtataggctgcatggcagcagctcagatctgtatgtacatcctgcgcttgccagtttctagtttgcatttgcttttctgggcatgccttttgttttaattatattgtctttgataagtccaagat

SEQ ID NO: 4720 - DNA, 1330 bp, Zea mays
ttaattttgttccgccaggtgcttttcttctagtactcaaggctctttattttggcggcgtatatgatacctgggcccccggggagggggatgtaagaaaaattaccaatttgacccttagccccggtgttatatttggttatttactaaaatccccttttgggggagaaggatggattgttagtgtggaaagaataccccacgcccagcttccggccgggatcttcttcctcccacacctcacctacaaactgctctatctcttgtgttgtgcatcgacaccattattcagggttagaagatggcaatactggtcattaccatggtgaacgtgcagtgctgccactgcagagccagcatcaccaagatcctggaaagccacaaagaggagttttgcatcgagaagattgaattcgaggagaagctcaacaaggtgattgtacgcgggaagttcgacggcgagaagctcaagaaggcgatactagacaaggccggcgagaccgtgaagatcaaggagatagccctcgtcgacaagtggccacccccacccccaccttcgcctcccccgcccaaaccggaatgcaaggtggtgccgtacccttacccgtacccgtatccgtacccgtggtcgtgcccaccacctcgcccgccgtgccactgctgcaagccgccgacaccgccgccgccgaagccgccgccgccacagccgacgccgtgccagtgccactgctgcaagccgccgacaccgtcgccgccgaagccgccaccacagccgacgccgtgccagtgccactgctgtaagcctccggcaccatcgccgccgaagccgacgccgtgccagtgccactgctgtaagcctccggcaccgtcgccgccgaagccgccgccacagccgacgccgtgctgcaagcagtgcgaggactcgcacgacaaggataaatgcaagcgttgcccaccatgcccgccgtgcccaccgtgcccgccgtgtccaccgtgcccgcccaactactggccgccacacccgtggccctgccagtgcccaccacaggacagccagtgcaccatcgtgtgatccacgtacgcttcctttcttgcaatctgccgcctgctgcgatcgtcgtgtgatctgtcccagtaatctcgccctagtcatgtctcatgtacttggttcgcgcgttcgttgtgtcgtttgggttgtgtggcgtgtgtcctgtcttgtcttgtataaccattctctctttcagaacatgtgtaacactgattgatgatgtgtttattcatttcatgttactttcttaatagcagcttcgagagcattgctagggcccta

SEQ ID NO: 4721 - DNA, 1488 bp, Zea mays
ttttttttttttttttttccaatcgacgacgggtgcccctcggggctcccccacgcgacacgcaatctgtaagtgcaaatgagatcaagaaatatacacgtaggtagagcatacgtgtatcctttcctttcttgctagctccatccactccactccactcctctgctactccacctacctcccggctcccggatccggcgatggagaagatgctccactcagccccggcccacggcaggctcccggagtgcttcatcttcccggccgacaagctcccgcaggccaaggccacctcagcgacggtctccctgcccatcgtggacctctccctcggccgcgacgaggtgcggcgcgccatcctcgaggccggcaaggagatcggcttcttccaggtggtgaaccacggcgtctccctggaggcgatgcaggacatggagacggtgtgccaggagttcttccggctgccggcggaggacaaggccgggctgtactcggaggacacggggagggcgacccggatctactccagcaccatgttcgacacgggcgccgagaagtactggcgcgactgcctccgcctggcctgctccttccccgccgtcggcgacagcgccgcggcctggcccgacaagccccggaggctccgggaggtggtggagaggttcacggtgcagacgcggggcctggggatggagatcctgcgcctgctgtgcgagggcctcggcctccgccccgactacctggaaggggacatcagcggcggcgacgtcgtcctccacgtcaaccactacccgccctgccccgaccccaacgccacgctcggcctgccgccgcactgtgaccgcaacctcctcaccttgctcctccccagcatggtccctggcctcgaggtcgcctacaggggcgactggatccagggtggagcctgtgcccggcgccttcgtcgtcaacttcggatgccagcttgaggttgtgacgaacgggatcttgaagagcatcgagcaccgggtgatgaccaacctgggagtggcgcggacaacggtggccacgttcatcatgcccaccacggactgcctcatcggccccgccgccgagttcctcagcgacgacaacccgccgtgctaccgcaccctcaccttcgccgacttcaagcgcatctacagcgttgtcaagctgggctcgtcgctaaacctcaccacaaatctcaagaacgttcagaaggagctctgatcatccatcaaactttgtagcctccctcgaattggcggcgaggacctagctagctagctggcaagatgtagtctgtgtcatcactgtcatgttactgcccggacgtcatggtgatgataggaatgacggaataaaaatgaaatggcaaatatgcgtgtttggcgcacgcatattcttgctaagtacttactcaataaagtcatatttgttttgggattaaaaaaattttcaacaaaaaataacttatttttcgatagc

SEQ ID NO: 4722 - DNA, 1593 bp, Zea mays
ggcccgatagcagcaggtcgagtcaaatgagtgtgacctgtcggcagaagcacatgcgtccatgtaacaatcacgagtccaaatcgacgacgtgtgtggcactgagcaacaaacaagacacgcaatctgtaagtgcaaatgagatcaagaaatatacacgtaggtagagcatacgtgtatcctttcctttcttgctagctccatccactccactccactccactctgctactccacctacctcccggctcccggatccggcgatggagaagatgctccactcagccccggcccacggcaggctcccggagtgcttcatcttcccggccgacaagctcccgcaggccaaggccacctcagcgacggtctccctgcccatcgtggacctctccctcggccgcgacgaggtgcggcgcgccatcctcgaggccggcaaggagatcggcttcttccaggtggtgaaccacggcgtctccctggaggcgatgcaggacatggagacggtgtgccaggagttcttccggctgccggcggaggacaaggccgggctgtactcggaggacacggggagggcgacccggatctactccagcaccatgttcgacacgggcgccgagaagtactggcgcgactgcctccgcctggcctgctccttccccgccgtcggcgacagcgccgcggcctggcccgacaagccccggaggctccgggaggtggtggagaggttcacggtgcagacgcggggcctggggatggagatcctgcgcctccgctccgagggcctcggcctccgccccgactacctggaaggggacatcagcggcggcgacgtcgtcctccacgtcaaccactacccgccctgccccgaccccaacgccacgctcggcctgccgccgcactgtgaccgcaacctcctcaccttgctcctccccagcatggtccctggcctcgaggtcgcctacaggggcgactggatccgggtggagcctgtgcccggcgccttcgtcgtcaacttcggatgccagcttgaggtggtacactaactaacactagtagagcttgcttgtttatttatttatgttgctttatgcatgacatgtgtagtagtagtagttggattccgattccgattccgattccccattattgcaggttgtgacgaacgggatcttgaagagcatcgagcaccgggtgatgaccaacctgggagtggcgcggacaacggtggccacgttcatcatgcccaccacggactgcctcatcggccccgccgccgagttcctcagcgacgacaacccgccgtgctaccgcaccctcaccttcggcgacttcaagcgcatctacagcgttgtcaagctgggctcgtcgctcaacctcaccacaaatctcaagaccgttcagaaggagctctgatcatccatcaaactttgtagcctccctcgaattggcggcgaggaactagctagctagctggcaagatgtagtctgtgtgtcatcactgtcagtcatgttactgcccggacgtcatgctgatgataggaatgacggaataaaaatgaaatggtgctaattaagtcatatttgtttgggatta

SEQ ID NO: 4723 - DNA, 3454 bp, Zea mays
  misc_feature (1097)..(1097): n is a, c, g, or t
ggtaccctcgcggtcctgtgccgggaaaaaaaaaaaaaaaaaagctttttaaggacaaaccaaatccgctgcccctgccctgcatcgcagttcgctgcaacttttgctcacaggacacaggcacagctttgatgagcagcggccaaaacagaaagagcgattcgatcgtttcctgccgctccactaccactagctagtctgccgccgtccgccgtgccgcgcgagctccgactgccggcgccggaggcaggggaggaaggtgctgctgctccccctgccgcccgcgtcctgtgactgagatccatccagctcggaggaggaggaggaggagtcgctcctggtcctggcttctagacgttgtgacccagatcttgacgcagctgcccaagtagtttactcatctagaggagaggaggggttggatccttgacccgatttggtgggggctttgccactgggatagggggacagtttggcctgctggatctttatcgccagttgttggtcctgtcctttccgttgggctgggacgcattcacatgccagtggctgccggtttggtacttactcgacggattggttaagcgctgtctgtggggttgttgtgctgctccttctttcatcttattttgtggtgattggtgggcgaggaggaagagctaggaagattatctctcttattcttcttgcgtcatttttcgggtgcggcaagatgaagtatatgaagcttggatcaaagcctgatgtctttcagacagagggcagcaatatcagggtttgttgcaacagaactggcaacagacattgttatatccgttggggatgccaagttttatcttcacaagttccctcttctatcaaagagttcactcctgcaaaggttagttgcttcaagcaatgatgagaaaaatgatgaagtggatatctctgacatccctggtggaccttcagcatttgaaatatgtgctaagttctgctatggcgtgattgtaacactcaatgcatataacgtcctcgctgcccggtgcgcagccgagtacctcggccgcgtccacgccatcgacaaaggaaacctcatatacaagatcgatgtgttnctgacatcaagcgtatttcgcacctggaaggactcgatcatagttttacagagcacaaagtcactgcaaccttggtgtgaaaatctgaaggtaatcaaccactgcattgactgtatcgcgtcgaaggcgtcaattgatccatcagaggttgaatggtcatacacttacaacagaaaaaagctcccatctgagaatggtatcgattcacattggaacggtgtcaggaagcaacctatggtccctagtgactggtgggttgaggacctttgtgagctcgaagtggatttgtacaagcgtgtgatcatgaccatcaaggcaaagggaagcacaccagctgctgtcattggagaagcattgagggcctacgcataccgacggctgcttggctcccttgaagatgctgtgagcaatggagtcgattgcacaaaacgccgtgcagctcttgatgccattgtatttctgttgccagctgaggaaggctcggtgtcatgtggttttcttcttaagctgctaggggctgcatgtttgcttgaatctggggagtcccatcgcgttaacttgatcaagagaataggcacgcagttggatggtgcttcagttccagaccttcttataccgctaaatactaatgaagacaatatatccagcatagatctgatcatggcaatagtggaagagttcatgtcgcggaatggtgatagtggtacggagaaatttcaagacgacgaaggaatcgtggacatcgagaacgtggcatctgtttccagcgcgtcaaagcttgcagttgcaaagctgatcgatggatatcttgccgagatcgccaaagatcccaaccttcctcttccaaagttgatcgcactcgccgaaatggtgtcttctctaccccggccaacgcatgacgggctctatcgtgccattgacatgtatctgaaggtatctctctgtgtctccaccgagtgctcccgttgtagggcgtttgaacatacttaataacactgccttccatgctgacacaggagcaccccagcctatcaaagagcgagaagaagaaactgtgcgggctgatggactgcaagcagctgtcgcaggacgcgtgcatgcacgccgtgcagaacgagcgtctccccctacgcgtggtcgtgcaggttctcttcttcgagcaagtccgggcatcgtcgtcggttgcttctgcaaggagcgacgctaattcgacgtcggggctcccgtctgccgttcgctcgcttcttcccagagagaacggcaactccattggcagctccaggtcagccgcgacgacgatgacgacggaggaggaggagagtggggtcccgacgtcgagcgacatcaactctctgaggtcgatgaggctggccaacaacagcggtgggagcgagaggagcagcggcagcagtgacgtgaacaacaagagcagcgacgacaggagcgccgccgccacggggaaggcgaaggggacgatgctgatgccgaagaagatgctgagcaagctctggtccgggaaaacgaacgccggcgagagcagcagctcggacacgtcggatagccctgggtccgccaacccggaggaggcgaagtccacgcagtcgcggatcacatggcgctcggtatcctagtcgcgcgcgcgcggcgggggttcagcggggtcacaagctcacagccttagttttgttcttggtcttgattttgccttcgcctagcgagtacagcagtagcgatctcataacatatggagttactgctactggtttcacttgtcatgtcgccgatgacgttttctttttggcatgggattgcttgtagctggagtggagtaggtttggtcattggtgatgtttccagcgaagttccatgggatatttattatgtgacctttttttcatggtaggaatacaaagaaagtagtacagtccgttataattgatgtattttttgcaggcaaaaataatcatagtgttttagtttgcttcttactgcgatataacatccgttatacccggccgtagcaaatattcgagtgaaatggtgttaaactgctgaggctagtgatcagagctcttgttttctaatacgaactgcagcgtcttgttatgagctgtttttggcagtccgttaaatcatcgagcctttgtttggatattttagtatttacccctaatcttccaactcgtttaggtattttagtattcacccctaatcttctaattcactcgtattaaggtagattaaagtgtaaattagtttaatttacaagaagcacgacgctgctactaagtacggagcgctgagctagtcgtcatggcagccattccgtaaaccctgccatcctagagcttgggggg

SEQ ID NO: 4724 - DNA, 1232 bp, Zea mays
  misc_feature (1188)..(1188): n is a, c, g, or t
aattcggcacgaggaaacgatccccctgctcgatccctacacgtctcctgaaacgcacgccctcccttggctgccccccctccccttccctttcgccccctctcgcgcaatttccccagcccggaccccaaccccggcggcgctgcagtccaccgcaagtcacctccacctcacgcgaggcctccagccctcgtcgccccgcgcttctcccccacgacccggccgccttcgcgcttgcgccccgcggatcgccggcgcgaccctcaggtgtgtgcgtctggcatggcaagggacctatcaactggccctgctttctcttttcatgaatgatgtccttccgttcgaaggacgcacatgcacaaacaagacttaactggccatggagaagccaatcaccgttatcagcgcagctgcttgttgatattccacctgaaatagagttgtccgactaccggagattgccaagttctcggagcgagagcccatctggacttctccatggcgaaggcgtcaaggaagaacctatccctgatctggacattttctttgaaaggctttacgaatatttctgcgcaaaagggctcaggtgtatcattaccaaatggataatagagatcctcaatgtactttttatggtatgctgtatcgggttctttttcttatttgttgattgggatactcttattcatttgaaatgcggtgtggaggcacttgagtctggggagaaaccatgtgatcttatgaaggccattaagcatgatccattagttcccttcacattgcccaaaatgataactgttggatcaatggtcataatgacagcttatggacttaccaactttctcaagttctttgtacagttaagaagtacactcaatgttcgtcagttctactatgacagacttaaggtcaatgatcttgagattcaaactatatcatggcccaaaataattgagaaagttgtcctgctccagaaatctcaaaaactatgtgttgttagggatctctcagagcatgatattatcatgagaatcatgaggaaagaaaattatttgattgggatggtcaataaaggcattctttcttttccaattcattcttgtgtgcctggggctggcccaactggatcacatgagcatggcaggagaaactatctgatacttccaaagtcccttgaatggaccttanactggtgcatctttcaaagtatgttcgatagtaaattttgtgta

SEQ ID NO: 4725 - DNA, 1832 bp, Zea mays
tgcatgcctgcagttagctttttaataacatctcatcgtgtagcctacaagatctaaaaagttatgctgtttttgttgagttgatggtacactatttcattataatgtctaatttgtccagggcatgggtgaaccatttcacaatattgacaatgtaataaaagcctcagcaataatggttgatgagcaaggtcttcattttagccctcgcaaggttactgtctccacaagtggtcttgtccctcagttaaaacgcttcctccaggaatccaattgctccctggctgtcagtcttaatgcgacaacagatgaggtagtgattattctattctttttttttttttttgcattgggcagacccagcgctggaggcacccacatgagtcaggtctgggaaaggattgtttcactgttttgtaaactaacttgttttgcaggttaggaactggataatgcccataaacagaaagtacaatcttaacttgcttcttggcactttaagggaggaacttaacctcagacaaaaacaaatagtgctatttgaatatgtcatgctttctggagtgaacgacaggtcagatatctgctttagtgtctttgctgactgtttttgtatgttatgaatctcttagcataggttgcatataaatctccttgcaatagataactttctcccctatattcaattgttcataaggtttttctttttctatctggtccaggcatacatgtatgcctactaacgacagtctatagttgttattggaatgcgtagcccagtaggtaaattgaatcttctctcccttcctactccgttggtaaactgaatcgttttctcagtattaacctttttcgaagctatcacagttaactagtacctgcttccaccctgaaccgtatatttttgtttgatttactgtgcttgcagtatggatgatgccaagaggcttatagagctagtccaagggatcccatgcaagataaacctcatctctttcaatccccacggcggttcccaattcaagcccacaccagacgataagataattgagttccgcaacgttttaattcaaggtggcctcactgtttttgttcggctcagcagaggggatgatcagatggctgcctgcgggcagctaggagagcctggaggctatcagctacctctgctccgtgtgcccgagaaatttcaggtcgccttgtgatgctaaacagtgcatacagtaaaaatggtcctgagcagcttgacgaacacacggagtaattggctcggaacgacgattcgatcgtgcaaatcttgcaagttctaccgccttcggaagcttgtgtggacttctgcaatatcgtgcaaatctgaacctgggtacttgtgcgacaacacatttagacatggtcttgcttctgctagtacgtggtgtacccaaaccaaattcgataagattattattattattataaattggtattttctggcaaatcgttgctgtataagacattaacagtgtaacatgctttcacttggtacttcgaaaaatatggaatgaacttatcggtgatcaaaaaaaaaagaagaatctggaggacaaggttgcttgcctgaatgagataccttaaccactaaggtgtgcatggtactagccacctacacacctgatcaccccaaatgaaagaaagaaaaaaaagcgaaaactctagcacaagccccaccggatcaaagttcttttcgtaaagcagtccagcatggcgacaccacggtccgaattttttgatagtctctttttcgaaaaaaattcacagttaatccctaaaaaaatatttccgtttttagaccc

SEQ ID NO: 4726 - DNA, 1272 bp, Zea mays
aagtgacaggaatcaggcggaaaccaaataccccgaacgtccacagcgagcgagaggccgcaaactcccgagaccgtacgaaccagacgattcaccaatcaccatggcggcgccggcgcggcgcaggtcctgcatctcctccggtggagccggagcgcctccttccgctgctgcttcgcctcttctccgccctccgccgcccgctgcgaggccggtccaaggccatgctcaaggggatggactactgactactccgaacccgagataaggacatgatttaagacatgtgtgtgtttcaagtagttcgttgattgggtgcaggcgcaggggtttcggccaggccaggccttgatgctgtggaaatgcctgtacgggaacaacgtttgggctcatttttacgacgagctggctggtttaaacaaggatttcaggaagatgataactgagcatgctgatctcaaggcattaattgtgaaggacattcatcggatagaacccgggcaggacaactgtctgtgtttcaaatgaagttggttgggccatgaaatgtcagttttgcttcactagaagggcatgggtcaaccatttcacaatatcgacaatgtaataaaagcctcagcaataatggttcatgagcaaggccattttagccctcgcaaggttactgtctccacaagtggttttgtccctcagttaggaacccaattgcttgctgccgccagtcttaatgcaaggacagatgaggttagaaactggataatgactataaacagaaaggagaaccttaacttgcttcttggcactttaagaggtgaacttaacctcagaaaaaaaaacaaatagtgctatctgaatatgccatgctttctggagtgaacggcagtggatgatgccaaaagtcttttgtagagctactccaagggatcccatgcaagcaagataaacctcatctctttgagttccctcgacggttcccaatccaagcccacatcagacgataaaatgattgagttcggcaaacttttaattcaaggtgggctcactgtctttgttcggtcagcagaggggatgatcagatcagatggctgcctgcgggcagctcagagagcctggagactaccagctgcctctgcaccgtgcacctgagaaaattttgaggtcgtcttgtgatgctagacagtgcattacagtaaactggtcctgaggcctgagaaaattttgaggtcgttttgtgatgctagacagtgcattacagtaaaaaaaaaaaaaaaa

SEQ ID NO: 4727 - DNA, 1981 bp, Zea mays
aaccctcctttctatctcacccgtttcttctctgcaagtagtactatttctccgtcatactgaagctctgctgtgtgtgcgcgcgcgcgttggaggaaggaggaagtaagcctaggaaagccatcgcccaccttctcgctacccaccaaacgccgcttggtaggagaagaattgcccgaaaagcttcccgttggccgggatctcttcttctttaattacccctggggattgcctggctcattagaccagacagggggagagagggagcgagctggccggctaggccaggagaggagaggggagacacagacaacgagcgctcgctgggaagaggaagaggttcgtggggacgcagggatccagaggaagatgaggcggtgggtcttagccatcgccattcccattctcgccgctgcttcggcggcggcgctgttccttggggctgaggcccaggcggtccagcagggccaccagacagagaggatctcaggaagtgctggtgacgtgttggaagataaccctgttgggaggctcaaggtttacgtgtatgatctccccagtaaatacaacaagaagctggtgaagaaggatcctaggtgcctgaaccacatgtttgctgctgagatcttcatgcaccggttcctgttgtcaagtgctgtccgaacatttaatcctgaagaagcagattggttctacactcccgtatacgccacatgtgatctgactccttcgggtcttccccttcccttcaaatctccacgcatgatgcgcagcgcaattgagctgattgccacgaactggccttactggaacagatcagagggtgcagatcatttctttgtcacgccacatgactttggtgcttgcttccattatcaggaagagaaagcaatcgggcggggaatccttcccttgcttcagcgtgctacactggttcagacctttggacagaagaaccatgtctgcctgaagggcgggtccatcacaatcccaccatttgcacctccccagaaaatgcaggctcaccttatccccttggacacccctcggtctatcttcgtgtacttccgtggtctgttctacgacaccagcaacgatcctgagggtggttactatgcgagaggtgctcgtgcatcagtctgggagaacttcaagaacaacccgctcttcgacatctcgactgatcacccaccgacttactacgaagacatgcagcgttcagtgttctgcctgtgccccttgggctgggctccatggagccccaggctggtggaagctgtggttttcggctgcatcccggtgatcatcgccgacgacattgtcctgccctttgcggacgccatcccgtgggaggagattggtgtgtttgtcgccgaggaggatgtcccgaagctggacagcatcctgacgtccatcccaacagatgttatactgaggaagcagcgtctcctcgcgaacccggccatgaagcaggccatgctgttcccccagcctgctcaggcgggagatgcattccaccagatcctaaacgggctcgcgcgcaagctcccacatggtgacaacgtcttcttgaagcccggggagagggtcctgaactggaccgccggaccgccaggcgacctgaagccttggtagcatctgcctgcctagaacctttttgtgaaaaaaagcaagaacgagaacatggtgatatacatacatgcgcctttaagtcaccatggttgtgtacttgtatagtgctgcattttggtatgttcttctttccctgtagttgttataccatatatcttcatttagccctctcttcttttctgccctttctcactagggtatgagaatgtcagccttgtcaatcatgcggataccatagtcgaaatctacaccattttactcactctgaatgttcactgccggacagccctcctgatcgagctgacaattgccatatatacagcacatggaccgccatctttcatcatct

SEQ ID NO: 4728 - DNA, 6617 bp, Zea mays
  misc_feature (4511)..(4511): n is a, c, g, or t
  misc_feature (5008)..(5008): n is a, c, g, or t
  misc_feature (5093)..(5093): n is a, c, g, or t
  misc_feature (5150)..(5150): n is a, c, g, or t
  misc_feature (5154)..(5154): n is a, c, g, or t
  misc_feature (5699)..(5699): n is a, c, g, or t
aatcgttctagctaattaaaccacatataaattagataagcaattcggtaaaaaatcgttccgggtgctcgatcctccggaattgaatattctcaaaccaaagatagagttcccaaaatgggcgaccaaagcaacgaaaagtaaacacaccaagtcacagcaaggtgaatgcgttggacgccgacgccgaaggcagccgccaggaagccggcgacgcagcaatgcacaccacaaaaggcaatcgaggagcatccccgtcgcactccaccccctcgcattccctgtacgaaagttcagccccgggcgtgggccccaccgcgtgtaccaccagtagtactctagtctcccagtccatcgacaggcagtcggcagcagactcgtcggtcgccagccactgactgacccagacaaagctccccccaccaccgctcccgtcccgtcccgcttcgcgcctcgacaggtccaggccctggtcctcgtcggcgactggccggagatgggcttcctccgccgctccgccaccaccgccgtcctcttcgctctccacctcctcctcctcgccaccgcctccgtcgcgtcctcgccgtcatcctccctgccggagcagcaggacgacgacgtgcaggcgctgctccacctcaagcgcggcctcgcctccggcgccgacgctcctctccggcagtggtcgctggagtccggcgcccaccactgctcctggccgggggtcacctgcgacgcgcggtccggccgcgtcgtggccctcgccctcgcgctcggcggtcgcctcggcggggagctgtccccggcggtcgctcgcctcaccgagctcagagcgctgtccttcccctcggccgggctcggcggcgagattcccccgcagctctggcggctggcgcgcctgcaggcgctcaacctcgccggcaactctctccgcggccgcctgccggccaccttcccggaggggctcaaaagcttggacctttccgggaaccggctgagcgggggaatcccgccgggtctggggagctgcgcgacgctccggcgcctgcgcctgtcctccaactggttggctggaaccatcccgccgcggatcggggagctcgcgcggctccgcgttctggacctgtccgggaaccggctcaccggcggcgtgccgccggagctcctccattgcaggggcctcgtcaggatggatctcagcaggaacttgctccacggccggctgccctcgggcctcgcgcagctcaagaacctgaggtttctctccctctccggcaacaatttcagcggcgagataccttccggtttgggccagctggggtcgctggaatttcttaatctgtccaacaattctctatcaagggaggttcctgctgatcttgtggcactgcgaaatcgcactgtcttactgcttggcaacaacaaactatctggggaggaggagataactgctgctgctcccggctcaccagttcatgtagttactgctcattcagttacaggtgaactgtttcctgtttctcctatagcaacagctatccgtaagctgatcgatacaggtccaggcacttctaatggcagcaccacgaccaccagcagcagcaatggtggcgatggtggcttgggaaccaaagagattgctgccatagcttcagcatcagccattgtggtgcttctgttagttgcactcaccctgtgcatctgcacaaggaaatggcgtctgaaaccatcagagcgctcctttgcgagcaaagaagtcaaggttttcgctgatgttgatattggagcccccctgacatatgagaccgtcgttcgcgccactgggaatttcaacgctagcaactgcattggtaacggcggctttggcgcgacatacagagccgaggtggcacctggagttcttgtggcaataaagaggcttgctattgggaagcagcacggcgacaaggagttccaagcagaagtgaggatcctcgggcaatgccgtcatcctcatcttgtcactctgttggggtaccacatcaacgagtccgagatgttcctgatatacaactacctgccaggtggcaacctggaaaggttcatacaagagaggggcaggaggccgatcagctggagaaggcttcacaagatcgccctggatgtcgcccgcgctctcgcctacatgcacgacgaatgcgtgccccgcgtcctgcaccgggatgtcaagccaaacaacatactgctcgacaacgagtgcaacgcctacctttccgatttcggattggcgaggctcctccggaactcggaaacgcatgcgacgacggacgttgccggtactttcggttatgtggctcctgagtacgcaatgacgtgccgcgtgtcggacaaggcagacgtgtacagctatggagtggtgctgctggagctgatttcggacaagaaggcgctggacccgtcgttttctccatacggaaacggcttcaacatcgtcagctgggctgtgaggcttatccagagaggcagggtccgcccggccggcgtcgagggctcgcgggagaaggccccgcatgatgatctggtcgagttcctgaacctggcggtgcggtgcacgcaggagtcgctcgcttctaggcccacaatgaagcatgtccttcgatgcttgagggaactccgtccaccttcgtactaggaagacaaggagcgcccccgggcgcctaaatacttaactaagaagggctgatgggctgacagctaggtcgtctccctgcgacgccaagggggggttgggtagtagctgtggtgaggaggtgccatcaattttgatctcctctagcagcctcctctccaccaggttttactgatgcatcacattctaggtagatggatgcttccttcctccccctctctctctctgtccgtctctcaaaaagcgaaaaacaatgaaaaacatagaaaaaaaaagcgaaaagaaagaagaaaactgaatgcttcaacagttgtgcaattagataacatttgagcaacattactttctttcctctgcatgatttgaggaacaacaaaaaaagaaagaaaggggggtaatgacgctcaaatggtatgtagctgcagaaccctggaaagcatttggtgttctggaaccttggtaaatattaccagtaaagatcaaaagctttgacatgtatatggatcgatggctgtgctggtatgctagctgctgttgtcgtaaagtccatggcttggattgctgttgctttcaactttgatggattggattgtgcctagcagagtgagagcgtgagttcgcagatgctgttgcccgtagttgcagaacgcagggtgtgctttccgccgcctctccggccgggggcggggaggtgcccaagtggtgaaggagaggaggaggataaatccacagtcagtgccagtctttttgggtcctctacagaagaaaccattgacgacagggtacaactatatattgctgctgacttgcatcacaatactagtatatctagaagcacccacctaatcccgtcgcccctaaaagcatcgtgcgttcacaaaagaaaccagaaggcagtgacatgaggaactcggtgatgatgatgtgatgcgatcgatcggaggcaggcaggcaggcaggcagctggccaattagtagccgaggtcatcgggcaaacaaaacgcgtcggcggggtagaagaagaagagagggccgggattgttttgtttccataacaagtggatccatccgattgctttcgttatttactacgacgatgggacggccggacggccagtgttttcaacgtgccttcgcgcgccaacaagccgatggattttgtagtggcccactcactagctagtggccaggcccagtacgtgagagtggcccagaggagaatcgtgcacggaaccggaggcccgttggttaacaataaataattatataaaaaaattggaaaaaaaatgacgccgttgccggggatcgaacccgggtcacccgcgtgacaggcgggaatactcaccactatactacaacgacatgcttgctgaacacatctgtgaaagatatcacatctacaatctatcataggcggtcttgactggaccaccagtccagaccggccggggtgtgggtgggtagtagactagctagtaggggaacgacgacgagaacaggcatccgcatatatggccagacacgatacgacacgtacttaccgccggcgccggtgccggtgtgtgtcctcggtcctccatgcatggccatggtacgtagtgtcgtcaccgtcacagctagcgccccgtcctagctagctgctctcgatcgatcgccgcatatgtatgcagccgccggcgcgcggccagttgagtacgtccacaccagtgaccagtcgtccaacgcaaagcatcaattattgtatgcgatgcatgcatgctactgtatcaccataatttatgcagaggggagctatgagagactgagaaagagacgaagacaaaggctgctgctgcctgctttntgtcgttgttgccactcgcttggtccatcctgctcatctctctcctttccaagccttttctctctctctcgatcgatcgatgcatgagagtccacagcgcatgcagcaacaacaagtggaggagaagtctcttctcatggatggatggatggatggatggacggacgcatcaccatctctatcgctggaaccccccactgccactgacagcaatatagcttttgttgcaataatgctagtctttacacaacaccccggcctctctaccggtcccacttgcattcattcatgtacgtgcagtgtgcttcttcctcgctccatctcagggtatgtatataaattcctctcgaaatatatatatatccgataagcttctctcagccgatgctacagtcacagtaaataatatccgataagcgattgaaatatttagatacgggtctatttaccgaacatactaaaaaatctccatagaagacattattggtctttcagtnaaacttaacttcaaaaccttcaactcagatagtagatcatttacctcaacgtcagaaccgtcctgcgaagagggacaaatggagnaaccacaccagacctaacacctaagactatatatacatatacactacttagagaccnttcnaaaatcggaggcccggtccagccaccccacttgccctcctaaagatccggccttgcatggatcccctctaattccctatcgaccaaatcagattttagctagctaccaagatcatcatcgcgtctacgccatatatgactaattggacggtagtagaatacattcgtgtactttttgtctattatatattaagtcccacataggatccagatccatggatgtgtggtcgcctgtggatctactatatactaccgtaccgggctctagcaacaagcatgattccgaaagctgtcacagtcatgccatccggccggccggagcatattggtggtcattgttgcactcatacagaacagctgctaactgtacatcctttaccaagcaggcatccagatgatgatagatagatagatatgctcttccttctttatttcttccttgcttgttggtcttcactagctagctacaaaagctagctagtgcaacagatataaaaaagaactaacataaagcacatgtatgtacatgtgaggaggggagatganaagtttaccctatatatatggagatgataagcgtcagctatccaacttgcacgacgtacagtactgtcctgttcggcgagctcggtgcaggtgcgcgcgggcgcggcagccaacgaccggcgttggcaggagcgagaagccatgttaggctagctgttctctaaatttctccttctgtattatttttgtatttttcgtacggatcgaaaaattaccaaacacgcactataaaaagaaacatccttagaaaaaaacatataatcgtaattagacgtcctcttatctagcatatggccactatctctaaagtttgacatatcccacaaaaatctcttgctggacatcttcctttgtgtaacaatttctagaatctgaactagaatgttcctctaaaaagaacatgcaagattgatggagttggtctaaaagtaaaggccatatcattgcgacaaagctaaatagaccgaaacattgccgtcaccccaccaattaggagtttcccccccccccctatatatcgtacccttgttagcaacccaattcacatttatatgattaacgctgtcgggtctctctatttgaagagcaaagtaatataattctccaaatatttctagcaatataacaatcaaaaagtagacgttgaatagcctcattttgattacagaaattgcatttcatactacctttccaaccgcgtttagctaagttttctttagtgaaagtaacactgtaacacctgaatttggggtataaaatttctttccaaatatctaccacattcagggtgttacctcttggctctctctctagtctctccctttctctttctttttgattagaattaagttaattaggcgaggatgtaattatttattttgtcaaaactatgtgagtcattaaattctgcaccatgct

SEQ ID NO: 4729 - DNA, 935 bp, Zea mays
  misc_feature (860)..(860): n is a, c, g, or t
cactgggggcggctaccccccggccggcccgcacgccccggccaaaaattccccaatcgctcgttttccaccgccgcggcggggctaaatcgcccggtattccccaagccaccgtcgctccacgccaccccggcgtcgccgcctccacacgttcgtccccggtaacacccgtttttatccgtcctaccaccccgcacgcccgctcgcctcctcctatcgtcgcatctctccacggccgcgagcagcaatcgatggtgggggacctgtccctcctcgccgtcgcctccgcctcccccgtcgtcctcccgccttccaaggagctccatggcgtgcttcctctccagggtaagagaccgcaggacgccggcgtgcagctctgcgcgccgttgcagcagcatccgccccaccatctagaggcggtgccttaccaccagggccagcccgtgcagatggtcgtgcccggcaaccatcagggacaggccctcccggcggcctaccaggccatcacgatgcccgacacggccgtgctcatcgacgtgcaagattctcaccctgactcggttcaacttagccttgggattgcggagcaatgtgcaaggcaagagaaactcctcaagtttctggtgtcaggatctgatgtaaaggaacttgatgaatccttgctagctgaattcacggggcaacagactctagcaataaacatgggaactcatccatatttgccggatgataagctatcaattcctgaattcgtgttgaatgagccccaacactatctgccagagaaagaacttgtcatcccagatcctcttctgcacttcatccagtcccatggtgctgctcttactattgatcaaagngggtcggtgccttcttaggtgggaatggagatgagatgagagacttgctctcaattgttctggggtgggacatgg

SEQ ID NO: 4730 - DNA, 3602 bp, Zea mays
  misc_feature (814)..(814): n is a, c, g, or t
  misc_feature (2135)..(2135): n is a, c, g, or t
ttctgatatgtggcgatagttgtttttctgggaaagataaactgtttgaactaataacttgctgcagcttacccattaatttccataaatcatggtagagcaagatggtgtattgtaaatcttccttgagcctcacatggattaatacgatataatggttcataatttatccattatcttctaagaacccatggatgagctagtacagaactagatggtcttgcatgattaacaggcaagaagcatgaataatagcaatgcataactaggtagtaagaaatgcgaagagcatggaagtctcctaagttgcccttcaacatagaggatgtagtttctatgccaatgatttgtttataagttacggattgatgtccactggtttagttgtcaacttgtgatctttgaagtttgaacattatggttcatttatgtattattaattgttattgccagtacacttccacttatcacatttacatggcatggtactttttgcataaacaggaaaagacgttctcgggctaacagccaagtatccaatttaaaattagcaggcacaactgctgatgtttcaaaaaggtactgcattctttttgcttcctttttatgatcaggcatatgttacttcatgttgctgctttcaaacattattagttatgccgtcccccatgctattttctcatttcacttattttagaagttttgactctgggtactgcggtccgcagtgttatgccaattgtcagcacagcataaatctttctgattgtagtggggtgtgaccttatcatttgcagcacagatagtagtcggnatttttttgtaactatctttattctgcatgttatagaatttaggaagtttctatgaaagttagcaaacagctaaacactaagcagaggggactgttgttattttgaacatttttaagtggttataaagttttgtctgtgccagaagtatgcgtaagtcatcattttggggcttaaacatgcatgaaagacctttaattgtggaaggtcttcatttaaccttgatatgtaatgttctaaatgaattctttaaatttacatgcgggtgcagaaacatttggaacatttaacttttatgttcttgctacattttagattgttgtttccacctttttagacagtcaagatattgatacgttctgttgtttttttaaatgtgcagtactgattttaattcaaaatctttgtcaaagaagaaacataaagtgaaaaacatcaaagaacgtgactcgtatcagagaaactacatacatgctagcgaggttattttatccatcctgctggacaaggacaggagcagctcgacaatcctctcgctgaaaaaggctggtcctgagatcactgaacttttaacgcaatgctctatcggcattgctggaactggactggctattctcctgtcagttatgtgcaagatgtctaatggcatgaggactccttttgcttctgcccgactgcttagcaccagcgtcggattcggactcttctggctatcctgggcagtcaatggattgcgtgacaccatcgccagcattttcagaagccgaagtggcatgaatatcgaggatgacgaggtcgcagtgaaaatagaaaaaagtgtgaacgagatcctcttcagggcattaactctcctggcaatcactgcactgaagtttgcatgagcagtcatcacgattttataggtttgtcgatgcagttgtgatatactcacctatgtctatgtggttcaggagtgtagacgtgtagtactgctttctgtaggaccaagttccacctgcccaaaccatggttatagcttcccagttctcattgatctcgtagaaaatgagccaagttgtaaattgtacagaaattttgcaggaaactcggtgtatattgtggatgatggattttaactctgtgaacattggataatctgatgcccagagcttatttatatttttatctactcaaaaacaaatgcattgtttcttttttcttccttttagtggttgtttatttaggattatagtctgtctagattctataatctaagttatttgaacttacactcagttcaaaataagttagattatacaatttggacagattataatctcaagnaaaacagaaccttagtagctgtttgatgcctggttgtttttttttttttttcgaacttaaaaaaaaacttcttcaagactcaagttgcttattacatgctcagtagtagaggcaaattaggaaaaaaaactgttaggcatttaaaatgcaaatgacatgattgatgcctttacaacgagtctcgtaacgacagatactggaagcacacatcaactttctgtagttgttctatgacaacaaactaattctaagaagctgcacactagacctatcataagacagcatgtaagggagaaatcttgaaggagccgtgctactggtgatgttcaagacggacaaccctgtatcggcagctgctgtggcaaagcagtcgaaagtctccggatttcgaaccaccgtggcaatgtaggcgaccggagcctccgtttcatatacaaattcgtcaacagatgttccgttggttcccccttgtctaccatctcgtctcaacagcattgagagcactcggacaaggtgcggcacacaaaccggatcatagattatatctgcgccaagaactacgtccggctggtagccccataaatcactttcggacacttcttcccaagaaagatatttgcactcgaccttattcttgctttcttttagcgctctagaatcttcccgctcaatgcataagttattcagttccatattttccttcatgtttctgagtgtacatgggtcaccatcagtaagaataaccttagaggcaccaacatgattaagacaaatgcccaccagaccgacaccggaacctagctcgaagcaacactttgtggagaaaattttagggtatgaaagaacaaattcagacaagaataaacttgatggccaaattgaacaccctgtatcaccttcaagcatattagaagaacatgatagtcgggccacaacacttactcgctttgggaatatattatcatatgtaggagatagaaaagatatttctttataaatatgacttgccttgtctaaaaatgaaacttttgcttcggacaacatacgttgagcaaattcctcataaagttcatcaatcacaacatttgaagataattcaacctcagatataatctttttaaaaataactgttgtataagtagagtcttgacatctttctacgtttgagccagtgcaagtctccaaaaggaaattttggacatgcggtgtgatagaacctcccccagcttctctggcgagcgcgagcacgcaggagggaggctccccagcgaggaacgcgagctttaggtggagcagctgctcggtactgttctgcgccgccgcgtcagccatcggcggctgggtgggcttcttgctctgagcgcgcacgggaggaggacgcggaggcggcggtttctcttttgtttgatgttttgggaagggcactggtacttttcgattaggatgttctaggtaatggtctcgtgc

SEQ ID NO: 4731 - DNA, 2283 bp, Zea mays
ttgtctgtaaaataaaaagtgatgtgacgctgaggtggctaggttgacggtaaaggttgtgcagtggagcgctgcggcctgcggtagataagggtcgatagtgccgtcgatagctgatatggcggtcgatgaaggttggaagggttggaaccaaccttagtacctgattgaaagaagttgatttccatcaaagttcataaggggggcggggtgaagtagttgctcattggtaaaaatagttcaaaacggcctctaaccgagttggttaggtggtctgagtagcactcctcaggtcctgggtttgactcctcgtgggagcgaattttcaggttgttgttaaaaaaatcgtcttgtttgtcccacgtcaaagtacaagtctaaggctatctccagcagcttacccatccatatactcatattcaaacttcactctgcgaacaatacagtctatagtgcaaaacaatgttttggataagtcatccaaaaggatgaccatatgggtgaactgctggacacggtctaaggcctggcctctatcacggtcgttctcacatgggcttcggtgccgctgtgtatgggtagggcagaggttcgggtttttttttgacccgcgtgagaagtcttcttaatataataccgtggggcggtcttacccccgcaggtcgagtttttttattggtaaaaatagaaaagacaacatgcatgagccttagcctccccccccctaagtcagggattgaaagaccatctacttacacatccatagcatcttcctgtgtttgcaaaaaaaaaggtgaatgtgcagttggtttcattctatgcatgcttaaccttgaaaacaacatcagtaggatgctactttgttgcacggtcaagaatttatgagtaaggtgtttatgcttatctttttatagcatctgatggctgaccccaatcatctcatatctcatcttaatgcctttggaacagattctcaccctgactcggttcaacttagccttgggattgcggagcaatgtgcaaggcaagacattcgcctcctcgtggccggcctcgggatctgatgtaaaggaacttgatgaatccttgttagctgaattcacggggcaacagactctagcaataaacatgggaactcatccatatatgccggatgataagctatcaattcctgaattcatgttgaatgagccccaacactatctgccagagaaagaacttgtcatcccagatcctcttctgcacttcatccagtcccatggtgctgctcttactattgatcaaagtggtcgggtcctcttagctggcaatggtgatgagatgagagacttgctctcaattttcctggcgttcatcatgtctgagacgacaaacaggtggctgcaaggctgcatttcttgttccatccgtctgggaggaaaagacagttctcgggctaacagccaagtatccaatttaaaattagcaggcacaactgctgatgtttcaaaaagtactgattttaattcaaaatctttgtcaaagaagaaacataaagtgaaaaacatcaaagaacgtgactcgtatcagagaaactacatacatgctagcgaggttattttatccatcctgctggacaaggacaggagcagctcgacaatcctctcgctgaaaaaggctggtcctgagatcactgaacttttaacgcaatgctctatcggcattgctggaactggactggctattctcctgtcagttatgtgcaagatgtctaatggcatgaggactccttttgcttctgcccgactgcttagcaccagcgtcggattcggactcttctggctatcctgggcagtcaatggattgcgtgacaccatcgccagcattttcagaagccgaagtggcatgaatatcgaggatgacgaggtcgcagtgaaaatagaaaaaagtgtgaacgagatcctcttcagggcattaactctcctggcaatcactgcactgaagtttgcatgagcagtcatcacgattttataggtttgtcgatgcagttgtgatatactcacctatgtctatgtggttcaggagtgtagacgtgtagtactgctttctgtaggaccaagttccacctgcccaaaccatggttatagcttcccagttctcattgatctcgtagaaaatgagccaagttgtaaattgtacagaaattttgcaggaaactcggtgtatattgtggatgatggattttaactctgtgaacattggataatctgatgcccagagcttatttagtatttttatctacct

SEQ ID NO: 4732 - DNA, 1848 bp, Zea mays
ccggccgggaaaattcccaatcgctcgttttccaccgccgcggcggggctaaatcgcccggtattccccaagccaccgtcgctccacgccgccccggcgtcgccgcctccacacgttcgtccccggtaacacccgttttgatccgtcctgcccccccgggggcccggccgcctcctcctatcgtcgcatctctccacggccgcgagcagcaatcgatggtgggggacctgtccctcctcgccgtcgcctccgcctcccccgtcgtcctcccgccttccaaggagctccatggcgtgcttcctctccagggtaagagaccgcaggacgccggcgtgcagctctgcgcgccgttgcagcagcatccgccccaccatctagaggcggtgccttaccaccagggccagcccgtgcagatggtcgtgcccggcacccatcagggacaggccctcccggcggcctaccaggccatcacgatgcccgacacggccgtgctcatcgacgtgcaagattctcaccctgactcggttcaacttagccttgggattgcggagcaatgtgcaaggcaagagaaactcctcaagtttctggtgtcaggatctgatgtaaaggaacttgatgaatccttgctagctgaattcacggggcaacagactctagcaataaacatgggaactcatccatatatgccggatgataagctatcaattcctgaattcgtgttgaatgagccccaacactatctgccagagaaagaacttgtcatcccagatcctcttctgcacttcatccagtcccatggtgctgctcttactattgatcaaagtggtcgggtcctcttagctggcaatggtgatgagatgagagacttgctctcaattttcctggcgttcaacatgtcgagacgagaaacaggtggctgcaaggctgcatttcttgttccatactttgagaggaaaagacgttctcgggctaacagccaagtatccaatttaaaattagcaggcacaactgctgatgtttcaaaaaggtactgattttttttcacatgattttaattcaaaatctttgtcaaagaagaaacataaagtgaaaaacatcaaagaacgtgactcgtatcagagaaactacatacatgctagcgaggttattttatccatcctgctggacaaggacaggagcagctcgacaatcctctcgctgaaaaaggctggtcctgagatcactgaacttttaacgcaatgctctatcggcattgctggaactggactggctattctcctgtcagttatgtgcaagatgtctaatggcatgaggactccttttgcttctgcccgactgcttagcaccagcgtcggattcggactcttctggctatcctgggcagtcaatggattgcgtgacaccatcgccagcattttcagaagccgaagtggcatgaatatggatgacgaggtcgcagtgaaaatagaaaaaagtgtgaacgagatcctcttcagggcattaactctcctggcaatcactgcactgaagtttgcatgagcagtcatcacgattttataggtttgtcgatgcagttgtgatatactcacctatgtctatgtggttcaggagtgtagtactgctttctgtaggaccaagttccacctgcccaaaccatggttatagcttcccggttctcattgatctcgtagaaaatgagccaagttgtaaattgtacagaaattttgcaggaaactcggtgtatattgtggatgatggattttaactctgtgaacattggataatctgatgcccagagcttatttatatttttatctactaaaaaaaaaaaaaaaaaagcggccggcc

SEQ ID NO: 4733 - DNA, 2194 bp, Zea mays
cgccccggccaaaaattccccaatcgctcgttttccaccgccgcggcggggctaaatcgcccggtattccccaagccaccgtcgctccacgccaccccggcgtcgccgcctccacacgttcgtccccggtaacacccgtttttatccgtcctaccaccccgcacgcccgctcgcctcctcctatcgtcgcatctctccacggccgcgagcagcaatcgatggtgggggacctgtccctcctcgccgtcgcctccgcctcccccgtcgtcctcccgccttccaaggtacgcgcgcgggcctccccccccctccctcgcgcccgggctgccgtcggtcaactgcctgtgccggtggggcgggcgatggccgcctgattcctgactggttcggctatggctttccaggtgcgatttcggttcgctgtggctgacggattccgggattcgtggtgtcacgatgaaacaggagctccatggcgtgcttcctctccagggtaagagaccgcaggacgccggcgtgcagctctgcgcgccgttgcagcagcacccgccccaccatctagaggcggtgccttaccaccagggccagcccgggcagatggtcgtgcccggcacccatcagggacaggccctcccggcggcctaccaggccatcacgatgcccgacacggccgtgctcatcgacgtgcaagattctcaccctgactcggttcaacttagccttgggattgcggagcaatgtgcaaggcaagagaaactcctcaagtttctggtgtcaggatctgatgtaaaggaacttgatgaatccttgctagctgaattcacggggcaacagactctagcaataaacatgggaactcatccatatatgccggatgataagctatcaattcctgaattcatgttgaatgagccccaacactatctgccagagaaagaacttgtcatcccagatcctcttctgcacttcatccagtcccatggtgctgctcttactattgatcaaagtggtcgggtcctcttagctggcaatggtgatgagatgagagacttgctctcaattttcctggcgttcaacatgtcgagacgagaaacaggtggctgcaaggctgcatttcttgttccatactttgagaggaaaagacgttctcgggctaacagccaagtatccaatttaaaattagcaggcacaactgctgatgtttcaaaaaggcccggtttcattcggactctttgcctttgtggtcttgctacattttagattgttgtttccacctttttagacagtcaagatattgatacgttctgttgttgtttttaatgtgcagtactgattttaattcaaaatctttgtcaaagaagaaacatgaaaaacatcaaagaacgtgactcgtatcagagaaactacatacatgctagcgaggttattttatccatcctgctggacaaggacaggagcagctcgacaatcctctcgctgaaaaaggctggtcctgagatcactgaacttttaacgcaatgctctatcggcattgctggaactggactggctattctcctgtcagttatgtgcaagatgtctaatggcatgaggactccttttgcttctgcccgactgcttagcaccagcgtcggattcggactcttctggctatcctgggcagtcaatggattgcgtgacaccatcgccagcattttcagaagccgaagtggcatgaatatcgaggatgacgaggtcgcagtgaaaatagaaaaaagtgtgaacgagatcctcttcagggcattaactctcctggcaatcactgcactgaagtttgcatgagcagtcatcacgattttataggtttgtcgatgcagttgtgatatactcacctatgtctatgtggttcagaagtgtagtactgctttctgtaggaccaagttccacctgcccaaaccatggttatagcttctcagttctcattgatctcgtagaaaatgagccaagttgtaaattgtacaggatttttgcaggaaactcggtgtatattgtggatgatggattttaactctgtgaacattggataatctgatgcccagagcttatttatattttatctacttaatagctgcggccccgtttcgggggaaaaaaaaaaaaaaaaaagcggccaaaaaaaaaaaaaaaaaagaaaaaaaaaaaaaaaaaagcggcc

SEQ ID NO: 4734 - DNA, 1045 bp, Zea mays
ggtaccctcgggtcggccgggtccgcacgccccggccaaattcccaatcgctcgttttccaccgccgcggcggggctaaatcgcccggtattccccaagccaccgtcgctccacgccaccccggcgtcgccgcctccacacgttcgtccccggtaacacccgtttttatccgtcctaccaccccgcacgcccgatcggccggccggcctcctcctatcgtcgcatctctcccggccgcgagcagcaatcgatggtgggggacctgtccctcctcgccgtcgcctccgcctcccccgtcgtcctcccgccttccaaggagctccatggcgtgcttcctctccagggtaagagaccgcaggacgccggcgtgcagctctgcgcgccgttgcagcagcatccgccccaccatctagaggcggtgccttaccaccagggccagcccgtgcagatggtcgtgcccggcaaccatcagggacaggccctcccggcggcctaccaggccatcacgatgcccgacacggccgtgctcatcgacgtgcaagattctcaccctgactcggttcaacttagccttgggattgcggagcaatgtgcaaggcaagagaaactcctcaagtttctggtgtcaggatctgatgtaaaggaacttgatgaatccttgttagctgaattcacggggcaacagactctagcaataaacatgggaactcatccatatatgccggatgataagctatcaattcctgaattcatgttgaatgagccccaacactatctgccagagaaagaacttgtcatcccagatcctcttctgcacttcatccagtcccatggtgctgctcttactattgatcaaagtgggtcgggtcctcttagctggcaatggtgatgagatgagagacttgctctccattttcctggcgttcaacatgtcgagacgagaaacaggtggctgcaaggctgcatttcttgttcatactttgagaagaaaagacgttctcgggctacagcccagtatccaatttaaaatagcagcacaactgct

SEQ ID NO: 4735 - DNA, 1607 bp, Zea mays
gatcgattcggcacgacggacctacatgtcacagactctaatgcagtgcgggaggctacatacaattggctcctccggggcgggcggggagattgttcatcgagctgtcttgtccccctcttggcctcttctttccggcgatgggcgccggcgtcctcctcggcgacgccgccggcctgggggcccacctcgccgtacgccgccggaggacgcgcctctaccttcgcaactgggcctccaagcccctgcgcccctcggtctggctcggcgtggccgcctgtgtttcacagaatcgcgaccgccgtggccacgtgaccaggttctccgcctccgcctcgagcggcagtgacgagcccggggagctgtccgaggatgaggcgcagagggagtgggaagcggagctgaatcgccgactgaaggaggccgaggagatggaggagttggagcgcaccgccgagcagctgcaaagccaggccgccgccgaggcccccgaggagtcggaggaggagaagcgcgagcgtgtccgccgcgagctccagaaggtagcgaaggagcaagcggagaggagggagacggcgaagcaaatgtttgagttgggtcaaaaggcgtacgggaaaggaatgtatggacgatcaattgaattcttggaggctgcgctcactatcatacgtccctcctctctactcggtggcgagatccaaatttggcttgcaatggcatatgaagccaataggaggcacaaggattgcattgcattgtacaaagagttggagagtagccaccccatgatcaacatcaggcgccaggcagctgagcttagatacattttagaggcacccaagttgaagatatcaaatgacgaggtggtcacaataccacaaattgggagcagctgggattggtatgctggaacatggagtgacaaaatcaaggaacaagaggacaagaaaaggaagatgagtgctgctagcaaccaagttcaaccttctccaaacatctttggagacctctctttcttgcgaccgccaaatgaatggaagaagagtgcatgggtggttgttaccttgtggatccttttgataggaacagcaatctatctgcaatcatgaatggctcctgcagctctgaaacaagccattcacatctctgcgaggcactggtccatggttcaacagaacccagagatgtcgctaatatggccgtgtctcagactgttgcatttgttgtttttttttgctgcagtgtaaatactaactactgtaactagcaatacaagcagatgccatctagttcaattgattagaaatcaatctgtctgctcatatacacttgatgatattgcatctggagttgatttgatattaccgtggtaggagtttattctattttagtacttaaattactaaatacgaaaaccaaaactttatttggtagggtgtttggtttctagagactaatttttagtccctccaatttattctattttagtacttaaattactaaatacgaaaattaaaattttatttcccgtatttggtaattaccaaatatgaagacgtgactgcctcgggcgagtcatggcctcggacgtgttgtggcctcgggcg

SEQ ID NO: 4736 - DNA, 1583 bp, Zea mays
gcacgagaccattacctagaacatcctaatcgaagcacacacaccaagagacgcgtctcaccagacgaccttctcgcctcagggcctgcttggcatcacttgccaggtccgttggatcggtcatcgtctcgtcaacacgagttctccaacgaacaagttcgatcccgctgctcatctatcgcgcgcgtcgtcaatcgtcatcaccatggttggaagcagccccctgcaggccgtgctggtggccccaggcgtcaaggacaggaaggtgctcgcgttcaagcgcgacgccctcaaggacaaggacgccgtctccggcctcatccactccatcctcgcgtccagcccggcgcagcgcagcgccttctacgtcttcgacctggccaaggtcgtcgacctcttcagggcgtggcgccgggcgctgccggacgcgcggccctgctacgccgtcaagtgcaacccggacccggcgctgctcggcgcgctcgccgcgctcggcgcgggcttcgactgcgccagccgcgccgagatcgaggccgtgctcgcgctcggcgtgcggcccggggacatcgtctacgccaacccctgcaagcccgaggcgcacctcgagtacgccgcggaggtcggcgtcaacctcaccacctacgactccgaggaggaggtggccaaggtcaggcgctgccaccccggctgcgagctcctgctccgcctcaagggccccgacggcggcgacgtcagggtcgacctggggaccaagtacggcgcgcaccccgacgaggtcgtgccgctcctgcgcgccgcccagcgcgcgggggtcggcgtggccggcgtctccttccacgtcggcagcggcgcgtccaacctccacgtctaccgcggggccatccaggccgcgcgcgccgcgttcgacgcggccgctgccctcgggatgccgcccatgcgcgtcctcgacatcggcggcggcttcgtgtccggccccactttcgacgacgccgcggccgtcatcaacgacgccctcgcgcaccacttcggcgacctgccgtgcgtcgaggtgatcgccgagcccggccgctacttcgccgagaccgcgttcacgctcgccgcgcgcgtcatcgggaagcgcacgcgcggagaggtgcgcgagtactggatcgacgacggcctctacggctcgctcaactgcatcatcatggaccactacgtgcccaccccgaggccgctcgccagcccgcgccccggcgataaaacctacacttccacggtcttcggcccaacgtgcgactccctcgacacggtgctcaccgggtaccttctgccagagatgagcgtcggcgactggctcgtcttcgacgacatgggcgcctacactaccggagccggctccaacttcaacggctacgcgacgtcagatataaagatctatgtagcctactccagctgaatgcgaacgtctccacgacgtcgggcctggactaattgatatgttctttttttatttattctataatcgacccaaccctgtattatctatctttcgatataaaaataaggtgttctttcaaaaaaaacgaaaaaaaaaaaaaaaa

SEQ ID NO: 4737 - DNA, 1756 bp, Zea mays
acaacccctgtgggaggagccagagccagagccagccagccagacacacaacctcggtcggcgcggcggctcaacccaatggctccttcctccctccgcccgccgcgccaccacccgtctcccctcgtcgtcctcgccatcgccgtcctcctcgtcttgcgcaccgccgatgggctgccggaggcgggaggaggaggaggaggcggcggtctgtaccgggagattctcagggacgagaccgtgcagaggctcaaggagctgggcaagatatctgatggggatggctaccttgaaaggacgtttctgagtccggcctctatcagagccactggtgtcatcgtcagctggatgaaagacgctgggcttacgacgtgggtcgatcagatggggaatattcatggtcgatatgagccggcaaattctaccagagatgccttgttgattggatctcatatggacactgtcgttgatgctgggatgtacgatggagccttgggtattatttcagcaatctcagcactgaaggttttgaaagttacggggaaactccagaggttaacgagaccagtggaggtcattgcattcagcgatgaggagggcatcagattccagacaacttttctgggaagcgctgctgtagctggtacactacctgaatcaattttacaagtatcagataagagtggcactacactacaagatgttctgaaaatgaattcttttgaggctacctctactgctattagtcaagccaggtacaacccggagtctgtggggagttatgttgaggtacacatggagcaaggccctgtcctggaagcccttcattatccacttggtgttgtaaaaggaattgcaggacagacacgattgaaggtaatagtagatggttcgcaagggcatgctggcacagttccaatgaaattgcgccgtgatccgatggttgcagctgcagagctcgttgtgactctggaacgcctctgtaaagagcccaacagtttgctgacctacgacgaggagtgcagctgcttcactgaggagtccctggccggcctggtgtgcaccgtcggcgagctgaacacgtggccaagcgcgagcaacgtgattccgggccaggtaaacttcacggtggacatccgcgcgatggacgaccaagtgagggagacgatcgtgacgagcttctcgaggcttgttctccagaaatgcgatgacagactggtcgattgcaaggtcgagcataagcactcggcggcagcgacgcactgcgacccggagttaacgtctcagctgaagcgcgcggcgcggtcgaccgtgtcggcaatgccggggcgcaccgtggcggccggcgagacgcccgtgctgatgagcggcgcagggcacgacgcgatggcgatggccaggctcaccaagatcgggatgctgttcgtgcggtgccgcggcggcatcagccactcgccggaggagtcggtgatggacaacgacgtgtgggccgcggggctcgcgctgttcaacttcatcgaccagaacgcggtgtcagaagaactggatgccgggcagaacgtggtggctgtggcgctggcggtggcagagtcgtgatggttcggtggcgattcttttcagtgggagtaggcctgtagcctgcaactgtacataagacttgttattacattgcattaaacaggaataaaaaaaacgcttctcttcgttaaaaaaaaaaaaaaaaatcacggaggggcccggtaccaaaaaagcggcc

SEQ ID NO: 4738 - DNA, 936 bp, Zea mays
ttgggtacctcgaggccggccgccctcgtggctgccccggaattgccgttgaggcataccgcatacgtttctcccccattcctctccccactccgaaccctagccaccgtgctcacttcccaggtcgaacccgccgcggcgcgagtccacggcagtgcaggacctgatcctgcggtctaggccgcggcggtgagatggtgatggtgtcaggcggcggggggaacgcgtgggcgaaggagatgaccctccgccgcaggatagccagcatattcaacaagacgcaggaacacttccctactctgaaagactacaacgattatctggaagaagttgaggatatgactttcaacctgatcgaagggatagatgtcgaggagattgaagcaaaaattgcaagataccaacaggaaaatgcggagcagatatacttgtccagagctaaaagggcggaagatcttgcggcagcacttaaagcaagcaggatgaaccctgtaaaggccgaggccaatgatacggctgctgggagttctcagggtattagtggcggggcaggagttcagggccagtatgcacctgccgctgttcttgggggagtggctcagcctcgccccacaggtatggcgccccaactaatcggcagtgggtcggatcctctgcaaggagacgacgaggagaccaggagactacgcgcagagcgagcagcacgggctggcggatggactgctgaattgagcaagagaagagcgctggaggaggcgtttagcgccatattcatctaggattagatcaaaaagcaacacatggcctggaggaaagccggcatacttaaaatggctgtcaaactacaaagcgttggatgatctgtgtcgtgattatctttgggacatggaattctcacaaattgtggtgaagcaccctttgtgtgcctttggttgc

SEQ ID NO: 4739 - DNA, 975 bp, Zea mays
atttccccctgggtgccgttgaggcataccgcatacgtgcctacgtctttccccccttcctctccccactccgaaccctagccaccgtgctcacttcccagctcgaacccgccgcggcgcgagtccacggcagtgcaggacctgatcctgcggtctaggccgcggcggtgagatggtgatggtgtcaggcggcggggggaacgcgtgggcgaaggagatgaccctccgccgcaggatagccagcatattcaacaagacgcaggaacacttccctactctgaaagactacaacgattatctggaagaagttgaggatatgactttcaacctgatcgaagggatagatgtcgaggagattgaagcaaaaattgcaagataccaacaggaaaatgcggagcagatatacttgtccagagctaaaagggcggaagatcttgcggcagcacttaaagcaagcaggatgaaccctgtaaaggccgaggccaatgatacggctgctgggagttctcagggtattagtggcggggcaggagttcagggccagtatgcacctgccgctgttcttgggggagtggctcagcctcgccccacaggtatggcgccccaactaatcggcagtgggtcggatcctctgcaaggagacgacgaggagaccaggagactacgcgcagagcgagcagcacgggctggcggatggactgctgaattgagcaagagaagagcgcttgaggaggcgtttagcgccatattcatctaggattagatcaaaaggcaacacatggcctggaggaaagccggcatacttaaaatggctgtcaaactacaaagcgttggatgatctgtgccgtgattatctttgggacatggaattctcacaaattgtggtgaagcaccctttgtgtgcctttggttgcaaaagcaaaaaaaaaaaaaaaaaaaaaaaaaaaaaaaaaaaaaaaaaaaaaaaaaaaaaaa

SEQ ID NO: 4740 - DNA, 1651 bp, Zea mays
tgcatgcctgcagttggtttacagggatcagagaataatagtaggacgggatcaatcggaatccctgtcgtctacaccagaatcactagtgccttcttctttgcatgaactcgaagcactagtgcaaagaagaacaggaaagatactaaggggttcaagtatatggacgtcatcagtccatggttactctctaggtctctaggagatttccaactgaaattgatacgcagaaggaacgcgaaatagatgacaaaaaagactaatttgcaggggacaggacaacacaatccgtcgggcggtcgggcctgttcgagttttgcagcattggcaggggcggcccagtacaagcgagcgaataggcccagccgcgtctccgcctccactccgccagccagtagccgcgtgcccgcgtcgcgtccagccgccgctcgcccgctccgctcaccgtctctgcctcctctcgcgcagatccgcccctggccaagagcccaagaccatcgcgtccctcttcctggactccggggagtagtccttcgccaactcctcggcgcggacgacgcgccacgtggactgcgcgtccgacagccagtccaccgagtccgaggccccggcggccgacgacttcgcggacgccatcgtccgggggctccgctccgacgaccgcctcctcttcgagccccacgggccctccagctccatcctcgagaggaagcctccggcggcgcctgccctgcggccgcgagcagcggcgtcctcctcgtccttcgttgacggcgtcgcggtggcgttcgactccgccgacccgtcagatggtgatggtgtcaggcggcggggggaacgcgtgggcgaaggagatgaccctccgccgcaggatagccagcatattcaacaagacgcaggaacacttccctactctgaaggactacaacgattatctggaagaagttgaggatatgactttcaacctgatcgaagggatagatgtcgaggagattgaagcaaaaattgcaagataccaacaggaaaatgcggagcagatatacttgtccagagctaaaagggcggaagatcttgcggcagcacttaaagcaagcaggatgaaccctgtaaaggccgaggccaatgatacggctgctgggagttctcagggtattagtggcggggcaggagttcagggccagtatgcacctgccgctgttcttgggggagtggctcagccccgccccacaggtatggcgccccaactaatcggcagtgggtcggatcctctgcaaggagacgacgaggagaccaggagactacgcgcagagcgagcagcacgggctggcggatggactgctgaattgagcaagagaagagcgcttgaggaggcgtttagcgccatattcatctaggattagatcaaaaggcaacacatggcctgcattggcattggtaaaacctgcactagttctgcagggcaaagaataagaactactcaatcagatgccgccatgcaaaagttaaaatgtgtctctatccatggcagggctactctaaaactaactaaatatattactagtggtctttcacatttgcatggttggtcttattgtgaccggcaagtcagtaagtgggcagccgagccttttgttcaaaaaaaaaaaaaaaa

SEQ ID NO: 4741 - DNA, 1805 bp, Zea mays
ggccgggtttcttctcgcagctcttaagtgcatagcttgctttgtgccaccaccgtaccgtaccaaacagatcaaatcagagatggcaagtcgtagtagctctgcagaaggtgcaggcaggacgttgcctgtcaatctcaagttgatcaccgtgctgagcatcgatggcggcggcatcagagggatcatcccggccaccatcctcgccttcctggaagcgaagctccaggaactggacgggccagacgctcgtatcgcggactacttcgacgtcgtcgccggcacgagcaccggcggtctcctgacggcgatgctcacggccccggacacgaacgaacggccgctgttcgccgccaaggacctggcgcggttctacatccagcactcgcccaaaatcttccggcagaagaatgctatggggtccaagctcgtcggcaagctgaggatggcttgtgggcccaagtacgacggcaagtacctccatgcgcagctccgacggcttcttggtaatatgaggctggacaggacactgaccaatgttgtcattccgaccttcgacattgcctacatgcaacccatgattttctccagctttgagttgaagcaccggccgtcgacaaatgcgcttctgtcagacatatgcatgagcacctctgccgcgcctacctacttcccgccgcactacttccagaccagggacgagaatggcaggaggaaggccttcaacctcgtggacggcggaatcgctgcgaacaaccccaccctgtgcgccatgggccaggtgtctaaggacatcatccttgcggacgacgacttcttcccggtgatgccggcggactacggcaagttcatggtcatctcgctcggctgcgggtcgaaccggaaccggaggtactgcgccaaggccgccgccaggtggggcgtcttcagctggctcttcaaggacggcagcgctcccatcatcgacatgttcaactccgccagcgccgacatggtcgacatccacctctgcgtcctcttcagggccctgcgctccagcgaaaactacctgcgcattcagtacgatcagctgacgggcagcgcaggctccatagacgactcgtccaggaagaacatggatagactggtgaggatagggaacaagctcctggacatgaacgtctcccgggtggacatggagaccggccggaacgtggaggtgcccggtgcagggaccaacgccgagaggcttgccaagttcgccaggcagctctccgacgagcgacggcgccggagccagaacgagcttattatgaattccgagcaagtgtttcaaattcaacatcaagcttggtactacggtggtgacgcttgagctgcatccggcctgctaaatgaggtttcagtactgttctagagccgtgtttcatgctttcggctatgtaccattattcctcatgccgctgttgtcaacttcgcttcagtataacctgggcaagaggtgtagacgtgtagtgttgatatctcgactcgtcaggacatatccacgggctcaaatctttcaggaaagaagcgacagtaccaggcctagcccaggtgatgccgcgtgatgaagtgaagagttcgaatgactttggacggtcagtcacagttattttcggcagcctcgtcctgcccatggaaaataaatagtaaatttcggcggtttgtatcggccgacgaaaataaagtaagtttcggcaacttatattaaaaccgtcgaaatttagattattttcagcggcccgtgctcttgcccccaaaatttaaccgtttttaccccctcg

SEQ ID NO: 4742 - DNA, 1489 bp, Zea mays
tttctcttctgccatgaattgttctttgaatggactcgtctttgtagctggtagtatctcatatactgtattactgttatactagtcatttggactactttgcacatttgtttcttgctcttggattctgaagggtgtctttctgtattactccctccatttttttatttgacgttttgcagttcatttttgcactatttggcgtcaaataaaaaatgatggacgttctgttattgtacttaattactcaagctcaagatggaggcagtgttgaaaagtggaagacattccagttctgcacttgaagaggcaaacaacttggagggcaatgcatacaggtccgtcataaggtgcgtcgagtcctgccagctacaatcggtgtttcctttagaggtcctgaggaagaagttagggaagttggagaaagagaagtctgagaggaagaaggcagctggtccaagcagattcccgaacaagcgatcccgcggcgcagctggaccctatcccttccctgctgccaaggctgctaggggctcaagctttggtccgcgtttccagaacccagtctcacgttccttaaactacgcacctcatgctggatatataaacccagcagctgcatcaccattctctgtccctgggagcgtgtcggggagacgaggtggtgtaccatatggcggacctggagccacgtatggtggctcccctagctttgcaaccggtggtgggcagcaaccattccgtcgttaggtctagggctgtttgttgtaactgaatgctccttgttttctggctaatagggataatgtatgcctccagctattcaagcatacttgttcagttcttgatggatgctggatattgaacgtcgtgtagtacacattctatggtactgtgtttgctttgttaaatttgaactgtgtcttccataaaaaaaaaaaaaattttgtggcgcccgcatacctgggcttcttaccagcttctgatatactacctacctccgtcgatcttttttatttgtcacgttctatattttagttcaaatatttaagaacggaggtggtaatattctcgtgctaatagcaaaaggagttgacacgtccaactaagcagacactataaataaaaatctacccagagattcccatgactattttccacatttctattttccctcgaaaatgtagaatatttcatcaatagatagcggcaaactcaagggaagtgcaatagcataaacataccttcaacgcaaaaaaaaaaaaaacttaaactattagaaggtactttaacaatcttcgtaaagtcaaatgacccgcttgtcatgaatacaaatctcaacaccatctttttttcggtcacttgatattgtctttacactatatcttagctacaagagagaacttggcatattttgtatgttgtatctatgcactatgctttcctatcataagacattattagataccgaactgccggccagtcggcc

SEQ ID NO: 4743 - DNA, 2771 bp, Zea mays
  misc_feature (127)..(127): n is a, c, g, or t
gtgtgctatgttgtgattgttgtgtgctatatgctgtgttggcagcaagcaacataaatgagcagccgataggagcaagaaacaatgtattaattagaggtaatgcagtcttacatggaacaattantgcattttagttaggtttagtagctgaaaccaaatagagtattttagtgactagattttagtcactagactttagttaggtttagagagtgtttggtttttagggactaatttttattccctaaattttattctattttagtctctaaattgtcaaatacgttcagtttccgtatttgacaatttagagactaaaataaaataaaatatagagaataaaaattagcctctataaatcaattaccccctaagcagacgtctgccttgaccatttgaccaaatttatacgtaataattactttagccaaatttagaacgaatatataatttctttgttacagactagtccgtgagcaaaacgagtatgtccatcgtgatgagcccattaaacttccaaaccgactgggcacagctaagcccaaatgcgttaacataagtaggtccattagaaccctcatgtaaaaatcgagaacaaaacccaattccattgtccacggcaacgaaacaagtccatctagaccgttcctcctctaatccccatcctcgctccccccaaccctcaccgccatggcgaccaccgaggactccgccgccgcgggcgaggcccgacgcctgttcgccctcctcgagtcccagcagcaggtactctctgactgccacggcgcctggtcgcgcgccctcgcacactttgcctcgcgcgaggaggacctcgcctcccgctccgctgcactcgacgaagccctagccgccgccgacgtttccacttccgagactctcgcagcgctcgaggcccgcgagtcctccattcccgcgcgcctcgctgaggcctccgccgcgctctccgccgccgtcgctgaggccgagactgaatccaccgggccaccacccaccgacatcaagggcgcgctccggtggatatgccgccgcatggacgctgctgcgctctggcgcttcatggccgcacgccgccgggagctcgcggtagtccggagggaggccggccccgccgtcgccatggccgtcgacccgccccgccttgtcctcgacgtggtaagcgatttcttagccgctggcgacggcgtcggcggggaccaatgctgggtgctcggcatgttgctgcgctctttgttcgatttggatggcaggaagcctcccgagataggagatacattggttgagagggcgtttgcagtaaccaaagagtggcaagagcgctttgggatcaatatggacaatttgtcttctgaagacaaggaggtggagatggccgaagctgatgggtcagagaactcaggagcaacagagaagaaagaaggaaaagaagatgaggagcaggaggaggtggaggaagaggacgaggaagaggaagaggaggaagacccagaggaggaggaggaagaggaggaggaggatgacccagaggaagtagaggaacctgaggcaccaggaaaggaagggaatgaggtgaagggagaaggggcagagggaaaggtgtccgaggagggagaaggggcaggggggaaggtgtctgaggagggagaaggggcagagggaagggtgtctgaggagggacaaggggcagagggtaaggtgtctcaggagggacaaggggcagagaaaataggacatgaggatgagaagaagggagcagcagtgggcaccatgaaagtgaagacgggagaagaaggtaataagggtgcatcagagcaatcggaggcacagatatttgtgcagatggtagcggcatttggattgaaggataagttcgatgaggagttcttgagaaggctgtttgttgctaatggacggaagagggagcttgctaggattgcatgcgtgcttggatttgaggaaagccttggagatattgttgaggaactaataaagtcagggaatgctatagaggctatatatgttgcccatgaggctgatttgcttgggaaatttccacctgtgcctctcttcaaatcttatctgcagaattccactgataaggctcaggcagtgttgaaaagtggaagacattccagttctgcacttgaagaggcaaacagcttggagggcaatgcatacaggtccgtcataaggtgcgtcgagtcctgccagctacaatcggtgtttcctttagaggtcctgaggaagaagttagggaagttggagaaagagaagtctgataggaagaaggcagctggtccaagcagattcccgaacaagcgatcccgcggcgcagctggaccctatcccttccctgctgccaaggctgctaggggctcaagctttggtccgcgtttccagaacccagtctcacgttccttaaactacgcacctcatgctggatatataaacccagcagctgcatcaccattctctgtccctgggagcgtgtcggggagacgaggtggtgtaccatatggcggacctggagccacgtatggtggctcccctggctttgcaaccggtggtgggcagcaaccattccgtcgttaggtctagccctctttggcggttcggtgtgccccttgttttctggctaatagggataatgtatgcctccagctattcaagcatacttgttcagttcttgatggatgctggatattgaacgtcgtgtagtacacattctatggtactgtgtttgctttgtt

SEQ ID NO: 4744 - DNA, 1721 bp, Zea mays
  misc_feature (1699)..(1699): n is a, c, g, or t
  misc_feature (1718)..(1718): n is a, c, g, or t
taggggccttttttttttttttttttctttttttttttttttatagtatggtgtccgtggttcatgactttttactatctacgtacgtgtgtacatggtattattgtgatgatatcctggtgggctactgtttattcggtgccgtgcatgcgcacaccaccgtacacacatgcatatgcatgcggctcggtcggctagagctcggcggtgaggccttccacctcgagctgaaacttctccatggcgtccttgggcaggcagatgggcacggacggtgccctccctctccccttgccgttctttgccctcgagaagtagttggtgacgccgaggagcggcccttcgccgcccttggccggcccgccgtagacggcctcgccccagccgaagtcgacgctcttgaacccggcgtggctgacgtccgacacgatgtacgtcctcgacaccgcgaacagcggccggccccggagcgcccggcggcccccccccccccccccctcggtatcataatagtcggttaagcacttaagttgtacctcaaattacatcatgaagtatacaataacttgatacataaagaaaaaaggaatataggacaacgagacactagataccgatacatgagttcagagagtcaccgcttccatatttctgtaatcaattgaacccacagcttgtagtcggaaatttacatgacaaagtttcatgcacgaaagacctctacttaacatgtaccataaggcatcgtgcgaagacctcaggcttccagtatagttcttatctgttcaggagagtgcttaaccaaagaccttgggtcaggataactgttattcggatccatgactgcgctgtaaatgagctcataagattctgctagagctcttgccaaaccattgcaggcatctgaacgtaaccttggaacctgcagttgctcaaattcaggcaaggaaccttctgttccagtcacaataccatagaatgccttcaagcattccataagcatttgtggcgacgtctcgataatatctgccagaggccttgcatcagccttgctaccatactcctttatgtacggcatcttatttgatagtccacatttcctaagaatgcagtcaacttctttatcgacaaggacacaaatatgtgcttcaatcatagagcgcaggttgtttacatagcttgtagcgacctcctggcccatcaatggctcctgaatagctgacaagcagttgatgaggtagactttggatgaagattcggcactcagaatcgatgtagataaattcttagacagaatagcatcaactgatatagaatccctgctatttccactaggatcagagcttgttctaccacgccgcgcaagtgatccttttgacttctgtgcctctgcagcttgctcacacacctgaattattggatccaataatgcagaaataacagggtcaaagtttggtctttttccagaggcaggaaccatcatgctattgtaggtatctatgagctcaagcagcaaagaaattccttctcttacagctggtggaggagagagatcaactgcaactagtggaggatatcgcaataacttctctccacgactcttcaggatattgaagaatgtctgctgagctgcatctctcacggaccagactgtcttgcacagcgcagtgtcttcacccagcagttctgatatcgtgtnacaatagtaacccaccgtnccg

SEQ ID NO: 4745 - DNA, 772 bp, Zea mays
ttcggcacgagtgaaactttgtcatgtacgaaagacctctacttaacatgtaccataaggcatcgtgcgaagcgccgccgggtccgggacacatcactcagctctcatctcgcagccgcagctagttacagttcagagagaagaaagagaccgagatctcgccgatagctagcatcatggcgtccaaggcgctcctcgtgctaacgctcctgctcgccgccaccttcctcgccgcctccgctaacgagcaagccaaggcggccaaagaggagaagaaggtggaggtccaagactggcacggcggcggcggctacccgggtcacggcggcggcggcggcggcggctacccgcactgccggtggggctgctgcaaccgcgggtaccatggcggctgccggtgctgctcgcaccctgatcagataccagagcccatgtaccgtcctgagctcgtcgaggtccacaactaaatagtatacgggtacgtatgccccgatgggaatgaatgggaagcaagagcacacgcgtagtacgctcgtcgtagtagtcaataaaagtttggttccatcaccgtcatgaaataaaagtaaggaggttgcacgctttgtgtgcgtgcttggaaacgtcgactgtatctcatgcatcgaataaatagatgttaatgaatatcattgggacaactttttacggaacataaaaaaaaaaaaaaaaaagaaaaaaaaaaaaaaaaaaaaaaaacgcgtatctagttctctctctctctctctcctcgtgc

SEQ ID NO: 4746 - DNA, 1321 bp, Zea mays
aatgcgatctacctcccaactgttaacgtttcatcattgatcatgcgtgcatggggcccaaataagcctacacggctgcatcttgcatgccgacgacgatcgccgtcgatcactggccggccctctcgatcgatcaccccacctcgcctacctataaatacgctgggctcgcatgcactgatgcacacatcactcagctctcatctcgcagccgcagctagttacagttcagagcggcgcgaggagaccgagatctcgccgatagctagcatcatggcgtccaaggcgctcctcgtgctaacgctcctgctcgccgccacattcctcgccgcctccgctaacgagcaagccagtgagttcaccgttcagtttcacgcactgtagctaatactgataacttgcaggcttattagctttcctagctcattcaagcaaagcaacaaattaatcaaaagctagccatgatccgcccgaattaataagtatccatctcatactatgcacgtgttgggtcgttgtggcagaggcggccaaagaggagaagaaggtggaggtccaagactggcacggcggcggcggctacccgggtcacggcggcggcggcggcggcggctacccgcactgccggtggggctgctgcaaccgcgggtaccatggcggctgccggtgctgctcgcaccctgatcagataccagagcccatgtaccgtcctgagctcgtcgaggtccacaactaaatagtatacgggtacgtatgccccgatgggaatgaatgggaagcaagagcacacgcgtagtacgctcgtcgtagtagtcaataaaagtttggttccatcaccgtcatgaaataaaagtaaggaggttgcacgctttgtgtgcgtgcttggaaacgtcgactgtatctcatgcatcgaataaatagatgttaatgaatatcattgggacaactttttacggaaaaaaaaaaaaaaaactgaaaccccattgactagtagatagtcaccacgctgacgagtatcgtgaggaacaaaaacgacgaaccagtctgtgacagcatctctctgttcttttaattcagttgatcacacagacagaaagcgctgccttttctgcagcaccaaaacaccggtgtgtttctctagtgtatgtattcaaagttcgtcggtaaaagcttccctgtgatttctaacatttggtatcgggaccgtgttcaatcctagccatgatgtctgctccagaacaccagcagcatctccggccggtagccaatttctggacactgaaagtctcaaataatctccatcaccaccaccgccacgacg

SEQ ID NO: 4747 - DNA, 666 bp, Zea mays
  misc_feature (655)..(655): n is a, c, g, or t
  misc_feature (663)..(665): n is a, c, g, or t
gccggccgggtccggcactcagctcgcagctggcttttcacgtacacagttgcagttcagagagaagagaaagagaccgagatctcgccgatagctagcatcatggcgtccaaggcgctcctcgtggtagcgctcctgctcgccgccaccttcctcgccgcctccgctaacgagcaagccaaggcggccaaagaggagaataaggcggaggtccaagactggcacggcggcggcggcggctacccgggcggcggcggcggctggcacggcgggggcggcggctacccgcactgccggtggggctgctgcaaccgcgggtaccatggcggctgccggtgctgctcgcaccctgatcagataccagagcccatgtaccgtcctgagctcgtcgaggtccacaactaaacaactaaataacgagctgcgctgctacgtatatatacgtacgtatgcccgaggggaagaacgaagaagcaagagcacacgtagtacgctcgtcgtagtagtagtcaataaaagtttggttccatcaccgtcatgaaataaaaagtaaggaggttgcacgctttgtgtgcgtgcttggaaacgtcgactgtatctcatgtatcgaataaatagattttgtccacgagttttttttccaaaggcccctaanaaaccccnnna

SEQ ID NO: 4748 - DNA, 1590 bp, Zea mays
atccggcatccagattccagagaacaggagaaagaaaagttgcgaaaaaagaacaacaaaaaaggaaacgaaaacgagcgggggagctcgcggaccccaaaaccctaaccccgcggacccacctggcggcggcggcggcggcgatggcggacggcggaggagaaggaggacctcctgcggcgtcggcggcgctcaaggaccaggggaatgagcagttcaaggcggggagctacctcaaggctgccgcgctctacacgcaggccatcaagctcgaccccgacaacgccaccctctacagcaaccgagctgcagcattcctgcagttggttaagcttagcaaagcgcttgctgatgcagagacaacagtcaggctgaagccacaatgggagaagggtcatttcaggaaaggttgtgttttggaggcaatggagcgctatgaagaggcgatagctgcatttcagatagctttgcagcacaattcacaaaatacagaagtctcgagaaaaatcaagaggctatctcagttggccagggaaaagaagcgagcccttgatgtagagaacatgcgttcaaatgttgacattgcaaagaacttagaatcactgaagactgagttggctacaaagtatggagatgcagaaacagggcagagtgtcttttctttcattgttaatgtggtagaatcagcagtaaaggtttggcatgatacaggaaaagtagatccaagggtccattttcttctcgatgatcagaagaccgatactgaaaaatatgccccagtagttaacattgacaaggcatttgagtcccccaacactcatgctgagtgcttcacatatctgcggcaatacgcggagaattgttctgcgaaggctgcttgtatggtggcacctaagagcatcatctcctacccacaggtctggaaagggcaagggtcgaggaagtggaagcttgaccagagcgacgggttcttcgtgcaattcgaggcaccggcgctgaggaagatatggtttgtgccaagcacaaaagagaagggacggacattgtgcaggagccctgaggccttggacatcggcatccatgaagtgctcccccgtatattcaaggaggcagcttaagcccaataatggaggactgtccatggattcctgatcctgcacagcgcttgctggatgttctccctgggacctgggaggaggaaagagctcgcccgacatacatttgtgtaaccagtggaatcggctacgctggcagacgcagactcggaagatttgatgctgtcactgtgctatgcaatgagcgtgttgtgtttcgagtggcaccgtctcgtggttagtgcgggtgttttgtttccattttcttttgattatctacctatttaccgaatgatccctgtcaagagctatgctcctttttttttcttcaaaaaaaacgactgcaccggcaggacagcaacgctgttggtgcccctgtgggagtggcaagcacacgggaggaagggtgggtgtgatgtaaagcgggatgaacagctatatacctaggtggattgggtgagacagaacagccaaaaaaaaaaaaaaaaaagcggcc

SEQ ID NO: 4749 - DNA, 4280 bp, Zea mays
  misc_feature (9)..(9): n is a, c, g, or t
  misc_feature (18)..(18): n is a, c, g, or t
  misc_feature (24)..(24): n is a, c, g, or t
  misc_feature (846)..(846): n is a, c, g, or t
ggtaccctncggggccgnccgagnaacgcatcgtcccccctccctttttccagcgccccaaccacaaggaacagccgcacaggtcggggtcaagccatcggaccttgattccgcttgccctcctgctttatcccgccgccgccgtcgtcgtctcaaccgcccactccttcctctccctgccgctcctgcgaatcgcgaaatcggagacccccggaccgccctccaatgacgaccatgagcgacgatggtgaccgcacctgcccgctctgtgccgaggagatggacatcactgaccagcagctcaagccatgcaaatgcggttatgatatttgtgtttggtgctggcaccacatcatagacatggctgagaaggaggaaacagtgggccgctgccctgcatgccgcacatgctatgacaaggacaggatcgtcaagatggctgccacttgtgacaggacagtggcagagaaaaatgcagagaagaagcacaggacccaaaaggttaagccaaaggcagcaccttcagcagcagcaacatcaactgtagaatctaagaagcatctggctagtgtcagggttatccagagaaatctggtgtatataattgggctacctgcacatttatgcaatgagagcgtacttgagtgtagggagtactttggccaatatgggaaaattttgaaggtttcagtttcccgtccgactgggcctccctctcagcaggcatcagcaaacagcaatattagtgtctatattacttatgccaaagaagaagaggccatccggtgtattcaagctgtacacaattttgtcttggaagggaaagtgttaagggcatggtttggntactacgaagtattgccatgcatggctgcgaaacatgacatgtgggaatccagattgtctctatttgcatgatgtaggcagtcaggaggatagttttactaaagatgagatcatctcagcatatacaaggactagagtccctcagatggcatctggtgtttcgcaaagacgcacaggcactgtgttgcctcctccaggagatgatttctcttacagtgcggtggtttcagccaagcatacatttaagaatggaacacttaataccaccagtcagcccagactttcacctccaaacagtagttctgggaggtccacgcttccatcagctgcctcatgggggcagcgtgatttgaatgccaggacaacagctactggagcgacatcgtcacaatctcatacaaaaccaaaatcagaatcacaaagtaatccattttcaagttcttcagtattttcctgtacaaaaacaccctcttcatggaatgatgatacaagtacagcagcaaaaatatctgaaggacagcaactgtcagaaaaagagtctagaaccttgcagccgtataagcctggtatttcaaaggaaacacaagctttatcatcactggagtcatcactggacatagacttctcaacaataccttcagcttggaatgacgatgacattgtagtaccagatgtgatgccaaaaggaagtgatgaaaatcaagttgcaaataaaaatggtgagctaacccatccagcatccaagtcactggttttatctaagaaagacataaaaatgaacattaccagcaaaactccttcagattttgtatcaagtccagcaatatctaaatcagatgtaagtactagtgatggtgaccactcactcaccaatattactcctaaatgccttgcttcaaatgctgtagaatgccaatctagtcatactgctgtggagaaaatgttggaggatattggatccaaggacactgacatggagaagctatctgctcagatatcttcagtaacattaggtggcaacgacgagattcagagtatggcaggaaatcaacaaccagatgtaatgccatgcacatctgttgatgtgctcatggatcagaattttggcagagacctagctcatcccaatcctgacgagctcttattgccttctgaaaataaggatagtattgtttcttgtcaatatagttctgataagcgtcttgattggagtttggagatgcaaaattgtagcgttactcctttaaatgatagaatggactctgcactgctcactgacaaaattcatagtagacagctggatggttcagagcaatcatcatattcatcatttgttgaatttcctagtacagtggatacctcattgtggaatgatacagaaaataacgctgcattgacgattgacaatataacttcttcacagatgcagccagggttttcttcaactgataacacttatgccttgctaaatggaggtcaagatgggctaggtactgtatatacacatgataatgtttctgtatatacacatggcaatgtttctggacatcctggaatgggaagtcatcaccatagagcaatgggttcattaagaaacaatagtataggaagttttgacaagaccataagcgtaaataagtatgaaagaagaataatttctgatacgttgtcagagtttaatccatgggatgattcatattcgactgctaacaattttgctaggatgcttagggaatctaaaaataatgatgtccattgcattgcgccttcatggaaatcaggaaccgggatcaaagagtccagattttcatttgctagacaggataaccaaggaaacttgtttgattcatctctcagaaactgtggtactggtactgagcagaatttcagtttgctaccccagaattctcgaggaaatatttaccagaatggccttgcattccaatctctagagaatgaattttcaaacaataactctcctggtgtattagatatggcaactactggtacatcgatgtctaaaatatctgcccccccaggattttcggcaccaacaagagtaccccctcctggattttctactgcatttccatcccaggatagtttgaaccccactcctgtgtttccttctggaattttgtgccatggcgggtctatcccccctcctagattctcttcattttcttctggaatttcaactcaggaagtgtctaagcctcctactagaccgccttctccattttcttctagattttcatcacaggacggtcttgacccctcttctagattccctttttcttctggattttcatcacatgatgggtctaatcagtcgtatggctcaacgaacccagaaaatcttctccggggtactgttcagggtggcaacagtaatcattatcaatctcagtttggaaggcactcaagtgacatggagtttgatgatcctgctatattagccatgggcaaagggctgatgcctggaattggcgattcagggctggagatgaaaaatactcctgcttttcaagcacagttgcaaccagcaagtagtgatccaagatttcagttacatgtacagccaaatgtgcagtctcgtcaaaacatgagattcacagaccctatgcaagatggtttgaaccatatgaacgataattacctggcatccagatttttagctcagaaccagggtcctctatctccttatgtgcagattccgcaacaacccagaaactcgcaggttataaatggtcactgggacgggtggagtgatttgagacaagggaataacgctcctatgtcagacatgtccaggatattatatccaagtgaagtgaacaagttgcatatgctgggttcaaatgatgtccataacagagcctttggaatgtgatcgtctcctgggataatgtgcgactttgagctgacatgttcaacttggggcgttttgtgcaagtaactggttgcacaacacatagtatacctgaggtggttaatggtgttgtgctcatgagctggcacacgactatttattgctgttggagttgaccaaaatgaaccttagttttggtccatccatttggaattaccaggttcattctcgtctatgatttgtgaagcttgaatgaaaagaaagattacgtgcctgagaagaacaaggcagctgaagttgaaatagatagagatatgtctattatgggatgtggtgtgacttgcgagcgaaagagatgaagaagattaggtgggcttggcttgatggcagcttgttttttcttgtgtcttgtacatgatgatattggtcggtggttgtattatgacttgtgatcgacggtggctgcattaacctgtagtggttgcccttgctccttcctgcctgttttgtttgcagctcctcctgttttgcatagtttatgctgattaagggaattggtgcc

SEQ ID NO: 4750 - DNA, 1359 bp, Zea mays
gccgggtcccccctcctggattttctactgcacttccatcccaggagtttccttctggaatttcgtctcatgatgggtctatagcccttcctagattcccttgggcattttcttctcaaatttcagcccaggaactgtctaagccccctagtacactgccttccccgtggccggccggtttttcatctctggatgggcctaattcctcgtctaggtttccttctgcatttccttctggattttcatcacagaatggccctaacccttcatctggattccctttttcttctgggttttcatcacaggatgggtctaatcagtcgtatggctcaacaaacccagaaaatcttctccggaatactgttctgggtggcagtagtaatcattatcaatctcagtttggaaggcactcaagtgacatggagttcgatgatcctgctatattagctgtgggcaaagggctgatgcctggaattggcgattcagggctggagatgaaaaatactcctgcttttcaagcacagttgcaaccagcaagcagtgatccaagatttcacttacatatacagccaaatgtgcagtctcaccaaaacatgagatttgcagaccatatgcaggatggtttgaaccatatgaatgataatagatttttaggtcagaaccatggtcctctatccccttatgtgcagattccgcaacaacccagaaactcgcaggttacaaatggtcactgggatgggtggagtgattcgagacaagggaatagcactcctatgtcagacatgtcgaggatattatatccaagtgaagtgaacaagttgcacatgctgggttcaaatgatatctataacagagcctttggaatgtgattatctcctgggataatgtgtgagtttgagctgacatgttctgacttgggggcgttctgtggaagtaactggttgcacaacacatagtatacctgaggtggataatggtggttgtgcttatgagctggtacacgagtattttttgctattggaatttacaaaaacgaacctgagttttggttcagccatttgaaattaccaggttcgttctcttgtatggtctgtgaagcttgagtgaaaagaaagattatgtgccgagaacaaagcagctgaagttgaaatatattgagatatgtctataatgtagtgtggtgtggctcttgaacgtgagcgactaaagatttggtgggcttgacttgatgatggcagtgttttcttgtgtttgtacatgatgatggtgttggtcggtggctgcctggccagtacatgcgttttgccataataatacccatggtataataataataataataataataataataataat

SEQ ID NO: 4751 - DNA, 1612 bp, Zea mays
  misc_feature (1554)..(1556): n is a, c, g, or t
tgctgggggcattccaatagactatcttatccgaaaaatccgaccccttgaatccgcttgccctcctgcttgatcccgccgccaccatctcaaccgcccactccttcctctccctatagggttccctgccgctcctgcgaatcgagcaatcggagacccccgggccgccctccaatgcgagttcctctccttccccctactcaactttccccttttcggctcgattcactacaatctcatgggaattttgccgcaccgccctctcccttcctctccaatgttgttaataatattggacccgtgcgtgcgtgcgtgtatccccgtaggccgtagcagagcacaatccggtggtatttaggactgatatagatttctgccgatagatttaaagttggatggttgatttgttagaatcgggcaaggacgaccatgagcgacgatggcgaccgaacctgcccgctctgtgccgaggagatggacactactgaccagcagctcaagccatgcaaatgcggctatgatatttgtgtttggtgctggcaccacatcatagacatggctgagaaggaggaaacagtgggccgctgccctgcatgccgcacatgctatgacaaggacaggatcgtcaagatggctgccacttgtgacaggacggtggcagataaaaatgtagagaagaagcacaagacccaaaaggttaagccaaaggcagcacccacagcagcagcaacatcaaccgtagaatcaaagaagcatctggctagtgtcagggttatccagagaaatctggtgtatataattgggctacctgcacatttatgcaacgagagtgtgagttcacatccagatttgatcaagtcgtgtgatgtgttcattgttttcaagtcgggcgacttgctggtcgttctggctgaccgacttgggtgattaatcgcgattaatcacgattaatcagacaacttgggggactaatcgcgattggtccaaaccgacttggacgattaattgcgactaatcgtgattattcggagacttgaaaacagtggatgtgtttttaaattttacttctcacaccaactctactgttattacttgtttaggtgcttgagtgtagggagtactttggtcaatatgggaaagttttgaaggtttcagtttaaaaaaaaaaaaaaaaaaagctttatccgatcccggccgaccttcgaggggggggcccgggcaaccaaattcgccttatgtggaggcgaatacccgggctccctggcccgtcttttaaaacgcccgggatgggggaaaaaccctggggtaacccaatttaaaccgccttgggaaaaaattcccccttttcccaatggggggaaaaaaaaaaaaaggcccccccaattgcctctcccaaaattgggcccccccgtaggggggaggaaaaatttacgcctaaatttttttgaaaaacccccggaaattttttttaaaaacccccctttttttttttaaaaaaagggggggagaggggggaaaacctttttttttttttaaaaaaaaaaaccccccccnnngggggggggggggtttttttcctctttttggaaaaaaaaccccccttttttataac

SEQ ID NO: 4752 - DNA, 2779 bp, Zea mays
caggcctccacaacaaagctagggtttgcctcccccaccctcctggcctcctcccgctttccctcatcctcgtgcgaacctcgcgagccaaggaccgctcgtcgtctcttgtctcgccgtcgccatgggtacggagcggaagcggaaggtgagtcttttcgacgtggtcgacgagacctccgtctccggcaagctgggccgcgccgcctccaacggcgccgccgccactgcggcggggaccaatccgtctgtcaaccggtggaacggccggccctacacggcacggtacttcgagatcctcgagaagcgccgcacactgcccgtgtggcagcagaaggaggagttcctccgccgcctccgcgacaaccagaccctcatcctcgtcggcgaaacgggaagcggaaagacaactcagattccacaatttgttcttgagactgaaggcttgggtaaccgttccatggttgcctgcactcagcctcggagggtcgcggcaatgtcagtctccaggcgtgtggcagaggagatggatgttactattggggaagaagtgggttacagtattcggtttgaagattgcagcagccacaaaactgttctcaaatatttgacagatggtatgcttctgagagaagcaatggcagacccacttttagagaagtacaaggtgattgttcttgatgaggctcatgagaggactttggcaacagatgttttgtttgggcttctgaaggaggttctaaaaaatagaccggatttgaagcttgttgttatgagtgctactctcgaagcagagaaattccagggttactttagtgatgcaccgttgatgaaggtgcctgggagacttcatccagttgagatattttacacccaagaaccagagagggactatctagaggctgctatcaggacagttgtgcaaatacatatgtgtgaacctgctggtgatatccttgtattccttactggagaagaggagattgaggacgcatgtcggaaaatcaataaggaaatcaataatatgggagatcaggttggcccagttaaagtcgtgcctttatactctacactgcccccagccatgcagcagaagatttttgaacctgctcctgccccattgaaggaacgaggtcctcctggaaggaaaattgttgtgtccaccaacattgctgaaacatccttaactatagatggcatagtttatgtgatagacccggggttttctaaacagaaagtttacaacccaagaataagggtggaatccctcctggtgtcaccaatttctaaggcaagtgctcatcagagagctggtcgtgctggacgaacgcaacctgggaagtgctttaggctatacacagagaagagctttaatgaggatttgcaaccacagacatacccagaaattcttcggtcgaacctggcaaatacagttcttaccttgaagaaacttggaattgatgatttagtgcattttgactttatggatcctccagcaccagaaactctaatgagggccttagaagttttgaactatttggctgcactagatgatgaaggtaatctaacacagttaggtgagatgatgagtgagtttcccctggatccacaaatgtcaaagatgcttgtcatcagtccaaagtacaactgttcgaatgagatcttatcaatatctgccatgctgtcagcacccaattgcttcctccggcctagggaagctcaaaaggctgctgatgaggccaaggctcgatttggccatattgatggggaccatctgacgcttctgaatgtataccatgcatacaagcaaaacaatgaagatccccagtggtgttatgagaactttatcaattccagagcactcaagtctgcagacaatgtcagacaacagcttgttcgcatcatgactagattcaacctcaagatgtgcagcacggatttcaatagccgtgagtactacgtcaatatcaggaaaaccctgcttgcagggtatttcatgcaggtcgctcacctggaacgaactggacattacctgactgtaaaagataaccaggtcgtccatcttcatccctccaattgcatggaccataagccagagtgggtcatctacaatgaatacgtcttgactaccaggaatttcatccgcacagtcaccgatatccgtggggaatggctaattgatattgcgccgcattactatgacctgagcaatttcccgtcatgtgaggccaagcgtgttcttgagaggctgtataacaagcgggagagggaaagagctgcaaatagaggctgaagttgatacttccacaaacctggtgcttcataattccacagcaggttatcacagatggcggacccgtttgtcatatgcatgatgtcttccacagcctgttgcctagtgtttcatcagcatgatcattatgcagacagcctcgagaaatcccttggcagctcaattagttatgatgcagattaattttgtgccattctccttatttttgtatgcgtaagatatttatattttgcgtttctatgtgattaactggttatccttcggttggaatgaaattccactgattttggtttattagcttagctggggttatgtatgcctataatatgcttacttccggttgcaggaggaagggttgaacgaggttggcaccgaagaaaattcggtgtccctttttatttatttatatatagtttctgtgtggtacgccaaggataaggcgatctgaactaactggcttagacagaaagaaattggattgcgtct

SEQ ID NO: 4753 - DNA, 3134 bp, Zea mays
gatatacaaattcccctcgtggatcgaacgacccccgcggccctgccccagaaacaaagctagggtttgcctcccaaccctcctcccgttctcccgcctcctcctgtgaaccgcgcgagccaaggaccgcccgtcgtctctcgccgctcgccgccatggggacggagcggaagcggaaggtgagcctgttcgacgtggtcgacgagacgtccgtctccgccaagctgcgcgccgcctccaacggtgccgccgccaccgcgactgggggcaacccgtctgtcaaccggtggaacgggcggccctacacggcacggtacttcgatatcctcgagaagcgccgtacgctccccgtcactatccccccccccccgttcctccgctccctccgcgacaaccagaccctcatcctcgtcggcgaaactggaagcgggaagacaactcagatcccccaatttgttcttgagacggaaggcttgggtaaccgttccatggttgcctgcactcagcctcggagggtcgcagcaatgtcagtctccaggcgtgtggcggaggagatggatgttactattggggaagaagtgggttatagcattcgatttgaggattgcagcagccacaaaactgttctcaaatatttgacagatggtatgcttctgagagaagcaatggcagacccacttttagagaagtacaaggtgattgttcttgatgaggctcatgagaggactttagcaacagatgttctgtttgggcttctgaaggaagttctaaaaaatagaccagatttgaagcttgttgttatgagtgctaccctcgaagcagagaaattccagggttacttcaatggtgcacccttgatgaaggtgcctgggagacttcatccagttgagatattttacacccaagaaccagagagggactacctagaggctgctatcaggacggttatgcaaatacatatgtgtgaacctgctggtgatatccttgtattccttacaggagaagaggagattgaggatgcatgccggaaaatcaacaaggaaactaataatatgggagatcaggttggcccagttaaagtcgtgcctttgtactccacactgcccccagccatgcagcagaagatttttgaacctgctcctgccccattgaaggaaggaggtcctcctggaaggaaaattgttgtgtccaccaacattgctgaaacatccttaactatagatggcatagtttatgtgatagacccggggttttccaaacagaaagtttacaacccaagaataagggtggaatcccttctggtgtcacccatttctaaggcaagtgctcatcagagagctggtcgtgctggacgaacacaacccgggaagtgttttaggctatacacggagaagagttttaatgaggatttgcaaccacagacatacccagaaattcttcggtcgaacctggcaaatacagttcttaccttgaagaaacttggaattgatgatttagtgcattttgactttatggatcctccagcaccagaaactctaatgagggccttagaagttttgaactatttgggtgcactagatgatgaaggtaatctgacacagttaggtgagatgatgagcgagtttcccctggatccacaaatgtcgaagatgctcgtcatcagtccaaaatacaactgttcgaatgaaatcttatcagtatctgccatgctgtcaggtatgttagttgtcacagaaggttaactgattgcatttctacaaattatcttatctatatgtttatctgaactactttgcttgtcagttctgttcaagtgaagtgccaggtttctattatactccctccgttcttttttaatttgtcgcggtttagttcaaaaactaactagcaggcgacaaattttcgagaacggaggtagtagcatgtgagcttgcatgcatgctactgcatgtgcacgtagcatcattttcttgtgcatttctttaatgtgctgtcatcagcaactgtcattcacctggcttcatgagctattggtcgaaatgatcatacagtttaggctgatgcagataattgctgtttgttgaattattctgacaaagcaaacggtatcgtctcgcccctttgcatctgctgaccaccgtggacctcgtctgttatttccctatccccccccccccgcccctccgctccctccggcctagggatgctcaaaaggctgctgatgaggcgaaggctcgatttggccacattgacggggaccatctgacgcttctgaatgtataccatgcatacaaacaaaacaatgaagatccccagtggtgttacgagaactttgtcaattcaagagcacttaagtctgcagacaatgtcagacaacagcttgttcgcatcatgactagattcaacctcaagatgtgcagcacggatttcaatagccgtgagtactatgtcaatatcaggaaagccatgcttgcggggtatttcatgcaggtcgctcacctggaacgaactggacattacctgactgtaaaagataaccaggtcgtccatcttcatccctccaattgtatggaccataaaccagagtgggtcatctataatgaatatgtcttgaccaccaggaatttcattcgcacagtcaccgatatccgtggggactggctaattgatattgcgccacattactatgatctgagcaatttcccgtcatgtgaggccaagcgtgttcttgagaggctgtataacaagcgagagagggaaagagctgcaaatagaggctgaggttgatacttccacaaacctggtgctctgtaattccaccgcaggtctatccagagcccgtatacgagctttggttatcacagatagctgtcccatttgtcttaggcaaatgcgttagcatgatgtctcctacacaccctaatatctattgtctcatcagcatgatcattatgtacacaacctcgagaaattctttagcatctcaattagttgtgattcagattaattgtgtgacagtctgtttttgtatgcatcagacgtttatgttttgtgtttctatgtggttaattggttaccctttggaatgaaaatccactgaatttggtttattccaaagggggggccgggtaccc

SEQ ID NO: 4754 - DNA, 1017 bp, Zea mays
gtcaggcacccaagcaccccacgcgacccgccacttccacaaggtggatagcgaacccacagcacgtctccatctctggtttgaccgccgccgccgccgccctacgcggctacgccaggcgccgaggccttcgtcggcattttcgtcggcaagcactcaccaggtattcagccatggtttttcttgaggcagagatgtcatggaatgtgttgatctcacctagccagctggaccgcaagggcctcctgctccgcaaggctatcattgtgcgtcttctggaggatgtcacaaacaggagggcttcgaaagagcatggctactacattgctgttaatcagctgaaggcaatatctgaagggaaagtgcgtgagctaactggagatgttctgttcccagtttcatttacttgcattacacagaagcctatgaagggagaggtcatggttgggcacgtggacaggatcctcaagcatggcgtgttcctcaaatccggacccgtggagagcatcttcctggctgagaagtcgatgagtaattacaagtacataggtggggagaatgcgatgttcatgaacgaccactcgaagctggagaaggacaccgccgtgcgcttcaaggtcctagggttccgctggatggaggctgaccgccaattccagctccttgctacgatcgctggtgacttccttgggccgctgtgaactgcttccacaggtcaaacaggttctaatgtacattgctcgttagatggtggatggatggttggatctgatgtgtagaattaaactttgctaccagtggtttggtcttgtagaacctgagacatggtaggttttctagatgctgttgccagtgatatttagctctggtttgaacgtatcagtgtacctgtatgatgaacaagcgttgtcatggatgtaccttttctatgcttgcttggaagttaacgttacatggtgttccctgaaaagggggggcccggtaaaaaaaaaagtactctgcgttgttaccactgct

SEQ ID NO: 4755 - DNA, 1431 bp, Zea mays
ccatctccatgcccaaagcatcaacaacatacacacaagcaaaacaaaatgcgaagctccgtagctaaattcagatattccaaacacaaaaggggagtgcagaaccaaaatggctgcctcgaccttccttctcgttgcttttctagcattgatcacttctcaggccattgcctctgatcctagcccgctccaagacttctgtgttgccgataaagactctccgggtatgagtgctctccttttgactcaagcagtgttcttataatatatacctgattaaataaggatcatttgttcaaacacacatctacatacaataagcatttcgagggtatatatgcatgtcctattaacctgttctccatctaactgtttgtcttcgtctacgcatgcatccagtgaaggtgaatggatttgtttgcaaggaccctatggctgtgaacgctgacgacttcttcaaggctgcaaaacttgatcagccaagggacaccaccaaaagcaaggtgggatccaacgttactttgatcaatgtcatgcagctgcctggactcaacacgttggggatctcgttggctcgcattgactacgcaccactaggtcagaatcctccacacacacacccacgtgccactgagattctcaccgtgcttgaggggacactttacgtcggatttgtcacctccaaccaagctgacagaagcaacaagctatttgccaaggttctcaacaagggcgatgtgtttgtattcccccaaggactaatccacttccagttcaacccagtacatgacaagccagcagtcgcgctcgctgctctaagtagccagaaccctggagctattactattgccaatgcagtctttggatcaaagccacctatctcggatgatgtcctagctaaggcctttcaggtgcaaaaggggacaattgattggcttcaagctcagttctgggagaacaaccactactgaaaaaatcaagtctgagttcaacatatgagaataaagaaatgtacttgtattttacatactactctatgtgttaacctttttctaggttgcgactgataataaaataaatgttcagtatttataaaaaaaaaaaaaaaaaaaaaaagccaaaaaaaaaaaaaaaaaaaattagtttagtaatacacgaatagtcggttattacgaagaaatcactcccctacatctataggaaaggataagtcctaaattcaaccaggagtgaccaaaaaagctcatatttatgacaaggcatgagctcgagctaaattttggcagaacaacccggatgttctccatttacatgcctgaaaatgctgcaacagagaacaaaggggttcttctgaaattacgcacgggcacatgtctttttataaatatgagctctatcggtcactctgaggctgtccaataaagggacaat

SEQ ID NO: 4756 - DNA, 1196 bp, Zea mays
ctcgaggccggccgggcccgggatcaacaacatacacacaagcaaaacaaaaagctaagaagctccgtagctaaattcagatattacaaacacaaaagaggagtgcagaaccaaaatggctgcctcgaccttccttctcgttgcttttctagcattgatcacttctcaggccattgcctctgatcctagcccgctccaagacttctgtgttgccgataaagactctccggtgaaggtgaatggatttgtttgcaaggaccctatggctgtgaacgctgacgacttcttcaaggctgcaaaacttgaccagccaagggacaccaccaaaagcaaggtgggatccaacgttactctgatcaatgtcatgcagctgcctggactcaacacgttggggatctcgttggctcgcattgactacgcaccattaggtcagaatcctccacacacacacccacgtgccactgagatcctcaccgtgcttgaggggacactctacgtcggatttgtcacctccaaccaagctgacagaagcaacaagctatttgccaaggttctcaacaagggcgatgtgtttgtattcccccaaggactaatccacttccagttcaacccagtacatgacaagccagcagtcgcgctcgctgctctaagtagccagaaccctggagctattactattgccaatgcagtctttggatcaaagccacctatctcggatgatgtcctagctaaggcctttcaggtgcaaaaggggacaattgattggcttcaagctcagttctgggagaacaaccactactgaaaaaatcaagtctgagttcaacatatgagaataaagaaatgtacttgtattttacatactactctatgtgttaacctttttctaggttgcgactgataataaaataaatgttcagtatttatgtactataatcgtaagtttgtgcctattgcggttccaccggtgtgtccttaatcaaaaagtgaatgtaactatatctatattttttgtaactatatcgtgttactccacatgttggtttggtgtggaactgacagacgatattataccccacaagacgaacaagcattgctaactatatctatattttttgtgagttgactctttctgtgcatatgtacgtatagtagcaaaaagctggggttgtgccagaagcaaagagaccaattaagaa

SEQ ID NO: 4757 - DNA, 826 bp, Zea mays
gcacgagaccattacctagccccgcctcgaggccggccgggccgggacttgtaacctggctcgcaacgttgcgtgaaggacctcgcgcgcgctctcctctactgcttggtcgtctcgttgccccggccgaacatccaagcctctccatgtctggcccttcgaagaagcagcgcggcatgccggcactggggtgctggctcatggctgtcggcaccttccgcttggccttcacctggtcgtgcttcttcggctccgggtcgctctgctcagccacctactccgagatacaggtgatcggcgtgcatgggcgcacggttgcggtgtggacgctgctgtcgtgcaccctctgcttcctgtgcgccttcaacctcaccagcaagccgctgtacgcggccaccttcctgtccttcgtctacgccttcgggtacctgagcaccgagtgcatggtgtaccacaccatgagtgcagctagtctcgtcccgttcaccttcatcgctgtcacatccatggtctggatgctgcttcaatggaactcggatggtcacggcccccgtcttcttcatgggtctactgcttccaagcagccatgacttcgcaggttctctcacctatggcttccttcaactacatacggttcagtgcatgcaagcaccatggaattatggaatatctgtaatcttttgtaataatcgtttctatgtcccgcaggctagtgaatgaaactagcaagctatcatctgtgataaatttgtaattttaccactctcaatttcggcttactattattataaaaaaaaaaaaaaagcagcccccctaggggccggcc

SEQ ID NO: 4758 - DNA, 729 bp, Zea mays
ctgtctcgcagcgtcgtccgtgaagcaggccctcacggtcgctcccctctattgctgctcccaagcctccatggctgtcccctcgaagaagcgcggcatgccggcactggggtggtggctcatggccgtcggcaccttgcgctcggccttcacctggtcgtgcttcttcggctcctccgcgtcgttctgctcagccacctactccgagatacaggtgatcggcgtgcatgggcgcacggttgcggtgtggacgctgctgtcgtgcacgctctgcttcctgtgcgccttcaacctcgacagcaagccgctgtacgcggccaccttcctgtccttcgtctacgccatcgcctacctgatcgtcgagtgcgtggtgtaccacaccatgagtgcggctagtctcgtcccgttcaccttcatcgctgtcatatccgtggtctggatgctgcttcagtggaactcggatggccacagcagccccagccgtccgcgccgtgggtctactaattcgaagcagccatgaccaagaccggactttgcagcaggttgtgtcaccgttggcttcaaactacatgaactcaccaacacccacatcaacaattaataaacgggagtcatgtataacctcattaaatgaggcgcttattaattgaggggtttctagtggattaaatgaaaaaaaaatcgagagaccgtctatttgcgaagagctcatctctttgacgattttct

SEQ ID NO: 4759 - DNA, 2106 bp, Zea mays
attcattcatccggcccgagagcagagcgcacaccacaccacctccgtgaggtggagcggagccatcacctccgtcacgcacgcgatttcttttcaaaccgagtagctcgatcgagtcctcgttacgcaactcgaccaaccggcggcggccagctgatcgagccgcccggccggccgcgcctggtgtgacgtgccatctcgatctcgatggggcatcttgctcctcctcgctctcttcttcttaatttgccgctgcgtgcggccttttattcgccctgcctctagctgctgcttcttccaggatcggggatcggagcttgtgctgctactgctactataccagcgctagctagcagcagccgccggccggctcgcgcaagctaaggaagggtcgacatgacgatggggctccgcgtccgcgactcctccgcgctgctggctctggccgtcgcgctcgcctgctgctccgttgcagtggtggcctacgaccccctggacccgaacggcaacatcaccatcaagtgggacgtgatctcgtggacgcccgacgggtacgtggcgatggtgacgatgagcaactaccagatgtaccggcacatcatggcgcccgggtggacgttggggtggtcgtgggccaagaaggaggtgatctggtccatcgtgggggcgcaggccacggagcagggggactgctccaagttcaagggcggcatcccgcactgctgcaagcgcaccccggccgtggtggacctcctcccgggggtgccctacaaccagcagatcgccaactgctgcaaggccggcgtggtgtcggcgtacgggcaggacccggcggggtccgtctccgcgttccaggtctccgtcggcctggccggtaccaccaacaagacggtgaagctgcccaggaacttcacgctcatggggcccgggctgggctacacctgcgggcccgccgccgtggtgccgtccaccgtgtactggacgcccgaccaccggcgccggacgcaggcgctcatgacgtggacggtgacctgcacctactcgcagcagctggcgtcccggtacccgtcctgctgcgtctccttctcctccttctacaacagcaccatcgtgccgtgcgcccggtgcgcgtgcggctgcggcggccacggcggccacgcgggtccgggcggctgcatcgagggggactccaagcgcgcgctgtcggccggggtgaacacgccgcgcaaggacggccaggcgctgctgcagtgcacgccgcacatgtgccccatccgggtgcactggcacgtcaagctcaactacaaggactactggcgcgccaagatcgccatcaccaactacaactacaggatgaactacacgcagtggacgctggtggcgcagcaccccaacctggacaacgtcaccgaggtcttcagcttccagtacaagccgctgcaaccatacgggagcatcaatgacactggcatgttctacgggctcaagttctacaacgactttctcatggaggccggcccgttcggcaacgtgcagtcggaggtgctcatgcgcaaggacgcaaggaccttcaccttcagcatgggctgggcgttcccgcgcaagatctacttcaacggcgacgagtgcaagatgccgccgccggactcctacccctacctgcccaacgccgcgcccgtcgtcgcctcgcagctggtcctgtccgccgccgcctcggcgttcctactgttgctgctcctggtggcatgaccgtgaccgaaccaagggcaaggcctccgttttgttttcccgtctcgtcccgtgggcagggagcagacttcagtaggcagggcattttatttggtttttttgccaaggattcaacacttgggttttcgtcagaggaaaactgtcgtgtatgtagtgtgagttgcaggtcgtcggatccccacgtacaagacaatctttggatctagaatatgcaaaacgtgaatcagcacgccaggatcatcgtctcctacaagattggcagaaaaaaaatctcatgatgagtgatgtgtcaacagacctatatatatgtgataatcactggtttcaacggttgcctgaacatttgctacatccgta

SEQ ID NO: 4760 - DNA, 2074 bp, Zea mays
  misc_feature (624)..(624): n is a, c, g, or t
  misc_feature (655)..(655): n is a, c, g, or t
cgctggggctagagtacctccctgccgacggggcccggtatttcgcgtacgtggagttgaaactcgtacgtggagctgaagcaggtgaccaagggcttctccaacatggtggggcgcggcacgtacaggacagcgtactgcggagagaatgattcgtcttctgagcagcagcaactcgcgatggagaagaatacgctcgcgcgtatggattgggaagctatcactcacacgcaaatatgcgggaggagaggaagcggatgggggatgcagaacttttgggacaatgataaagaaactgttggagcaagatgcagaacttttgggacaatgataaagaaactgttggagcaagaaaaaacatatttctttcctaatatcggttttgggtaggtttaaggctttttttgggttcctcttagctctttgccagccctcgctctacgaacgaattgactgagttagaagaggaaccatcgttgatgcctgttctgacttgtcaaagcttggctggcaatgtggtcaccttgacagtgacatccgatcgatcctgtggcgtatcctgaatttgccaccacaagcatccaatccaattgctctcccactgcccagaagcttcatcacacntcagctagaggcagccatgcatggcaggacnaaaaagcggtccagtccaggtccgtacctgagagacttgtgttgaccctcctcatccatggcagtaggtaggttgagctgctcgttgatcactgctatcattgggtacctcgccgtcggcccggcccgtcggcatcctcaagtcatcagctagctagccttccctacagcaactgcatacatacaacacttccatctgcccgctcgtcttcgatcaattcccaagtcaaataatataacagcaatggtggttcccgtgatcgacttctccaagctggacggcgctgagagggccgaaaccctggcgcagatcgccaatggctgcgaggagtggggattcttccagctcgtgaaccacggcatcccgctggagctgctcgagcgcgtcaagaaggtgtgctccgacagctaccgcctccgggaggccgggttcaaggcgtcggagccggtgcgcacgctggaggcgctcgtcgacgcggagcggcgcggtgaggtggtggcgccggtggacgacctggactgggaggacatcttctacatccacgacggatgccagtggccgtccgacccgccggcgttcaaggagaccatgcgcgagtaccgcgccgagctgaggaagctcgccgagcgagtcatggaggccatggacgagaacctcggcctcgccaggggcaccatcaaggacgccttcaccggcggcagccggcacgagcccttcttcggcaccaaggtcagccactacccgccgtgcccacgcccggacctcatcacgggcctgcgcgcgcacaccgacgccggcggcgtcatcctcctgttccaggacgacaaggtcggtggcctggaggtgctcaaggacggcgagtggaccgacgtacagccgctcgagggcgccatcgtcgtcaacaccggcgaccagatcgaggtgctcagcaacgggctgtaccgcagcgcttggcaccgcgtgctgcccatgcgcgacggcaatcgccgctccatcgcatccttctacaacccagccaacgaagccaccatctcgccggcggcggtgcaggccagcggcggtgacgcgtatcccaagtacttgttcggcgattacatggacgtgtacgtcaagcagaagttccaggccaaggagcctaggttcgaagccgtcaagacgggggcgccaaagtcatctccagcggcataaataaacagggaaaacaattattgaatgcattattaaaaggtagtaataagtttgttaagtattaactagctagttgccctctttgctatatatatatatatatatatatataaaataggtgagtgtccgtgcgttgcaacagaaatatataataccacgacaagttatataaaaaaaaaaaaaaaatattagaaaatatttcgtaatcctttggtaaaaaaaaaaaaaaaa

SEQ ID NO: 4761 - DNA, 2290 bp, Zea mays
  misc_feature (2210)..(2213): n is a, c, g, or t
  misc_feature (2215)..(2216): n is a, c, g, or t
  misc_feature (2218)..(2224): n is a, c, g, or t
  misc_feature (2227)..(2228): n is a, c, g, or t
  misc_feature (2233)..(2233): n is a, c, g, or t
  misc_feature (2261)..(2261): n is a, c, g, or t
  misc_feature (2275)..(2275): n is a, c, g, or t
  misc_feature (2286)..(2286): n is a, c, g, or t
tgtagttctcttgttatcacttggtatattggcagaactatggtcgtgaaataaattgaccatctccgaaattgacatggcatttttgaagaatataaactttttgaccacctctctaaataaatgggctgtccagtaaaatcatttcatagtagtgaatagtcctataatttttctctgcttcaaacagctgagtagctcaaaatttctaacatatgggtcttcagaccaggtcccatgtgaatcggttagttgatatcatcctatacaattcttatatactatatatggctacaaattagctcggaaaaatggactagcagtagtgaccaataagcaagtcagtttgcacgcgctagccgtcctacagcctcgaggtagtagccctccctctctatcgttgttgaagctaccggccgtatagctgcttgtagctgcagctgcacacgcggctgaacgttctcttcctgcctctaaatattgttatttattccctaataacgcgaagtcgccggccatcggcatgacacaaataaataaataaataaatatttaaaaaaggcgcatcacaagaaccaaagtaaacaccggccagaacgacaatgcatgccttggttcccttgcaaaccaatccaagctcccagtgtaaatcagtcccctgattgattggattagttgagctttcaaaataaacaattatttgacacctaacttgttcagctataaaaggctcaggggctacacagcctccaccaccatccaatatccactgcaccacttctgctaatcccttgttcttgtgcctccgatccggagctctcaccattgtcatcgtcaatcgatcaatataaagcgagccaattaccccaaggagctaccgcttgcgacggtatggcgatcccggtgattgacttctccaagctggacggccctgagagggccgagaccatggcggccctcgctgccgggttcgagcacgtggggttcttccagctggtgaacaccggcatctccgacgacctgctggagcgggtgaagaaggtgtgcagcgactcctacaagctgcgggacgaggcgttcaaggactccaaccccgcggtgaaggcgctcacagagctcgtggacaaggagatcgaggacggcctccccgcgaggaagataaaggacatggactgggaggacgtcttcaccctccatgacgacctgccatggccttccaaccctcccgccttcaaggagacgatgatggagtaccgcagggagctgaagaagctggcggagaagatgctgggcgtgatggaggagctgctggggttggaggagggccacatcaggaaggccttcagcaacgacggcgagttcgagcccttctacggcaccaaggtcagccactacccgccgtgcccgcggccggacctcatcgacggcctgcgcgcgcacaccgacgccggcggcctcatccttctgttccaggatgaccgcttcggcggcctgcaggcgcagcttccggacggcagctgggtcgacgtccagcccctcgagaacgccatcgtcatcaacaccggcgaccagatcgaggtgctgagcaatggccggtacaagagcgcatggcaccgcatcctggcgacccgcgacggcaaccggcgctccatcgcctccttctacaacccagcgcgcctggccaccatcgctccggcgatccccgccgcaggggtcggcgacgacgactacccgagcttcgtgttcggcaactacatggaggtgtacgtcaagcagaagttccagcctaaggcgcccagatttgaagccatggccacgacgacgaccaagtgatgacctagcagcgactcagcgagagcctaaataaatattaattcacagtcgtcaagttaatcttgtggttatacggtacgggcggggcttgtacttatgtaggttgctaagtcttaagtgtgtagtttaattaacgtgtgtgtggaatgtacgcgtcatacaaatgtgttggtgtgtgccctgccgcaagattgcggtgagcggtggatctatggtcaacgggtgcctaaatgatttgtgcttttgtagcataaaatggcacatctcctctgcttttgttacatctccaccttttctttttgcacttttcacctcaagtaaaacatgtggcggctttcactaagtacaaagaagctctacagagctatttctattgnnnncnngnnnnnnnccnnccccncgccggggggagcgtccccctttcgccngctggcgtaaaaanaaaaaaggccnaggt

SEQ ID NO: 4762 - DNA, 897 bp, Zea mays
  misc_feature (13)..(14): n is a, c, g, or t
  misc_feature (781)..(781): n is a, c, g, or t
  misc_feature (810)..(810): n is a, c, g, or t
  misc_feature (826)..(826): n is a, c, g, or t
  misc_feature (837)..(838): n is a, c, g, or t
tcgagggccggcnncgggaaaaaaataacaaaaaaaaaaaaaaaaaaaaattgggtaccccaagccggccgggatcctcaagtcatcagctagctagccttccctacagcaactgcttacatacaacacttccatcttcccgagctcgtattcgatcaattcccaattcaaataataatataacaacaatggtggttcccgtcatcgacttctccaagctggacggcgctgagagggccgaaaccctggcgcagatcgccaatggctgcgaggagtggggattcttccagctcgtgaaccacggcatcccgctggagctgctcgagcgcgtcaagaaggtgtgctccgactgctaccgcctccgggaggccgggttcaaggcgtcggagccggtgcgcacgctggaggcgctcgtcgacgcggagcggcgcggcgaggttgtggcgccggtggacgacctggactgggaggacatcttctacatccacgacggatgccagtggccgtccgacccgccggcgttcaaggagaccatgcgcgagtaccgcgccgagctgaggaagctcgccgagcgcgtcatggaggccatggacgagaacctcggcctcgccaggggcaccatcaaggacgccttctccggcggcggccggcacgagcccttcttcggcaccaaggtcagccactacccgccgtgcccgcgcccggacctcatcacgggcctgcgcgcgcacaccgacgccggcgggggtcatcctgctgttccaggacgacagggtcggcngggcctggagtggctcagggacggcaaantgggacgacgtgcaanccgctcgcggnncgccatcgtcgtcaacactgcgaaaccagattgaggtgctcagcaacgggcgcttacgc

SEQ ID NO: 4763 - DNA, 4941 bp, Zea mays
gccttttgctgacgtcgtcgttgatcgagctgagtagtaccggcaagacatgacgtacgtacggcacatgttattattatgctcaagaacaacgttgagaaaaatataatagcgttttttgcgtgcttcaaactgttgtcgtcgtctctgtacaaattaagactagtatttggttcgtcattgtgttgcttctaaatcagaccatgcatgcatacgtgttttatttgtctgcaggtgccacgtgggggacccctggacataattcttaattaactgtagatgattaactataatcgtacgtctaagatttaatcgatgaccagtagtgtcacacaatatataattcatgcatgccgatggcttgttcaaagcacaggagcacgcacatacgcatctcaattccttaatctggtcgtccagcatgcatactatgatcgcatggacagaagaagaagaagaagaagaaggaggcagagaattccaaataaattattttaatttagaggactaacaaagatatattactatatggaaatgagtagtggtcagaattatgttcttggaccgggcaataaaattaaatatctagctgacttatttgtaatcatccctaattaatcagtgcctaattaatcaacgtgatcatctatgcaaaaaataaataaaaccacttgcattgattgagacatttgccagcctttcaattccctgctagctagctggtccaagctagctagctagcttgttggcattttcttgattgtgacgacctgagcagggaggaaaaacgcaaattttgcagcgcgtggaggagagatcgagatgtcattattagatgtgcctgtggcgttgtaataaattgatcgattagtttgtcctgggaaactgctttgcatctgattagctgcagctgtagttgttatttggcgcagctaaaaggggaaaaaactcgagaaacatttaaggtctgtttgattttagatcatttatttgtttcaaacttgagctttaataaaatttagatctagctgcaggtaataaagattgaagaaaggaagaatcaacctcagtccagattcgcaggcgggaggacgtatgtggtgtgcatggttcatgacgaatccaattccagccacattttccttgcgggaaaaacaagaaacccaccaggacaaattaagccagtttccaagcaagctttaatttggctttctcgatcgggcggcgacggtttgcaaattccatggaccctttttcattgcgttaatttggcaactagcgaaccttcctaccatgcatgttggagtagcagctggccacgatttgctgacggaaggtttttttttccaaggaagatgatgacccaaaacatcaggaatttccatgggacaagaaactagctagggttgaaggtctgggtgagcttcattcaactttttggattgcactgatgatcgaataatgcaatggctggaaaattccagtttttaagcatataaaagtatttaaacactcgagcatgggctggacaaaccctaacatatataagagagtgatatatatccaacaagctgcattattgttggtttctaataatgcactcatcgatgctcctatcgtattaaatattttcttcattctaaattgtaagttgttttagtgtttttagatatcatatgtatacgctaggtttaaatatatagatacatctttttttcgaaaaggtggcatgcatgagaattgtctctaattcatttagagaaggaagaggactacaaacaacagttacaaagcactgccccgctccatattgtaaaaccttctctatgataagatgggcgaccacaggctgattttcccccaaagttttggaagatcctcctatttctttcttttcagatattccaccaaaaatagtctaccaacccatagaaaatcattcgtctatgtttatcaacacggagtctacaccttctccaccatctatggatagagtcatcgtggttaagagatgttcttagggctaaaaaaaattcgaggctcgcgaggcggcttaaacttaggtcggctcggagtggctcatgagcctcgagcgagcagagacgaaccgagccaagttgtagagctcattggtataacaagccgagtcagtttgcaagttatgccaaattaatgaatctataaaataataatagatattggataattttatagatattcgactcgttccttatcatttaatgatggatttatgataatttaaaatttagattacttataatgttaaatgatggtcatatttcatatctatatacaataatagtcattgtataatgcaatattatttatcaaggtgtagctcgcgagttgagtcgagcctccttcttaatcttattgagtggacgaaccaagctgagccgagtcgagcttggtcacccagcgagtcgagcctccttcttaaactcgttgaatgagactcagctcatttctagccctaaaaaatcgcatcatcatcggcataaagcgagcaatgcagacatttttggtagtacaagcttcggatgaccggctgcagacgctttctcaataaccttctgtaggggatcaatggccaagatgaaagagggtcaccttgatgaagacttcaggcgtgtttaaattttttgcttgggcgatcattcactagcactttggaagatgatgtagccaagatgctagtctctctatttttgactgaaacctagctagagcttttaaaacatcccggagatagttaagggaatcaaaggcttttgaaatgtccaatagataccattttttttcttgtggaggaggctatgaataacattttgttcatatagaaaattatcacattatgtgacaagcaagggaaaataacttatatatagttaatagtggagggagtgtctgatataaaaagctacatatttttgctggttagttgttagttaggtctttacctgccctctctctacgaacgagctgatgccagttctgactttgtcaaagcatggctggcaatgtgattgaatgcctgatgttagctcgtcaccttgacagggacatccgatcctgaatttccgattggggtggcaaaggtcaagttgccaccacaagcatccagtccaatggctctgccactgcccagaagcttcatcacacctagaggtagccatgacaggacccaaaaaaaggtccagtccaggtccgtaccagctgcgacgacgcttgtcagtaggtaggttgagctagctgcttgttgatcactgctatccgcaccattgggtacctcgaggccggccgggatcctcaagtcatcagctagctagccttccctacagcaactgcttacatacaacacttccatcttcccgagctcgtcttcgatcaattcccaagtcaaataataatataacaacaatggtggttcccgtcatcgacttctccaagctggacggcgctgagagggccgaaaccctggcgcagatcgccaatggctgcgaggagtggggattcttccagctcgtgaaccacggcatcccgctggagcttcttgagcgcgtcaagaaggtgagctccgactgctaccgcctccgggaggccgggttcaaggcgtcggagccggtgcgcacgctggaggcgctcgtcgacgcggagcggcgcggcgaggttgtggcgccggtggatgacctggactgggaggacatcttctacatccacgacggatgccagtggccgtccgagccgccggcgttcaaggagaccatgcgcgagtaccgcgccgagctgaggaagctcgccgagcgcgtcatggaggccatggacgagaacctcggcctcgccaggggcaccatcaaggacgccttctccagcggcggccggcacgagcccttcttcggcaccaaggtcagccactacccgccgtgcccgcgcccggacctcatcacgggcctgcgcgcgcacaccgacgccggcggcgtcatcctgctgttccaggacgacagggtcggcggcctggaggtgctcaaggacggccagtggaccgacgtgcagccgctcgcgggcgccatcgtcgtcaacactggcgaccagattgaggtgctcagcaacgggcgctaccgcagcgcctggcaccgcgtgctgcccatgcgcgacggcaaccgccgctccatcgcttccttctacaacccggccaacgaggccaccatctcgccggcggcggtgcaggccagcggcggcgacgcataccccaagtacgtgttcggcgactacatggacgtgtacgccaagcacaagttccaggccaaggagcccaggttcgaagccgtcaaggttgcagcgcccaagtcatctccagcggcataaataaatggaggggaccaattattaaatgcattataatttatttgttgaataaaacagccggagaaataatgataatgtaaagtatatatgataaacaccggttaggatttaaggtgtttaactttagttgcatggtataatatgatatattgttgtagcaaaataagtttattaagtattcataagtgttctaaaaagtgggctaaggcactattccagcccctttctcaaacagaaaatagtgatttaattcgggctatagcgactaatagttgctatatatattaggcgtagtagcaaacaatttcaccctttggaaacagttatatctagaaataactatagccagagatttagaaccttgttaatcatgtagaaattaaaggttcgtcaagtcagagcggcaccgaacaagataaaaatgtgacctcccctatatgcaaatgtctgccaacttattacattggtgggtgccatcttactatgtacaaatatatcgcggaaaccatattatcagcgtcgagaattggccatacccctggatattgataatat

SEQ ID NO: 4764 - DNA, 1291 bp, Zea mays
aagagacggcagtggcggcgcgattcagagtagcgacaacggcgacgcatggtccctcgcgccgcccgccatcgtcgccagcgaccttttccccgattgtacctgcaccagttagagttggagaagaccaacccccaccgtcttgggacccggtaccatcgccgagagctggacggcgctgagagggccgaaaccctggcgcagatcgccaatggctgcgaggagtggggattcttccagctcgtgaaccacggcatcccgctggagctgctcgagcgcgtcaagaaggtgtgctccgacagctaccgcctccgggaggccgggttcaaggcgtcggagccggtgcgcacactggaggcgctcgtcgacgcggagcggcgcggtgaggtggtggcgccggtggacgacctggactgggaggacatcttctacatccacgacggatgccagtggccgtccgacccgccggcgttcaaggagaccatgcgcgagtaccgcgccgagctgaggaagctcgccgagcgagtcatggagaccatggacgagaacctcggcctcgccaggggcaccatcaaggacgccttcaccggcggcagccggcacgagcccttcttcggcaccaaggtcagccactacccgccgtgcccacgcccggacctcatcacgggcctgcgcgcgcacaccgacgccggcggcgtcatcctcctgttccaggacgacaaggtcggtggcctggaggtgctcaaggacggcgagtggaccgacgtacagccgctcgagggcgccatcgtcgtcaacaccggcgaccagatcgaggtgctcagcaacgggctgtaccgcagcgcttggcaccgcgtgctgcccatgcgcgacggcaatcgccgctccatcgcatccttctacaacccagccaacgaagccaccatctcgccggcggcggtgcaggccagcggcggtgacgcgtatcccaagtacttgttcggcgattacatggacgtgtacgtcaagcagaagttccaggccaaggagcctaggttcgaagccgtcaagacgggggcgccaaagtcatctccagcggcataaataaacagggaaaacaattattgaatgcattattaaaaggtagtaataagtttgttaagtattaactagctagttgccctctttgctatatatatatataaaataggtgagtgtccgtgcgttgcaacagaaatatataataccacgacaagttatatatgtgtgttatactgttattagaaaatatttcgaaaaaaaaaaaaaaaaa

SEQ ID NO: 4765 - DNA, 1363 bp, Zea mays
cattgggaccctcgaggccggccgggacatgatcagctgcatgcaactaagctttcactgaagcaagcaaacaaacacctaaagatctgctatttgagtatttctcgtttctcttcagcttcatcagccatggtggttcccgtgatcgacttctccaagctggacggcgctgagaggaccgagactctggcgcagatcgccaatggctgcgaggaatggggattcttccagcttgtgaaccatggcatcccgctggagcttcttgagcgcgtcaagaaggtgtgctccgactgctaccgcctccgggaggccgggttcaaggcgtcggagccagtgcgcacgttggaggcgctcgtcgacgcggagcggcgcggcgaggaggtggcgcctgtggatgacctggactgggaggacatattcttcatccacgacggctgccagtggccgtccgacccgtcggcgttcaaggagaccatgcgcgagtaccgcgccgagctgaggaagctcgccgagcgcgtcatggaggccatggacgagaaccttggcctcaccaagggcaccatcaaggatgccttctccgccggcggccgacacgagcccttcttcggcaccaaggtcagccactacccgccgtgcccgcgcccggacctcatcacgggcctgcgcgcgcacaccgacgctggcggagtcatcctgctgttccaggatgacagagtcgggggcctggaggtgctcaaggacggccagtggatcgacgtgcagccgctcgcgggcgccatcgtcatcaacaccggccatcagatcgaggtgctcagcaacgggcggtaccgcagcgccctggcaccgcgtgctgcccatgcgcgacggcaaccgcccgctccatcgcctccttctacaacccggccaacgaggccaccatctcgccggcggcggtgcagggcagcggcggtggtgagacgtaccccaagtacgtgttcggtgattacatggacgtgtatgtcaagcagaagttccaagccaaggagcccagattcgaagccgtcaaggccgcggcgcccaagtcatctccggcggcctaaaacttgcactagacaacttccttatctagtgctaaaacgtttgcggagagttaaatgtcgggcactcgaataaagacaaaatttaccgagtattcgacaaagaactcttctccaatagtgttgccgcttaaggacacaaactcaatacaggatggtaaaattatttgggttgttgctattttgtttcatcgtgttgagcctgaaaatgtaatcctaatactcttgttcctcgtgttcaatgacatatattggatttttggaaaacggacgcgtgggaagcggcc

SEQ ID NO: 4766 - DNA, 1453 bp, Zea mays
aaaaaaatttcactggcagaagaagccatggggcagaagccgtcgtacctcctgctgctcgtcggcctcctcgccatcgccatgctctgcgccggcccgggtcacgcgctgcgccaactgaacgacgccaacggcggtggcctggagttctccttgggctccaaggcggccacggcggcggccaagaccgagccgctggacccgtccctgagcgacgactacgagaacgatacaagccacgtggagttcgagccagagctcggccgcgcgacggccgtccccgccgcgaccaccgtcactgtcactgccgccgcggggccgaccacggagccttcgacgtcccggaacgccgccgccgccggcggcagccacagcatgaggtggtggctgccgccgtcgaccatgccgtcgttcccgctgttcccgacccccggcgccggcggcatgcccgccatcccggggctcccgctgcccggcatgccgttccaccccatcggcggctggggcgcgcccgcgcctcccgccccgacgcagccggcgccttctgccgcagaggccgccgcgagcacgaacgccaacgaccccaacactcgcggagggggcgtcaactgaccaaaccttgctctgcttgcgtatgctgcgacggctaccattcatttttcagttttttttttctatttttattactactgctactcgtatcgcctcaaatgctgggtctagagcgtgatgattgatacatgtggttgtattggaaactcataatgcaagagtcaagagatacgcacaaaactttttcgtctgataaaaaaaaaaaacaaaagagaattcaaacgctaaaaaattactgctcgtgagccagattacctaacacagagtaagaattgattataccatctaactttgaccaatttttaaataaatggagagtatctagtgatatttttaattcgtaaggatctaaacacatattcaaaaaaataaatggcgcggtttctccaacagatataaagtgctgcaaatgttttccaaagccgctagggttgtgcaaagatactacaacccaaacgtgataaaaatatgaaaaaaggttttcttgaccacaattatctgagatctaccttaagaaaagcaaaccgtatgatgttagtggttaatgaaaagtacgcaaagattcagcgcttgaacgcacagggctagcactgcttagcagacaattaaataaaataaaatgtacacaaagattcagcgcttggatgcacacagcgcactgattagcactttaacagacaaataaagcaagttgcaaaaagaaaaaacaaaatggagatgcggggtatcgatccccgtgcctctcgcatgctaagcgagcgctctaccatctgagctacatcccctatttgaagcttttgcaatcttggattaattaagcaatagaaccagtctagcgcag

SEQ ID NO: 4767 - DNA, 824 bp, Zea mays
cttggggcccccgagggccccccggaacacagcaagacccgaccttgcctcctcctgcagcagcagcataaccagaggggagtacatcaagccgtttcgagagagctttaggctactgctagcagtatggcttccgctgcgcgcttcctggtggccgtggtcgtagcgtgcgcactcctggccagcaacaactgccacgcggcgcgccgcttggccgacacggccgcggctcccgctgctgctgctggtgccgtccctggcctccccgccgtgccgaccttgccaacggtgcagccagtgccacaggtggcggtgccacccatgccggccgtgcccgcggtcaccgtgccgcagatgacgctgccgcccatgccagcggctcccaaggtggccgtgccgctgccgccaatgcccgccatcccatccgtgctgcccaagctgaccctaccaccgatgcccactgtcgttccatccgtcgtccccaaggtggccttgccgccgatgccgtcggtccccaccgtcaacgtgcccatgccgttcgcggcaccgcctccgtcggcatagacgcgcgcggcgcgctcctgcaggttcgcgttcgccgtgcccaccatgtagagcagaggtggtggtgaccggtgctggtgtgtaccggtgtatgcgagagtgatgtcattgtttgtcagtattgttgcacctgcgtctcgtgctttctttttgtgcgtagcgttgtaccattgtacgtatgtatatcctttgtattgctatcacattcatttaaatctgaactttaactttcactgtagaaaaaaaaaaaaaggccccta

SEQ ID NO: 4768 - DNA, 1041 bp, Zea mays
caatcagtttgtagctgctgcagcgcacgatcccccctgctcacctaaacgctgaaattctaggcacagggcgagcaagaatccgcctcgatcgatcgccgcaactaatcttacttgtcctgtcctgccattctgatcaccaacttgcgctgccacaccgatccggccacccacctatctaatcgcaccctccctaatcatcctataaatcccgccgcggcttcctcgacggccgcggcggcccaggcagacccgaccttgcctcctcctgcagcagcagcataaccagaggggagtgcagcaagccgtttcgagagacagctttataggctactgctagcagtatggcttccgctgcgcgcttcctggtggtcgtggtcgtggcgtgtgcactcctggcgagcaacaactgccacgcggcgcgccacttggccgacacggccgcggctcccgctgctgctggtgccgtccctggcctccccgccgtgccgaccttgccaacggtgcagccagtgccacaggtggcgctgccacctatgccggccgtgcccgcggtcaccgtgccgcagatgacgctgccgcccatgccagcggctcccaaggtggccgtgccgctgccgccaatgcccgccatcccatccgtgctgccaaagctgaccctgccaccgatgcccgctgtcgttccatccgtcgtccccaaggtggccttgccgccgatgccgtcggtccccaccgtcaacgtgcccatgccgttcgcggcaccgcctccgtcggcatagacgcgcgcggcgcgctcctgcaggtttgcgttcgccgtgcccaccatgtagagcagaggtggtggtgaccggtgctggtgtaccggactaccggtgtatgcgagagtgatgtcattgtttgtcagtattgttgcacctgcgtctcgtgctttctttttgtgcgtagcgttgtaccattgtacgtatgtatatcctttgtattgctatcacattcattacgccgtatataaaagacaaaaaaaaaaaaaaaaaaaaaaaaaaa

SEQ ID NO: 4769 - DNA, 788 bp, Zea mays
aggcccggcccggatttccgggaaaaaaaacacagcaagacccgaccttgcctcctcctgcagcagcagcagcataaccagagtgcagcaagccgtttcgagagacagctttaggctactgctagtgctagcagtatggcttacgctgcgcgcttcctggtggccgtggtcgtggcgtgcgcactcctggccagcaacaactgccacgcggcacgccacttggccgacacggccgcggctcccgctgctgctggtgtcgtccctggcctccccgctgtgccgaccttgccaacggtgccgccagtgccacaggtggcactgccacccatgccggccgtgcccgcggtcaccgtgccccagatgacgctgccgcccatgccagcggctcccaaggtgtccgtgccgttgccgccaatgcccgccgtcccgtccgtgctgcccaagctgaccctgccaccgatgcccgttgtcgttccatctgtcgtccccaaggtggtcttgccgccgatgccgtcagtccctaccgtgcccatgccgttcgcggcaccgactccatcggcgtagacgcgcgtgctcctgcaggtttgcgttcgccgtagccaccatgcacaggtggtgcggtgaccagtgtacgcgagtgatgtcattgtttgtgagtactctctgtacgtgcgtcgcatgctttcttttttttcgtaacgttgtacgtatgtatatcctttgtatttctcccacattcttttgctgtatatgtctggtcaacgctcttcaaaaaaaaaaaaaaaaaa

SEQ ID NO: 4770 - DNA, 889 bp, Zea mays
ggccggagagaataggagcttgaggttcgcaacacagcgagacccgaccctgcctcctcctcctgcagcagcagcagcagcataaccagagtgcagcaagccgtttcgagagacagctttaggctactgctagcagtatggcttccgctgcgcgcttcctggccgtggccgtggtcgtggcgtgcgcactcctggccagcaacaactgccacgcggcgcgccacttggccgacacggccgcggctcccgctgctgctggtgccgtccctggcctccccgccgtgccgaccttgccaacggtgcagccagtgccacaggtggcgctgccacccatgccggccgtgcccgcggtcaccgtgccccagatgacgctgccgcccatgccagcggctcccaaggtgaccgtgtcgctgccgccaatgcccgccatcccgtccgtgctgcccaagctgacgctgccaccgatgcccgctgtcgttccatccgtcgtccccaaggtggtggccttgccgccaatgccgtcggtcccgaccgtgaacgtgcccatgccgttcgcggcaccgcctccatcggcgtagagacgcatgtgctcctgcaggtttgcggtgaccgatgtacgcgagagtgatgtcattgtttgtgagtactctttgtacgtgcgtcgcgtgctttttttgtgcgtaacgttgtactattgtacgtacgtatgtatatcttttgtgtttctaccacattcatttatgctgtgtatatgtctggtcaacactcttctccttttttttgttcttctgttcaaatctgaacttttgcttcccccgtacacagggccggtcctgacattttggtagccctaaccaaaaacctatatggaagccctatatgaacgttt

SEQ ID NO: 4771 - DNA, 864 bp, Zea mays
gcaacacagcaagacccgaccttgcctcctcctacagcagcagcagcataaccagaggggagtgcagcaagccgtttcgagagacagctttaggctactgctagcagtatggcttccgctgcgcgcttcctggccgtggccgtggtcgtggcgtgcgcactcctggccagcaacaactgccacgcggcacgccacttggccgacacggccgcggctcctgctgctgctgccatcgtccctggactccccgccgtgccgaccttgccaacggtgcagccagtgccacaggtggcgttgccacccatgccggccgtgcccgcggtcaccgtaccgcagatgacgctgccgcccatgccagcggctcccaaggtggccgtgccgctgccgccaatgcccgccatcccgtccgtgctgcccaagctgaccctgccaccgatgcccgctgtcgttccatccgtcgtccccaaggtggccttgccgccgatgccgtcggtccccaccgttccatccgtcgtccccaaggtggccttgccgccgatgccgccggtccccaccgtcaacgtgcccatgccgtttgcggcaccgcctccgtcggcgtagacgctcgcggcgcgctcttgcaggtttgcgttcgccgtgcccaccatgcacagcaggtggtggtgaccggtgtacgcgagagtgatgccattgtttgtcaatactgttgcacgtgtgtctcgtgctttcttgttgtgcgtagcgttgtaccgttgttcgtatatcctttgtatttgtaccacattcatttacgccgtatatgtatggtcaacactcttcaccttttaaacaaaaaaaaaaaaaaaagaacttaagcttccacag

SEQ ID NO: 4772 - DNA, 3199 bp, Zea mays
tgttatatatattttattaaaacttagaatttttgagagcgaggatggtattttttttataggaccaaaaatacctagcatttattatcccacgctgatggatgaaaaaagcgacgcacaccggccagcgggcagctcttcgacgcacaccaagtctactctcacctcctccgtctctcagatccacgctgcctagttgttcggacttcagaccccgccgtgcgctgcccatggccgcgggtcgcggcgacgccgcgagcatggtggcagtgggtctggtgtggggcgccaccaacgcgctgatgcggcggggcgcgctcgtctgggaccgccgcgcccgtgcctgcccctccggtaacgtcctccggcggtgggcggagctgctcctgacgtggcagtactcggcgccgttcgccgccaacctgagcgcgtccgcggccttcttcgcgctcctcggcgccgcgcccatctccgtggccgtccccgtcaccaacgccgtcactttcgccgccacggccgccgccgccgcggccctcggcgagcgcgtccggccagcgcccgcggtccttggtaccacgctcatcgtcctcggcgtctgggtctgcatctcgtaggcttaggctgaagatctgcttggtttagttctggcattacagtcgtcgcatggggggaaaaaaggaagttttgagggcaattctcagattccatttcactcctctgtgctgtgttgccaattgccatatgagtgaattattcccagtttgttgatggcagcggcgtttcattagctagatggtcagaatataatgcagtttcattctggtaattttggttactgaatccatttctgcttaggtgatgaatgaatataacactacggttccattcattacatcctgagggttgacatcccacagcagagcattcttctacccttggagctaatttgagaaccttattttatcaattgatttctaaattctccttggcattgaattggatcaacagagttgtttttccaaattcatttcaagctgaaatggtattggggcacgtttctgtttcatatgttttgatgttcaattccagcaaataccaagctcctcggttccgtattgggggtgtgtggtttgcttctgtactgatatcatggtgaattgagggtcaaattctaaggctcaattccaagacatccaaacacgtggtggtattggagatatacaattccaattctccaaatcctagcttaatgccagcatccaaatggggtgttaggtttttggggggcaatgcatcaccacaagttacctgaatattcagaaacataggtgctgtttggttcgtccggtttgctccaacgcaagacgattacgttactttgtgtttggttctagcatgctgaagattccattcacgtaatcctagccaaacaacaccataatacttgtaacaattgacattacaatgacttgttggtatggctaaaaatcagaaccagttcctggttgttttgtctttagatcatatacggtttggtattcagatcaaccttatccagtttgttcattggcgccacgccatttacactaaaaggaaagtaaatgctattcatccatacagagttacagactaccttgaaaaggagggttatttttcatatacaaacttgaactttattttttttatttctttgagaacacaactacatacgtacaaacagacttgcccatgcatacactatgcgcaatgccataccatacgacacgtagacagatgtaggatttgtctttgtgggtcttaatggtgagttgagagcgagggcgccacgctaggcaacggcgaagagatggctggcttaggtaggacgggagccagaggggaggacgaataaggcgacacggaggtggagcggcggaaggtggcaacctctgcgtcgtcactgacggccggtgggcgaggggaagtggtggtggaagggcgaggcgataatggtgacgacgaaaaggaggagctgcgggaggagaacggggaagaagattctgtgtcgtgatgtgactgtgagagcacactgggcctccaacgatcttcctttctgcttcttgggctgacgatggatcgagcgggagacgtcgccgtcgaggtgggggcaccgccaaatatgatctgcgtttgggggcccatatagacatgagtagggcccggctggccaagcccgttcatcggcggcggagccggagcagaagaagcctcgtggacggtcgcagtacgtggacgcggcggcgtcggcgtccggtatggatccggtttcgccggaggatgcgacgcctgctgcggcacgcctaccgggtaggccatgacgggtgacttattctgagccgcctcgtcgtgctgcggcacgcccaccggtgcataggcgctgaagttggccgccttgtccgggacccgctttaccaccggcgcgacgacggggcccaggcggtaggacacgttcagcacgccgcgcggttcccaccggtgcaccttccggacctggtacgacgccacctgcggcggctggggcccggcgccggtcgcgccggcgaggatgtcggcgagcgggacgacgacctcgcccacgtcgcggtcacccaggagccgctcggcccggagcagcacgtggagggacgcgccggacgccgtcggagggacggcgaaccggaacgtcgcgttccagcacgggttccgcccgccgtatgggtccggctccgtgcactgccgcgtcagcgggtcgccggagatgctcaccacggcgtacacgtgcatgcgcgtcatcaggttcacgctcttcagctcctgcgctgacaggaggctcagctccaactcccggtatgccatgctacgactgatcgatctctgtcaggatttaattttggctccctatatatataggtgatcaggtggtggcttcaacttgaagcataagcaggtcccgatgtgcttacagggggagagggtttgatcaactagagctaacagttaattggctaaaatttgtcagtggaattagctagctaactattaactaatttactaaaaatagctaatagttgaactattagctagagtgtttggattttctcagctaattttaggcattaactatttactttagcgccttcaaacacccccttaatatgcttaaaggctggtttgcagtttt

SEQ ID NO: 4773 - DNA, 2546 bp, Zea mays
  misc_feature (56)..(56): n is a, c, g, or t
tatttatgtttatcaagtgaccaagatagcgatgggcaccgagcccctctacatcnccgatcccatagagcttcgctgaagctccttaaaatttaaaacatacacatcataatcagtacaatgtagaggaggggcccatataatatagcggtttagttagccgcttctaatttttttggcttcgtccctatgtttatgtgtgtatatctgtgtcaagattagaataagaaaatagaatataaaaaaaacaaaggaagatccacgggctctaaccagtctttcctctcgcactccctcaccgaggcccaacaagcacaggtgcgtgcccacgaaccagttctcattgattgagtacttgacgatacttgacagggccaagagactagctaactaactcgccaaggcaaaatttagctatttaatagcaaaataaatctccaacagactagctatatgactcgtaagttatctggctctctaaattagctctctcactaggtaaatttagctagccacctgactagccaaactagatatataatctgttggactgaaatgcagatatagagtgtaatctttttgaaaacgtaaataaatagtcaaatagagagcaaaaaatgaagagtctcttggagatgctctaactctccagagcgcaaaacaaggtatggaaagactcttggagattgaatagatatagaaagtggttttaatattaacgactcactaaatgataatttagagagtgaaatttagaaagactcttggaaatgctcttagccatctaattccattagtaagaaagaatgagctggctaaaaaatagctagctaactattagcggatttgctaaaagtagctaataactaaactattagctatatgtttccatgtagtttaatttttgcagcactttagatgttgactttagctttttgccaaataggtcaataaactgatatcactacatagaataatatagttacaataaaaatattagcaatgtatttcgtcatttcttgacaatacacccataaattgaaaatcgcatgctaccgtagactttgactgacggcctcattcacggaatggttcgccacagtttttgtttgctggaaccgtgacgggtgcacgtatcaaaataggtaaatgggaccacaaagaaaatacaaaacaaacgtaaataataatacttgaacgaaatgaatgagaggagaaaattacagagcaaactccaggcgcaggcgcaggcgcaggcgcaggcgcagggagacctcaatcatctggatttcggcgacatatactactgcagggagagaatccaccggcctccctcctttgggcttgtctctgcctctctctctcctcccttctcccacccacccctctctcttgctgtgggtgtgctgtggagaggagaaaggaagtagagcaagaacaagaactaataacaccaacaagagctgctgccaactcctgcacagcctgggctctcatcactgattgcccacctattaccttcctcttttgcgatttagaatcacccatatatctacctgctctcggtcctctgtgaactctctcgtcttctaggtttcccaggcctcaagataggcctctggaccaaagcttgaaagcagctgctgttcttgcctctttttttaattcttcatttcgtggttcctggatttttgggttcttaggtttcttgtatcttcccccaaccttgcaaaatcttgtggtgaagtttcttgcgttcgctgtttcgggaccatggacgaaaggattccgccgccgtccctcttgcaatactcgcagtcccctgctcattcttccccccatcccctcaattctatgaggtattcttcctctgaaagagaaaggtgagtgttgttcttgatttttttttatttcttttgtcactattgttctccctgttgttcttggtgagttttgttttgtttttgatcctgccctttcggaatccttctgaggagcacgagatttgatgctgcggtggagatttccgcttaattctaaacttccggatgccatgtttccccttgatcaatgctgccgattgttatggaggagtgatctgtaatcgtagggacttcttttgtgatggctcgctgatagatttgttactgctgtcctaaacggagctgtatggttgactcgctgctaatgggtgtaaactttgtgtgtaacaaatcgctcattggcgatagtcacatgtaaattttaatttgatggatcgttctgtatatatcatatcaaagtttccttttacatttcatttctgcgggattatagctgctttagttttagatcctccaaattatgtttcttcttttgtatcacatggataataaatttagcattggctactgttatcctaacgttgattcttgtttggcagatatctggctgagttgcttgcagagaggcagaaattggccccatttgtgcaagttcttcctttctgtaccaggcttttgaaccaagagattttgcgcgcatcttctatggcgcctaccatactt

SEQ ID NO: 4774 - DNA, 1536 bp, Zea mays
gtttcgccttattgcttaggatcactatagtattgcgtgctcgcggtgttacttactcttttgcgcgggactgaacgatgcgtgttttttttttccctggcatggcattcgcaggctggtcctggtaccatcgcagaggcactcatacgagggcttcctatcatcctgaacgacttcatccctggacaggtcaagtagcagcatctcgctaatctggttactgaaactatcttcttcgagttaggtgggctctcatctcatagctgtacaagcatagcgaatcagcaaccttttgctcctactgtaaaaatgcaggaagtcgggaacgtcccatatgtcgtggacaacggtgccggcgtgttctccaaggacccaggggaggccgcgagacaggtcgcccgctggttcagcagcagcagcacagacggggacgagctcaggagatactcgcgtaacgcgctgaggctagcgcagcccgaggcggtgttccacatcgtcagggacatccacaagcagctccagcgacagcctgccgcggtcacccggatcccctcccgctcgctgacctcgtccttcccgtaccatatgtgaaatcaagaatgctactgcagttacgttttctgctgcatgttggataatattatgcttgggacttgatgtatgcctaaccttttgaagaacctgtatattatattatattgtatataagaattgctctctgttctgttcatgagtgatttttgtgtatttctcgctgctgaatactatttggaaagaagttaacatacattgtgactaagaatgttatatttctatcgcctatcaagcttgacatcccaattctagagttcgagtacctggtcgtgccttctacttcccgcgcaagtaaagaagatgcgtgctgcgcgttttttcagaccaacttattacagacttgacagcacagcacaaccaaggaagttttaaacaaaattcaagctagaaccctgttctaaatctccaaagaagggcatggatggcacaacggggactggtccggttgcaggtggaagtattggcacagctggggatcagataggaatggcagcggcgttgctacagcaagcactctcagctctccagggtatgaatgccgacaagggagggggtgctgctcaaccttctgctgctcaacaacctgtgatgtcggtacctagtgatgggaagaaggtacacccgaaacctgctgttgtggaagagaagaaaaagtccgatcaagagaaggagggttttgtggatgcgcctaagaacaacaagagctactgtcataggtgctacggcaagggacatgtcatgagtgagtgttcggcggcgctgttttgtgaagtatgtggcactgatacgcacataaagcacaaatgcccggtgttcaacgctccgaaggtttatgcggttccggccggctttggcatcaacaagggcggcttcttccacattccctcgaacaagaagctggtgaagacgaagcaagatgctaggacagcaatgatacaagtg

SEQ ID NO: 4775 - DNA, 927 bp, Zea mays
agctacgtgggcccccccccccagagagagcgagcgactgagaccgacagggttcggttcgacccgatgcttccggcgctgcggcctcgccgccggctccccggtggcatccctcctccgccgcctcctctccgactccaccccctcctcctctggcactggagagagtgatctgatggccgcggccgcagcgaaggcccgggcggaggcggcagcgcgggctcgggtggaggcgtacaagcaagtccaaaacttcgactggagcagcggcgccgactggaagaccgccgccaacatcctcttcacggtgccccctaagcgcaaggagttcgggcttgatttccaccttgtgcagctcttctttgtctgcatgccatcgctagctgtctatttagtggcccaatatgcacggagggagatcaaaaggatggaaggggaagcagaagagaaaaggaaaaaagacgaggaacttgagaaacaaaaacaggtcgaggaagaatctgccaaggaggatgctgattcaaagctttcgaaggtattagacaggctagatacactagagggtgtcgttaaggagattgtggatgacaaaaggaaactttcttcccctgatttaccgaccaaagaggaggttgcaaagaaaaatgaagcatctccggctaaggcttctgattcgagaagctatggtcagccagtggtggctgccaatagtaaggacaccaactatgcttcaaatgctccagcaaatactgcaaaaccaaacaataaggggattggtgataaggcatttccagttgagtccgaaagttgataaatcatttgagtttttttcttctgaaaacacaaaattggtgtttagctatgtagtcgtgtcctcgatgctaagcgaatgaaaagatgtaatttccacaccttaggatatgatgc

SEQ ID NO: 4776 - DNA, 2195 bp, Zea mays
ggggctcgtttcaaaaaaaaatgataaatgtctgatctgcactctctaactcttcaagtcatagtctgcattgttgtctcctcgtaaaggacaaaatcaatgtttcagttaagaaagcttccaatgcttacttcttcttatctacattttagaccacacatcctgttgagtacaaggaacactcgtctttcaagttcatgtaatagtataggatgtttgtcatcttttcatgtatgatgcttatagatgactgctaaaactgaatgggcttctttatctgaaactgtaattttgttctcactgtttgcataaccaacagcatctaaaccttaccaacaatctactgtaataggtatgtactgcatgatactaaatatgctaaatcaataattattttaggaaaaacggcagaccacaacatgtctgtgagtctgtccatgcatcaagtgctgaaagtgagtagcgtctgacgaccgttgggttctagagtcaggtgaagtgttgattcgccttcgacattgagagcgttgcttcgaagacaacagaccatagctcgacgaattggatgatcttctctgtgctagactggtagtcgttcaccgcatgccttccatccagcttgtaagaattcccgggttttcctccacgctatgtggagtgatctgtcatgctagaaggagattttgttgcctcttgcggtcttgccgtttcctaccttgatcgaggccagttatgaacagatgttaagtcaccaagccggcgtgttgtttgaagaatgctataaactctgcttcaatcataagggagaatgtgattcagtcgagtaagagtgtgcattgtttgacctctctactgaattgttctatttttgttggctgggctccagtgattcattcggatggatacgaagagaaatggtcaaatttgtagttcagcgcgccaagctcagacttgtatgatggtgtgtagtatcttgtaacttaaagaaatgtaagaaaaatgtccagttattttggaggattctcaggactttcttaagttaaaatttgtatttttctttctcatactagttagctagctcagcatgtacatgagaagagaaatagggcatagctaaatccaaaattctggagcgacaatcttaacttcgtttgtcacaaaagaaatgcaggggtggcaatatggactttgtcaaatgggacgcactcttccaacgaagtcaaataggactgcccgtctctatagaagccgcatgcctatatagatgtgcagcttcttctccctccacgccggccgggacacaaacatttcatcgcctcctaaagcagcatcggccactaacaccgtctcttcctcacctagctagggaacgagaacgaccatggcgtcccaggccatcgagagccaccgtgcaggcgctgaggtcgtcaccggaggagacgcaatctgcaggaagaagtcaatcgagctgctggaggagctcggcctccccaagggcttcctgcctcttgaggacatccaggagttcgggtacaaccgcgtgacagggttcatgtggctggtgcaggggaagaagaaggtggagcacaccttcaaaaagatcaagcagaccgtatcgtatgccgctgaggtgacggcattcgccgagaagggcaagctgaggaagatcaccggcgtgaagacaaaggagctgatgctctggctcagcgtcgtcgaggtctacgttcccgaggcctcaccagagaaggttaccttcaagactggcactggcctatccgacaccttcgatgcctctgcctttgcgctgggagagtaattagcagtcataaaaatggttggcttcaaaagacatgcataatctatcttttgtatttgtaaatttttcatatatcttgagatgagtttgtggtactcatgggcgatgcccattgcaacatttctatgtattttcttgtttatcagataggctttttctaaatatctcacttcaaaactttaaaaataaatgtcctcgcagtcatagatgagttcttatattggagcagatggctgtgtatttattacgaagggtaatattgtgttcaaaagctgccagtacagttacatctaaggccagatacatacttgcatttactataaagtgtgtgaggctacaacacctaccaactatgctgaatacgataacgtaagatatt

SEQ ID NO: 4777 - DNA, 1417 bp, Zea mays
  misc_feature (31)..(31): n is a, c, g, or t
  misc_feature (1353)..(1353): n is a, c, g, or t
gtggccaccataagccgctcaaaagcggaancaaacgggtcgctcgacgtgctttaaaactctgtgcctgtagctgcatacacacgcgcgggaaccaaacagcctgtatatgcatattgtcatgcagaggctgaaataatcaagttattcccttttctaaaaaatatgtgaagtcagtgacgaatgctatcaacttctgaacagatgtgattcagtcgagtaagagtatgcattgtttgacttctcttctgaattgttctatttttgttggctggtctccgtgattcatccggatggatacaaagaaaaatggccaaacttgcagttcggcgcgccaaactcatacttgtgtgatgatgtgcacatgtatatacatcttgttatgtaaagaaatgaaaaactacccaattatttttggaggattctcagaactatcttgagttaaaaattgcctttctccccttctcatagtagttagctagctcagcaggtatatgttctgatttcaaacatgagaagagaaacagggcatagcaaaatccaaaattgaggagcgacaatcttgacctcgtttgtcacaaaagaaatttaggggtggcaatgtgggctttgtcaaattcaacgctctatcttgccaatgaagtcaaatagagtccgccccgcgttgcttctctatagaaggcagaagctgcatgcctatatagatgtgttgcagctccatcttccatcacacacaaacatttcaacgtctcctaaagcagcatcggctaataccaccgactcttgctcacacagctcgttctctgcagctgccgcacatagctagtgaacgaccatggcgtcccaggccatcgagagccaccgtgccggtgctgaggtcgtcaccggaggagacgccatctgcaggaagaagtcaatcgagctgctggaggagctcggcctccccaaaggcttcctgccccttgaggacatccaggagttcgggtacaaccgcgagacagggtttatgtggctggtgcaggggaagaagaaggtggagcacaccttcaaaaagatcaagcagactgtgtcgtacgccactgaggtgacggcattcgccgagaagggcaagctgaggaagatcaccggcgtgaagacaaaggagctgatgctctggctcagcgtcgtcgaggtctacgtgcctgaggcctcgccggagaaggttaccttcaagactggcactggcctatccgacaccttcgatgcctctgcctttgcgctgggagagtaattagcagtcataaaaatggttggcttcaaaagacatgcaaatctatcttttctatttgtaaaattttcatatatcttgagatngagtttggtggtgctcatgagcgatgcccattgaaacatttctaggaaaaaaaaaaaaaaaaaa

SEQ ID NO: 4778 - DNA, 1316 bp, Zea mays
agaccacaacatgcctgcccatgcatcaagtggtgaaagtgagtattgtcagtcgcccgttgcgttctagagtcaggtgaagtgtcgattcgcgttcaacattgcagagcctacaggtcttgttggtacccagcctcttttgatcatttagctgccgtgagcagcttgtgttgcagtgctaaccgtgaataaaattacttttttacaccttcgttttccgaactgagttccagttgaaggtgattcagcaagtatgggggagattttctgaagaatgctatcaactctacttcagtcatgagggagaatgtgattcagtagagtaagagtatgctttgtttgacctctctactgaattgttctatttttgttggctggactccagtgattcattctgatcccaaaattcaggagcgacaatcttgacttcgtttgtcacaaaagaaattcaggtgtggcaatgtggactttgtcaaattcgacgctctctgccaacgaagtcaaataggactgcccgccccgcgttgcttctctatagaagctgcatgcctataaagatgtgttgcagctccttctcccatcacgccggccgggccgggaaaaacatttcatcgcctcctaattcctaaagcagcatcggctactaccactgtctcttgctcacacagctcgtctgtgcagcacatagctagtgaacgagaacgaccatggcgtcccaggccatcgagagccaccgtgccggcgctgaggtcgtcaccggaggagacgccatctgcaggaagaagtcaatcgaactgctggaggagctcggcctccccaagggcttcctgcccctcgtggacatccaggagttcgggtacaaccgcgagacagggttcatgtggctggtgcaggggaagaagaaggtggagcacaccttcaaaaagatcaagcagactgtgtcgtacgccactgaggtgacggcattcgccgagaagggcaagctgaggaagatcaccggcgtgaagacaaaggagctgatgctctggctcagcgtcgtggaggtctacgtgcccgaggcctcaccggagaaggttaccttcaagactggcactggcctatccgacaccttcgatgcctctgcctttgcgctgggagagtaattaccagccacaaaaatggttggcttcataagacatgtataatctatcttttgtattttaaacttccatatatcttgtgatgagtttatgacccatactcaagggtcgtgcccattgcaaacatttctatgtaattccttgtttatcatatagaaaagaaaaaaaaaaaaaaaa

SEQ ID NO: 4779 - DNA, 2303 bp, Zea mays
  misc_feature (32)..(32): n is a, c, g, or t
gggaccgagtctctcgccagtcgccatccaanaatctcgttcctctccgtggggtggggcggcctgtccaaggatccggccggcaaggatctccggggcgcgcgagcagccatggccgcgaacggagaggatttccggggccctctcctgcttggagcgcgagacgacggagcggcctggtggggccgtgacggcgccgaccctccgcgaggccgccggagcagcagccgcccgtggacggcgctggccatcgccgcggcgctcctcgccctggcgggcgtcgtcttcctcctcagctccagtagctacgggggccgtcccggcgcctcccgcgccgccgccgccgcgcggcggagcccgcaggaggtggagtccgcggtgggcgcggcggcggcggacgacgcgcggtgctcggaggtggccgccgcggcgctgcgcgcgggcgggcacgcggtggacgccgccgtggccgccgcgctctgcctcggcgtcgtgcaccccatgtccagcggcatgggcggcggcgccttcgtcgtcgtccgggacgccgcctccggccaggccgtcgccttcgacgcccgggaggccgcgccggccgccgccacgccggacatgtacgcggcggacccggcggccaagtacaggggcgcgctggccgcgggcgtcccgggcgagctggcggggctccacgccgcgtggtcgcggtacgggcggctgccgtggcgggacctggtggcgccggcgatccgcctcgcgcgcgacggctacgaggtggtcccgtacctggcccgcgcgctgcaggagtgcgagggcgacgtgctcgcggaccccggcctgcgcgccgtgttcgcgccgggagggcggcgggtgctggcggcggggaagacgtgccgcaacccggcgctggcggccgcgctggagcgcgtggcggaggagggcgccgcggcgctctacggcggcgccgtcggggaggccctggtccgcgacgtcagggcggcgggcggggtcatgacgatggacgacctcagagggtacagggtggacgtgggcgccgccttgcgagccgacgccatggggttcaccttcctcggcatgccgccgccgtccagcggcaccctcgggatggcgctgatcctgaacatcctgcaagggtacagctcgctcgagttcttgaaggagctccttggcatccaccgggtcatcgagtccatcaagcacatgctagccatccgtatggacctcggcgaccccgacttcgtggacgtgaccggcgacgtcgccgagatgctgtccacgacattcgccgacaaagtccggcagaggatcgtggacaacacgacgttccctcccggctactacttccccaagtggagccagctggacgaccacggcaccagccacctgtgcgtggtggacggcgaccggaacgcggtggcgatgacgacgaccgtcaacgcatacttcggcgccaaggtgctgtcgccgtcgacgggcatcgtgctgaacgacgagatggacgacttctccgtccccgcgaagcgcacgccggaccgcctcccgcccgcgccggccaacttcatagcgcccgggaagcggcccctgtcctccatgacgccgctgatcatactcaaggacggtgagctcgccggcgtcctcggaggcagcgggggcacgaacatcatcgccacggtggtccaggtgttcgtgaaccacttcatcgtcggcatggaccctctggcggccgtccagcatcccagggtgtaccacaagctgatcccgaacgtcgtgacgtacgagaaccagacggtgggcgacggcgaggtgatcgcgctgggcggcgcggcgagggcgttcctggaggagaggggccaccggctgcgcagcacggactcgggcgccgtgtgccagttcatcgtgcacgagctggcggagccgccggccgcgcccggacacggcgtcttccgcgggaggctcaccgccgtgagcgaccccaggaagggcggcagccctgcagggctgtgattgtgaattgtgatggaggctggtgcgcgtggatagttgcgccttccgatccaactttcgtgcgtggatctcatctcctccctgtagatagatagaaagattcatagacatcatgcattgtttatatatatattgcctagatgggaatccatcaaactgctttcgcgaactagtggacaggcacgaccagtgaaagtttcgagaaacaatagtgaacatttgagagaatttatatgtaacaggtgacaagatttaatataatgtgtatttgcaacaagatg

SEQ ID NO: 4780 - DNA, 668 bp, Zea mays
ctcgggcgagctcggtcgcagtgggcgatgcggaatccgttgtgagcgcgcgaaccaatcctaggcaaccataaaagggacacagccgagcccctatcctccctttactccatcaacgcgcaattagccccaaccaaactaatctccatcgccaccgtaagaaccgtgagggtcgagtgccgccgcacggggcaagcctttcccctcgccgatctgggcacgttgtcgtgtcgtggtacatcgcgggggcgtggtggtgctgtttagcctctcacggcgattgaagaagcacggggccgccgggaatttctcgccgggatttttcatcgtcgctgcgccgtgggcggagggtctctacgggtgcaatctcgacgagcaagccactgtggattctgatgttcagcaagtagaagtagctgagcaggagctcattgaaggagaagagcaggtggtcgaagaggagctgcctaacactgaggcattcgacttgatctaggtggcgtctcccagtcagctttatggcaccagggaataataattagttcgttttattttatcatttatttttgtaagacttccgctatgtaataaatacatttatgatatttatgacatttatctctatgcactaaaaaaaaaaaaaaaaaaaaataaaaaaaaaaaaaaaa

SEQ ID NO: 4781 - DNA, 742 bp, Zea mays
ggaccctcgaggccggccggggtcagatcaccagccataccacacgaccgcagaggagtagcaagagcccgggggagaaatgagcgcggcggcgggcgggctgcggcggctgctggcggcggcggcaacggcgggagccgcggaggtgcgggcgtccatcttcggccacgcgttgaaccctacgggaaggcgcgcggcgacgaagctcctgcggaagaagatggtcggcgaccaggtggcgcagtggtacccctacgacatcaagcgcgacgacccgctcgtcatggcgcgcgaggagaaggagcgtctggctaaactggaaatgctgaagcgtcgtggcaagggcccgccgaagaagggtcagggaaggcgtgccgtcaagaggagcaagtagtcgagctgtgctaccctatcaatgctcatctctgtttctggagcttgccttgttcttacatgctgtaacgtactaccagtgatttgtcgggtgagtgggcgacgacagatgcaaaaaaaaaccccgccttttctatcaagtttagcttacagatgttttttttttttcatcaaattgcaatgaaaccgccttctatgttggatggctgatgtgctaacaaaaaaaaaaaagatgctgacacctaattaagtaccggctacagtgtttcggtgataatttccaggatggaccaggtgcctttcggtccgtcaagattaggatgaaataaattcgggatctgaattaatc

SEQ ID NO: 4782 - DNA, 2774 bp, Zea mays
atgggcatatttccttttcagcgtgcagcgatttgacaatcacgggtgctccatcaccgaaggagatctcgctgtcaggtgcccgccggccattcgcccatagagctacaatttagtgtaggcagagtttaagcgcaaaagttttgacagtgttcagtttaggcagcttttgttctgcaagatagcaggaagcgttctttgtgttcatgttcatattcattgtcatgtgcagatggtattcttgttcagtgtcaggaattggaactgaaaaggggtgatctggaggttgacagagtttttattttcagatttcatgaactgaatactttcgtaccagaacaggatactttactactacagctgaatatttttattttcagatttgatttctagttgattcgattgctactgcatgcatttcatgaactaaatgttttccaattgatttgcatgcgtttctttgtagtgcgtactggacgacatgcaacggaagtggaatcagaatgtgtttctttgcagtatgaacctgacgccatgcaaaggaagaagagttcctctgtcacacagacacttgcatatatgcatatgagcgcacccttcttcctcccacaattcagtctatcgccacacaattcagtctgtcagcacactatgattcggtggacacatgtttgtataactatatgcatatttgatcaagtgatgtcaaggctgagatataccccattgtaatagactgtatttaagttgtatttagtgtttggagaaccacaacattttatctaggtggtacatgctctaattgattgataacccagctttagacagtgaaatttgacgatttcgaagcaatttcgcacaaacgcgtggaccaaaccgaaaaccccaaagcttcgaccctggtgcggtctcacgccgaggagcgagagaaattccccatcgatcttggtttcctctttcctccctctccgcggcatggatcccgccggcgcctctccggcgccggctcccgccgtggaagagcccgtaagcgccacctccattttcgacacccttggcgcggaggtgctggcggtcatgtccccggtctccatctgcatggcccttgtcgtgctcctcatctccctactctcgccgccgtcctccgggtccgcgtcgagctcaccccctccagtcacagctgccactctcgtctacctcgagtcccctaacgactccccgggccagaagctcctcggggcgctcctcgacgccgccgtcttcgtcgccctcgttgccgccgtcacctttgtcctcgttgcgctctactacttccgctgcacgggttttctcaagaactacatgcggttctccgccttcttcgtcatcttctccatgggaggcgccatcgtggccgccgtgctccggcgcctcgcggtcccgctcgacgcgcccaccgcgctcctgctcctcttcaacggcgccgctgtcggtgtcctctctgtattcgcctccgccgtccccatcctcgtccgccaggggtacatggtcgcgctcgccgtcatcgtcgccgcctggctctccaggctccccgaatggaccacgtggatcatgctcgtcgcgctcgctctttacgacctcgttgccgtgcttgcaccccggggaccgctcaggatgcttgtggagttggcctcctccagagatgatgagctgccagcactcgtctacgagtctcggcctacaatcggcccagtcacaagttcttcctcttacgcttcagccatggggtctgtggagatgcaaaccatggcagattctggtcagatcggtagcagtcaatatgaccgggtcgagcaggaggaagatgccagccctgccttcgtgcaaatgagggatcttgtgagagtccgatcaagcattggtgagatgaaaagatcaagaggttctgtgctccaaatggagaaccttgaaagggaggtaccagtgatttcagcagaactgacagcaaaccaaggtgggagttcacagcatgccatcattcaaattgaacatcctgacgaagaagagacatcacctttggtgtctgcaccctctaccaacaatgcagctttggatgaggagcatagacaaagttcatcgtcagagcctctggattttgagatgtttgagtctaccaggggcatcaagttgggccttggcgattttgttttctacagtgtgcttgttgggagagctgccatgtatgatctgatgactgtgtatgcatgctacctcgccatcattgctgggcttggttgcacccttgtcttgctttccatatgccggcatgcgctacctgcactcccaatctctattatgctgggagttacattctacttcttgacacggttgctgatggagccatttgtggttggtgcttcaacaaacttggtgatgttctgactttcactgatctgctgttgtcatttacatgtggatgaagccctcaatcgaaagaaagttgttggttagcaattcagcatcctatgtgagaatgactaataatttgttggtcacttaccgtaaactgtcatttgtatttatttctaggaatgcttaagaccatatactctgaggtagcatcgtaggtagatttagctcatgtcttgttgtaagtctatcaacctgacatgatattcgagaagagctattctacattcgttgttctttggcgtattgtgttcttcaaagttggtgttttcaccctaagattagagatcaagtaattgaacatccattacgttaatcattatatg

SEQ ID NO: 4783 - DNA, 1956 bp, Zea mays
ccagtataaaaatcaaaacaattttttgctgttttcttgattggtaaactttcaacggagaaatttatggttttgggcacaatttcgcccgcccgcgtggaccaaatcgaaaaccccaaagcttcgaccctggtcggtgtcacgccgaggagagagaaattccccatcgatctcggtctcctctctcctccctctcttggggcatggatcgcgccgccgcatcgccgcccgccgtggaggaacccgtcagggccacctccgttctcgacagcctcggcgcggaggtgctggcggtcatgtccccggtctccatctgcatggccctcgtcgtgctcctcatctccctcctctcgccgccgtcctccgggtccgcggcgggttcgcccccgccagtcaccgctgccacactcgtctacctcgagtcccctaacgactccccgggccagaagctcctcggggcgcttctcgacgccgccgtcttcgttgccctcgtcgccgctgtcaccttcgtcctcgtcgcgctctattactaccgctgcacgggcttcctcaagaactacatgcgcttctccgccttcttcgtcatcttctccatgggaggcgccatcgtagccgccgtgctccgccgcctcggggccccgctcgatgcggccaccgtgctcctgctcctcttcaacggcgccgctgtcggggtcctctctgtcttcgcctccgccgttcccatcctcgtccgccaggggtacatggttgcgctcgccgccatcgtcgccgcctggctctccaggctccctgagtggaccacgtggatcatgctcgtcgcgctcgccctgtacgacctcgtcgccgtgcttgcaccccggggaccgctcaggatgcttgtggagctagcctcctccagggatgatgagctaccggcactcgtctacgaatctcggcctactgtcggtccagccactagttcttcctcttatgcttcagtcatggggtctgtggagatgcaaaccatgtcagattctggtcagatctgtggcaatcgatatgaccgggtggagcaggaggaatatgccagccacgcctccttggaaatgagggatcttggaagaggccgatcaagcgttggtgagatgaaccgaccgagaggtcctgtgcttcaaatggagaaccttgaaagggaggtaccagcgacttcagcagagctgacggcaaatcaaggtgggggttcacagcatgccatcattcaaattgaacaacctgacgaagaagagacatcacctttggtgtctgcaccctctaccaacactgcagcattggatgtggaggagcatagacaaagttcatcgtcagagcctctggattttgagatgtttgagtctaccaggggcatcaagctgggccttggtgattttgttttctacagtgttcttgttgggagagctgccatgtatgatctgatgaccgtgtatgcatgctaccttgccatcattgctgggcttggttgcacccttatcttgctttccatatgccggcacgcacttcctgcactcccaatctctattatgctgggagtgacattctacttcttgacacggttgctgatggagccatttgtggttggtgcttcaacaaatttggtgatgttctgacttttcactgatctgctgttgcatttacatgtggatgaagccctcaaccaaaagaaagttgttggtcagcaactcagcattctatgtgagagtgactaatattttgttggttacttatcgtaaactgtcatttgtatttattgctaggagtgctcaagaccatagactccgtggtagcatcatagatagatttagctcatgtcttgtagttccatcaacctaacatggtattcgagaagagctattctacattctgaataatcaagtaattgatcatccattaggccagaaaaaaaaaaaaaaaaattgacct

SEQ ID NO: 4784 - DNA, 2475 bp, Zea mays
tgtctcttccctgctccggtgctccctccccaccaaacctacccgctgcccctgtgttatttatatcgcacgcaacgccgggatgcggcagccacaacacatcccacaaccattattcttgttccactgcatcaggtcgtccaactctccaagcggcaagcgccatgccttcttccgcgcaggttctgctctgcctcgccgccgtgctcgcggcggcggcggccaccaccgccgaggcgcactcgcagtgcctggacaacccgccagaccggtccatccacggccgccagctggccgaggccggcgaggtcgtccacgacctccctggtggcctcagggcctacgtcagcggcgccgcgagctcgagccgcgccgtcgtcctcgcctccgacgtcttcggtccgtaccacacgctctcgcagttctctctagtcgtttgggcatacttttttttttaaaaaataaaatttggacagcaagctctcctttctttctccctctaatcgattattcctggcatgcagggtacgaggcgccattgctcaggtacatagctgcatccgttcgattcctgctcctcctccttctccggcgtaccccagttttaggagacttgtaacagacagagcatatgtattccatccttgatttagctgaaatctgtggttggtgttcaataacgcagacagatagcagacaaggtcgccaaggcagggtacttcgtcgtcgtgcccgatttcttgaagggagactacttagacgacaagaaaaacttcacggaatggctcgaggctcactctccggtctgttctatgcacttttcgttactctgtccctatcaatatatatatatatcgccatcatcttttttttttcttcttcgcgtcgcgtcgcatcgcaagaaactactgcaagcaaaattgattggttggttggggatcctatcgatctttacaggtgaaagctgcggaagacgctaagccactgttcgccgctttgaagaaggaagggaagtccgtcgcggtgggaggctactgctggggaggtatgtgacgcccgcgccccctgaaacgaacactccaactcctccatttagttcaggcaacacatagagcgttctgtttctcacatccggccttgttgctgctgcttcctcttcactggcatggcacttggcagggaagctgagcgtggaggtggggaagaccagcgacgtcaaagctgtgtgcctttcgcacccgtacagcgtcactgccgacgacatgaaaggtgcagtgcagtgcagtgtgctcctcctcttcttctatgctgcgtcactagcctcaccgcatgtgttggttcgaaatcgaaacagaggtgaaatggccgatcgagatcctgggggcccagaacgacacgaccacgccgccgaaagaagtgtatcggttcgtgcatgtgctgcgtgaaagacacgaggtgagctccaagctacgactgattgcaatgacactgtgtggatcggataccggccagctcattattctagtggtggtggcacacacaggttccctactacgccaagatcttccagggagtcgagcacgggttcgcctgcaggtacaacaccaccgaccctttcgccgtcaagaccgcagagacggccctcgcctacatggtcagctggttcaacaagcacctcaactgaatgaagcctgcactgcacccaccagactgaattcaataaaccacagcagtgctgtgatattttgtttcgattcatggctccccagattgatttgtcatggctaagacctctactactgtaatttccctcatttttttgtctcttcaaactctctgtatttctttttttttgcttttttatgatcgcaataaagttcagtaggggtatacccctcctgtttgcttcaaaccgcgcctgactctgtctgtcagtccatctccacgcgcctcaggtgacgctgggccaagtcgtggaaatggctaacgggccaggaagcctagtgcgcttgtatctgggctggactgggccaactgaaccggctctttgtcgtctccacctacgcgcgcgtggatacaagcagagccacggctctttgtatcggtactagcttgtacgaacatcaatgatcaaacccttctaaactatgaaatctatcgtcgctacctagagccacacaactcatggttttgaaaagccatcgcactacatgacgcttcatttacgacgacctaggttggttgctaaaaacgcattcggttggtcagagcgatctatacggatggtttttgcaagtgacgtcgctaaaagttttagcgaccgacatctttttagtaatcgatcgtctgttgttgatatcgtatatttagcaaccaacagaaagttgtggtactgacagttgttattaccaataataaatagtcaattagcatttaacaacgacatatccgatatatacacaaaagcaccacaaa

SEQ ID NO: 4785 - DNA, 1122 bp, Zea mays
ccgggatgcagcagccacaaccattattcttgttccactgaccactgcatcaggtccaagtccaactctccaagcggcaagcgccatgccttcttccgcgcaggttctgctctgcctcgccgccgtgctcgcggcggcggcggccaccaccgccgaggcgcactcgcagtgcctggacaacccgccggaccggtccatccacggccgccagctggccgaggccggcgaggtcgtccacgacctccccggtggcctcagggcctacgtcagcggcgccgcgagctcgagcagcgccgtcgtcctcgcctccgacgtcttcgggtacgaggcgccattgctcagacagatagcagacaaggttgcaaaggcagggtacttcgtcgtcgtgcccgatttcttgaagggagactacttagacgacaagaaaaactttacagaatggctcgaggctcactctccggtgaaagctgcggaagacgctaagccactgttcgccgctttgaagaaggaagggaagtccgtcgcggtgggaggctactgctggggagggaagctgagcgtggaggtggggaagaccagcgacgtcaaagctgtgtgcctttcgcacccgtacagcgtcactgccgacgacatgaaagaggtgaaatggccgatcgagatcctgggggcccagaacgacacgaccacgccgccgaaagaagtgtaccggttcgtgcatgtgctgcgtgaaagacacgaggttccctactacgccaagatcttccagggagtcgagcacgggttcgcctgcaggtacaacaccaccgaccctttcgccgtcaagaccgcagagacggccctcgcctacatggtcagctggttcaacaagcacctcaactgaatcaagcctgcactgcacccaccagactaaattcaataaaccacagcagtgctgtgatattttgtttggattcatggctccccagattgatttgtcatggctaagacctctactactgtaatttccctcattttttgtctcttcaaactctctgtattctttttttttttttttttgcttttttatgatcgcaataaagttcagtaggggtatacccctcctgcttcctccgtgtttgcttc

SEQ ID NO: 4786 - DNA, 1070 bp, Zea mays
tcgaggccggccgggtcccggggccccgctccaattccgttgctgccgccagcccacaaccattattcttattccactgcatcaggtccaagtccaactctccaagcggcaagcgccatgccttcttccgcgcaggttctgctctgcctcgccgccgtgctggcggcggcggcggccaccaccgccgaggcgcactcgcagtgcctggacaacccgccggaccggtccatccacggccgccagctggccgaggccggcgaggtcgtccacgacctccccggtggcctcagggcctacgtcagcggcgccgcgagctcgagccgcgccgtcgtcctcgcctccgacgtcttcgggtacgaggcgccattgctcagacagatagtagacaaggttgcaaaggcagggtacttcgtcgtcgtgcccgatttcttgaagggagactacttagacgacaagaaaaactttacagaatggctcgaggctcactctccggtgaaagctgcggaagacgctaagccactgttcgccgctttgaagaaggaagggaagtccgtcgcggtgggaggctactgctggggagggaagctgagcgtggaggtggggaagaccagcgacgtcaaagctgtgtgcctttcgcacccgtacagcgtcactgccgacgacatgaaagaggtgaaatggccgatcgagatcctgggggcccagaacgacacgaccacgccgccgaaagaagtgtaccggttcgtgcatgtgctgcgtgaaagacacgaggttccctttcgccgtcaagaccgcagagacggccctcgcctacatggtcagctggttcaacaagcacctcaactgaatgaagcctgcactgcacccaccagactgaattcaataaaccacagcagtgctgtgatattttgtttcgattcgtggctccccagattgattttcatggctacgacctcttctactactgtaatttccctcattttttttgtctctatgtatttcttttcttttctttttgcttttttatgatcgcaataaagttcagtaggggtaaaaaaaaaaaaaaaaaa

SEQ ID NO: 4787 - DNA, 1203 bp, Zea mays
  misc_feature (5)..(5): n is a, c, g, or t
gcacnagaccattaccccgccccggcccgggccgggagccacaacacatcccacaaccattattcttgttccactgcatcaggtcgtccaactctccaagcggcaagcgccatgccttcttccgcgcaggttctgctctgcctcgccgccgtgctcgcggcggcggcggccaccaccgccgaggcgcactcgcagtgcctggacaacccgccagaccggtccatccacggccgccagctggccgaggccggcgaggtcgtccacgacctccccggtggcctcagggcctacgtcagcggcgccgcgagctcgagccgcgccgtcgtcctcgcctccgacgtcttcgggtacgaggcgccattgctcagacagatagcagacaaggttgccaaggcagggtacttcgtcgtcgtgcccgatttcttgaagggagactacttagacgacaagaaaaacttcacggaatggctcgaggctcactctccggtgaaagctgcggaagacgctaagccactgttcgccgctttgaagaaggaagggaagtccgtcgcggtgggaggctactgctggggagggaagctgagcgtggaggtggggaagaccagcgacgtcaaagctgtgtgcctttcgcacccgtacagcgtcactgccgacgacatgaaagaggtgaaatggccgatcgagatcctgggggcccagaacgacacgaccacgccgccgaaagaagtgtaccggttcgtgcatgtgctgcgtgaaagacacgaggttccctactacgccaagatcttccagggagtcgagcacgggttcgcctgcaggtacaacaccaccgaccctttcgccgtcaagaccgcagagacggccctcgcctacatggtcagctggttcaacaagcacctcaactgaatgaagcctgcactgcacccaccagactgaattcaataaaccacagcagtgctgtgatattttgtttcgattcatggctccccagattgatttgtcatggctaagacctctactactgtaatttccctcattttttgtctcttcaaactctctgtattctttttttttgcttttttatgatcgcaataaagttcagtaggggtatacccctcatgtttgcttcaaaaaaaaaaaaaaaaaagtacctaaaaaaaaaaaaaaaaaaaaaaaaactcgagactagttctctcctcgtgc

SEQ ID NO: 4788 - DNA, 2344 bp, Zea mays
acatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcatgttccgcgggccgtggctcgcccgcgcggacttcctgctgacgtgcgacccggcggccgtccagcactgcctggcgtccaaccacgggggctacgacaggggccgagactttgcggagatgttcgacctcctgggcgacgggctgctggttgcggacgccgcgtcgtgggcgcgccagcggcacgtcgccgccaccgtcttcggcaccccggcgttccggtccttcgtcctgtgcaccatggcgcgccagacggcgcggctgctcgtgccgttcctggactgcgccgccgcggatcaggaaggggacggtggcgtcgttgatctcgaggacgtgttcatgcggtactcgctcgatgtgacctacgcctccgtgttcgatgccgacctggacatgctgtgcgtcgccgccgcctcggcgccggtgccgccgttcggcctggcgaccagggtggccagcgaatctgtgctcttcaggcacatcgtgccggcctggtggtggaggctgctgaggtggctcaatgtcggctccgagaggaggctggccgaggccaaggcggtcctcaacgaattcgtctaccgcgagatcgccaaacgcaagtcacggctcgccaccacaagccaagcaggagaaggctacgacctcctgtcactgtacatggcgtggccgagggaacccggtatgagcgagcggcagagggatcagttcctccgggattccgccgtcagttacttgtttgcggccaaggacctcatcgtcgccgcgctcacctggttcttctacatgctctgcacgcacccgcacgtcgaggccaagatcctcgacgagctgaggtccctgcatcccacagccacggtcgcggccaccggcggcggcgagcatgccgtgttcgactctgacgcgctccagcccgcgtcctacctccacgcggcggtcctcgagacgctgcggctgttcccgccggcgcctttcgaggagaaagaggcagttcgcagcgatgtgctgcctgacggcaccacggtggccaagggcaccagggtcatcttctgcatctacgccatgggcaggatggaagggctatggggtagcgactgccacgagttccgaccggagcggtggctgtccgatattggccgagtccggcacgagcccagccacaagttcgccgtgttcaactgcggacccagaagctgcctcgggaagaacctggggctcagcaacatcaagattgccgccgccgcaatcttatacaactttcgggtggagctcatcgacggccatatcgttgagccacagaactcagtggtgcttctcaccaagaacgggatgagggttaggatcaagaggaggcacgcagcatgatgcactgtgctacttctacctttacatcagttaaactccaaaaaatggtggggaaacgaacaaaaggtgatagggcatatagaataaaaacgcagcacaaattttattccagattaatctgctcatgtgatttcagccatattggatacaagttctgaactttgatgcttctgattcggaaaattaatcaaaaaaaaatgttaaatagtttcgagggagacaaggaacaaatagctttatgatttccacaagttcggcaatctgtaatgtacactcacagtcacaggtaatatctgacgctggtgataatattatgctaaacataattcattgatttcccttttgcaatccaacaataaatggaccaaagaatttaaagaatatttcagttagtagtttactgctcatggtttacaaccggtgtattaaatcgcgggaggtttagcgcctgggttcgagaacagctaagcccagctataaccgactatagcggaagctaagccttttagcggatttgcaaaaaaaaaaaaaaaacagagtataaacttgacacagatgaatatatgacaaatttgatattcataaatattgccatacatataggaaagagttcagttccatacatgactgctgtaaaatgtctgagcagcttaacttaaaacaaaatatctgagctcagcttaacttaaaacaaaatatctgagct

SEQ ID NO: 4789 - DNA, 1186 bp, Zea mays
ctcgaggccggccggggctccagcgagggcactagccgccgccgtttccatctccccggcgctccatcgctgggcacgcaggcgacggcgacggcgctcaggctcgtgctctcaggaacggcgtcagctgcttcctttctcgcctcttgccagtcgcctcgcgccctcgcctttggtcctccgcacggctggtgagctctgcgtgcgtgcctctctctctctcctcccttctccggtggatcatcaacggcgcccggccccggcggctgcgccgtgcgcggcctgagggcagcgggagccagcagccgctgcttagtgccgctttttggaaccctgctatttgttcagacagttgttatatatatctgaagaataacatctttcattgaaagacatacgtagaccgatggcaacactgaaagatgcagcggcaaggaagtctatactggcaacaatccgtcttgttgtcccagccggtgcagcccgtcctgcacctccagttggtccagcacttggtttctaccggctcaatttgatggccttttgcaaggacttcaatgccaggacccaaaaatacaaggcagaaactccaatgcaagtcaccctaactgcctacaaggatagcaccttcgagttcgtggtcaagtcgccctcggtatcatggttcctcaagaaggcagcaggaatcgaaaccgccagcactcgcccaagccacgtgaatgtatcgtccctcaccctccgccacgtatacgagattgcaaagttgaagcaggctgaccccttctgcaagcacatctctcttgaggcgctgtgcaagtccatcattggcacagccaactctatgggtattgcgattgttaaggatctatgagcagcaatgccagccttttagtcatgaagaaatctgtgacattttgtatgttcctagtttgtagttggtgctggagaggatacaactcatctgtctcacagagcttcctgccactgccatgtcaggagtatgaaactctatgcaattcctgggagagccttcagcgcagcctttttctcttcctttgttcattttgtgacttaactggtactatgtggttttacgttggtgctttaaataataaattgtagttttggtttcttccaaaaaaagcaggcaagagacaacctggcgaactgaaacatcttagtagcc

SEQ ID NO: 4790 - DNA, 916 bp, Zea mays
gtccaccggacacgaccctaaccttctcactgctccagcgaaggcactagccgccgccgtttccatctccccggcgctccatcgctgggcacgcaggcgacggcgacggcgctcaggctcgtgctctcagggacggcgtcagctgcttcctttcccgcctcttgccagtagcctcgcgccctcctttgctcctccgcacggctgacatacatagactgatggcaacactgaaagatgcagcagcaaggaagtctatactggcaacaatccgtcttgttgtcccagccggtgcagcccgtcctgcacctccagttggtccagcacttggtttctatcggctcaatttgatggccttttgcaaggatttcaatgccaggacccaaaaatacaaggcagaaactccaatgcaagtcaccctaactgcctacaaggatagcaccttcgagttcgtggtcaagtcgccctcggtatcatggttcctcaagaaggcagcaggaatcgaaaccgccagcactcgcccaagccacgtgaatgtatcgtccctcaccctccgccacgtatacgagattgcaaagttgaagcaggctgaccccttctgcaagcacatctctcttgaggcgctgtgcaagtccatcattggcacagccaactctatgggtattgcgattgttaaggatctatgagcagcaatgccagccttttagtcatgaagaaatctgtgacattttgtatgtgacatttctatgttcctagtttgtagttggtgatggagaggatacaactattctgtctcacagagccttcagcgcagcctttttctcttcctttgttcattttgggacttaactgatactgtgtggttttacgttggtgctttaaataataaattgtagttttggttaaaaaaaaaaaaaaa

SEQ ID NO: 4791 - DNA, 3223 bp, Zea mays
  misc_feature (2990)..(2990): n is a, c, g, or t
  misc_feature (2992)..(2992): n is a, c, g, or t
  misc_feature (3009)..(3009): n is a, c, g, or t
  misc_feature (3021)..(3021): n is a, c, g, or t
  misc_feature (3025)..(3025): n is a, c, g, or t
  misc_feature (3042)..(3042): n is a, c, g, or t
  misc_feature (3058)..(3058): n is a, c, g, or t
  misc_feature (3072)..(3073): n is a, c, g, or t
  misc_feature (3094)..(3094): n is a, c, g, or t
  misc_feature (3113)..(3113): n is a, c, g, or t
  misc_feature (3119)..(3119): n is a, c, g, or t
  misc_feature (3125)..(3125): n is a, c, g, or t
  misc_feature (3140)..(3140): n is a, c, g, or t
  misc_feature (3142)..(3142): n is a, c, g, or t
  misc_feature (3146)..(3146): n is a, c, g, or t
  misc_feature (3148)..(3150): n is a, c, g, or t
  misc_feature (3154)..(3154): n is a, c, g, or t
  misc_feature (3163)..(3163): n is a, c, g, or t
  misc_feature (3166)..(3167): n is a, c, g, or t
  misc_feature (3172)..(3172): n is a, c, g, or t
  misc_feature (3177)..(3177): n is a, c, g, or t
  misc_feature (3183)..(3183): n is a, c, g, or t
  misc_feature (3190)..(3190): n is a, c, g, or t
  misc_feature (3192)..(3194): n is a, c, g, or t
  misc_feature (3198)..(3198): n is a, c, g, or t
  misc_feature (3200)..(3200): n is a, c, g, or t
  misc_feature (3203)..(3204): n is a, c, g, or t
  misc_feature (3206)..(3206): n is a, c, g, or t
  misc_feature (3215)..(3215): n is a, c, g, or t
  misc_feature (3222)..(3223): n is a, c, g, or t
gatgtggttatttccctccaaatgtgtaaattccatatataactatccaaacaggatattgaatttgattcgcggaaagaattccattagtatcaaaaaaatgaattgattcaaattctaaggaattactttctttaggaatctaatatctagaatgttatttatggaatgagtttcatttccaaggaaacaaacgggccctaattgtatttgagggacgaaatcaaagaaagctcaaggatgaaaatagcccgctttgaaaggttgaggtttgcttcgaacatacaaacttagctagtatgatatgtgtatgtataatcctaagtatatactaaaattgctcaagcaaattttgtcaatatgcttaggctgacgctaataggctatatctactgccacatcagtcatcgttttgtttgtatctactatcatcgatctttacctatcataacgatcaagttcaccacctttaccattaggctctagccaccttagtgtcatgtcagctttttacatgttcttattagaaattaaacacatggttttaccaaataaaaattcatatgtatatagctaagcaaataaaaattatatagttacatagtttatgaatcgtaaataaaattgatacaattcatcaaacataaaaaatatgtattatttaaaactaaaagtcacataatttataagtatttttagattttttgtttttattttttggatattaaaataatgtggaccaattaacagatgacacgtggtagctgatgattggtaccaaccgatcccgatcggtaccgactgattaaccgctatctggagtacgaggcgatacaaactacacttggaccggaataggcgatatcgaccgtgactctttgggcaatatcgtcccacgcggacattggccttagactatgtctagtagcttacatatcctatctcatatttcatctcgtttttcaaacttcactctacgaaaatataatatacagtgcaaaatattgctttagtaactatatgggtaacctcctggacaggtcttagagattcagctctaaaatggttgttttgaatttattagaggttattgatcgatttagataaaaaacatctatggataatgtgccttatcggaaaccttctatgtagaaaggcagtcgtggttttatgggcacataaacaatctacattttcaatggttagaagaaaagttaacctaatgaaactatttccctagacctacgtaggagtatcaaggatccatgaatattttattaatagcacgatttgtatatagtgtactgtaaagactagaattacttggtgtaaaccaaacacgcacggtgtcatcaccatttcgcacgtggccaagtggtggcactcactcacctagtcacctcttggcttcttgctttccattgccagcgccagcaggaggcagctgcagcagacctaccgccaatcgtgtgacgccaccaccgctctctgactcttcctccacgaaccacatcaaaactgatcggctccccccccccggccggcgcgagagcaaacgccacgagagtcgcgattcttccaccacttccacgggaccggtcggatccaatctgctgccgcccagccaccgccaccgccgccaccgccggctcctctataggggtcttccctcctcttcgcccttcgcaacccgcaagttccgagcgattgatgagtatttttctccccgtcccttggagcgactcggtggatgcgagggacctgtccgcgctcgacccgccttcgcccctatctcgccgcccggcgggcaggctcctgctctcgccttccgttcccggagctagccgcaggcccatgggctagtgggtcgtcgttcgccctcctgcgatcgcgagcggagaggcggcctgcgggatccgcccgtccccaatccaaataactcctctccttggacgatttcggagttactggcctgcctgaaaatcgattcctgctaacgccagtattgtgcttttcagtaacaagagtgtacagttgttgcttcttgggatgtgaatcctgtcttgggtggggatccagctcacgctagatttccccccttttgcctttcactttttcactcgggagggaaaggttgggttcctgggtaattaacatccaatcgctctgcttgattctaccttatcttctaatcactatttccgtgctcttaatgcaagtggtgggaaggcaaagtaaatattgtattgccggttttggggacatattcttggggatattccggtctgtgcaaacatatctcttgcccttagtttagtttgatgctcatatcagtattcagtactggtggggagtgcacatatcacaaatcctgattatcctcggccgttggggagatgagttcctcacaagaatccaccttcacctcggcctcagcggctgcacaagttaatgcttccgctttggacttgctcccggtctatgccaaggagcttatcgccggcggcgctgctggtgcatttgcaaagactgcggtagcaccactggagagggtcaagatcttattgcagacaagaactgaaggtttccagtccctcgggatcctccagtccttgaggaagctgtggcaatacgagggaattcgaggcttctacaaagggaacggtgcaagcgtgcttcggattgttccatatgcagcattgcattacatgacatatgagcagtataggtgctggatattgaataattttgcttcatcaataggtacagggcctgtcgttgatcttttagctggctctgctgctggtggtactgcagttttgtgtacatacccattagacttggctaggaccaagctggcataccaggtttcaaatgttggccaaactggtaatgctttgggaaattctggtcaacaacaaacgtataatggcataaaagatgttttcaagactgtttacaaagaaggaggcgcacgatctttgtatcgngnagtaggcccaaactctnattggtattctncccntatgctggcttgaagtnttacatatatgaaganctgaaatctcaagnnccagaccgaattaccagggantcctgctatactgaaagcntctctntgcganagacttaaacttggncntatntnnnaccnccccctccnccnnatccnctcgntatgtnggccccngnnnaacnanacnncntcggttccnaaccaann

SEQ ID NO: 4792 - DNA, 1436 bp, Zea mays
  misc_feature (627)..(628): n is a, c, g, or t
gcacaagttaatgcttccgctttggacttgctcccggtctatgccaaggagcttatcgccggcggcgctgctggtgcatttgcaaagactgcggtagcaccactggagagggtcaagatcttattgcaggttccgaacttcccattctatcattttcagtatttgtggtggttatgaatttatgataatgtttagctcacttgctgcacatttgctatttgctatgtagacaagaactgaaggtttccagtccctcgggatcctccagtccttgaggaagctgtggcaatacgagggaattcgaggcttctacaagtgagtagcatggcagaaatgcctcaggcttttttactgctgaattaagtatattgatctcaatccactgttattggccatgcagagggaacggtgcaagcgtgcttcggattgttccatatgcagcattacattacatgacatatgagcagtataggtgctggatattgaataattctgcttcatcaataggtacagggcctgtcgtcatgatcttttagctggctctgctgctggtggtactgcagttttgtgtacatacccattagacttggctaggaccaagctggcataccaggtttcaaatgtggnnccaaactggtaatgctttgggaaattctggtcaacaacaaacatataatggcataaaagatgttttcaagactgtttacaaggaaggaggcgcacgatctttgtatcgtggagtaggcccaactcttattggtattcttccatatgctggcttgaagttttacatatatgaagatctgaaatctcaagttccagacgattacaaggattctgttatactgaagctctcttgcggagctttagctggtctatttggacaaaccctcacttatccactggatgttgtccggagacaaatgcaggttcagagcaagcagtctcaaaattcgagcgatggcttccgtataagaggaacttttcagggtctcttgctcatcattcggtgccaagggtggagacaactctttgctggcttgagccttaactatgtcaaggttgtcccttcagtagctatcggtttcacaacatacgacatgatgaaggcattgcttggagttcctccccgagagagagtccatgcgtcaggtggtaacaagtgaagcaatgttggccatccttgtgttatgactgatgaactaaagaaattctaggttgtgacattgttattcttgttatgaatcccattgcatagggtggagagtgttgtatattggtcaaatagctatattcatgtaacattaagttgagatgcttgtatcatccattatgctgcttgtaatgtaaccatgaatacaatgacgcctccaaagatcgctttaaattaactataaaagattaatattacccgtaaaaaagaaagaaaaaaaaaa

SEQ ID NO: 4793 - DNA, 3922 bp, Zea mays
  misc_feature (1844)..(1844): n is a, c, g, or t
  misc_feature (3519)..(3519): n is a, c, g, or t
catccttgaccatcttggctagtgtaataatgttcaaggtaacagattctgaccttaaacgtgtttgtttacacaattcttaccaagctttgacctatctatactaaatcgatttactaaatcctgcataatctgaaggtttcaatcagtacaccgtgtattaatctttactctgaatgagtcgcctgtttgttttactgtctggcattttcttgattgcgcattgctggtacaattcatcacactagattaaactaaagtaaatactcagtatttgcaaaattgttcttatgcgtttgtgatcttattgtgacacaacacatttaaaatttcagtcttacccccattaaattttcatccaacaacaacaaccaaaccttttagtcccaagcaagttggggtaggctagagttaaaaccgaacggaaaccacgagtcaaggtttaaacacatggaatactgttttcccatccatcacccaaaatgaaaatctgagactttcagtattaataaacagcaaaaatttaagacttgaggacctgtcagacgtatcagccatgatagaatcagtgtcgaacacattctcgagaaaccatagagtaggaaacactgctgcatgagatgaaccgtcatggtgcaccagcaacctttcttcacaatgctttggtactgtttttttaatgtgtactctgatttcatacaggattgggatcgtcaaaatccaacgcaaattgttacagagatgtgtggcttcgttacaatcctttccgggacttttcttcttcacaagacaaaggatatggtggatggtatgtctgcatttacattcctttgacctgtaactactcatgttcataatgtcctgtcggctcgcatcacaggtgtcccaccaaatttaccaattcggcttcctaaacatgcggatgaggatggctatgcagacgacgtaattcctctcagatctgctgctgacggtattccactcaggtcgccaagggctacagattcatttcgctcctcgtgatgtcctgagatttgcaagtgcactgaatcatgtagattccaggctcatacccagcagccgtcagtctatatacatgggaagcggaaaatagccccccattcactcggttggataccacaacgtaggtttaactgtaggattcaacaggtaacaactcggctaaccccctaaccctaatttgagtcattggtacagaattttgacgattatatcagttgtacacttatccgggtaacatcatcaccaagatgaccaagaatctatgttttgggttacatgtatatcgcggtgagccacataggttattatgttatattgaattgttgtattctttgaacacaaacactctgaatacaggaagatttgaacaaaaaaaaaacgccgttaaccatttaccacttttatctgaacacttgatatctagctgtttcatccttcattacatgataagttcaaggagaataagcagcttggatgcacatatgtgaatccatcgctcaactgccctgtgaaactgtatccaagagcgaaattcggcataatgtcgaattagtcggttgtggcgtcaggtgccgtatcctctatggatttatacatttttgataactttcgtttctctttcagtaagttaatggaaaacgatgacagtcgccggtcacctgtacctacaagcctacaccattacatgtttgaggcagtttttcaatataaataaattagaagcacagagctgtctaaaacgcaaaatcaccgtccaaaatgatagctatgtctcaatttcatatttaggaggcgttgggttgtccggaaacggtgacctngacaattccgagccacattgtttttctaatttatgtaagttttgatcacctaaaaaataccaaggccatttcgggagaaacgaacagggctagctggagattggaggcattagaatggccagccaagtcttcattcaaccttgtcggtcccatagcagtttcagttttttttatactgcaccttgataaaattcttgccattacaattctgtctctttggagaaacaccattactattcatctaatttgaccaatgctacttaactatttgaaaagtagtatggtgccattaactacgtctcgtgtcccacgtagcttcttgtacacatacggttcttgtgtatttgctgtatagatcaaattacactcctttgatccgtcctctcccaaatcccacccaacctacctgaactcttgacatacccaacccaacccatcttggtgattcaagccaacgacaagttggtggtgattcaagccgacgacaagtccatggaggcgcgacaagttggtggtgattcaagccgatgacaagtccgtggtggcgcgcctctctaacctcttctcttgtggatccatcctccctattctcttctcgcgcactcttcaaggttgtcaaacatatatggttcaactattataagcaatggttgtggactatctattgcaactctctcaggtgtaacaaatattaggccgtgctcagcagtgtgtatatagacgtgtaaaacaatgttttcactgtagactacacgttttacagagtagagtttgaaataggaactatgatagggagacatatggatagtctagtggaaacaaccttattggtggttggatacctattgcatctcactcaggtgtagcggctattattggtggtggactagctactgcatctccctcaggtgtataggtgtattagctacgataggcacaagtcatgtgctaggaagtgcatggacactcaatctatctccaatttgtttattgttgaacactcctaatagctgcgaagacatctctgtcttatacatcttaaacatttctacaatctgtctcatcaattaagtgaacatcctcatcaaacctcttatcaaagtaacacagatgcaatttgcttagaactccattttatctcatcatgaaagcatttcattagtgcatctagtgtaaaactacctacttccatattccagcatatagttttcccttttgaataggatttcctaccattcggctccactctgacgaaatcttgaactgtagtctctagtgcgaacaaagatctactaacaaaataattaatcggttcgaacaaaagcattcgtccaacacaaatatacaaaacaagcacgtgagagattttagaggcacatcttgaacggtcttcgtccatcttggaagttggaccttgattcaccacttcgcctagctgctacatgcgaccttcacgactgttgacgacctcaattttcattgatgccttcccaggtgacctcgacatctagtgtcaccattggatcaaattccaagaggctcctcaaatcagtagttgtcagagagagagagagagatagtttactttccaaagtcacattggtgaatagtaaaggtgtttctccaaagagacataattgcaatggcaaaaatctaaacaaccctttattcaatntaattatgcgccttctagtgagatgatgagatatgatgacaatcaaagaggctaatataaaaaagtttgttgcaagtgccttcatttgttaagaaatcctaaatattataattagcatcttgctagattattgagttatattagtcagatggtgtacttgattgagttttgagtctggtttattcaactccactcatacatgtaatggttatgtctgaaccgtgtctccagtagtctaatggagttcaactaatgtcccggtgtatgtctatgtgtctaagactgtatatatgacataggggccgaccacacgatgatagacatcgatttaccctgaattactctattttgcttggagcatggggaaaaaagttctatgcatatatccacacaaacagaagtc

SEQ ID NO: 4794 - DNA, 719 bp, Zea mays
attgggggtccctcgaggccggccgggcccccccgcccgtcgacccttttcccgcacaacagccgcgccgctctcccgatctatacgaccacatacggtagctagcctagcttcttcgtcacagctcaccacggcgcagcaaccgcagcccacgaaggcgacgaaaagctgccgaaccaccagcagaggagagcgagggaccgcgcaaccgagccactccctagtccctccttctccctctctctctctctcttcgcctccggatctcgcatgcgcggtggccaccgccgcgcccgacggtggagggtgaggagttagcgaggggccctgaccctgagtgctggacggcggcgtgatggggggagcgcagctggtggggagatgggtggagtcgtacacggggatgtcgacggacaacatcaagggcctgctgctcgcgctctcctccagcctcttcatcggtgccagcttcatcgtgaagaagaaggggctcaagaaggccgccgcgtccggcgtccgagcaggcgttggtggctactcatacttgcttgagccactgtggtgggcaggaatggtaacaatgattgttggcgaaatcgctaactttgcagcttatgcatttgctcctgctatcttagtcactccacttggtgcacttagcataattatcagtgctgttcttgcccatataatgttgcgggagaaacttcatacatttg

SEQ ID NO: 4795 - DNA, 1829 bp, Zea mays
  misc_feature (101)..(101): n is a, c, g, or t
cattgggtacctcgaggccggccgggcccgtcgatccttttcccgcacaacagccgcgccgctctcccgttccacacgaccacatacggtcgcgatctagnaactagtagcctagcttcttcgtaacagctcaccacggcgcagcaaccgcagcccacgcaggcgacgaaaagctgccgaaccaccagcagaggagagcgagggaccgcgcaaccgagccactccctagtccctccttctccctctctctctcttcgcctccggatctcgcatgcgcggtggccaccgccgcgcccgacggtggagggtgaggagttagcgaggggccctgaccctgagtgctggacggcggcgtgatggggggagcgcagctggtggggagatgggtggagtcgtacacggggatgtcgacggacaacatcaagggcctgctgctcgcgctctcctccagcctcttcatcggtgccagcttcatcgtgaagaagaaggggctcaagaaggccgccgcgtccggcgtccgagcaggcgttggtggctactcatacttgcttgagccactgtggtgggcaggaatggtaacaatgattgttggcgaaatcgctaactttgcagcttatgcatttgctcctgctatcttagtcactccacttggtgcacttagcataattatcagtgctgttcttgcccatataatgttgcgggagaaacttcatacatttggtatacttggctgtattctttgtgtggtcggttcgacaacaattgtgcttcatgcccctccagagcgtcaaattgagtctgtggcagaagtgtgggatcttgcgactgaaccagcattcctgtgctatgcagctgttgtgcttgcagcagcttttgtgctcatattccattttgtccctgagtatggtcagacacatatcatggtatatgttggcatatgttctcttgtgggatctttatcggtcatgagtgtcaaagctcttgggatagccttgaagctgacattttctgggatgaaccagctagtctatccacaaacatgggtgttctcatccgttgtaaccttatgcattgtaacacagatgaactatctgaacaaggccctcgacacattcaacactgcagttgtttcacccatatattacacaatgtttacatccttgaccatcttggctagtgtaataatgttcaaggattgggatcgtcaaaatccaacacaaattgtaaggagatgtgcggcttcgttacaatcctttctggaacttttcttcttcacaagacaaaggatatggtggatggtctcccaccaaatttaccgattcggcttcctaaacatgcggatgaggacggctacgctgctgaaggaattcctctcagatccgctgctgacggtattccgctcaggtcaccaagggctacagattcatttcgctcgtcatgatgccccgctgagatttgcatgcgcactcaaatcgtgtcacttgaaggctcatacccagcaggcgtcagtcctatatatacatgggaagggaaagataaccctccattcactcggttggatacacaacgtaggtttagctgtaggattcaaaaggtaacagctcggctgcccccttgtaaattctgaggcattggtacagaattttgaggattatatcagttatactcgtccgggtaagatcaccaggatgaccaagagcccaagtttttgggttgtatacttgtatgtatattgcggtgagccatataggtcactatcttgaattgctgtattttttcaacacaactctcagagtacaggatgttgaacaagaaaaaaaaaaaaaaaa

SEQ ID NO: 4796 - DNA, 3771 bp, Zea mays
ggatagtgctcttgtatacgaggggtcctatgtttagaacctaaggcatcgggtcctataattgtttgatgattttttgtgaaacatgacctctgctggagcaggttttggtgttggggtcttatatttcaaaattttgaccaagaaaaataggaccccatttaagactcttgttggagatgctctaaagagtattaattagtgcgaataaggactatattacccctattaattaggggttgcccggtgcacatagaaagtggggaggacaatggagttaaaatcataccttagtcccttttagttaccccttaatgactaaagaattaaagtttagtcacctctactttgaaccctatttgttttttcagaactaaaattgactagttactccaaaccaaacaggccttagagagtgtttggtttatagggactaatttttagtccctttattttatttcattttagtccctaaatggttaaatataaaaactaaaactctaatttaattttcgtatttgataatttagggagataatgtagagagtaaaattagataaaatggaggtactaaaaattataaactaaacaccttttagtctatctcgccacgtgaaaagtcatgcaaatgcaaaaatatcgctcgcacgacgttatatcataatgcatgtgtctacaatagatcatacatctcacaggggacaaaatactcgtgagaagaggggctatgtaaatttgtacactctctttacaagaggcaaaatacatataagagaggttatgtaaatttatacaccctctctccttcaatatataatttaatcgggtaatggagaataagtattgtttattgagatggtattgtttaggtgttggagaaacacagttttatatgttaatactacactcatacactgctcactatgcaactattctattgtttgagatagcttttataaatccgaagatacaattgcaattagaaggaaagcccaggggttagccactcacaccgttcgtttcgtatatcccgcccccgccccccatcttatcacaacggcactccatcgcctcatcttatccgccggcctcctcacgccgtcgctgctgcctgctcactccccactcccgactccccgacgcacgagctcccaggagttagccatggcctccaccaccctctcctccgccttcagcctcctctcccgcccctccacctccccgtgccccgccgtctcgctcccgaggtcctccttccccgtgcctgacagccgccggagacgccgcgccgtcaccgtcgcgtccaccgccaccgagtcccccaaggtcttggagctcggggacaccattgccgggctcactctcgaggaggcccgcaaccttgttgaccacctccaggagcggctcggcgtcacagctgcggccttcgcgccggccgccgtcgtcgcagcgcctggggcgggcggcggggccgcggccgaggaggaggcccccgttgagaagacggagttcgacgtagtaattgaagaggtgcccagcagcgcgcgtatcgccactatcaaggtggtgcgcgtgctcaccagcctcgcgctcaaggaggccaaggaccttatcgagggccttcccaagaagcttaaggaggccgtcagcaaggacgaggccgaggatgccaagaagcagctcgaggaggtcggcgccaaggtgtctatcgtgtgacactaggtatactgactccttttttttttcttcttttttttttaaatttctttctttgatctttgcctcccaatcttttgtgtatccccattgtcgtttataaggaattgctgtttgatgatatgaattcagtgtgaatgtgacatgcttaaaactggtaatgtagatttgccttgttggcactatcattacttcatgacggtgaacaatagggcattttgctttccttattctgttgcttgcaattgctagtagcctttgtagtgggttgcattgtattcgttattattcgttacaaatgtcatctaaaaaattgtctgtaagaaaggtactacaaacgttttctatttgattatactttcatttaatgtgtattcttccttttataatttgtttccatacatttagcatctaagagatcaaaactgttttctctcgtatctaataaacagaataccccgccgcgtcgtacgctggtctggctgaggccacgcgcccacgccttctgttggtctgtgcaaaagccgtttggtctctatttgcatgccgatgccgtcgcgttagctgttcaacctcggttcggaaagataacagaataccccgacccttgcgcgttgcggacttgcgcctaccctatataataaaccgatctacgctgtgcctccatcaaataaacacttgcatctacgtattgttagctagctggctctcgacaagacaaggtgatcaagggacgacgactacagcgcgcgcaagccgtccgtgtcctctcctccctgccggcgccggcgcaatgacgttcgcgtacgacacggacgtcgtcatggacgacggcaccatcatcaaaactaccgtcaccaactccggcgacgccaccaagctcttcctccgcgaggtgcgccagaccagaaagcccctgatcgtgggtctggacaccgagtggcgcgtcattcgccgacagggccggcgcccgcgcaaccggatggccgtgctgcagctctgcgtgggccaccgctgtctggtcttccagatagtcgcggccgactatgtcccggccgcgctgaaagccttcctcgccagcccgcagcaccgcttcgtcggcgtcgtggtcgacgtcgacgtagagcgcttgcgctgcgactgcaacattgtggtcaataacactgtagacctgaggtatgccgcggccgacgtgctcggccggccgcacctcaggacggcggggctcaagatcctcgcccgcgaggtgatgggagtggaaatagagaagccgaagcacctgacctgtagcgagtgggacagacctctgtcgcaggcgcaggtccgctacgctgccattgacgccttcgtgtcatacgaggttggccggctggtgctcaccagggagcacgcgcaagatgcggccttcaccggtgcaatgacgatattgccgtcgcagttgccgtaaatgtgcatagttttacttagttagtgtagggattgtttacatggtgtatctcgcacatttattcattggtttaaagaaaatttggattcttatgttttttttcaaaaaaaaaaaaaaaatggtcctccacacaagttcttcgcctcgaccgttaaagctgataatgatctgggcttcaacccggtttatgcggaatttgtttctgttttgggctaatccagtttggtttgttagagcaactccagcagttgtctaaaagacttcctaaatcaataatttagctagttaatataaaaactcatctccaacagttatctaaataaactttctaaatttaacaactcattatcttagagcaactccaatagttatgtaatttttagctctctaaatcacagatttaagaagttgctaaataactttaggagtaaaaaaatgtgagttctccaatagttctctaaatataggttgtagttttgtttttgtatctatccacataaaaaaataaagtcacaaatgtcattaattaccttcattatctatataatgcagtaaacatttttttagagagttgctaaatggttgccaaatgtagagaggaaataaag

SEQ ID NO: 4797 - DNA, 1002 bp, Zea mays
accgttcgtatatcactctccccatcttagcccgccggcccccatcgcacgcactcctcatcttatcccccgcctcctccggtcctcccgccgctgttgctcacttctgagtcccgacgcacgagctcccaagagctagccatggcgtccaccaccctctcctccgccttcaccctcctctcccgcccctccacctccccgtgccccgccgcctcgctcccgaggtcctcccacgccgcgccccacatccgccggggccgccgcgccgtcgccgtcgcgtgcaccgccaccgagtcccccaagatcctggagctcggggacgccatcgccgggctcacgctcgaggaggcccgcagcctcgtcgaccacctccaggagcggctcggcgtcaccgccgcggccttcgcgccggccgccgtcgtcgcggcgcccggggcgggcggcggggccgcggccgaggaggaggcccccgtcgagaagacggagttcgacgtgatgatcgaagaggtgcccagcagcgcgcgtatcgccactatcaaggtggtgcgcgcgctcaccagcctcgcgctcaaggaggccaaggaccttatcgagggtctccccaagaaggtcaaagaggccgtcagcaaggacgaggccgaggacgccaagaagcagctcgaggaggtcggcgccaaggtgtctatcgcgtgacactaggtatacgagtactcctttttttttctttagtttcttttgtttgcatccccaatctcttgtatccccactgttgttcgtaaggaattgctgtttcatgatatgagatttgtgtatgtgtcgattcactagcttgtatgtgcgtgatatatctctgccttgaattggcagtgaatgtgatctgctcgaaactggtaatgtgtatttgccttcttggcactatcattaattcatgatggtggacaaatggacattttgctttccttgtaaaaaaaaggaatgaaacgccccaatttgctagcagtc

SEQ ID NO: 4798 - DNA, 2707 bp, Zea mays
  misc_feature (1990)..(1990): n is a, c, g, or t
gatgtgcaacacattacttttagaaatgtgttttcaaagttagcaaaactgagtctcattccttgacaatttcagcaactcgtgcatttaactcctgaaactcttaacttggcgaacataactatagttgctcgatacaatgggggttgaggttagggcccacggacacgacccatttaaggcatatccatatagatgcacgaaaaagttataaattataatttatttcatactttcatatactcaaagctggagttgatactagttatatgttttttgcagttttgaattggaagatgcgatataattttaactttactatgaacattagacaataagctaattttatggactttatctagagcgagttgtatttttccccttctaacaaaaagtttttttatgaataagttattgtgcaactctaataacttaatagatacattaagttttcttttagttaaatttgtttgtcttatttttattatttttattaaatgtattttgaattttaggatttaatacgaaggtagaaattaaattttgggtttttataattcctagagacaacttgtacacagttgttaccgacgttaattaccctctttctctcaaaaaccgaaactatccaccggcactctcgatattgagtgattgatttatatggattaatttttagtcccttcattttattctattttagtctccttaaatatgaaaattaaaatatagttttaatttctatatttgataatttatagactaaaatgaaataaaatgttagtacttataaaacaaacaccccttaattacctctctcgaaagcgaaactatccactggatgtatcattataggttttttgtgagtaaccacttcatactaaagggcgtactttagtactattatagtgtaaaatttagagaatattgtcacccataagtaatatacatcgcaagttgattactaaaatttaataaaataattttatttttatactaattattgagttgtaaaaaaataagataacaatatacacaaaccaaaaggaagaaataaaaaataaataagaatgaatagaggatgcgctaactcctaactcattcggcactcttgtggccgtttcggcgtttcgtttcattctgtcttcgtcctcgcgtctgctccggtcgcaggaggcaggatcgctcggatgctccgtcctccatccgcacggccccgctccctgctgccgccacgcgaccatcgccgcagccacctcaccgagtacccccgcgcgcgggtcctgccaccgagccctccacgaccccgtggccgcgcccggcccggtcgcaccgcgctccgctggaccccagtaccatgtctccaagatccactctgaccttgtaggaacaccaattccaacgattctgacggctcgcgctttcatcgaagagttgatccttgtcaggcttgtgatccgcagccgcctctgcctgatcctgctcagctccggccagccgccgctccgccggaggcctcacgctcctcaccgcgcccgtgcttaccctgaccccaccctcactttgctcccttgaactacggcgtcatcatcgacgccgacagcaggggaagcgcgtctccgcctgatgcccggatgatagtttgaccatgttcgcaatccgttcgacgaaatgccctgtggcatttgtgggcgtagctggcaccttggtggtgcttatcaccgctgtccatgtgttcatggtgccaatacttcctgcctccttctattacttcggttctcgcagcagtataagccacccaaagaatgtcctcccagccgtcgaggtggttgactcgcgcctcaaggggtgtttcccttctgattcatatggtgctgtggcattccgaggcgcgccatggaaggctgagattggtcgatggcttgctgggtgtcatgctaactcttcgtctgttgatgttactgaggtttgtacccacccttgttactgnttgtgcgctttgacttagctttttattgggttaatttaggtttctcttctgcgacaggccatgggtgcaaaacgctgcgtgaaagactgcagtgctcgtggtgtttgcaactataatctgggagagtgcagatgctttcatggatattctggttgatcttacttctcagtattcactttctattaataagagtccatgcactaataattcaatacttgggatcttgaagggctggcttttaagaacttaatactagaggctagagccaaataaaaaaaaggtaacaatatcatttgatagagttaggtagcacaaaatattaatcatgcattcttatattggatacagcaatgcaacctacaaatgtcttcctaaccatgtgtacagcatttttttcacagatcttataaaatttcatctctgagtacgctcagtatatctcctttcatctgtggcatactctgtttagatcacttgaaagaacacagaacatgtattttgtatgtctgaaagaatatatacctttcagtttattgtatatgaatttatggattaagaattgcagcatcgaagcctcatatgttgttttttttactacaaatacctgttgttggatttgagctctgtgagtgacctaggtgaaatgggaactgaactactgtgttaaacttatgtgatcatagccttgtctgtggagtgtggacatatatttctgca

SEQ ID NO: 4799 - DNA, 2936 bp, Zea mays
ccggtcgcaccgcgctccgctggacccgcagtaccatgtttccaagatccactctgaccttgtaggaacaccaattccaacgattctgacggctcgcgctttcatcgaagagttgatccttgtcaggcttgtgatccgcagccgcctctgcctgatcctgctcagctccggccagccgccgctccgccggaggcctcacgctcctcaccgcgcccgtgcttaccctgaccccaccctcactttgctcccttgaactacggcgtcatcatcgacgccgacagcaggggaagcgcgtctccgcctgatgcccggatgatagtttgaccatgttcgcaatccgttcgacgaaatgccctgtggcatttgtgggcgtagctggcaccttggtggtgcttatcaccgctgtccatgtgttcatggtgccaatacttcctgcctccttctattacttcggttctcgcagcagtataagccacccaaagaatgtcctcccggccgtcgaggtggttgactcgcgcctcaaggggtgtttcccttctgattcatatggtgctgtggcattccgaggcgcgccatggaaggctgagattggtcgatggcttgctgggtgtcatgctaactcttcgtctgttgatgttactgaggccatgggtgcaaaacgctgcgagaaagactgcagtgctcgtggtgtttgcaactataatctgggagagtgcagatgctttcatggatattctgggaaaggatgtgaggaggttctgaacttggaatgcaaccttccaagttccccagaatggcctgtaggtcaatggatagtttccatctgtgcagctcactgtgataaaacaagggcaatgtgcttttgtgggcctgggacaaaatacccagatcgtcctgtggcagaagcttgtggtttttaaacaattctacctgccaaacctgatggtccaaagcgtactgattgggaaacacctgacctggaaaacatactgacatcaaacagcagtaagcttggatggtgtaatgtggtccctgaggacgcgtattcatccaaagtgaagtttaaagaagaatgtgattgcaaatatgatggtctctgggggcagttctgtgagacacgtgttgaatgcagctgcatcaaccagtgctctggacatgggcattgccgtggtggtttctgtaaatgtgacagtggatattttgggattgattgcagtatcccatcagcatattcgcttgcatatgactggccctcgtggctccagacaccagtgaatttaccagatctgaaaactttgaacagtaccaccattggtgttaaggccgttgttcagaaaagaaggccactgatatatgtatatgatttgccagctgagtttgacagtcatcttcttgaaggacgacattacagattccagtgtgtaaacagaatatatgatgacaagaatagaactatatggacccagcaattgtatggtgctcagatagcacttcatgagagcattcttgctagccctcaccgcactcttaatggggacgaagctgattatttctatgtgccagtgcttgactcatgtctaataactagatccgatgatgctccacatcttctattgccggagctaccatgcacttgagtactatagaatggcacatggtcacatagctcagcagtatccttactggaaccgcacttcgggaagagaccatatctggttcttttcatgggatgaaggtgcctgctatgcaccaaaagagatttggaagagcatgatgcttgtccactgggggaacactaatacaaaacataagaattcaacgacagcttattgggcagataactgggatgatattcctttggataagagaggcaaccatccatgttttgatccaagaaaggatctagtgcttccggcatggaaggaacctaacccaggggccatatggttaaaactgtgggcaaggccaaggaacaaccgtacaacacttttttatttcaacggtaatctaggttcagcatacgaaggaggccgtccagaagacacgtatagcatggggattcggcaaaagctagcagctgaatttggttccacaccaaacaagcagggaaggcttggacggcagcatgcggccgatgtgacagttacctatctacgaactgaaaaatattatgaagaactagcaagctctgttttttgtggtgtcctgccaggggatggctggagtggccgtatggaagatagcatgcttcaaggatgcattcctgtaataattcaggatggaatttttctgccatatgagaacgtgctcaactacaatagttttgcagtccgcatacaggaagatgacatcccaggcctcataagcacactccgaggaataaacgatacgcaagtagagtttatgctgggaaatgtccgccagatgtggcagaggtttttctatcgagactctatattgttagaggcgcaaagacagaaaagactcttctctgaagaggcaccctggtctgttgaggtatcgaaacttcctgatgacgacgatgtctttgcaacgtttatacaggtattgcattataaactgtacaatgacccttggcgtcaagatttcctgcaaacaaaggatactcggctgccgaacatctgctcaagaacatcctgaagcgtttagtcaggcagcattgcaaccgtaaagaataagcatatattcttaggaacaaaagtacaaaactgtagatatttcttgcattctggacaattgttcttctgactgatagcccaatttaattagaccatttcctgaaaaaaaaaggaaagccaaatgccccggtttcctccttccaaaacatggatagcatacatcgcatttacagctctggtgtttgcagtcccaagctacatcgattttcaccgagaaagaattggattttgttgtcc

SEQ ID NO: 4800 - DNA, 1184 bp, Zea mays
ccacgcgtccgtggtcatgccgcctttggagccaccggccgtatagccatctcaataatcctgtatgtggaactgtatgcctgttgcatcgagtatctgatattggaaggtgacaatttatcaaaattattccctaatgcgcacctgagcgttgggagcttgacaatgaactcccatgtacttttcacaatcttgactaccatcatagtcatgccgaccacttggcttcgtgaccttagctgcctgagctacctttcagctggaggtgtttttgcatcaatccttggagtcatctgcctattctgggtaggagttgttgataatgttggctttgagaacaaaggaactgctctgaacctccctggaatccctattgcaattggattgtatggttattgctactcagggcatggggtgtttccaaacatctactcttctctgaagaagcgcaatcagttcccttcaatcctttttacttgcattgggctgtctaccattttatttgctggtgcagcggtgatgggatacaaaatgtttggtgaagccacacagtctcagtttacactgaacttaccagagaatttagtggtttcaaagattgcagtttggaccacggtggcaaatccaataaccaaatatgcattaaccataaccccactgactatgagtttggaagagttgcttccaccaaatcaacagaagtactcaaacatagtcatgcttagatcagccctggtggtgtcaaccctcctcattgctctatctgtacccttttttggacttgtgatggccttagttggttctttacttacgatgcttgtgacctatattctaccttgcgcgtgctttttagcaattcttaggagaaaagtgagctggcaccaggtagcagtatgctcgttcatcatcgtggttggggtttgctgcgcttgtgtgggaacatactcgtctctgtcaaagataatccagaactacacatgatacagttgttcctgcaatccaaatttatgtccaaactcaatgagccaaactgcccagcaaattagtcaagtcgatgtatcataaatttgtgagatgtccatgtttgcatgttaatggatcaacacaaataatacgtttgtggcaaggatttgagacaatatttatgaacaaaagatgaggttgattttgtgttgtggaaaaaa

SEQ ID NO: 4801 - DNA, 1124 bp, Zea mays
agaggtgtctcgatccgacttggtatttggcggctccactgctcacgtcacgtgccgcccgcgttctctctccgactcccatgcctctccggtgagctagtctggtatccatcggcgagctagttttgtctccaccggcgagcacgcgtctgtaacctcctccacccccatcgaactcctcctgctctccaatccgctagatctcggctccgtgcagctatgctgattgtgaggaatttggtagcacctctatcagggtttttaaactagagtgctgccgccccagcatacataatatggacgaagaaaatgttgttgagctgctgcaacgttatcgccgtgaccgtcaagtattactcaactacattctttctggcaacttgatcaagaaagttgcaatgccacctggtgcaatctctttggatgatgtagatatagatcaagttagtgttgattatgtcctcaactgtgctaagaaaggtgaacctcttgaccttggagacgccatccgcctttttcatgatagccttgactatccatatgtgaataacactggagctgtggatgagttctatttgcttacaaaaccagaatattcaggaccagctccaacacgagaaccaccacctatcccagccactgcaccatcatcagttgtggtaccaccaccggatgtggaaccagcaccaattattgtgtcatcgccagtcacagctaccaacttgccaaaatcacaaccatttgattctccgaccgagaaggagttaactatagatgacattgaagactttgaggatgatgaagatgaatttgatgggcgaagggcttctagaagacatcaaactgacgccagtgatctatcgttgctgttaccactatttgaaacaggtatcacagataatgatcttcgtgagacagcatatgagatccttgttgctgctgctggtgcttccgggggtcttatagttcctcagaaaaaaaaaaaaaaagagaagagacacagattgatgaggaaactcggtcgtagtaagagtgaaagtgtggatatcaacactcaacggcaacctggtttagttggtttgcttgaaaccatgcgagctcaacttgggattacagagtccatg

SEQ ID NO: 4802 - DNA, 1013 bp, Zea mays
actgctcacgccacgcgccgcccgcgttctctctccgactcccatgcctctccggcgagctagtctggtatccatcggcgagctagttttgtctccaccggcgagcacgcgtctgtaacctcctccacccccatcgaactccacctgctctccaatccgctagatctcggctccgtgcaggttacgtggatggctgtgtggtgttgctttgctcgctaatttggttggatcaggagtgtcctgggagctatgctgtgctgattgtgaggaatttggtagcacctctatcagggttttaaaactagagtgctgccgccccagcatacataatatggacgaagaaaatgttgttgagctgctgcaacgttatcgccgtgaccgtcaagtattactcaactacattctttctggcaacttgatcaagaaagttgcaatgccacctggtgcaatctctttggatgatgtagatatagatcaagttagtgttgattatgtcctcaactgtgctaagaaaggtgaacctcttgaccttggagacgccatccgcctttttcatgatagccttgactatccatatgtgaataacactggagctgtggatgagttctatttgcttacaaaaccagaatattcaggaccagctccaacacgagaaccaccacctatcccagccactgcaccatcatcagttgtggtaccaccaccggatgtggaaccagcaccaattattgtgtcatcgccagtcacagctaccaacttgccaaaatcacaaccatttgattctccgaccgagaaggagttaactatagatgacattgaagactttgaggatgatgaagatgaatttgatgggcgaagggcttctagaagacatcaaactgacgccagtgatctatcgttgctgttaccactatttgaaacaggtatcacagataatgatcttcgtgagacagcatatgagatccttgttgctgctgctggtgcttccgggggtcttatagttcctcagaaag

SEQ ID NO: 4803 - DNA, 1361 bp, Zea mays
cctcgcggccgcggggatatcgccgtctgcccgtctctactgggaagggaagggagcacctgcctgctcctgcgcggcggcggttgagcggcgtggaggaggcactacccgttcttctgggctgtcaggccttccgtaccgccgccgccgtcgccactcccactcccacagccgcgcacgcgcttctcctcctcctcctcactgcgctccaccaagagatccgccgcaaagacgtcaatggactcgtcttcagtcggtgaacccttctacgtcgtccgcaagggggacgtcatcggcatctacaaaaccctcagcgaatgccaagctcaagtcagcaattcggttcgcgacccttctgtcaccgtcttcaaaggctactcgctgcgtaaagacaccgaggaatacctcgccgcgcgcgggttaaggaacgctctctacgccattgatgcaacagatgcacgagatgaattgttcgacgatctagttccctgccctttccagcaacctgatggagctgcatcgtctactctgaaaagatcacaggagattgaaatcggaccatcaaagaagcatcccaaagttgatgagcaggtaccattacctgatagtcatctctcttgtattcttgaatttgatggtgcctctaaaggaaatccagggaaagccggtgctggagcaataataaggcaggtagatggttccgtgattgctcaactacgtgagggtctgggcattgcaaccaacaatgctgctgaatatcgtgcattgatcctagggctaacatatgcagccaagaaagggttcaagtatattcgtgctcaaggcgactctaagcttgtttgtaaccaggtccaagatatctggcgtgttaagaatgataatatggctagcttctgcaagaaagtgaaggagctaaagggaacatttcatttattccaaatcagacatgttttgagggaatataattcggctgctgatgctcaagctaactttgcagtagaacttcctgttggtgaagttcaagagcagtcgaacttcccatgctagcagttgtgttgtggtcaagtgtggtttgtgcatcgctaaggttctgggactgaagctatgtcacatttgttcagttctcattgacacaaaaggaagagacgaaacaacagttgtattggaagtggtagtgggtctgatatatctgcggagtattgaacagacagatgcaatattgagtagattcttaggaaatttaatcgtctcaaacttctagatagtgcgagttgatttgtccaggaccagtgtttgctgatatacgatgtttgtattcagaacagtattagtaccggaaactttaattgctcctttctctt

SEQ ID NO: 4804 - DNA, 1501 bp, Zea mays
gcgcgccgcccgccgccccgggaaagggaagggagcacctgcctgctcctgcgcggcggcggttggtaagccccacctccggtcccagcctggccagacttctgcccttctcctccgcctctctaatggtgattcgcagttactcttctttccactgtgggttgctgatttccagagcggcgtggaggaggcactacccgttcttctgggctgtcaggccttccgtaccgccgccgccgtcgccactcccactcccacagccgcgcacgcgcttctcctcctcctcctcactgcgctccaccaagagatccgccgcaaagacgtcaatggactcgtcttcagtcggtgaacccttctacgtcgtccgcaagggggacgtcatcggcatctacaaaaccctcagcgaatgccaagctcaagtcagcaattcggttcgcgacccttctgtcaccgtcttcaaaggctactcgctgcgtaaagacaccgaggaatacctcgccgcgcgcgggttaaggaacgctctctacgccattgatgcaacagatgcacgagatgaattgttcgacgatctagttccctgccctttccagcaacctgatggagctgcatcgtctactctgaaaagatcacaggagattgaaatcggaccatcaaagaagcatcccaaagttgatgagcaggtaccattacctgatagtcatctctcttgtattcttgaatttgatggtgcctctaaaggaaatccagggaaagccggtgctggagcaataataaggcaggtagatggttccgtgattgctcaactacgtgagggtctgggcattgcaaccaacaatgctgctgaatatcgtgcattgatcctagggctaacatatgcagccaagaaagggttcaagtatattcgtgctcaaggcgactctaagcttgtttgtaaccaggtccaagatatctggcgtgttaagaatgataatatggctagcttctgcaagaaagtgaaggagctaaagggaacatttcatttatttcaaatcagacatgttttgagggaatataattcggctgctgatgctcaagctaactttgcagtagaacttcctgttggtgaagttcaagagcagtcgaacttcccatgctagcagttgtgttgtggtcaagtgtggtttgtgcatcgctaaggttctgggactgaagctatgtcacatttgttcagttctcattgacacaaaaggaagagacgaaacaacagttgtattggaagtggtagtgggtctgatatatctgcggagtattgaacagacagatgcaatattgagtagattcttaggaaatttaatcgtctcaaacttctagatagtgcgagttgatttgtccaggaccagtgtttgctgatatacgatgtttgtattcagaacagtattagtaccggaaactttaattgctcctttctctatgttggttacttggttaaggttgagtgttgcttataaaaaaaaaaaaaaaa

SEQ ID NO: 4805 - DNA, 2057 bp, Zea mays
aaggcccaactccactcatcgccactgcgccgaaacccaaagcggggaggaggagcggaaaagaaaaggaaaatgggaggagcggaagcaagtccgagcaagtcagaggatccgccggcctatctccgcctataaaatgccgtcccaccccccaccttcctagcagctgctctccaccaagagctgctggcaccaccaaaccaatcgctggatttgtccagagtatttccggtttcaccgccctagatctgacccgagacgccgcgtcttcgctgagatggcgattactgtgaggcggtcgacgatggtgcgcccggcgcgggagacgccgcggcagcggctgtggaactccaacctcgacctcgtggtgccgcgcttccacacgcccagtgtctacttctaccgccgcgacggccccgtgccggatgcggaggggttcttcgacggcgagcggatgcggcgcgcgctggcagaggcgctcgtgccgttctatccaatggcgggccgcctcgcgcgggacgaggacggtagggtcgagatcgactgcaatggcgagggagtgctcttcgtcgaggccgacgcgcccgatgcctctgtcgatgactacggtgacttcgcgcccaccatggagctcaagcgcctcatcccgaccgtcgattacaccgacgacatctcggccttctcgctactcgtgctccaggtgacttatttcaaatgtggaggcgtctcccttggtgttggcatgcaacaccatgcagcggatggcatgtctggcttgcacttcattaactcatggtctgacctctgccgtggagctcaaatttctgtcatgcccttcattgaccgcacccttcttcgtgctcgtgatccaccaactccatcttttcaacatatcgagtaccagtctgccccagctatgttgtcctccacaacccagttccttgcttccaagtcaaagccacctgccactgctgtggacattttcaagctcactcgctcagaccttggccggctgcgctcacagcttcctgcaggggaaggtgcaccccggttcagcacatatgcagtgctagcggcacatgtctggaaatgtgtctcccttgcacgcagcctacctcctgaacaacccaccaagttgtattgcgccactgatggccgtcaacggctacagcctccactaccagatgggtactttggcaatgtcatcttcaccgcgacaccacttgctgaggcgggcaaggtgaccagtgagctggcagaaggagcagcagtcatccagggagcactggataggatggacaacgactactgccgctcagcgttagactacctggatcttcaaccggatctgtcagcacttgtgcgtggagcgcataccttccgctgcccgaacctagggctcaccagctgggtgcgccttcctatccatgatgctgacttcggatggggccggcctgtgttcatggggccaggtggcattgcgtatgaaggtctggcgtttgtcctcccaagtgcaaatggcgacggcagcctgtccattgctatctcgttgcaggctgagcacatggagaagttccggaagctaatcggcggtgccaactgttgaaggaggatgtcatagggcgagagggattatgctccgcccaaattctcagataaaatactgaagtttcaagtgaacccagtggctgcactttcactttgaagacttgcagaggaaattcatggtcacttcattttgtgaggttaattatagagaaagggtagaaattatatgaagaaacatagtaaaaaatcattgttaggaacaaactccaatagcaggctctacttgtacgtcgcagacataagctgagactgatctgcgattgcaacagattatactcttctatcaggttgactgaagttccctcgaaaaaaaaaaaaaaaataaagccaaaaaacaatgatccgcccaagcaaagcttgctcaaaacaatgggcaaaggtcgtcatgcatgctacaattacaatactccaagcattagtcgacataagggcgacatggtgtattatgt

SEQ ID NO: 4806 - DNA, 4013 bp, Zea mays
gggcaccaagagctgctggcaccaccaaaccaatcgctggatttgtccagagtatttccggtttcaccgccctagatctgacccgagacgccgcgtcttcgctgagatggcgattactgtgaggcggtcgacgatggtgcgcccggcgcgggagacgccgcggcagcggctgtggaactccaacctcgacctcgtggtgccgcgcttccacacgcccagtgtctacttctaccgccgcgacggccccgtgccggcggcggaggggttcttcgacggcgagcgtatgcggcgcgcgctggcagaggcgctcgtgccgttctatccaatggcgggccgcctcgcgcgggacgaggacggtagggtcgagatcgactgcaatggcgagggagtgctcttcgtcgaggccgacgcgcccgatgcctctgtcgatgactacggtgacttcgcgcccaccatggagctcaagcgcctcatcccgaccgtcgattacaccgacgacatctcggccttcccgctactcgggctccccgtgacttatttcaaatgtggaggcgtctcccttggtgttggcatgcatcaccatgcagcggatggcatgtctggcttgcacttcattaactcatggtctgacctctgccgtggagctcaaatttctgtcatgcccttcattgaccgcacccttcttcgtgctcgtgatccaccaactccatcttttcaacatatcgagtaccagcctgccccagctatgttgtcctccacaacccagttccttgcttccaagtcaaagccacctgccactgctgtggacattttcaagctcactcgctcagaccttggccggctgcgctcacagcttcctgcaggggaaggtgcaccccggttcagcacatatgcagtgctagcggcacatgtctggaaatgtgtctcccttgcacgcagcctacctcctgaacaacccaccaagttgtattgcgccactgatggccgacaacggctacagcctccactaccagatgggtactttggcaatgtcatcttcaccgcgacaccacttgctgaggcgggcaaggtgaccagtgagctggcagaaggagcagcagtcatccagggagcactggataggatggacaacgactactgccgctcagcgttagactacctggagcttcaaccggatctgtcagcacttgtgcgtggagcgcataccttccgctgcccgaacctagggctcaccagctgggtgcgccttcctatccatgatgctgacttcggatggggccggcctgtgttcatggggccaggtggcattgcgtatgaaggtctggcgtttgtcctcccaagtgcaaatggcgacggcagcctgtccattgctatctcgttgcaggctgagcacatggagaagttccggaagctaatcggcgaagcttaaacggtgccaactgttgaaggaggatgttattgggcgagaaggattatgctctgcccaaattctcagataaaatactgaagtttcaagtgaacccagtggctgcactttcactttgaagacttgcagaggaaattcatggtcacttcattttgtgagattaattatagagaaagggtagaaattatatgaagaaacatagtaaaaaatcattgttaggaacaaactccaatagcaggctctacttgtacgtcgcagacataagctgagactgagctgcgattgcaacagattatactcttctatcaggttgactgaagttccctcagtggccaatcttggatctgtctgcaggtgtgctgcacatcttagccctttttctgaggcttgaaaaagaaccccaaactgagattctcaattgctgcaggctgatgagatgcaactgagcacacagcctgaggttgtggcggtgtggcctgatctggcttgccattgtcggacatcgtcatcggcgccggggacaccgagcagttcgtcgaggcactagtttttcaacactgctgggtggtgagcagttctattacgccatgacgccaccttgcacaaactttacgttgcgattacctctgcatagcggcggtcctaacattctaagggcccgggacaaggtttcaaatagaggcctttcaaattatttttaatgtataaatgttactaattaaacactcaaaatacatctaaaaatatttatatcaaataataagtaaataaaagaatatatattatagtattactttaaaattttcttctaacatgtttagatattcattattttgttgatgggctatcggatcacgtgactagaattcggggtttatcgaccaatgtaccgctttgatcaagtccttgttgcaaacctgagctatagcctatgcctatcaagtacttagcttgtatgaggacgcgtgacgtaaaacaaaggacgcgtaaaatagaagacgcgtgactgcaaataatcttttttagagtgaatttagaaataaaggattaaataagagataagatagaagagctgctggaacggtcttatgttagggatccatggctcgtccaatatattagggagcaaaaacaataataataagtattttttttataatggatgtttttaatagaaaaatacattgattccttcccattagtaatgtatatagagatgtttaaacggagacaattgatagtatcggaagagagcatataaaaaggaacatgatcattaatttagtgcaaaacagatcaacgatattaacttatcagtccgtttggatgttagcattgagacagaggaattgtattggggtaggaatgccaaagctgagtggaaatggaaatggccttcaatctcattgttgttgtttgattgtatatataattggaaatgggatcgggagatcatccaaacaacggaattggaggttgtccaatgacacgctccaatgctaacttccaaatggggtatattagtaatttaggcccatttaggacggctctagctctataaaatttagtatagttagtggagaagatcactagatactctaagaatcgtggagatgtgagttaactttagatgacatttaaataagtcgattttatttattattcagattaaaaatatatctttaaatattaaatttaaaactaccactctatagtggagcgaatttggatcagttccaaatactcccaactaggtgcatctcaagctaaaaacacctatcctgacaccatgtgcaggtatctagattgcgtcccgtttctagcgagctacacttacccatgcaaccaatcacatggatagggcactaccaagctcgtctgtcgaactctgggaaggtcctcccatatcatagttgtgttgggtctctgctagagtgtgcatttaagctaggtgtaacaagctagcacaaagcacggggaaaaagcacgacccaagcacagtacgatatggaaaaatttcggcccggcccggctcgatgcaccggtcggcttgggccgaggtcctagcccgtttatgcaagcacaaaacggccttcactgtatattagcgggcatgtgttcatgcacgccttcagggtgacacagtccatgggctagtgcccatcgtccacccgccctcaagcctaagaccgtctacaacagtttattcatagtttacctaaaaacactattttacactgttatgcactgtacattgcaccagagtggagtttgaatatatgaatgaggatggataaactgctggatatagtataagaggcaagttgcccaaccaatgagccaaccatcggttgaactggaaccctaaacctaaatggccagacgcgagacactcaaacccacagcgcaaccgccctcgcccactttcccttcgccttgtccttccccaatccccagtcgccgaccgcacacattccatcttgccccttgcgctcttcactagccggcagccaccgcctgccctggccctacgttctataggctcgagcagcagggagcacacacatccagtgacaaccttccgccc

SEQ ID NO: 4807 - DNA, 2780 bp, Zea mays
  misc_feature (558)..(558): n is a, c, g, or t
  misc_feature (1046)..(1046): n is a, c, g, or t
agaatatcccagggcttgttcgattattcctatcacgtgtggattggatgagattgaaaaaaattatgaaagattttgatttatttaagactgaagcatatctaatcctatctaattcatatggattgagagtaaacgaataaaccctaagtgttagtatgaatcccgaggtgaaattctttggtcgtgaaaatggtatagagagttattccggatggagaattttctgttatcatccttaattgttgcggacggacaagcccgcgggctggaagtgccttgtccgcttgctttttcttaaacgaaaaaaataacgtacataattataaggaacttttttcgcttgcttttcttaaacgcgaaaaataacatacagtgattataaggaaaattttctgttgcgggaaaggaatgcgaaaggcgtgacaggccatttgaggattttgtgcttgtgggatactgggattgcatctgcagtcaacagcgagcggggattttcaatcagtcgggaaaattggcttttgtctcgactctagattctggactgggatacgcggncggcatctgcaacttccacgatatttatttaaggcagtgctccatgtactacgcggcagctgcggagggctgtatgccttttatgtcgtgtttggttctattagtcttaggactaaagtttagttcgagattaaactctaatccttattttatttagttatagagactaaacagattctaaatacattaaatacaacatataaaaactaaaatgtctctttttcttgtttaacactaattttctagataaggacaattaaaaatgaaagttgttctttagttccttttagcacccatgtaagggaagactaaaaataattagtccctactttagtccctctgtttggcaaaataaagactaaacagaactaaaaaccatgaattaaatattaatccctctaaccaaacaggtccttactatacaagagtataaatcgtaaccaacgtggtacggagggaactctatgcaatgcacctatacactgcancgtgagcagcatgcggcagcacatatacggtacaaaattaaaaatgatataatatataaaagttggtatatagttgagatagagtaaatatgactgcatagcattatggtatatagtaaatatgactgcatagcatttttcatactttcaaatttattgtacatttttttgttttattaaatctgttgtttaaaatattaaaatggattgaggagaggaaagagaaactttatatggagaaaatccagcagtgtcatctatatctagagaaccgtttagagaatgctgatggagacataaaggataggaatctcctctaatcttaggctatctccagtaacgtctcctaaatttcactttttaaaataatattctctgtattttacaacacactctaaaaatatcatcttttatatcttctcagtctccatagtaacatttcctaaattaggtcctctataattatagtggtatcatattaacgttttctaaattatgtcctctatataattatagtggtatcagatttcactatacatatactggtggtagcatgaaaacaacggtttatttttctgttcttctgctcaaccatttcgtcaaacatgtgcattgcaagctgttgtcgcctttcttccacagcttcactccaattgggcacaagaaaagaaatcgaagctacaagaataccgcgggcagcacggcggcctctgcgtcagccaagacgagccccgcgactgcgcctggtcgacgaccacgcactcgtcggcatcaggcacagccgagcgctcccagcgctcatgtctgttcatcggcgttggaaacgagctggtccccgccgtccgcaatccagcttcaccagcgtcaaagttgccccatcaggggcgtagcgcgtggctatggtggccggagctaacttgctagttttgggcacggcgaagcccgacgccagggccttgaacgcaggcatggccgctgctggtggatgcacgacgactagtggatgcacgacggtggccctgaacggcgactggtggatgcacggcggcgctgatgatggaccgatattttatcggaacttcgttgttgggcgccaccacgccatacaggacgttcgattgtctaaatttggtttacaggatggtctttgttggagagagttatagtatcataacagttcgaaggctacaagccttccaagattggaggctctcactcgacggtgacacgaggattttcagtgctctgctctaccaactgagctagcctgaccctttcttgtgcatcatcttattaaagtatttacatctatgtcaattaaagggactaaaaaatcaataaagtattacattcaaaattaggaaatgggaggggtagtctatgcattatggatggcttacttaataatacttaaaaaacgaattaataatcgagattccttgccgatactctactctaataaataaaaaaagaaatcatctatttaatgaatagcataagattcattgagttcttgtcgcactcctttgtgaaagagtagaatgagaaagctagtgaatcttaaacccattgataaaagaaaaaatacaagacaccccagcatcggacaacttctctctcccctggttctggcgtgccactgctcatctgcgctaacactgtttgctaccgtagccgtgggtccgctagtaattgttagtagaaaacaaatgatagtagataaaaaatagtaac

SEQ ID NO: 4808 - DNA, 1644 bp, Zea mays
acattgggcacctcgaggccggccggcgcggcggaccaccacgcctgttctcagtcacgctagtagtaggaaatcctagcgcgtcgctgcttccattaccgcctccgcaaccagcccgccgcgcccccgagcgtttcgttccgggagcggcgagactgggacacgccagccctttatttcgagctttctgcgtgcgggaggggggttgacaggcgatggcggccgagggcgaggcggcggcgctggagttcacaccgacgtggatcgtcgcggcggtctgctctctcatcgtgctcctctcgctcgtcgctgagcgatgcctccactacctcggcaagacgctcaagaggaagaaccagaagccgctcttcgaggcgctgctcaaggtcaaagaagagttgatgcttctggggttcatctccctgctgctgacggtgttccaggggatgatccggaggacgtgcatccctgaacgctggacattccacatgctgccatgcgagaagccagatgagaaggccggtgaggccgccaccatggagcattttgttgctgtagggacgcttggcaggatcggtaggcgtctgttgcaggaaggcactgctggggctgagcaatgccagaagaagggaaaagttccacttttgtcccttgaagccatacatcagctgcacattttcatatttgttttggcaatcacacatgttattttcagcgtcacaactatgcttttaggaggtgcacagatacaccaatggaaacagtgggagaatggaattaaaaaagatgctcctggaaatgggcctaaggtaaccaatgtacatcatcatgaatttatcaagaaacgtttttaagggtattggcaaagattctataatgttgagttggctgcattcttttggtaagcagttttatagatcagtatctaaatcagattacaccacaatgcgccttggttttatcatgactcactgccctggaaatccaaaatttgatttccatagatacatggtaagggttttagaggcagattttaagaaagtggtaggcataagctggtacttgtgggtcttcgtggtgatatttctgttgctgaatgttaatggctggcacacatactttttggattgctttccttcccctgctgcttctgttagccattggcactaagctggagcatgtcatagctcagctagcccatgatgtagctgagaagcacacagcggtcgagggcgatgtgatcgtaaaaccatcagatgaacacttctggttcggcaagcctaggattatcctttaccttatccacttcatcctctttcagaatgcatttgagattgcgtttttcttctggatactggtaagcaggtttttttttgcatcattcgtaaattgcattgagatttgagaactggacacaaccaacattgttgaccctcctttatcttttctagagcacttatggattcgactcgtgcatcatgggacaagttcgttttattgtgccaaggcttgtcatcgggtatttaaatcgttgaaaacgcatccatttcatgaggaaaagaaaaaaaacatcaatatgttatgttctcttgacacttgtatccacgctttgtacttgcagggtggttattcagcttctctgca

SEQ ID NO: 4809 - DNA, 1946 bp, Zea mays
accacgcctgttctcagtcacgctagtagtaggaaatcctagcgcgtcgctgcttccattaccgcctccgcaaccagcccgccgcgcccccgagcgtttcgttccgggagcggcaagactgggacacgccagccctttatttcgagctttctgcgtgcgggaggggggttgacaggcgatggcggccgagggcgaggcggcggcgctggagttcacaccgacgtggatcgtcgcggcggtctgctctctcatcgtgctcctctcgctcgtcgccgagcgatgcctccactacctcggcaagacgctcaagaggaagaaccagaagccgctcttcgaggcgctgctcaaggtcaaagaagagttgatgcttctggggttcatctccctgctgctgacggtgttccaggggatgatccggaggacgtgcatccctgaacgctggacattccacatgctgccatgcgagaagccagatgagaaggccggtgaggccgccaccatggagcattttgtagggacgcttggcaggatcggtaggcgtctgttgcaggaaggcactgctggggctgagcaatgccagaagaagggaaaagttccacttttgtcccttgaagccatacatcagctgcacattttcatatttgttctggcaatcacacatgttattttcagcgtcacaactatgcttttaggaggtgcacagatacaccaatggaaacagtgggagaatggaattaaaaaagatgctcctggaaatgggcctaaggtaaccaatgtacatcatcatgaatttatcaagaaacgttttaagggtattggcaaagattctataatattgagttggctgcattcttttggtaagcagttttatagatcagtatctaaatcagattacaccacaatgcgtcttggttttatcatgactcactgccctggaaatccaaaatttgatttccatagatacatggtaagggttttagaggcggattttaagaaagtggtaggcataagctggtacttgtgggtcttcgtggtgatatttctgttgctgaatgttaatggctggcacacatacttttggattgctttccttccccttattcttctgttagccattggcactaagctggagcatgtcatagctcagctagcccatgatgtagctgagaagcacacagcggtcgagggcgatgtgatcgtaaaaccatcagatgaacacttctggttcggcaagcctagggttatcctttacctgatccacttcatcctctttcagaatgcgtttgagattgcgtttttcttctggatactgagcacttatggattcgactcgtgcatcatgggacaagttcgttttattgtgccaaggcttgtcatcggggtggttattcagcttctctgcagctacagcaccttgcctctgtatgcaattgtaacccagatggggagctgctacaagaaggagatcttcaacgagcatgtgcagcagggcgtcctgggctgggctcagaaggtcaagatgaaaaagggactgaagggagctgcatctgctagcaaggacgaatcgattaccaatgccgattcggcaggaccttccgttaagattgaaatggcgaaggctggggaggatgttgagatcgttggaaacacaggttgattgggacaatagggtgcccgtgttgtaatgatgtaacaggctaatatgccatcatcttttttttgtagatactagatagcttgctgtggcaataccgcaatagcggtgaactagagaaggtttgggcccgggagcctcatctgttatcggtccagtaggaagcaaattcttatatacgggatatcgataaaaaatgaactaagttcctggatttggttccattaccactaaaaaaaaaaaaaaaaaaaaaaaaaaaaaaaaaaaaaaaaaaaaaaaaaaaaaaaaaaaa

SEQ ID NO: 4810 - DNA, 845 bp, Zea mays
tcgagggccggctcgaggccggccgggacgggagaaaatctccaaacgcagcagagcccctcgcgccgccgacctcttcagcctcgcagcacaccgccgccagcccgagtgaccgctgcagcctagggtttccggcggcgatggcgggtaagggagggaagggtctgctggcggccaagacgacggcggccaagagcaccgacaaggacaaggacaggaagaaggcccccgtgtcgcgctcctcccgcgccggcctccagttcccggtgggtcgcatccaccgccagctcaagtcgcgtgcctctgcgcacggccgcgtcggcgccaccgccgccgtctattccgccgccatcctcgagtacctcaccgccgaggtcctcgagctggccggcaacgccagcaaggacctcaaggtcaagcgcatcaccccgcgccacctgcagctcgccatccgcggggacgaggagctcgacaccctcatcaagggcaccatcgccgggggcggcgtcatcccgcacatccacaagtcgctcatcaacaagaccgccaaggagtgaatcaaggccgtgctgctgcttctgcctgactacagtcccatctcgttctgtacttgtgcaatctgagtttaagtgcatgttggcacagttctagtaaactcatcctgttcacctatgcttctatcttgttaatttaagctctattccgcgagctttttggattgcaggtatcgtgattaacgggttcgtaaaattagtacgtcgaaccttgcaattgaatccgattgtttggttctttttttttgctaaaaaataaaaaaaaaaaaaaaagcggcctcgagctccagc

SEQ ID NO: 4811 - DNA, 759 bp, Zea mays
cattgggtacctcgaggtccggccgggacgggagaaaatctccaaacgcagcagagcccctcgcgccgccggcctcttcagccttgcagcacaccgccgccagcccgagtgaccgctgcagcctaggtttccggcgccgatggcgggtaagggagggaagggtctgctggcggccaagacgacggcggccaagagcaccgacaaggacaaggacaggaagaaggcccccgtgtcgcgctcttcccgcgccggcctccagttcccggtgggtcgcatccaccgccagctcaagtcgcgtgcctctgcgcacggccgcgtcggcgccaccgccgccgtctattccgccgccatcctcgagtacctcaccgccgaggtcctcgagctggccggcaacgccagcaaggacctcaaggtcaagcgcatcaccccgcgccacctgcagctcgccatccgcggggacgaggagctcgacaccctcatcaagggcaccatcgccgggggcggcgtcatcccgcacatccacaagtcgctcatcaacaagaccgccaaggagtgaatcaaggccgtgctgctgcttctgcctgactacagtcccatctcgttctgtacttgtgcaatctgagtttaagtgcatgttggcacagttctagtaaactcatcctgttcacctatgcttctatcttgttaatttaagctctattccgcgagctttttggaaaaaaaaaaaaaaaagcagccacccccaaaaaaaaaaaaaaa

SEQ ID NO: 4812 - DNA, 1323 bp, Zea mays
tctaatcatggctgtctttgcttccatggcgatgcaagtcacactgacaagccccatcctaagcctaaagcttggccttcgttaagacaaagaaaagaaaccactttggcactctctcgtataaatagctccgtcccatcgtcgtcatatctcgcgggctttcccgcaaacctgcaagatcaacgtcgtcgttcaagccagcggtagtagagactacgaccgaggctagctaagctaagagatggcggatcaccagtactcggcgtggacgacttccgctgctcgtcatcgggtcttctcctgtgcgctcatggctcttgttagttttgtggctgcaggacgacccatggtgctcgccgacgccatcgtctttcacgtggcgaacaggtgcccgttcccggtgtggccggcgtccgcccctaacaccggccacccagtgctcgccggcggcggcttctacgtcccgcagggcaagtcgaggcgcgtcgtcgcgccggccaactggaacgggcgcttctgggcccgcaccggttgcaacttcaccgcgaacggcatgggcgtagcgggctgcctcaccggcgactgcgagggccggctcgcctgtaacgggtccgtgggcgccccgcccgccacgctagtcgaggtgagcctgcacgaggacgccccgaaagggagctcctacgacgtgagcctggtggacgggtacaacctccccgtcgccgtctccgccaagcccgccacgggcggcgcggacccgaacaagtgcgccattgccggctgcgccaagaacgtgaacgcggtgtgcccgccggagctgcaggtgaccgctaccggcagcggcggcggcaagacggtggtggcgtgcaagagcgcgtgcctagcgttcgggctcgacgccttctgctgccgcggcgcgtacgcgacgccggccacgtgccgagggaccgtgtactcgcgcctcttcaaggacgcctgcccggcatactacagctatgcctacgacaccgccgccacgacggccagcgggtgctacgcgcaggagtacatcatcacgttctgcccgtccagatggggcgacgagcccggggatcgtgctgctcagatttgaatttggtgtcgtcatcgtcagtcaggcaattaccaatcaccattgcgtcgagcttttcgcacgtctttatgtatgtgtgtacgcttgtgtctgcttctagtgggctttcacataaatttctacatacatatacacatacaacaataaaaaataaggtagtgctatttatcggccgcgtaaaaaaaaaaaaaaaaaagatcaacaaaaaagcgtat

SEQ ID NO: 4813 - DNA, 713 bp, Zea mays
gctcgtgttatgtccctacctaatggtctctccaagatgtccaagtctgctccttcagaccaatctcgtattaaccttcttgacccaaaagatgtgattgcaaataagatcaagcgctgcaaaactgactcattcccaggtatggagtttgacaacccagagaggccggaatgcagaaatcttctctctatataccagattatcactgggaagactaaggaggaagttgttagtgagtgccaacacatgaactggggtacattcaagactattctcacggaagctctaattgatcatttgcagcctattcaggtccgttatgaggagataatgtctgatccagcttacttggataatgtccttttagaaggagcagtaaaagctgctgagatagcggacatcaccctgaataatgtttaccaagccatgggtttcttgcgtagataatgtatgggtcaaaacatttgttcgggagctcttatcttttttttttttggcttcgagcttcgagcatgcttcacattagggcgctactgtttttcccacgcggacctgctgcttgtgcagggccttcattttacgacttcaaccccctttgagtcgtctcatgatttccatatcatttgattcatgtgataataggctgtctgctgttccttcaaaaggaggacggtctcaaaagaaagaaaattacaaaaaagagaatagcgaag

SEQ ID NO: 4814 - DNA, 1564 bp, Zea mays
  misc_feature (1489)..(1489): n is a, c, g, or t
ccggccggcatcgccggaacacacacacgtcggtccaaacacgcgccgtccgctcgcggcttctccaaccaaagccgtgcagccaaatccgaagggtagcgtagcacggggacgacgccatgagccgcgcgctcctctcccacgtcctccaccgtccgccgcacttcgcgtacacctgcttaaggagtggcgttggtgcccgaggaggagtgctcgcttctggcatccacccactccgtcgtctcaattgcagcgcggttgaagccgttcccggccccaccgaggaggcgcctgctcctcaggcaaggaagaaaagagtagtttctggtgtacagccaacaggatcggttcaccttggaaattatctaggggcaattaagaattgggttgcacttcaggattcatatgagacattctttttcatcgtggatcttcatgcaattactttaccatatgaggcgccactgctttctaaagcaacaagaagcactgctgcaatatatcttgcatgtggcgtcgacagctccaaggcttctatctttgtacagtctcatgtccgtgctcatgttgagttgatgtggctattgagttcttctactcctattggctggctgaatagaatgatccagttcaaagagaagtctcgcaaggcgggtgatgaaaatgttggggttgcacttttgacttatcctgttctaatggcttctgacattcttttgtaccagtccgatctggtacctgttggtgaagatcaaacacaacatttggaattaactcgtgaaatagctgagcgtgtaaataatctttatggtggaagaaagtggaagaaattgggagggagagggggtttgctatttaaggttcctgaagcccttattcctccagcaggggctcgtgttatgtccctaactgatggtctctccaagatgtccaagtctgctccttcagaccagtctcgtattaaccttcttgacccaaaagatgtgattgcaaataagatcaagcgctgcaaaactgactcattcccaggtatggagtttgacaacccagagaggccggaatgcagaaatcttctctctatataccagattatcactgggaagactaaggaggaagttgttagtgagtgccaacacatgaactggggtacattcaagactactctcacggaagctctaattgatcatttgcagcctattcaggttcgttatgaggagataatgtctgatccagcctacttggataatgtccttttagaaggagcagtaaaagctgctgagatagcggacatcaccctgaacaatgtttaccaagccatgggtttcttgcgtagataatgtatgggtcaaaacatttgttcgggagctcttatcttttttttttttggctttgagcttcgagcatgcttcacattagggcgctactgtttttcacacgcagggccttcattttacgacttcaaccccctttgagtcgtctcatgatttcncatatcatttgattcatgtgataattttctgtctgctgttccttcagattctgctggggaaatgttctagtttct

SEQ ID NO: 4815 - DNA, 4060 bp, Zea mays
  misc_feature (3803)..(3803): n is a, c, g, or t
ctgacccttttttcaaattgttggtggataaattaatcttgtgtgcgtgttagataaaacacaagggttatagacagatacgaagagaaacagtttttatattcacggaaccagctatgaaaggagtgaatgaaaaaaatggatgcgagaaattttggtttaataatatatttttaatgttaacaccgtgcatggcatatttaagtagccgtttagttcgaattaatagctaaatgtttgacgagcataaagcttaagcattcgccaaccgggtggtagcctggtaggtatggtggcgaccacgaccagtaggatattagaatgcactccaccctgacgagaccttctaaaatctttatgacacttttcctttattcttggtgctcagattgcatcctttaatcatcaccattcaccatagacaagttaacaagtcaagctgatcgagacgctcgcaccagaggcttcttccaaagcaggggagaagaggagagaagagcgagcgagctatggggttcggcatggtgtccctcctcgacggtttcttccggcgcgcgctcacgtccgccggcctccgcgcaggctccgccgccgtggacgccgacaccaccatccacttctgggcgcacccctccctcctccaggcccaggcccagccctcctccgcggctccgcggccggtggtggtgctgatccacgggttcgggccggacccgacgtggcagtgggcggcgcaggcgggcccgctgtcgcgccacttcgacctgctggtgccggcgcctgctcttcttcggcgcgtccgccacgcgcgcccccgcgcggtccgacgcgttccaggccgccgcgctcgccgcgctgctcgcgggcggcggccacgtcccgggcctcggcggccggaccgtgcacctcgtgggcgccaactacggcggcctggtggcgtaccacctcgcccgggagctggagcagcgaggcgtccgcgtcgggaaggtggcgctgtgcgacgcggacgcgtgctggggcgccgaggacgaccgcgcgctggcggctcggagcggcgcggcggacgtggtggacctgctggcgcctggcgacaccgccgcggtgcggcggaggtggatgatgactgatgagcgcctaccgccccttcaaacacatccccaagtgcttcctccgcgacctctttcaggtacggcgtacggtagtatacgcgtacgtacgaattgggcccatcggacacgaattcacggtcgtggcctaggtttggtgggctggggcccaggatacattacactacatatatctaaatctaagtatctggcccacagatcaagcttagacggtacgtttagattaacaacgttagctgagctcaatcattgtccagcaggatggtaggtcaataggattacaagtgggtgacactccaccgtccactccattttactgcctcactttattcccaatttaaatttgagcgacgttctaacgaactgtcagcaaaccttcttaaaaaagcatcgctatcagagcatccaccggacccacgaaacctgctaggtctcgtaaagcatacttgtagtccgccagcatgaatgcatgatgcaagcatcactgtcaacagcattccctgcatgcacattttttttagttattactacttactaccacccgtgacccgtccatgcctaatcaattatttaggggcagttcattttacttgttctctagttgagtgctcttaacttcatcaatcaagtttacataatgtatatattgattagcaccaacaataatgtcaaataaatgtgtcacgcgtatttcctatattctaaattataatatattttaggttttattagatatattatctctagtaaaaactacaaactaaatagaccaaaaacaccttttaatttggaacgcaacaagtacaccataaaattaatttaatggcataaatatttggtgcattttatatagcttaattaggttaaaattagggaaattaaacttacaacgaaactaaactactcactttgttctaaaatagttaccgttctcgtttttccatgcatgcatgaatcaggtttttttttctttgattaaatatgtatatataaattatttatatttatagtacacaataaagtatcattggatagatctttgaatctattttgtaataaacttatttggagatataaatgttgctgatattttctctaaatctagttaagcttgaaaaacttgaacggtgcaaatatcatagcagcatcaactatttgagaacgaattgatgagtacctacattttatataacttaggacgtactgtgtatttcctaatttttaagccattccagttcaattaagagttaaaacatctcgagtttgattaaatctatataataaaataatatcataaatgtacgtagaaacacttcgcggacaacagggaggagaaggtggcgctagtcaaagggatcactgccaaagaaggcttcgagctgactcctctacctcaggtcgatcgatctcgcctgctagatttcatcgtgcagctactaccaacacaaaagcgctcatacatgtgcacatcttctcaatttgctgcaggaggtgttcatcatctggggtgagttcgaccagatctacccggtcgagaaagcacacaagatgggagggtaggttttatttgtggtttaatttcagtccaattaatcttcagtaatcacacggcttaagtaacccgtgtgtgtgtatgcaggaagctcggggagaaggcgacggtgaaggtgatcccgggctgccgggcacgggacacctgccgcagcaacaggacatcaagctcttcaaccgcgtctcctcgacttcctgctgcagcctgctgctgcttccacctccaatggcagcgctgccgccaagtagctcgggttcttttcttggttctccacttgtattgtctcccgcgtggcacgagcttgctgttgtgttattgtgtatataaaattctctgcagctgggttttattccgcctcttcgttttctatccagctggtttggaaatagagacagtgcacattgttgtgtttagcaagatgtgaaataaatgatgaggcattgtttttctttaaagtcgggtattttggattcatgtcgcaaatgtttttttcaatgacaagaacggaattgtgcagtttttttatagaattagttgtgtttggacctctacagaaatctatatatcttattaactcatagtttcattaaaagttattctccacgtacaagccttccacaagggtagtcgtaattatgatactctctccgttcatatgaattagttatttgggtttgtcctaagtcaaacactatcaatgttgactggttatgcgggatgtttcataaaattttagtaaagttattatagattcatcatgacttgaactactataatatgtaatccttttagtttaaaataatttaattttatatattgttggtcacaatttaaataatttgacctagggaaaatctaaaatgactaaattatatggacagagggaatacatatctattcacacaagtaattcacgtcaccaagccacatgacccattaacatgaatttgtgtctatatatgctgagatcctatagcaacctggagggtgtgcttttagctttattaacatatctcttataatcttatatctcattgtgggtcagtttgtttgagattgtaatctcaagcaaacaggtcctaagtccatctcaattctcaacatatatacaagttatccatcancaccacacttgcttaatagcttatgcaattatgacgcatatgcaatctatccacatcggcaagccatatactaacataaatttatttccatatcagtgtaccacacattccactaaaatatattcgagaaccttcaacgtgtgaggtatgtttctagctttattaaaaaaaagcggatacaaagagttataactaaagcttaagaaacaaaaaagacaacaattggcattacaataagtttgaaaaaaaatccaaat

SEQ ID NO: 4816 - DNA, 4380 bp, Zea mays
ttgtctggtcgcctgtcatcagtcaagtgtcaacgaaggaatgcgacggctgtgatgtagccatgtaggtccccaacccactggtgcctgccactctactaatcagccccaacagatcgcattcgtcagtttaatatacaagacaaatttgttcctgcgactttctacttttacaagatcacaaagttataaccacagctttttttttgcattaccatattacgatataaaaaaaactatatcaccataacgttttatcataatttttaatatggttttgttacatgattttatagataatttatcatggcaaattatgtacgcgacatttacgaccctgttttggttcataaataaatgttggcagaagaaattatccagactatttctcagcaaaaaaaaattctaactaaactttgacataatattttttatgaataaagtagcttaagcgtttaacttttttgtttctcaacatcttgcaaatatacacaacatgtacagcgtatattttttacataatttcttccggaaagcttctataaaaaacaataagaataaatgagaagcaaagaaataaaagaggaagaaaaaagagagtaagaatacaaaatcaggaccgaccattcgccaaccgggtggtaggtggcaaccaatcagggtgattagaactttagaagtgggtgccactccactccatctccacctcacttcgctctcaatttaaatttcggcgacgtcctaacaaactgttaagcgaaccttctataaaaccatggctagcactagcagagcccatcaggataccaccaacaatctttatggaacgagtaggggtggtcaaaagaatcaaaagtatatataaaatcgtctcgagcaacgtcttctatatccctactctatatatctcttttataatctcctctaaaaaatcttaactctatatctcatctctctccaattgttctcttcatctcgttttctatacgtaaatatgcgtatattcaatacattttgctctaggttaccgtacatacgtagttgtcatgtcctcaaatttcttaaagtattaaaatggatagagtagagtagagaaaaactctatatacgaaggaaggatagagaaatgtcctatatatttagaaggtgtttttagaaaaataaaaagttatagaaaagtacagggggattaatatttagagaagagaatctttcaatgagcctaactgggtgataggtgagagtgagacacacgactccaccatacccacacttcacctttgacgacccaacaactgcgaacaaaccttctagaaacccactgcgtagatgttttggccaatgacaggtggggcacgcctgcaattgccaaagctggatcggtcggtgtccttttaacgtgaacagaaaaagggctcgctcaccaacaaaagaaggaccccagtaccccactaaagcgtaagagaagaatgtggcgtgaacagagagacctgaccctgaggcaggtgaggaggtccagggagcaatgggtttcggcgtagtgcacctcctcgacgcggtgttccgccgcatgttccggtcggccggcctccgcccgggctcggccacggtgaacgccgaagacgacacggtcatccactactgggcccacccgtccctcctccgcccgccgccctccgactccgactccgagcagcggcagccggtggtggtgctgatccacgggttcgggccggacccgacgtggcagtgggcggcgcaggcgggcccgctgtcgcgccacttccgcctggtggtgccgacgctgctcttcttcggggcgtccggcacgcgcgcgcccgcgcggtccgacgcctcccaggccgccgcgctcgccgcgctgctcgcgggcccgggccagcagcacctcccgggcctcggcgccggccgcaccgtgcacgtggtgggcaccagctacggcggcctcgtggcgtaccacctcgcccgggagctggagcggcaaggcggcggcgttcgcgtcggcaaggtggtgctgtgcgactcggacgcgtgcaagggcgccgaggacgaccgcgcgctggcggccaggagcggcgtggcggaggtggcggagctgctggcgcccgccgacacccgggcgctgcgccgcctcatggcggtctgcgcccaccgccccgtcaagtacgtccccgagtgcctcctccgcgacatgctccgggtatgcgcacattcgcctcgcgacatgctccggccggcttcgattgtattcaaaccgtgcgcatttatgcacatgtatgcagagatacttcgcggacaagagggaggagaagatggcgctcatcagagggatcgccaccggagaaggcttcgagcttgctccgctgcctcaggtacgtactcaccactgaacaccaccagagcatgcacaccgatcaggtcgctacgactacggaaatacggaatgtactatgaacacgagcacatcgatgaactaactgcaggaggtgctcatcatctggggagagttcgaccagatcttcccggtggacaaagcgcacaaggtgaaagagtaagttgtcccttctgctcggagctgtccgtttcttcactcactcactcagtcacttttggttttccaatccaacgcaagtcaactgatatcatggagtgtatttgtgtgcgcaggaagctcggggagaaggcgacggtgaaggtgatccccaacgcggggcacctgccgcagcaggaggacagcaagctcttcaaccgagtcctcctcgacttcctgctgcgcccttcctccaccgccgcctgacctccaacggcagcgcccaagccaaacagcttatagctcgctcggctgccgccttttgtttccggcgttcttgtttgtttgtagagtggagaggaggcgctgccgccttttgtttttgtttttctccatggctggcttgttttgaaattcaagagggtggcaatgtgcagatcctaccttgtgtctaatgatgtaggtttgatttattactgtggcacagatttctcgacgccggccatgtctacgtacgtcagcgttgttttcatcgtccgcgatcggattcacagcgtgcggtgcggcgcattctccctccgccgcccatctcccgtcttttgctggtgtaatgttatgagagattacgaggccatgccctggtgtcctcttctagttcagaaggcaacgcccagcggccaacgccgcagaacttgcacggacaaaaggcaactcgtccacgccgaacgagagcggttaaaagattgcaaatttccagagcgcattcctttctggtgctacgtacaaaacagccgaatgatcaatgccatctgatcgagacgggcgtgcaagtgcaagccaagtcgggatcagccgacccgtacctacagaccaacggcaacaaccacgtcgacagtttctatacaccatggacgttaaaatccataggaaccaagcaattgctccatcgccataatttgatcaagtcaagggtaatgttgtcagaatgttgttgtgaatcttgaatgattgcttactggtacaataaacttccaggggaaaaaatgaactactttcacatgagcagagagagctaatgcaacctagaagaagtgaaaactcaaaactggaacagtaaaaggacgagttgggaacaatggaatgaaaagaaaaaaaaaactgataggaaaacgaaagggttgttacagcaactacggcagatggcagagaaggagcggactggatgcacgagcggcatctcttctttctgaacccagaggttcccaccttctttctttctgctttattctgtgagaaaaatctggctgtactaggcaagagaggaccttcggtcagctgtacagaagaagtgacggtgtcgacaaacccaggctatactacagtcgtcgaggcgccattattcattggcaacgggttcccaggacgagctgtcaggatactagagccaaggcattcctgagggttagcgtagaaatagtcctcttccttgggctggccagggatggcctttctatccgtaggttgccccgtgcggctcttgtgcgcctccttcactgcgcctgagaactcgtcccaagatagagcgcgtccttggaaaaggtccaagagctcaacgagcttctttctgtccaaagcaatggtcttgcggaaacccatatacctgaaacagatcagcaatgtgacaatgttgttttatgtttacaaccgtagcagcagaagatatgaacttgtgaaggcagagagacagttctttcgcacaaaggaattcaaaatcggcataagctatacttccattgactgctagtaatctctactacttattaagttagcaa

SEQ ID NO: 4817 - DNA, 1601 bp, Zea mays
ggcacgtcgcggctcccggcgccactgaaccggctcaccggcttcaacgccttctggtactcgcaccacctcctcggcatcgtgtacgcgctcctgctcgcgcacggctacttcctcttcctcgtccggaggtggtacgagaagacgacatggatgtacatttcggtcccgctgctgctctacgtcggtgaaaggatgcttagagccttgaggtcaaatgcttataccgtgaaaattctcaaggtgtgtcttctacctggaaatgtgttgaccataacgatgtcaaagccctatggatttcgttacagaagtggacagtacatatttcttcaatgtccaataatttctccattcgaatggcatcctttctccatcacttcagcacctggagatgactacctcagtgtccacatccggacaaacggtgactggacacaggagctcaagcgcatatttgtggagaactacttctcgccgcatctcaacagaagagcttcgtttagcgagctaggtgcggcagaaccaagaagcttgccaaaattactcgtagatggtccctatggtgcccctgcgcaggattttagaaactacgacgttctacttctcgtcggcctcggaatcggggcaacaccgttcataagcattctacgggatctgcttaataacattaagatagctgacgagctgatggacttggcaatggagaccagcaggtctgaagacagcgccaacagctttagcgtctcaacggcgagtagcaaccggaagagagcatacagaacaagccgtgcacatttctactgggtcacccgagaagccggatcctttgaatggttcaaaggggtgatgaatgaggttgcagaaatggacaagaagggtgtcatagagctgcacaattacctcactagcgtttacgaggaacgcgacgcacggacaactctgctgtccatggtccaggctctgaaccacgccaagcacggcgtcgatatcgtatcggggaccagggtgaggacgcatttcgccagacccaactggaaggaagtcttcaccaggatcgcctccaagcatccgaattcaacagttggtgtgttctactgcggcgcaccgacgcttgccaaggagctgaaggctctggcgcacgagatgagccacaggacgggcactcgcttccatttccacaaggagtacttctgagtttcgacagatagaatgggcagtcgatgctcgttctaacgtgatctggtcttttctgatctgatctcgatagcgttaggtaccggtaaagaagacagaattttgcacagatgcaagacaaaccaagctgacctctcctcctgatctggaactgtacatagcataaaagaagcaccacagggttagcttagtatacgtagcacaattcaaataaatatattgacaaagaaaagagagacagagaaagggcaggatagaggctgttgttgttaactcgaagatattgatgataggcatggcggtatacgtgtatacagtatagttaggtgctaggtggtagttatatatatactgtatatgatatgggtcgatgaatatacgaggagccacatgctgctgccattctc

SEQ ID NO: 4818 - DNA, 2450 bp, Zea mays
acgaaacctgtgtgtgaatgtgtgatgagggcaaaaagcaagtaacccatctatctagggttggaagcttgtacatggccacctcggtggttgtggcacgcctcgcgggcgaggcctcgcagcccaaggtcctaccttctgcgaatggagtctcatccgagagctattggcgggtagctgctacgcgccgttggcagggccgcggtgtccggtgctgcgcggccggtttccgcggtgggggcgccgacgccgacgccgtgatcgccagcgaggactttgtggggttctttcgggaggcgtggccgtacatccggggccaccgtgggagcaccttcgtggtggtcatctccagcgaggtcgtgtgcgggccgcacttctaccgcgttctgcaggacatatcacttctccatggtctggggattaaatttgttcttgttccaggaacacatattcaaattgataagctgttgtcagaaagagggaagaaggccaagtatgttggtcagtacagaattactgatgaagatgcaagaaaggctgcaatggatgcagctggtagaatacgattgacaatagaagctaaactttctcctggtcctccaatgttaaatcttcgtaggcatggtgttattggacgctggcatggtcttgtggatagcattgcaagtggcaatttccttggtgctaagagaagaggggtggttaatggtattgactacggattcaccggggaagttacgaaaatagacgtttcacggataagagaaaggcttgatagtgatagcatagttgttatcagcaacatgggcttcagttcatcgggagatgtgttaaattgcaacacctacgaggttgctactgcatgtgctttagccttggaggcagataaacttatctgcgttgtagatggtcaggtatttgatgatcatggacgggccattcaatacatgtctattgaggaggctgatttgttgattagaaagcgtgctaggcaaagtgatattgctgcaagttatgtcaaggggtgtggatgagggaggcatcaattctttgcataaaggggacgacagaccatcatttgagtcccaaggcttacataaatgggtatgctgctttcttttcgaaacggattggctcgtatcccgggcccggcgatttattctggcgagcaagggtttgctattggtggtgaagagcggttaagcagatcaaatgctgatccttttcaaaacgggttgggttttaacaatggaaatggtatttactctggtgagcaagggttcgctattggtggtgaagagaggttaagcagatcaaatggctatctttctgagttggtcgcggcagcatatgtgtgccatggtggtgttcaaagagttcatattatagatggatgtgttgatggatcacttctattagaattgtttacgagagatggagcaggaacaatgattgctagggatgtttatgaaggaacaaggatggctacagcggaagatcttcctggcattagaaaaattattcggccgctggaggattctggtgttttggtgcggagaacagatgcacagcttcttgaagcgctagagtcattctatgttgttgaaagagatggttcaatcattgcttgtgctgctctatttccattccctgaggaacaatctggtgaagttgctgcaattgctgtatctgaagaatgccgaggaagaggtcagggggacaagttacttgattacgtggaaaagatggcattatccctgggtctcaagaaattattcttgcttactacacgaactgcagattggtttgtgcgacgtggcttttcagagtgctcaattggatctatccctgagcagaggagaaaacgtatcaacttgtcccgtggatccaagtattacataaagcagctgtagccaaagcctgctgggattatcgccaacaattttgtcatcaggtgactcagcagcatgcacagagtttggttccacacttccacttaattaagatggtaccagccaagattacaccaatttcgcggttgcccaaaggcatataattgcacaaagaaacaaaacaccattttactgtcactgtgtttgaaagatggttgtctttgtttaagtatgtgacagaagtttgttttgccaatagaatcaaggcagagaagaaatagctgattgaattatatgtagaccctatttaacaagcaataccaaagatgaagtgctcgtacagtatcatctctggttggtgcctcattgtgtgcatcatagatgattgaacttgccttttccactcatagctgattggccttatcttttctacttttgttgagagaaaaaaaagagctagtgaaacaattggttctcttgtatcagatgtcaaagtatccttgaatgaaaacaaaaaaatatgaagtgctcgtctgttatcgaaaaaaaaaaaaaaaa

SEQ ID NO: 4819 - DNA, 1836 bp, Zea mays
tgggatatttgaaatgggcttgtataaagttcctaaacttaggtgtagagttttaaaatactaaagttttaaacataacaatgcaaaattataatgcgatagctcaaggcaaacaaatttacagtgcaaagttttagatctggaagtataatgttggatataacaattagaaaagtttcaaacttgtgatttcaaagttttcaatgtgcaaagagagagttttttttacctgcaaggtgttttaggatttaagattttttaaatatttagacatagattatctaaaaaattgtggattcgtccgttcaggtgctttaacgttcgatggctaatgaatgaaagtttgatcgaagaaatgctttggtagagactagagagggcgcgtgcggatcctatgatcctatcggcagcaacgccgagcccgagatcgtcctgccacttccgccgcggggacctgcactgtaccaccctaccccgaaacgtgggccccacgccgccagacaggccctccaaggcctccgccgcggaaatccccggacagcccccgtctcaccccacgcgtaacggctccttccgctgtccctcgcgcgtggacccacctctcagtcccttgcaactcacgccgtcgcccgcccgcccgcccgccagcccgccttaccccacgcgtaacggctccttccgctgtccctcgcgcgtggacccacctctcagtcgcttgcaactcacgccgtcgcccgcccgccagcccgccttaccccacaccccacgcggccccggccgcctgtccttatccgtccttttcccgcccgactcaggcgcagcgcagcgcggcgcgggccgcctccttattaaagcgaactgcggcgctccccctagccggaacaacgcaaaaccacttttccttcacgcctcgcaacgcatctacacttcccaaaacgcagcagcacttcttctttcatccacttcccaaatcgcagaaggaccagggaacagagagacccttcgttttcagtccggaactggcgagaccaatggacgccgccggggaggcctcgtcgccgtcgtccccgtcgaagctgcgggacaagctgcggaccacggtgtgctgttgcttcggcgcgggcggcggcccggagaggacgaggtggcggcggcggggcgcggccgcgggcgagttccgctacgacgcgctcagctacgcgctcaacttcgacgagggcgacgacgacgacgcgtacgcggaccccgccgcggtcttccggtacaggaacttcaacgcgcgcctcccgtcctcgccggccgccgctgccgcggttgggacccagcggcaacacaccacggccatcgcctagaacgtagaacgtgatggctctcctgtaatttttttggccgacttctgtaattttttttggccccctcctgtaactgtacgatctactaaacgagcgacagagttcttaagctcctctgtgcagcgacgtactctagcgcgttttatgtatatagtattattactcttgtcgtaaaaaaaaaattcagagtgttccatcagattggaagtggcggtgatgaaccctagaaatcggggattcgattccagaaagaaatatctcctcgccgagaatctcctctgtttatccgttagatgtcttttgtctgagataaagcaaaaaaatctccttcggaatggaaaaaaagatctgctgctacatatggacgcgcgtgtgatcgacgaagctagcggattttgcggctggtgacgaagccgtgatgaagttgtaggggaaagaaagcaatgcgaatgatccgctgtcgcgttgctgactcatgagtcca

SEQ ID NO: 4820 - DNA, 2691 bp, Zea mays
tggtggactaactatgcaatgcttgttgttacatcaatgagcatttcccactcttttatgttgtgcagaaaccagcatcaatggctgatgcacaaggcttttttaagcccctcagtgatgttattgcaaaagcaactgcaatgaccgaaggaaggagacctgactatttcaaccatttaaagagtgttgctgacagtctcccagctttggcttgggtggcatttttaggaaaggactgtggttagtaaagtcgccccccttggtttaagcttatcaaacatacacaagatatagcactcattttgttttacccttttcctctttgtaaggcatgagtttcccaacagcacatgtagaggaaagctggcagatggctgagttctataataacaaggtatgcttctcctatgaccattttgtagtttgtgctctacttatatgttgaacatctattcatatagtgacattggatgcacaatttttgaaagcatcatcagacttttttttaaatatgggtttatcttagacgagagggatgtaatgagaagataagcagtgcacttcagcacattttgtttctaggggttatactgttactgttaccaactaatcttgatgcagcttttgttacatactcacaaatggaagtttgtttgtgtaacaagaattcaaagttaaccaagtagataaaatccatgatcagtttttggagaaaatgcatgtggccatttgccacttcctgttttttttcttgaaatgacatacctacaaaaatgttggcttgcttccagtacaaatatttgattggaaacgagattcgttagggaatggaaggacgaaggagcgtatcatagagccataacagtaaatgtaccagtttcaaaacccaggaaaacacacttgctcctccattagcattttcataaatttgttagtattggttatatgaaaatttatcttactattttttctttcttttcgtaaaaagtttattataaatacaactctggaaacaccctttctcctgcattaatatgtttagagttacaataccgactatatgaagacttccctatagacgtgcttaaataaaagtatttgtatactatagatatggtatatgggtataaatttagatagcactggtcaaactatgtcttgagggttacaaaaagtcagtataactattaccaaataagaatggagaagccgaaaaatggatgtattcatttatccttcttaaagtgcaaccctagaacatatttgtttagacttaattgctcttttatgttttgcttgctgattaatttgctgtggtgcactaagattatcttagtaattcaaacttttgttctactgtgaagcaattgcatcttcacaagttatggttgatgaagcatatacttcatttttttccttgctcataggttcttgtggagtacagaaacaaagaccctgatcatgttgagtgggctaaagcattgaaggaactatacatgcctggtttgcgggattatgttaaaaagcattaccctcttggtcctgtttggggtcctgctggaagtgctgttgtttcccagccaaagcctgctgctccaacacctaaagctccagcggtcaaggctgccccccctccaccagctcctcctgctgcacctctttttagcacagagaagtcgccaaaatcttcaaagcctaaagaagggatgtctgctgtgttccaagagattagttcaaaacctgtgactgcagggttgcgaaaggttaccgatgatatgaaaactaaaaaccgtgctgagagaagcggtgttgtcagcagcgctgctactcctgctgcagctcctgaaaagacttctcgtgcggggtccttctctttcaaatctggacccccaaaactggaacttcagatgggacggaaatgggtggttgaaaatcaggttggcaagaagacccttgctattgatgattgtgattccagacaatctgtctatgtgtatggatgcaaagattctgtccttcaagtaaacggcaaggttaacaatatcactgttgacaaatgcactaaatttggaatcgttttcaaggatgttgtagcagctttttgaggttgtcaactgcaatggcgttgaggtccaatgtcagggtacgtcaccgacaatatcaattgacaacacatctggatgtcaattatacttaagcaaagattcgctgggagcttcaattacttctgctaaatctagtgaaatcaatgtgatggttccaagtggcggcaccgacggtgattgggtggagcatgcattgcctcagcagtacatccatagtttcaaggatgggcaattcaccacttcaccagtttcacactcgggggcgtaaatacaatttgttgctgctgtgtttgttttttatttcgcgtttgccttgtttttgaagatgaacgtatgatgatgaggtttgtaacagttttgggtctcgcagcactggactggaccctgactgcgattgttgtttgtgttgccccttgctcggtgcgcggtgtgtatgttctgcatgcacgtggttccattcgattggtgtatttgtgtgccaacaaaccactatacgtggtgtgtgtgtgtgtctttagctgaccattctttgacactgaatctcactatatttgaattgatgtggacgcttgctttttcgagcaaa

SEQ ID NO: 4821 - DNA, 738 bp, Zea mays
  misc_feature (680)..(680): n is a, c, g, or t
  misc_feature (708)..(709): n is a, c, g, or t
tggggccccccgggccggccgggaccgagaccgagagaaaggcagactgggggagagagaggaatcgagagaccacacgccggcgccacgtagcttgatctaggcgatggaggtggcgcttgtggagcggttggaggcggcggtggcgcggctcgaggccgccgtggcctccggcgcctcgctcgcgtcgacggctccgcgcgacttcgacgctctggaggcccggtcggatccggccatcatggcttacgacgagttcgtcgcggaggccgtcgggcggctcacggccgcggcggagaagatcggcgggaaggtgctggacgcgaccaaggtgctcgccgaggcatttgccgtccgccaaggacatgctcgtacaggccaagcagcaccagaaaccagcatcaatggctgatgcgcagggcttcgttaagcccctcagtgatgttatggcaaaagcaactgcaatgaccgaaggaaggagaccagactatttcaaccatttaaagagtgttgctgacagtctacctgctttggcttgggtggcattcttaggaaaggactgtggcatgagtttcccaacggcacacgtagaggaaagctggcagatggctgagttctataataacaaggttctttgtggagtaccgcggccgcgaccccgctcatggtgaatgggctanagcattgaaggatctatatatgcctggnnttgcgggattatgttaaaagcactaccct

SEQ ID NO: 4822 - DNA, 3116 bp, Zea mays
agatgattatatatcaatataccactgatatgcgaatactgattactgatatatattatcttaactttctagtgtacacagaaataaagtgattactaagggttctctagttcaatccagaatctcttcccatctcagatttttcatattcttatcatccatttttttcccaaatattatccacctgacattgttatagtatcaaatcgtttcttttctattagaagtccctttttccgactcgactctcacctgatagcaccttcctgcggcggctagggttgaaccgcctccctgcgtccaactttagcggtcggtacgtggctcggtcatccctaaattgtcacagctcttcctcgtcgacccttcaacgcttccatcacccaacatccatgtcacccgtctgcatctgacattgcccctctcagtgccgtcctagccctcactttgacgttcggtgatggcgatgcttcaggcgatgacgcaacgtctatcgcttttacataacctgtagtttttacattatttatagttgacagttgttttaaaccaaacaattttcatctttttcataattgtcaactcacaccacagctgtagctgaaccaaatagatcctaagtctattgcctgaacctgtttggattatagatcgatgccatgcgagatttaagatgctagaatatgacaatatgttacctcccccaccaggccaccacacaattgttcacattctttgtcactgcggtaccagtagtttttttttgcatgttatgtgaggtgttagtacttgttatacgcacgcatagcatttaactcggcaatttaattagcaattttggtgtcaggttttatcttttctttatttaattagcatcctagccttgtgagtcagtaactcaggatcgattggcactgaccctgacatatctctgtttctgtaactatcaaccgctcgcacgtaacttgagttgtcgtattataggtggagcatgcattgcctcaacagtacatccatagtttcaaggatgggcagttcaccacttcaccagtttcacactcaggagcgtgaatacaattgttactgctgttgtttttgaggtttgtaaacagttttgggtcttgcagcactggactcggtctgcgattgttgttttttgttgcccttgctcagtccgcggtgtgtatgtcctgcatgcacgtggttcctttctgttggtgtttttgtgtgccaacaaaccaccaaacttggtttgtatgtctttagctgatcattctttgacactgaatctcattatatttgtattcatttggacgcttgcttttttcgagtctcttttcagattcctttaacaaagtgacaatggcaaatgctgttatcgtactttaaatctcgacgctgtgcttggatcgtgaaacacgtactagaatacgagaggtggcgcaatacattaggcagaaaaaagcataaagaaaaaaaaaggtcatgtaaacatcagcaaagctatgaccggaaaaccggcaatgatagggagcatcgaggaagcgcgagacgattcagcagcactaggttgggcgcaagcggtagtggtccctctcgacgtagccgtccctggccccggcctgcagatgccggaaggcccagctgccgccgtcgagccctgctgcgctggagtcacctgcaccgacggaggcactcttatcaggaagaagccagtgagcaaaagacgaaccaggaagaagcagctacatcaccatgtatcatactgtaaccccacctgtgtctgctgccctggcgttggcttcagcgtcgcggcggacgtggttggcgccggagccggcgccgtggctggtatcggtccggccgtgccgttcctgagcaaccccgtcgggtacgtctcggcgaggctggtctggaacagcccgaagtaccgctccgacgccttgccgggcttgaggtcctcgtcgtacatggcgaagatgtacgtctccaccgacttgccgggcgcgcgcggcgtgccggacagggagcggaggtgggacacgaggcccgacacgaaggcgcgcgcgttctccaccgtggcgccggcctcgtcggggtcacccttgtgcggccagccggtctcggccaccacgatgtccacgtccttgtaccccttggcgtccagcgcggcgcgcacggcgtcgacctgcgcgtcgaacatgttggtgtacgtgaggccggacccggcgtccgggcggccggcgttgggctggaacaggcagaaggccagcgtctcgggccgcgggtcgctgaggtacgcgaagtaggggtacgggttgacgaggaacggcgagccggtcttgctcaggaacgccagcagcgggtcgagcgccgccgcgagctccggcttgaacgcgccggaggagggcgggtcggagctcgccagcacgtccatggcgttcacggtggacaccttgacgctggagttgggcggcagcgcgtcgtgcaggttctgcatggccgggacgagctgcgacgcgagcgaggcgtcggcaaagaggacctcgttgccgacggagacggtggagacggccggcgacgaggccgggaggtgcgcggcgacccaggccgccgcggccgcgggcgaggacgcgaggttggcgatgtcgccgttggtggcgcccaggaggagggagacgcccgtgccggagaaggcggagatgatggccgggtcggtcccgtagaggcgcaccttggtgatggtcgtggactggacgaggcgcgcggtggacgacggcggcgggaggttgtcggccacttcgccgtagttgatgcccatgaaggactgcgacgctgcaagcacacacgtgtctcagcttaatcgtactcatcaaccattcaatgtactgggggtatcataaataaagctagacgtttcttcaaaaaattcccgcgctgcaaagacctccaatgaacacataagccacttccagctcgagtgctcgacacgtcgaaggcgaagtccgagtctaaacacgtgaattaaaaaaaactgtagaatatgtaattagttgatggtgtcccgtgtcggtttcaccgcacacagctacatgtcgccgtggactgatggcatg

SEQ ID NO: 4823 - DNA, 2219 bp, Zea mays
ccgggaacttggctcgtctcggggctccgcgggtcccgccgggacaaaagtcgtcgtcagaaatttaacgacgcatattcgtctgactgacccgcccgtgcgccttcctcccgcctcccgcctccccttccaccaccaagagtgacgacagagagacagacagagagaatggcggcgccagatgcccggccctcgtcagccggtccaccgccggcccgctccctcctcctgcctctcctgctcgtgctcctcctcgcggcctactcgctcccagccgactcagcagcgcgcccgtcctccaactccaacccacggcctgccttcacgccgccgctgctgaagcgccaccagctgcggcgcccgagcagcagcagcgccgagctcgtcgccgggcccgccaacgcgtcgaccaagcccttcacggcgcactacttcccgcagctgctcgaccacttcgccttcacgcccaacgcgtccacggtcttccgccacaagtacctcctcaacgacaccttctggcgccggcccggcgccggcgccggcgacgacggccccggcccgctgttcgtgtacacgggcaacgagggcgacatcgagtggttcgccaccaacaccgggttcatgttcgacatcgcgcccacgttcggcgccctcctcgtcttcatcgagcaccggttctacggggagtcgaagccgttcgggaacgactcgtacaggtcggccgagacgctgggctacctcacgtccacgcaggcgctggccgacttcgccgtcgtcatcaggggcctgaagcgggacctcggcgccgaggccgctcccgtcgtcgtcttcggcggctcctacggcggaatgctggcttcctggttcaggctcaagtacccccacgtcgccattggtgccctagcttcctccgcgccgatcctgcagttcgaccacataacgccgtggagcagcttctacgacgccgtctcgcaggacttcaagtccgagagctccaactgcttcggtgtcatcagggcagcctgggacgtcctggatgagaggggggccacagacaaagggctcctggacctcagcaaactcttcagagcctgcaagactgtgaagtacgcttattcaatccggaactggctgtggacagcattcacctacactgccatggtggactacccgaccccagccaacttcctggagaacctgcctgcctacccagtcaaggagatgtgcaagaccatcgacgcgttccccgcgggcgcagacgtcctggagaaggcgttcgcggcggcgagcctgtactacaactacacgggagaccaggcctgcaacaagatagaggacggagacgacccgcacggcctcgatggctggcaatggcaggcctgcacagagatgatcatgcccatgacgatctccaacgagagcatgttcccgccgtccgccttcagctacgacgacaggtccgacgagtgtttccagagctggggggttcggccgaggccgcactggatcaccactgagtacggtggatataaaatcgataaggtgctcaagaggttcggcagcaacatcatcttctccaacggaatgcgagacccatggagccgtggcggggtgctcaagaacatctcgtccagcatcatcgcccttgttacagagaaaggtgcccatcatttagacttgaggtcttcaacgaagggtgatccagactggctcatagaacagaggaggcaagaggttgagatcattcagggatggattgatcagtatcatcaggacatggcggaaacatcttcctgaagacagggcaagtcagtattcttcttcttacacatggtggaaacagggcgtgtatcatcaggacatggcggaaacatcttcatgaaaacaggacaccttcctgttacggtcatgtttggatccatggaaaaaaataaaggacaaaaaatcaataatttacacactaaacatcagaaattgctgaatcttacacaaagcaggcccctttgtgaattagtaaggggtggtgcaggtgctgggacttcaatccgcgccagagcagtgatcgactgatctcgcaggcctctggccagcggaccaaggcagtcttgagtcttgactcagtttctgttttttttaactgtattgtttcttcttttgttctcggcaaggaacagtcttgacaaaaaaacccgagggaggcccggccaccagggctgggt

SEQ ID NO: 4824 - DNA, 935 bp, Zea mays
cattgggtacctcgaggccggccgggaaagcaagtccaggttcggggacctcgaggccgcccgataaaaccccaccacaagggcgcagattccacacggttcctctctgaccactcctctcctctcctctcgccggcgcatcgcccgactgtcagtcagcctcagccatggccgcggaggaggagcagggcttccgcccgctggacgaggcgtccctgctcgcctacatcaaggccacgccggcgctcgcctcccgcctcggcggcggtggcagtctagactccatcgagatcaaggaggtcggcgacggcaacctcaacttcgtctacatcgtgcagtccgaggccggcgccatcgtcgtcaagcaggcgctcccgtacgtgcgctgcgtgggggattcgtggcccatgacgcgggagcgcgcctacttcgaggcctccacgctgcgggagcacggccgcctgtgcccggagcacacccccgaggtgtaccacttcgaccggaccttgtcgctgatggggatgcgctacatcgagcccccgcacatcatcctccgcaagggcctcatcgccggtgtcgagtacccgctgctcgccgaccacatgtccgattacatggccaagacgctcttcttcacctccctcctctataacaataccacggatcataagagcggagttgctaagtactctgcgaacgtggagatgtgtaggctcacggagcaagttgtgttctcggacccataccgtgtctccaaatttaatcggtggacctcgccttatctcgacaaagatgctgaggcagttcgcgaggatgatgagctcaagttggaagtagctgggctgaaatcgatgtttatcgagagagctcaagctctgattcatggagatctccacactggttctatcatggtggaccgaggggtcactcagtca

SEQ ID NO: 4825 - DNA, 1780 bp, Zea mays
aagaactctacataaaaccccaccacaagggcgcggcccgcacacggttcctctctgaccactcctctcctctcctctcctctcctctcgccggcgcatcgcccgactgtcagtcagcctcagccatggccgcggaggaggagcagggcttccgcccgctggacgaggcgtccctgctcgcctacatcaaggccacgccggcgctcgcctcccgcctcggcggcggtggcagtctagactccatcgagatcaaggaggtcggcgacggcaacctcaacttcgtctacatcgtgcagtccgaggccggcgccatcgtcgtcaagcaggcgctcccgtacgtgcgctgcgtgggggactcgtggcccatgacgcgggagcgcgcctacttcgaggcctccacgctgcgggagcacggccgcctgtgcccggagcacacccccgaggtgtaccacttcgaccggaccttgtcgctgatggggatgcgctacatcgagcccccgcacatcatcctccggaagggcctcgtcgccggtgtcgagtacccgctgctcgccgaccacatgtccgattacatggccaagacgctcttcttcacctccctcctctataacaataccacggatcataagaacggagttgctaagtactctgcgaacgtggagatgtgtaggctcacggagcaagttgtgttctcggacccataccgtgtttccaaatttaatcggtggacctcgccttatctcgacaaagatgctgaggcagttcgcgaggatgatgagctcaagttggaagtagctgggctgaaatcgatgtttatcgagagagctcaagctctgattcatggagatctccacactggttctatcatggtgaccgaaggttcaactcaagtcattgatccagaatttgggttctatgggccaatgggttttgatattggagccttccttggaaacctgattttggcatactatgcacagaatgggcatgctgatcaagcgaatgatcgtaaggcttacaagaaatggatcttgaagacaattgaagagtcgtggaatttgttccagaaaaagtttgttgaactatggaataaacacaaagaaagcaatggggaggcatacctgcctgatatatacaacaagccaaagcttttgagcgttgttcagaagaagtacatgacaaacctatttcatgatagccttgggtttggttcagccaaaatgatcaggagaatagtcggaatcgctcacgtagaggatctcgagtcaatcaaggatgccagcaagagagcggagtgcgagcgtgctgccctcaactgtgcgaagacgatcctcaagggaagacaccagttggagacgatcgagcaagtcgtcgagcatatccagtccttcgatcaggactgagaagacgacagtctatttgtgcgctgaagcctgaaggagacatactctcgtcaattaacccacgcatgcccgagtatcgatgaatcgtctgttttgtagtgatgaagcgcccggttgtttgtgatctctgtattggttgctaggtgagaaaagtatgtggtctcctggcttgaactgtgtgtacactattattccgggccggcatagcgagcagctgaataatgaaatgtacgggtcctcagtgaccatctcagtgcatataaacacgtgtgttaccaataaattttgttatggtgctggtggttctatggcaaaaaaaaaaaaaaaatgttgtttggttgcattacttgcatatatgaacatctgatccgattcag

SEQ ID NO: 4826 - DNA, 2487 bp, Zea mays
  misc_feature (327)..(327): n is a, c, g, or t
tcggtattattgatgtccctttctacacttagtgagctagtaacctcagcttttactttgtgaactttagtcgctttcaatatcaatataagcatataggtataccttgtaacaaaaaacaaatcttctttcgcccacgtgtggacgtggcagattggcggcaccacagaactagctatcacacgcctccacctcacacgctctatcatcaagtccgcagcatcccgacgaactcctggtggcctggcctgcacccaaaatatccatatccttcccgccggcctgccaaataatctctttcttgatgagatcggcgcgtatatcttntccggtgtccgatccggccggcattagcaatttgactcgtacgtgcgtgactacagttgcatgctatggccatggccaccacttcgccggcaactgtgcagccatcatcatacaagcacacgagccgcggcgcggcgcggtgctgccctcctcctctgctgtcctggaagacacgaagctttgggcagcaggtgacgacaagggccacggcggcgagctcccgtgggcagcccgccggcgtggcactggcagggggagaagagggcgacagtatcaggcggctgcagaacgggtcggacgtgcggggcgtcgcgctggagggcgagaaaggccgggccgtggacctcacgccgctggcggtcgaggccatcgccgagagcttcggggagtggctgcgagaggaggagctccggctccggggccaggagcccgagcagctgcgtgtgtccgtcggccgcgaccccaggctgtcggggccgcggctcagcgcggcgctctttgcggggctcgccagggcgggctgctccgtcttcgacatggggctcgccaccacgccggcctgcttcatgagcaccatactgccacgcttcaactatgacggctcaattatgatgacggcgtcacacctcccctacacccgcaacggcctcaagttcttcaccaagcgcggcgggctcacctccggcgacgtcgagaacatctgcgaccgcgcagcgcacaagtacgtggcgcggaagacgggagtcggcggcggcggcaggggcacgccgccggtggtgatgcgcgtggacctgatgagcgcctacgcgcagcacctccgcgacatcatcaagcagcgcgtggcgcacccgacgcactacgacaccccgctgaggggcttcaaggtggtggtgaacgcgggcaacggctgcggcggcttcttcacctgggacgtgctggagaagctgggggccgacaccacgggcagcctccacctggagcccgacggcaggttccccaaccacatacccaacccggaggacgccaccgccatgtcgctcacccgcggcgccgtgctggcgcagggcgcggacctgggcgtcgttttcgacaccgacgtggaccgcagcggcgtcgtggacgccgggggcgcggccatcaacggcgaccgcctcatcgcgctcatgtcggccatcgtgctgggcgagcacccgggcaccatggtggtcaccgacgcgcgcgccagcgacgggctcacgaggttcgtcgagtccaggggaggccgccactgcctgtaccgcgtcggctaccgcaacgtcatagacaagggcgtgcagctgaacgccgacggcgtggagacgcacctgatgatggagacgaccgggcacggcgcgctcaaggagaactacttcctcgacgacggcgcctacatggtggtgaagatcatcattgagatggtccggatgaagctggcaggggtggagggaggggtagggagccttatcagggatctgcaggagcccgccgagtccgtgctcctccggatggacgtcatgggtgagcccaaggatgccaaggaaagggccacacatgcagtcgaggcttttaagaactacatccaggaggacaaacttttcggttgggtgctggacgactgcggggattgctcagttgccgagggatgtcttacggacacaaacaatgatcccatcaatgttgatgcacacatgtacagagcaaaactatacgacgagaatcagagagcagtaggcatggtccacattcgtcaaagtgtgcataatcccaacatagcactaaacatgcagtcctatgctcctggtggctgcaaatccatggcaaaggatcttcttgagaggttcttgctggcaagcggactgaatgagtttgttgacataagccaagtagagaagtttgtccagtagttcttatgcttattatagaatcttagatttacctactctgtatatgaacctagctaggagttcactactgttgcgagtgtacatctattacattattctcctatcccatccatggtaaaccttgtatgtgtttagcaaatattgatagatgaatgcttgatattattgatagagacaatcagctataaatagacgcgccccttccatgaaaaaaaaaagaaaaggggcggccgccacc

SEQ ID NO: 4827 - DNA, 1224 bp, Zea mays
  misc_feature (101)..(101): n is a, c, g, or t
  misc_feature (123)..(123): n is a, c, g, or t
cccacgcgtccgcccacgcgtccgcccacgcgtccgcccacgcgtccgcccacgcgtccgcggacgcgtgggcccgttgtctgcacctttggtgtcgtgtntgccgatgtgcttggcttgttntttccttggaggcttcttgcgttataggaaccttgccctgcctactgttgatacctggcctgttcttcattccggaatctccaagatggctggcaaggatgaatatgatggatgagtgcgaggcttctctacaagttctgaggggggtggacgctgacatcactgtagaagcgaatgatataaagatagctgtagcatcggcaaacaaaagtggtgcaatgagctttcaagagttgaaccagaagaaataccgcacgcccctaattctaggaatgggcctacttgtgttgcagcagctgagtggaataaacggtataatcttttatgcaggtagcatcttcaaagctgcagggctcaagaacagtaacctggacacatgtatacttggagtgattgcggttcttgccactgctgttacaaccaagatcttggacagggctggacggagaatcctccttattatttcttcttttgggatgaccctaagccttcttgtggttgctgttgtattttacatcaaggacaatatttcacatgactctgacttgggtaacaccttaagtatggtgtccttggttggtgtcttggcttatgtcactgcctactcctttggtatgggtgccattccatggatcataatggctgagatccttccagttagcatcaagagtgtggcaggaagctttgcgaccctagccaactggttgacatcctttggaataacaatgacagcaaatttgcttctgtcctggagtgctgcaggtacatttgccttctacatgatggtgagtgctttcactctcgtctttgtcatcctttgggtgccggagacaaagggaagaactctcgaggagatacaatggtccttccagtgagctccagtatttcatctatatatatgcaaatagcgtggcaaatcctccaggatctataaaaagatatagtgaaatatagcagaagctatttcatttagcaattttatagtttaaatgaaattggctattgattctgcatgaaaacatgtaaacaaggaaatttgatgaacataatactcaaatatatgtacagggatgtaaatgaagatgtctctggatccctggg

SEQ ID NO: 4828 - DNA, 3181 bp, Zea mays
cgcggtgacagaaaactcaatcagttagactgagcttttcatcggacgtctatcccaccgtcagtaacatttcgcacacgccttaacgataacgaccaggcaagacagagctggtttcactgcagacgcttccatcgatggaagaagagacgtttcgtgctgaagcttcggtgctagctctcttctacactaactgctagctctgcttggtaactctttcgcagtcactgatgattgcggcggttccgaacgtcatgggctggctcgcgatctccctggcaagggtatgtcgctagtcgctactacgtgtgtcggtttatctccactcgttgtcttcacagatgacagcatcggctttgatggccgtcaatgtctgctctgctctgcaggacacttcgtttctgtacgtggggaggttgctggaaggattcggtgtcggcgtcatctcctacgtggttagtactgtgataaaactccatgccttgcctggttatatattatgcgtgccttgagactacaagcactgccgcttttgtgtttcttttaagctggtctagttctagacagactgatccatccctagcagcaaggtcattttcatcggcataagaacaatgggagcatggacactggtcacatcatcagctaactttggtctgtgggttttgtgccaccaggtgccggtatacgtagcagagatatctcctcagaacatgagaggagctcttggcgccgtgaacccggttcgttcgcacccacaagcgtcttatctttttttttcctccctccctcatgatgagaaacacttcttgcttttctttatgctgacgtcactgtgtgcaactggcctccctgcagttgtctgcaacctttggtgtcgtgtttgccgatgtgcttggcttgttttttccttggaggcttcttgcgttaataggtaatgaaaccctgatgcattaataaacctgatgctgctgctcttagcttgcgtttcaactctctgatctgatatcttagctcgcacgatcagcaactcctaaagagctcagatagtacagatgcagtagacgaatgtttttggaattcagtccctactcgagataatttctgtcgtgaagcgtgtgaaatgccacacttgcaggaaccttgccctgcctactgttgatacctggactgttcttcattccggaatctccaagatggctggtacacacacacacacacacacaaaaagctggataatgaactctgaatgatcattgccagattgcagtctccaatgcccgttttttgccccttgtatccataggcaaggatgaatatgatggatgagtgcgaggcttctctacaagttctgaggggggtggacgctgacatcactgtagaagcgaatgatataaaggcacgcacctgcttccactcatctagaatggatggatacagcttatttgaaaacagtcttcactctgtatcattactactatttccttcaacatttggtgcatggctccatgtgcttcattcttgtggaatcggaggtgggatcaactttttaattttatgcagatagctgtagcatcggcaaacaaaagtggtgcaatgagctttcaagagttgaaccagaagaaataccgcacgcccctaattgtaggtttgcaactttatctgcttatatgggaccaaattagtgatcgcatttcgtaaactgtctgctcatgacaatgctgcaacctctcgcagctaggaatgggcctacttgtgttgcagcagctgagtggaataaacggtataatcttttatgcaggtagcatcttcaaagctgcaggtaagctgtgcacttgtttactggcttgtggttttcgtctactagttgagcatcataactttagcaatggattttttactccttccaaatttgactggagcagtagggtattacggaactgtttagctgtttactgaataaaaagcgtcagtctctgtttggcaatatgcattttttacacatataggaatagtgtagtagattacaaatatcaaaagagttaaaatggagtaaagtgatcttacttttctcaaggcctagcgcattatagtatgtttttttaaaaaactaatgtattagtccccttgtaagttgtaacatggtttatcattctctgctttgatgaatgttgccattttattgtttgttccaagttctcctctgcatttgtctacaacagtgccggttaaccttgttttgactgtgagttctaacaatcaaagctctccagggctcaagaacagtaacctggacacatgtatacttggagtgattgcggcaagtacctaatgactaaatagacctgatctagtctcccaatgttttttcattaatcttctgacaacattccatcaggttcttgccactgctgttacgaccaagatcttggacagggctggacggagaatcctccttatcgtaacgtctgcttccctctaaagccactaatctgtggttcttctgtagcttaacttaactatcacttcaaattacagatttcttcttttgggatgaccctaagccttcttgtggttgctgttgtattttacatcaaggtaagttcaactttctttgcaaaattgtaatctagtatactgatgcaatacatggtttatgaacattttgacacgaagtgttgttgcagggtctcacaacacatttcactgaatattcttcttttttgtcatgggctattcgtttcaggacaatatttcacatgactctgacttgggtaacaccttaagtatggtgtccttggttggtgtcttggtaagtctgtcaactacattttatatgaacattgctttctaaatttggaatctatgccgtaattttttgcccaaatactttgttcaggcttatgtcactgcctactcctttggtatgggtgccattccatggatcataatggctgaggtatagtcacatataactaatttagctcataagatgcttgaggcacatgatgaaaggattctaaatgaaggcttaatctcgaaactttgcatattggcagatccttccagttagcatcaagagtgtggcaggaagctttgcgaccctagccaactggttgacatcctttggaataacaatgacagcaaatttgcttctgtcctggagtgctgcaggcatgca

SEQ ID NO: 4829 - DNA, 1029 bp, Zea mays
cttcattccggaatctccagatggctggcaaggatgaatatgatggatgagtgtgagacttctctacaagttttgagggggatagacgctgacacaactgcagaagtgaatgatataaaggtagttgtaacatcaacaaacaaaagtggtacaatacgttttctagagttgaaccaaaagaaataccgaactcccataattctagcaacaggcttacttgtattgcaacagctaagtggaatgaatggcataatcttttatgcaggtagcatcttcaaagctgcagggctcaagaacagtaacctggacacatgtgtacttggagcgattgcggttcttgccactgctgttacaaccaagatcttggacagggctggacggagaatcctccttattatttcttcgtctgggatgaccctaagcctgctcgcggttgctgttgtattttacatcaagggcaacatttcacatgactctgacttgggtaacaccttaagtatggtgtctttgattggtgtcttggcttgtgtcactgcttactcctttggtatgggtgccattccatggatcataatggctgagatccttcctgttagcatcaatagcgtggcaggaagctttgccacccttgccaactggctgacatcctttggaataacaatgacagcaaatttgcttctaagttggagtgctgcaggtacatttgccttgtacatgatggtgagtgctttcacggtcgtcttcgtcatcctttgggtgccagagacaaagggaaaaaccctcgaggagatacaatggttcttccagtgagctctagcatttcatctttatatgcaaatagcgtggcacatcctctaggatctataagaaaatatagtgaaatatagcataatcaatgtcatttagcaattttagtgtttaaatggaatttgctattgttttcgtaagaaaaactataaatattgaaattttataaaaatattactcaaatatatgtacgaggatgtcaagaagaaacgaaaacacaag

SEQ ID NO: 4830 - DNA, 2324 bp, Zea mays
cattgggtacctcgaggccggccgggacacattgcggccccgggagggcaccagaagcagccagcaagctcatgcccttcaaaagcctccggcagcccagcgccccagccagctagtggtgatctctcatctcagcagcgcgcctgaacgtgtgctccctgctaagctctgcgcctcgataggcaaaggaaaatcaaaccgatcgtcgtcagattaaatggccggtagcagcgcggagcagctcctctccaggatcgccgccggcgacggccacggcgagaactcgtcctacttcgacgggtggaaggcctacgacatgaaccctttcgacctgcgccacaaccgcgacggcgtcatccagatgggcctcgccgagaaccaactgtcgttggacctgatcgagcaatggagcgtggaccacccggaggcgtccatctgcacggcgcagggcgcgccgcagttccggaggatagccaacttccaggactaccacggcctgccggagttcagagaggcgatggccaagttcatggggcaggtgaggggcggcaaggtgacgttcgaccccgaccgcgtcgtcatgtgcgggggagccaccggcgcgcaggacactctcgccttctgcctcgctgacccgggcgacgcctacctcgtgccgacgccttattacccagctttcgaccgcgactgttgctggaggtcaggagtgaagctgctgcccatcgaatgccacagctcgaacaacttcaccctcaccagggaggcgctcgtgtcggcctacgacggcgcgcggaggcagggcgtccgcgtcaggggcatcctcatcaccaacccctccaacccgctgggcaccaccatggaccgcggcacgctggcgatgctcgccgcgttcgccacagagcgccgcgtccacctcatctgcgacgagatctacgcgggctccgtcttcgccaagccgggcttcgtgagcatcgccgaggtcatcgagcgcgacgccccgggctgcaacagggacctcgtccacatcgcgtacagcctctccaaggacttcggcctcccgggcttccgcgtcggcatcgtctactcctacaacgacgacgtcgtggcctgcgcgcgcaagatgtccagcttcggcctcgtctcctcgcagacgcagcacttcctggcgaagatgctctccgacgcggagttcatggcccgcttcctcgcggagagcgcgcggcggctggcggcgcgccacgaccgcttcgtcgcgggcctccgcgaggtcggcatcgcgtgcctgccgggcaacgcgggcctcttctcgtggatggacctgcggggcatgctccgggagaagacgcacgacgcggagctcgagctgtggcgggtcatcgtacacagggtgaagctcaacgtgtcgcccggcacgtcgttccactgcaacgagcccggctggttccgcgtctgctacgccaacatggacgacgacaccatggaggtcgcgctcgaccggatccgccgcttcgtgcgccagcaccagcacagcaaggccaaggccgagcgctgggcggccacgcggccccttcgcctcagcttgccgcgccggggagcaaccaccgcttcgcatctcgccatctccagccccttggcgttgctgtcgccgcagtccccgatggtccacgccagctaggtagtcaccgagcgttcggtaagactggctgtaggttgtgccctcacatgactgcaaacaagtggacaaaaaaaaaagacaagactaataaagggcgtacgtagctagcttgacattacacagagtgacagagacgttgcacaggcgtcagcaggcgtcggcggtaagcagctagtcaagtaggacgcatttgtcctcggtttcttcgtcttttttttttgacgaaggggcgaagccccctatttcattaagaaataggaatgtatgaaacaaccgcacccacgcggtaggacttccaaaaagaacagccacggccagagagttatctagactctaaacactaacgcaagatcagtgaagagactacgataacagggaaagttttggcctacgaagagctacataagactttcttatatacaacccaccaagacaggcagaagccacaaaagacctgaccagtaaggccaacaaaagacagacaactatcccaacaaggcttcacagcttcaacatcttgtcacccagaaatccgcctgtcaagaggacaccaccccaaggccctcacgaaagcttcacttgccgtctttcggattaacttgcttcctagcaccaccattctttgctccttcttttttctgacgaatcg

SEQ ID NO: 4831 - DNA, 2649 bp, Zea mays
  misc_feature (49)..(49): n is a, c, g, or t
  misc_feature (2237)..(2237): n is a, c, g, or t
tttccccattgaaaacgaacaccaccattgacactgataaatgtagtanagcatttgacaacatactttcctagaaagtaaccagcagagactggacgctacgtactaccacaccattggagcagccaatttaatcgtgtatagaactccgtatcgaaatttgtctgtgaatggaccttcatttgcatctaggtctagtacaatggatttcgaacaggacagcgccgatctggcaatacacacacgcacgacgtagcacagctgttcttcgttccacgcgttaattgaaggcaaagcgactgtagttgctgttggtggccaagttgtttaatgctatagtagcagccagtcactcctagggcaaattttaggacttttgcattgcattgccgccatgtagaggttgactgcacaccgagaatatcgagcattcattaggctccttgacttgttgctgtgaactccggccatctgtcacagtacgtatatgaccagatcggcaccatttgtctcggcctgacaatctcgcgcgccattggccatgcaaagctgtcctgccgttcggagagactagagagccagttggcaaattgacatttgcgataggtggggcggctttgactatgacatgatgacagatccagatggtcctccgctagtccccccgagcccgaggacagcacactagctcacacgaactgacagcgcggaggaggacacgtaccgggatgacaccgccacccatttgctggcaagccggggtgcgccggcggttcaggttgaatccttcctaatggtcgtgctagcaaaccccgcaagctcagtgcgggtccaaaacccattaattatcccacaaagccgccgttagacgtagaatcgacgccgcgcgccacggccggcggcggctacctggctcttaccaccatcattcgcttgtccgttccgtcgcccccgccaccctctcagagatggaggcggttaagtgcctgtcgactattgcagaacgtcgtcaggctcgctagttcgaccgagcatcctagatacataatccaaattccgctcggcgattataggagggtgatagtactgagtacagggcgaaaaacgttgaaaaggtcagcgaggcccccacatgtctcccccggtcgcgttcgcattcaacaccctctgcgctgcgtttcatggaagtttccagcagccacgcccacgcgcatggacgcggctgatcttataaaggtggcgcgcgtcccaacctcgggagccatcatttcaccagaagctgcaaattgcaagctctcctccctagctagcctctccagcagcccaaccacagcctgcagctgcagctcgcgttggcacagcgccgcctgaacgcgtgctaatttaagctctgtcgtagctcaacgcggccgccgggctttcgccgacgacgtcaaaatggccggtggtagcagtgccgagcagctcctatccaggatcgcctccggcgatggccacggcgagaactcgtcctacttcgacgggtggaaggcctacgacatggaccctttcgacctgcgccacaaccgcgacggcgtcatccagatgggcctcgccgagaaccaagtacgtgacgtagccctgccgcatgcagctacagctacaccctttcgacctgcgcaacaaccgcgacggcgtcatccagatgggcctgctgtcgatggaatgctcatgtaattaaaccaccggccggggcgtgttttgcagctgtccctggacctgatcgagcaatggagcacggagcacccggaggcgtccatctgcacggcgcagggcgcgtcgcagttcaggaggatagccaacttccaggactaccacggcctgccggagttcagagaggtacttattaattaagctaactaacagctcggctaaggaaacgccagaatcattgattaggtttgctgctccctaatggcgactgcgaaaacgacggagcagctaccggccagccggccggcggttagctagcactagcagccgccttcctgacagatcatccatgacgttttgattgttgcaggcgatggccaagttcatgggccaggtgagggccgggaaggtgacgttcgaccccgaccgcgtcgtcatgtgcggaggcgccaccggcgcgcaggacactctcgccttctgcctcgctgacccgggcgacgcctacctcgtgccgacgccatactacccagcgtatgtctcgaccnacgtcatccttgtacttgtaccgaaattagtcacccgttgacacgaaagttggtaagagcgcacggaaaggcagagctaattcgagtgtggtgtcaacaaataatagccaattgtagcccctcgccatcttcccttgtttgggtaacgtttcaaaatttacctcgttcacgaacctctaaaagtaagtagctagccccctcctcccccacagtcaaatcaacataatacagtacaatagaccttgttagtagcatggatgattgtcgtcaagtggacaacgcaatctagtcacgtaaggaaaaccatgcacgttgttcatacacgcggtctgtttccatgcgactttaatttccacgcacgtttgtatcgctgaccaaccaactgaacgtgcctgtaggtcccgcacagcaa

SEQ ID NO: 4832 - DNA, 1838 bp, Zea mays
ggcagatctccagtccccggccctccgtcccctcctcctgcgaaggctcctccagcaccactagctagagctaaccccgtgctgctgctgctgctactacctgctgccgcgcgccgttcgttgccgtgcgggcgtgttgtggtccgctgatctcgttcgcgggacgccggggggtggtggtggtggcagcggtggttggtggtgcgcggcgtgaaagaaagaaagaaaaaaaaaaggcccgccgctttgcgctgctctgcttccgtaggtgtcacgagatttggccctagcctttcgctttcctttttcatctcgctcacaagggaagggaccgagggacgagggagacgttggggaggggagcgagcgagccgtaacatccgagctgttccaatggcgacccctgccgttgctttcgtcgccagcgctttgttggggcggtggtagcgctaggagcggagcagtactaggttggtaggtggttgtagctttgcgcgtgacccgagcgcgcgctcgctcgctcctgtgcctctctacctcgcttgcgtgcgccgggaaggcagtgggtggctggtcggttctcgcaagaggttgctggtgctgttcctcctcccccggttgatgagcatggggcattgctccgagcagcggacggggttcgaggtgactaaggactggaacggcgccgaccagttcgcgatccggtccccgcggggggcgtccgttcgggtctgcctgcacggcgggcaggtcgtctcgtggaggaaccaccgcggcgaggagctcctcttcagcagcagcaaggcaatcttcaagccgccaagagcgacccgtggtggcattccgatatgcttcccacagtttggaaactgtggaacattggagcagcatggatttgcaaggaacaagatatggacaatagacgatgaggctccacctctaaattatggtgataataacagcaacaaagcttctgttgaccttctgctaaagccatctgaagatgacctgaagtgctggccacactgttttgagttacgtctcagagtctctctttcaatggatggagacctttcactgatatcacgggtcagaaatgttaatgggaagccattcagtttcgcatttgcttaccatacatacctttctgtttctgacatcagtgaagtgaggatagaaggtctggagacccttgattatcttgacaaccttagccagcgggaacgttttaccgaacagggagatgccataacatttgaatcagaggttgatcgagtctatgttggctgcccaggcgtaatagctgttcttgaccatggaaagaaacgcacattcatcgtgcggaaagaagggcttcctgatattgttgtgtggaacccctgggagaagaagtccaagacgatggcagacttcggcgacgacgagtacaagcagatgctgtgcgtggatgcagccgcggtcgagagggccatcacgctgaagcccggggaggagtggacggggaagctggagctctccgccgtggcgtcgaccaactgcagcgaccacctggatcgcccgggcaggctgtagagcgctgggtgggtgggttcgttcgcccctgacgaaaggcatgtactagttttttttcatgtacatgggggcgctaggtccggcccttgcaggctgcagtatcatctacctgtcaggtgtgtcatgtgtgagtttaaacttatgtcagatccaagtattgctgtgatcgacatgttcgatgttcctggactgcgaagtctcaagcgcaggctgttcgtttggctggctttaatccgaaacggcatctataaaatgaaaaaaaaaaa

SEQ ID NO: 4833 - DNA, 2740 bp, Zea mays
cgaaaagatgatacaccgagtctccaaggctcaagggactcggtaagtccagttcttgaaccgcatgctgttttactggcttcgatcctttggtgaaacagcgtatgaaattactgaggcatatgtggtttcatctctcgtctcgtcctggaagcaaacaaccatgaggattctagaggtgcgtactgatcagagagcattcgtaactggtgccatattctaattcaacttagttttcactgcctatgtttggaagggattcaaatgagttagaatgggaaaccctaaccctaacaggggttgggtgatgtattagtgcgactgtaggtccaatctgcatatgtgaagaacgaattttagcggaacaatttgaagaaattatcattcaaggttgagttattaatcttctgccccatctactatttgttgctcagtaaaatcgtgtcaattatctccaaaagacagatcacatccagtaattttttagaaaaaacaacattgtttagtgtcgcaatttgttatgctctgttgccttccactgtctacagattgttgatgaggccaatacaaagctcatgagggattatgtcgtggaggttagccacattgaagacaaaaactaaaacgtctgagtgatgatataggaagtctgactaagctaaggatcttgtgagtatcgccataatgtaactttttcttttgaaagatgcttctatgtttcacagtttacactacgactcaatcactcactttctgagcattgctttgcagagatctggctcaaacagatatcttggtggtccattgccagctgccattgggaagttgcttaagcttgaatatttgtaattatgatttccgagcattcattttctgtttatatttttggattagagattacagtatcagataattttgatatgagaatatagctttgatatgacaatgatattatgactttcatttctttttaggtaattgatgtacttttgcctaggaaatttgataatcatatctgtgcattttagcatgttctaagttcattcaaggtgctacttatggagttctatgatagtgtactagacttaggtggttgtataaaagcacctatgttatttgaattcagaatcgtaccagtttaaacattttctcagctataggccattaagcattcaagtctatagtatccaaaatgcaaccggaccatacatttctgatgtgaaccagtgctggttgtggttgcagaagcttgtgccacaaaccaaacatgttcatatcgtggccgtttcggccatatgttgggccatcttgaaatcaagcaatagaatgtgctttgagaatattctaattaaatcacctaatgaaattatctgccatgcgagcgctctgatgatttcatgggcaggtttgagcaaaagggagttgcagcctgcagggcttgattcaagaaggtgcaaagctgctggtttgggcagcgagcgtaacgttggatgctcgtgttgtcgatcaagtggaagaggataatgatgatacagagaattaaaagtttggtatagtgatcaactttccggtggaagcccgacgaggattgtctacttctggatcttggccgtgtagctttgttctgcttctcttgtgatgttcttgtccgagtataaggtctacaatggcataatgcttgtaccatctttttctgtggcaacttattttttctcatgcagtgcatgtgacttgaaactttgttaagacatagtttgtgaaagggaaaaggatccaatattttctgtagtcgattttggtatttgacgtccatcacaaacgattatgaacagaagctatgtacttgtctgcattttgtatatcatagtgatgtctgtcgatctgtatctattttttactcccgtcgcaacgcacgggcatgtaactatgatttagtgaagtacctagatcaactcacttgttatgattgttgagttgattcttgatagtatcactaaacaatgacatatttgtgtataagtgcccccgttgcaacgcacgggcatatacctattatatatatacttgctgtcttgctctagtggttacctctgtccgtaccgtacaacttgtaccagtgctagtacgcagctgcctgccgaggtaaaactgccatgctctgctgcgttgcgatggcaatcaagctgttttaaatttcgcggccagtgccccggccaatcgacctgcgtgcgtagcctggcgttggccactcagcgcgcgctagctcccgcagcggcctcattattatgccagtctcagtctccccggcggtgcccagtgcccactgtgccgaccaccgggctgacgaccgctgctgcaaccgcgtccccgtccgccgtcccggcctcccgagtccccgggctacctgccaatgaacaatagcccagccggtagcgcgcgggaaggcggcgagaagcatccccacgcgtccgcatgtgcggttgggagttgggttttggatattttctcggcgctctcgcagcccttcctcctcccctgctgtctcgttcatcatagactcctgtctgagcgagtccattgcatttgctgctgcggcaggtcctgccgccatgcctgactccctcgtgctccagtccaaacacaggcatctgtcttctgctagccattgatttcgtgtagaactgtactactgtagcctgtgtggctgcgggcacctgtactgtactgcaccgcgcaaagg

SEQ ID NO: 4834 - DNA, 1308 bp, Zea mays
gccggccgggtccgctctctctagctttaaaagcatcctctccgccgcggcgcaacggccacaccttccgtcccccggcctccgctcgcctcgccgcccgcctgtccctgtctgtctctctctctcctcgctgagtcgccgccagccatgaacaacctcctcacggattcctttgagctcccccggcgggactcctcaagagatgcagacattgaaatgggaatgcatcaagctgatgcttcagacaacttaaaagatttcttgaagaaggtcgatacaattgagagtttaattgcaaagctgacaaatctattgaataagctacagactgcaaatgaggaatccaaagcagttacaaaagcaagttccatgaaagcaattaagcagcggatggagaaagatattgatgaagtggggaaaattgctcgtcaggcgaagacaaaagttgatgaattggaaaaagacaacttatcaaataggcaaaaacctggatgtggaaaaggttctgccgtggaccgatcaagagagcaaactactggagcagtgaaaaagaaattgaaggagcggatggatgactttcagaccttgagagaagcaatcaggcaagagtatcgggaggttgttgaaagaagggtttttactgtaactggtaatcgtcctgatgaagagacaattgatgacttgatagagaccggaaaaagtgagcaaatattcaaagatgctatccaacatcagggaagaggccagatactagacactgttgctgaaatacaggagcgacatgatgctgtaagggatctagagaggaagcttctggagttgcaacagatattcatggacatggcagttcttgttgaggcgcaaggagacatgatcaacaacatcgagacccatgtctcgaacgccaccaaccacatacagcaaggtgtgagcgcgctccagaacgcgaagaaactgcagaggaattcgaggaagtggatgtgctacgccatcatcatactgctggtgatagtcgtggtcattgtcgtcgcagtcatccagccatggaagaagggcacctagcgtggtggtgccttttttcctgtttgtgtaatatgtgtgcagttttttttgtgggtgattcgtgatttgttgttgtacctatagtcgacgcaacaggagctctggcatttcgattcattctgtctagtgaaaggacactgccatcatatgccgatgaaaaataacgcttcattggaaaaaaaataatgtgttttatattttattgggattttttgtaattaaaaaaaaaaaaaaaaaaaaaaaaaa

SEQ ID NO: 4835 - DNA, 1624 bp, Zea mays
agtttaaaattgaagcttttgataaactttaatggatacgccttaaaaaatttcgtaaaatgaatattatgtgttgcatattgaaaacagtgcataaataataaaaaggtaataaataaatgaataaacttaatacatgaaccttgcattcatgttggaatatatttttgtgtgcaaattagaactttgtttgaatttaaatctaattggaatttgaaaataggaaataggaaaagaaaagaaaagaaaaagaaaaaagaatactcacatgtgtcatgggccaattaccacctcctagctcatcatcttcgtcacccagcgccgacccatgggcctattccttctctcccccgcgccatgcactcgcaggtggcccccaccccgcccgcgtccgctttaaaagcatcctctccgccgcggcgcaacggcgacaccttccgtcccccggcctccgctcgcctgtccctctctctctctctcctcgctgagtcgccgccagccatgaacaacctcctcacggattcctttgagctcccccggcgggactcctcaagagatgcagacattgaaatgggaatgcatcaagctgatgcttcagacaacttaaaagatttcttgaagaaggtcgatgcaattgagagtttaattgcaaagctgacaaatctattgaataagctacagactgcaaatgaggaatccaaagcagttacaaaagcaagttccatgaaagcaattaagcagcggatggagaaagatattgatgaagtggggaaaattgctcgtcaggcgaagacaaaagttgatgaattggaaaaagacaacttatcaaataggcaaaaacctggatgtggaaaaggttctgccgtggaccgatcaagagagcaaactactggagcagtgaaaaagaaattgaaggagcggatggatgactttcagaccttgagagaagcaatcaggcaagagtatcgggaggttgttgaaagaagggtttttactgtaactggtaatcgtcctgatgaagagacaattgatgacttgatagagaccggaaaaagtgagcaaatattcaaagatgctatccaacatcagggaagaggccagatactagacactgttgctgaaatacaggagcgacatgatgctgtaagggatctagagaggaagcttctggagttgcaacagatattcatggacatggcagttcttgttgaggcgcaaggagacatgatcaacaacatcgagacccatgtctcgaacgccaccaaccacatacagcaaggtgtgagcgcgctccagaacgcgaagaaactgcagaggaattcgaggaagtggatgtgctacgccatcatcatactgctggtgatagtcgtggtcattgtcgtcgcagtcatccagccatggaagaagggcacctagcgtggtggtgccttttttcctgtttgtgtaatatgtgtgcagttttttttgtgggtgattcgtgatttgttgttgtacctatagtcgacgcaacaggagctctggcatttcgattcattctgtctagtgaaaggacactgccatcatatgccgatgaaaaataacgcttcgtatccgtcggtgaaaaaaaaaaaaaaaaaaaaaaaaa

SEQ ID NO: 4836 - DNA, 1308 bp, Zea mays
cggacgctggcggagctcagatcctctgcggcgcaacggccacaccttccccggtcccgcctccgtctctgtccagcgggcctccgctctcctcgccgcccgcccgcctgtccctccctcctcgccgccatgaacaacctcctcacggattcctttgagctccctcggcgggactcctcaagagacgcagatattgaaatgggaatgcatcaggctgatgcttcagacaacttgaaagatttcttgaagaaggtcgatgcaattgagagtataattgcaaagctgtcaaatctattgaataagctccagactgcaaatgaggaatccaaagcagttacaaaagcaagttccatgaaagcaattaagcagcggatggagaaagatattgatgaagtggggaaaattgctcgtcaggcaaagacaaaagttgatgaactggaaagagataacctatcgaataggcaaaaacctggatgtggaaagggttctgccgtggaccgatcaagagagcaaactactggagcagtgaaaaagaaattgaaggaacggatggatgattttcagaccttgagagaagcaatcaggcaagagtatcgagaggttgtcgaaagaagggtttttactgtaactggtaatcgtcctgatgaagagacaattgatgacttgatagagaccggaaaaagtgagcaaatattcaaagatgctatccaacatcagggaagaggccagatactggacacagttgctgaaatacaggagcgacatgatgctgtaagggatctagagaggaagcttttggagttgcaacagatatttatggacatggcagttcttgtcgaggctcaaggagacatgatcaacaacatcgagacacatgtctcgaacgccaccaaccacatacaacaaggcgtgagcgcgctccagaacgcgaagaagctgcagaagaactcgaggaagtggatgtgctacgccatcatcctgctgctggtgatagtggcggtcattgtcgtcgcggtcatccagccatggaagaagggagcctagggtggctctaaacagggaggagggcgtgggagatacgtttttttttggctgtctgtgtaatatctgtgcagttgttgtgggtggttctgtgatttatggttgtacttatggacggcaccagagaagctttggtatttcgattctttctgtttgggatagttcgtgcagtccattgaccatagctctcagaaatgttattgtggtgaccatatattcatatgtcggtcagctgatgaaaagaatggtgcttctgaatctttcccc

SEQ ID NO: 4837 - DNA, 1279 bp, Zea mays
cacaccttcccccggtcccgcctccgtctctgtcccgcggcctccgctctcctcgccgcccgcccgcctgtccccccctctctctccctccctcctcgccgccatgaacaacctcctcacggattcctttgagctccctcggcgggactcctcaagagacgcagatattgaaatgggaatgcatcaggctgatgcttcagacaacttgaaagatttcttgaagaaggtcgatgcaattgagagtataattgcaaagctgtcaaatctattgaataagctccagactgcaaatgaggaatccaaagcagttacaaaagcaagttccatgaaagcaattaagcagcggatggagaaagatattgatgaagtggggaaaattgctcgtcaggcaaagacaaaagttgatgaactggaaagagataacctatcgaataggcaaaaacctggatgtggaaagggttctgccgtggaccgatcaagagagcaaactactggagcagtgaaaaagaaattgaaggaacggatggatgattttcagaccttgagagaagcaatcaggcaagagtatcgagaggttgtcgaaagaagggtttttactgtaactggtaatcgtcctgatgaagagacaattgatgacttgatagagaccgaaaaaagtgagcaaatattcaaagatgctatccaacatcagggaagaggccagatactggacacagttgctgaaatacaggagcgacatgatgctgtaagggatctagagaggaagcttttggagttgcaacagatatttatggacatggcagttcttgtcgaggctcaaggagacatgatcaacaacatcgagacacatgtctcgaatgccaccaaccacatacaacaaggcgtgagcgcgctccagaacgcgaagaagctgcagaagaactcgaggaagtggatgtgctacgccatcatcttgctgctggtgatagtggcggtcattgtcgtcgcggtcatccagccatggaagaagtgagcctagggtggctctaaacagggaggagggcgtgggagatacgtttttttttggctgtctgtgtaatatctgtgcagttgttgtgggtggttctgtgatttatggttgtacttatggtcggcaccagagaagctttggtatttccattctttctgtttgggatagttcgtgcagtccattgaccatagctctcagaaatgttattgtggtgaccatatattcatatgtcggtcagctgatgaaaagaatggtgcttctgaatctttc

SEQ ID NO: 4838 - DNA, 3329 bp, Zea mays
atccttcccggcacgtgcgtgtctcccatcgccaggtagatccctttcctcacgccacgccgagagagaaaagatagagggagaggcaagagtcgcatcgcagacccagaccacgccgccgccacctccgccgccacttccgccggtgatcgagtcgcgtcggcgctaccttcaagctagaagacaataagcatcggcagacatgttcggctccaccaacccatttgggcagtcgtccacaagcccatttggccagacctcgtttggaactccacagggatttggccagtcttccactgctgccaacaatccttttgccccaaaaccatttggcagcccgaccacagcttttggggcacagaccggaagctcgctctttgcaactacatccactggtgcctttggccagcagcaatccactcccgcatttggcacaacatccactggtgcctttggccagcagcaatccactcccacatttggcacaacatcctcatctcagtttgggagctctacaccagccttcggtgcatcccccactcctgcctttggtgccacatcctctggatctttgttcggacagaagccaagttttgggggttttggatcatcttctagccagtcaagtccttttggtaacacgttccagcaaacacaaccaacatttggcagcagcacttttggttcatcaactccgccggcgtttggtgccacggctcctgcatttggcacaactacaccagcctttggcaccacaactgcaccagccttcggtgccacgactagcccagcatttggttcaacttcaacatctttatttggtgcttctagcgccccaatgtttggttcttcagcctttggcacatctgctactggttttggaacttcagggactacagcatttggtgtgagtagtactactccgggttttggatcatcaagcacaccttcatttggcacatcagctagtgcgttcagttttggttcgtcaccatcttttggacaaacagcagtttcctctggtagcactccctttggaacaactccctcaccttttggtgcaccagctcctgcgtttggctcacagacagcagcaccaacttttggacaaccacaatttgctaatcaagctggaggaaccagaataaaaccttattctcaaacaccagatgttgacagtgctactagtggtactcagcctgctgcaaaacttgattccatatcagcaatgcctgagtacaaagagaagagtcatgaagaattgaggtgggaagactaccagcgtggagacaaggggggaccgaacacttctggaactccaacattggcacctagccgtccttctcctataccggataacacttttgcttcgacaagtaatccattctcaacgaacccattttcaacaaacaacccgtttgctcctaagcccactacaactactagttcaccattcaacacctcatttaacaatgcatcagttgcaagttcgagtctattcacatcatcccctggtaccacaatgtttgggcaaccaggtgtttctacacttccagctccagcaagtaattcaccatcattatttggaaatatcaatcctgctcctgctacatcgtcaatatttgccacgtcagtgacgaataatccaagtccattcggcactggcacatcattggctaacactcaatcagccccactattttcctcagcatttgctcaaccgacatcaagtacaccggctttctcctctgggagcctatttggctcaactaatcctggcagtctgtttaccagcagcggtccttcacttttttcaacaccaacatttcaaccatctgcccctgctcagagttcgaacatgttctccttccaacccccaattcaaccagcagcttctaccggtggactcccttttttccccaacacaaatcaggccttgacgggacagccaacttctagcctgtccagtatggtcatgcagcctgctcttgtttcaaatccatttgggatgcttccagcaatgcctcagatgtccatcgggaatggtggatcttcaccttcagttcaatatggaatatcaagtttgccggttgcggagaagcctcttccaagtagatcattgtccatggcggttcctaggcatttgtcacagagaaggataaaactgctgccaagaaaatataatccaatatctgatggcaaggttccattctttgctgatgatgaagaatctccagcaacaccaaaggcagatgcttttttcatccctagagagaacccaaggaacctggtaattcgtccaattgagcagtggtcttcacggagagaaactggccggcaatatactgcaaagaatgttactgattcgaacaaatatgaagatgcttccattgaaggtgagcgtggtaagtctgccatgtcaccaagcagcaggccacctgtagtggaaaatgacaaacagcatgaggccagggccatggctcaacatgcgaatggaaatgctacttcagttgagaggctgttgcctaagcttccacgtgcagattacttcacagagcctagtatagaggagcttgcggccaaagaacgtgcggagccaggctactgcggtcgagtgagggacttcgttgtgggtcgacatgactacggcagcatcaaatttttcggggagacggacgtgaggtgcctcgatctggagtcaattgtggagtttaacgaccgggaggttattgtgtacaaggacgatagcaagaagccccctgtgggcgaggggctgaacaaggctgcagaggtgactctactgaacatcaagtgcgtaaacaagaagaccggggagccgtgccagggggcaagagtggagaggtacagggagatgctggtgaagaaggcggaggagcagggcgcagagtttgtgtccttcgacgctgtcaagggagagtggaagttcagggtgaagcacttcagcgcctacgggctttggtgaaatcctggggagttaagtagtttgtttgttctgatggagcaacgctttacgctcttgtcaattaccatgcttggatctgttgtgctgcttctgtacaatgttgctgctgttaaaatgcttgcaaattgcactgctctgctgctgaaaacaggagcagcagtagaaactaccgcaacaggagggcgtgctacctgctactgttatgtattattattattaactatattctaagtataataagacttagttttttaaataaaaaaatattactttatgcacttagatatatgctatgtatggagagagaataattatgtataatagtttataaaatgatcgtaacttt

SEQ ID NO: 4839 - DNA, 2285 bp, Zea mays
  misc_feature (2233)..(2233): n is a, c, g, or t
tcgcgatctacaattcggctccacgcctcttgagtcttgacgaaagagagacagggaaagagggagaggcaagagtcgcagcctcgcagctctagacccagaccgcctccgcctccgccggtgatcgagtcgcgtcggcgctacattcaagctagaagacaataagcttcggcattcggcagccatgttcggctccaccaatccatttgggcagtcatccacaagcccatttggtcacaacaactcgtttggaactccccagggatttggccagtcttccactgctgccaacaatccctttgcctcaaaaccatttggcagcccgaccacgccttttggggcacagactggaagctcgctctttgcaactacatctactggtgccttcggtcagcagcaatccgctcccgcatttggcacaacatccactggtgcctttggtcagcagcaatccactcccacgtttggcaccccatcctcctctcagttcgggagctctacaccagccttcggtgcatcccccactcctgcctttggtgccacatcctctgggtctttgttcggacagaagccaagttttgggggttttggatcatctcctagccagtcaagtccttttggtagcacgttccagcaaacacaaccaacatttggaacgacgccggcatttggtaccatgactactcctgcatgggccatcactactcctgcctttggcacaagtacaccagcctttggcaccacaactgcaccagccttcggtgccacgactaccccagcaggtgcccccgcggccccgcccggtattcggtgcttctagcaccccagtgtttggttctacagcctttggcacatctgctactggttttggaacttcagggactacagcattcggtgtgagtagtactactccaggttttggatcttcaagcacaccttcatttggcacatcagctagcgtgttcagttttggttcttcaccatcttttggacaaacaacagtttcttctggcagcactccctttggaacaactccttcaccctttggtgcaccggttcctgcatttggctcgcagacagcagcaccagcttttggacaacctcagtttgctaatcaagctggaggaaccagaataaaaccttattctcaaacaccagatgttgacagtgctactagtggtactcagcctgctgcaaaacttgattccatatcggcagcgcctggatacaaagacaagagtcatgaagaattgaggtgggaagactaccagcgtggagataggggtggaccaaacacttccggaactcaagcagtggcacctagctttccgtcactaatacaacagaatgctccaaacccattttcgacaagcaatccattttcaacaggcaatccatttgctcctaagcctgctccaactattacttcaccattcaacaccccgtcgacccagccttcagttacaagttcgagcccattcacatcatcccctagtaccacaatgtttgggcaaacaggtgtttctacactttcagcaagtaattcgccatcattgtttggaaataccaatccagctcctgttacatcatcattatttgccacatcagtgacaaataatccaagtccattcggcactggctcattattcgctaacactcaatcagccccattatttccctcagcatttgctcaaccgacatcaagtacaccggctttctcctctggcagcctatttggctcaactaatccgggcagtctgtttagcagcagcggtccttcacttttttcaacaccaacatttcaaccatcggcccctgctcaaacttcgaacttattctccttccaacctccaattcaaccagcttctacaggtggattccctggtttttccaatactacaaaccaagccttgatgggacagccaactcctaccctgtccagtatggtcatgcagcctgctcctgtttcaaatccatttgggatgcttccagcaatgcctcacatgtccattggaaatggtggatcttcaccttcagttcaatatggaatatcaagtttgccggttgtggagaagcttcttccaagtagatcattgtccatggcgtttcctaggcatttggcacagagaaggataaaactgctgccgagaaaatataatccaatatctgatggcaaggttccattctttgctgatgatgaagaatctccagcacaccaagagcagacgctttntttgtccctagagagaacccatagaatctggtaattcgtccaattgagcagt

SEQ ID NO: 4840 - DNA, 1300 bp, Zea mays
ataattcagaaatgagtttttggcaatgattcctgttttggggtcttttaacatggtctatcctgctgcatttttacccagaactcctaccctgtccagtatggtcatgcagcctgctcctgtttcaaatccatttgggatgcttccagcaatgcctcacatgtccattggaaatggtggatcttcaccttcagttcaatatggaatatcaagtttgccggttgtggagaagcttcttccaagtagatcattgtccatggcgtttcctaggcatttggcacagagaaggataaaactgctgccgagaaaatataatccaatatctgatggcaaggttccattctttgctgatgatgaagaatctccagcaacaccaaaggcagacgctttttttgtccctagagagaacccaaggaatctggtaattcgtccaattgagcagtggccttcgcggagagaaactgaccgacaattgactgtgaagaatgctactgatttgaacaaatatgaagatgcttccattgaaagtgagcgtggtaagtctgcctctgccatgtcaccaagcagcaggcctcctgcagtggaaaatgacaatcagcatgaggctagggccatggctcaacatgggaatgggaatgctacttcagtcgagaggctattgcctaagcttccacgtgcagattacttcacagagcctagtatagaggagcttgcggccaaagaacgtgcggaggcaggctactgcggtcgagtgagggactttgttgtggggcgacatggctacggcagcatcaagtttcttggggagacggacgtgaggtgcctggatctggagtcaatagtggagtttaacaaccgggaggtggttgtttacaaggacgacagcaagaagccccctgtgggtgaggggctgaacaaggctgcggaggtgactctactgaacatcaagtgcgtaaataagaagactggggaggagtactgtgaggggacaagggtggagaggtacagggagatgctgatgaagaaggcggaggagcagggcgcggagtttgtgtcctttgatgctgccaagggagagtggaagttcagggtgaagcacttcagcgcctatgggctcccttgtagttaagtattctgtttgttttgatggagcagtgataactaagttgcacgctttacgctcttgtcaaatagtaccatgcttgattctgttgtgctgctttgtacaatgttgctgctgttaaaatgcttgcaaattgcactgctctgctgctgagaacgtattctaattagggggggc

SEQ ID NO: 4841 - DNA, 3958 bp, Zea mays
attccgaaaagcgtggcccgtgtggtctcattgcacgttgaacaacgagccattcattttccctttcctatttttcttggcgctgctgattgctaaatcctgctcctctttaggtatgttatttgttttttcccatttccttccttggatagataggttttcccccccaagaaacatttcggaccgcatacgttcatcatcggggatggatagcgcattgaaatctttttttttcaggaagagtgaatttacgttggccagctgaagctgcttgtcactttgtcagcactagcttgccacctcggctcatcatcatcagcttccatctcagtctcagtgtgtgtcagcagctttagtactcgtttcagaaattagacagaccaaccaccgttttttttccttccatcgtcagcacatgcaatgcagaaggtcctgcggaaagatttagggcatgtttggttcgctaactaacttgccacactttatctaacttttctgtctaaggttagttcttcaattcaaacgactaaccttaggggtaaagtgtggcacaattagtcacgaaccaaacaggcttttaagctttcccgccttttgcccacactgatcattggcaaaaacacgctcgaattccttatgttatccccacacacgcacacagagacgttggttcagctatgcctatcgccgctccacaatctcatctcgaataagatactgacgcacccccatgtctccccttccatcaccctggaaactgcagagcagagctacgcgctataccgcatattggtggggaaaagaaaaggattcaatcaggccgtctgaagagagcatgagcatgattataccggggcggaaagcgagcttttagtaaactgcctcacttgcgctataagtctagctgcaggagtgctctcggattcccaccccccgttctgtagctctcctctaatcctgatttttgtatgcgtggtggtcgctcttccgtctctcccagcccagcagccagcagtcgtctccttctctacctccctcgcatatcctgctcctctgtaaccactgtactaaaactagcctgtacctgtactgtgctgacattatatacagccccttctctttgcttcttgctcgtgccaattggcagttgccattgccaatcaccacgtagagctgcattattgcttgcttcgaggccatgggaactgcaagagttcgcttcgtggtccttgttctgatctctacgtttctcagagtcagaggtaaacaatccggtcgttttgaagactactgagaattcagttcttgtaaggcatggtgaactgacgtcgtctctggttcctgctttgcagaaggcagagccgcgacattcacgttcgtgaaccggtgcacggggacggtgtggccgggcatccagtccaacgccggaagctcgaggctggacacgacgggcttcgtgctgccgccgggcacgtcgcgcgcggtcccggcgccgtcggggtggtccggccgcgtctgggcccgcaccggctgcgggcaggacggcagcggcaaggtggtgtgcgcgacgggcgactgcgggtccgggtccctggagtgcaacgggcagaacgcggcgacgccggcgacgctggccgagttcacgctggcctccgcgggcggcaacgacttctacgacgtgagcctggtggacggctacaacctgccgatcctggtggagcccgcgggcggcgccgccaccggcgccagtgccacgacgtgcgccgcggccgggtgcacggcggacctcaacgagcggtgccccgcggagctgcgcgccgagggcggcgccgggtgccgcagcgcctgcgacgccttcggcaggcccgagtactgctgcagcggcgcctacgccaaccccaacacctgccgccccaccgcctactcgcagctcttcaagtccgcctgccccaactcgtacagctacgcatacgacgaccccaccagcaccttcacctgcgccggcggccgcgactacaccatcaccttctgccccgtcgccaccccaaggtaccgacatcttcatctcactcagttggagctcatcacccacccatgacccaccctcgtagtagttgactttttttttttttttgcccagccatgcccggttcattttattttacggttgctttggcgtgccgtcttgattaatgattagaacgtggttagtcataaaaagctcgcgagacttgcaagcagagtttggccggccggccggggcaaatgaactggccacggcacaccatgatccatggcccggtacactcgcacggcacctagcaatcgttaccggtagcggttggtgcatgatcaagagcgagcgagcgagtgaacactggtcactgagcgcgccatgtcaccttatctgtgtatatattaaatgcatgcatagaaaacgagtgcaggtatgccaaattgccaattgccatgttcatgtaataaaactctgatgaaatggggtacaagaatgggacagtggtggcgagaggtttggaaggttgcaaggtgattggcctggatcaagtactcagccacgtcaccacgtcggtagcagtaaacaatgaacgcgggaaggggggaaaaggcaaacaattaaggatggctttgctttcattatagattcacgggaccgggcgtttcttctttttcactaattaattgctggtccgcccctcttattattattcttatttccccgacggaacgtgcagcgtgaaatcgtcgagtggccctggagcggcaacaacgacggcggcaccgacaggcccgacgccgacgctcccgggggcgacgccgcggtcggcaggcggcggcccggaggggcagggcgtgatgctgggcgacaactcctggctcgccagcctcgccacgggcgacgcgtcgtccgcgccggcgctccgggccttgcccctcgcgccgctcctgctcgtcggcctgctcctgcttgtgctgctatagcaccaccagcgggaaacccaggcaaccgaccgcgtcacgggcgtgtgaggcgaaagcttttgatctcggacagcctaccgaacgcgcgcgctcctgctacgtttgatgaatcatctcctagtcacggtgcaggcctgcagtgcggcggatgattttgacggctagccgaatgcgcgcacccccatccccagtcagcagctgaaggaaaaaaagtttaagtggcctactcatggatgaggtggctgcagcatggactagacacaaatactattagtgctgatggtgtatagtaccgctgccgctttaaagtagtgtacagtgcagtgcagctctgatggcgctgtccctcggcacatgggaggagatgtgccatgccatgccatctgatctgtgcttgcggatcaatcaaatactacgtacgtgtctacgtaaaaaaaaaaaagcgtggtggggaggacatgggcgcggtgatgagaattgagatgatgcccgctgatctggtccactgcttttgagttttgagtgaagccaaaggaaggaaggatcggtgccgccaggcgttcatgcctccctataatccctataaccatttctgagctgcgtcgtatcgtatcaccctaggatcgcattccaattaggtcttgttcgtttgtaccggattgatggatcggaacgatttcaagccgaattagttctctaaattatataaactttgattagctggaacgattcctggtgcaatccgacgtaaacgaacaaggccttagtgtaaacgtaatgtcatgtttttaattcgtaaggttggttgatgcgatctgtgactgatcgagcacggtagggtccctagggaccatacatatcagagcttgcttatagattcatccacattctctcgatcactcgaccacgcactgagcctgtcttgctttcttgccgagagaacaactcccctgcaggt

SEQ ID NO: 4842 - DNA, 2117 bp, Zea mays
gcacgagaccattacctagaacatcctaatcgaaaaaccccccgttctgtagctctcctctaatcctgatttttgtatgcgtggtggtcgctcttccgtctctcccagcccagcagccagcagtcgtctccttctctacctccctcgcatatcctgctcctctgtaaccactgtactaaaactagcctgtacctgtactgtgctgacattatatacagccccttctctttgcttcttgctcgtgccaattggcagttgccattgccaatcaccacgtagagctgcattattgcttgcttcgaggccatgggaactgcaagagttcgcttcgtggtccttgttctgatctctacgtttctcagagtcagagaaggcagagccgcgacattcacgttcgtgaaccggtgcacggggacggtgtggccgggcatccagtccaacgccggaagctcgaggctggacacgacgggcttcgtgctgccgccgggcacgtcgcgcgcggtcccggcgccgtcggggtggtccggccgcgtctgggcccgcaccggctgcgggcaggacggcagcggcaaggtggtgtgcgcgacgggcgactgcgggtccgggtccctggagtgcaacgggcagaacgcggcgacgcctgcgacgctggccgagttcacgctggcctccgcgggcggcaacgacttctacgacgtgagcctggtggacggctacaacctgccgatcctggtggagcccgcgggcggcgccgccaccggcgccagtgccacgacgtgcgccgcggccgggtgcacggcggacctcaacgagcggtgccccgcggagctgcgcgccgagggcggcgccgggtgccgcaccgcctgccacgccttcggcaggcccgagtactgctgcagcggcgcctacgccaaccccaacacctgccgccccaccgcctactcgcagctcttcaagtccgcctgccccaactcgtacagctacgcatacgacgaccccaccagcaccttcacctgcgccggcggccgcgactacaccatcaccttctgccccgtcgccaccccaagcgtgaaatcgtcgagtggccctggagcggcaacaacgacggcggcaccgacaggcccgacgccgacgctgccgggggcgacgccgcggtcggcaggcggcggcccggaggggcagggcgtgatgctgggcgacaactcctggctcgccagcctcgccacgggcgacgcgtcgtccgcgccggcgctccgggccttgcccctcgcgccgctcctgctcgtcggcctgctcctgcttgtgctgctatagcaccaccagcgggaaacccaggcaaccgaccgcgtcacgggcgtgtgaggcgaaagcttttgatctcggacagcctaccgaacgcgcgcgctcctgctacgtttgatgaatcatctcctagtcacggtgcaggcctgcagtgcggcggatgattttgacggctagccgaatgcgcgcacccccatccccagtcagcagctgaaggaaaaaaagtttaagtggcctactcatggatgaggtggctgcagcatggactagacacaaatactattagtgctgatggtgtatagtaccgctgccgctttaaagtagtgtacagtgcagtgcagctctgatggcgctgtccctcggcacatgggaggagatgtgcccatgccatgccatctgatctgtgcttgcggatcaatcaaatactacgtacgtgtccacgtatatagcgtggtggggataattgagatgatgcccgctgatctggtccactgctttcgagttttgagtgaagccaaaggaaaaggaaggatcggtgccgccaggcgttcatgcctccctataatgcctctataaccatttctgagctgcgtcgtatcatatcaccctaggatcgcatttcaatttgtgccaacgtaatgccatgctttaattcgtaaggttgttggttgatgcgatctgtgactgatcgagcacggtagggtccctagggaccatacatatcagagcttgcttatagattcatccacattctctcactcgaccatgcaactgagcttgtcttgctttcttgccgagagaacaactcacctgca

SEQ ID NO: 4843 - DNA, 821 bp, Zea mays
actcctatgggcgattgggaccggccggccgggagctcagtctatcattccattgtctggtcatttgtccccggccggcacgtaataatcaccactatggccagcggacggagaaagagcggcattccagctctggggtggtggctcatggcagtcggcaccatccgctccgccatcgtgtggtcctgcctcttcagttctgcatcgctctgcttggccgtctaccccgagatgaccggcgtgcaggagcgagctatggctgcgtggactctgctatcctgcacgctctgcttcctgtgcgcgttcaacatggacagcaagccgctctacgtggccaccttcatgtccttcgtctacgtcgccggctacctgctcgtggagtgcttcttctaccacagcgtccatgcagccagtatcgctccgtactgcttcatcgcagggacatccatggtttggatgctgcttcaatggaactcccatggccgtggccgccgtccccgtgaggctagcaagcagccctgatccaacctctggttcttttgccatcgatgtgattggggcggtctactatacagacgatgaataaattatttatttacaaaaaaatgtattatatatataagatgcacaccgagttccgtacgttgttgctgttgacttgttgaatgtaagaagtgacgactagaatgggtgtcgtctaagttgagttgtattgtgtcgtagcatcttgatataaccctataatctgttgttggaaaaaaatgtttgctcagtcacaacaaaaaaaaaaacccgcccaatagtacacaccttttaagtaa

SEQ ID NO: 4844 - DNA, 792 bp, Zea mays
ttggctcccgggggggccggccgggtcctcagctcagtctatcattccattgtctggtcatttgtccccggccggcacgtaataatcaccactatggccagcggacggagaaagagcggcattccagctctggggtggtggctcatggcagtcggcaccatccgctccgccatcgtgtggtcctgcctcttcagttctgcatcgctctgcttggccgtctaccccgagatgaccggcgtgcaggagcgagctatggctgcgtggactctgctatcctgcactctcagcttcctgtgcgcgttcaacatggagagcaagccgctctacgtagctaccttcatgtccttcgtctacgtcgccggctacctgctcgtggagtgcttcttctaccacagcgtccatgcagccagtatcgctccgtactgcttcatcgcagggacatccatggtttggatgctgcttcaatggaactcccatggccgtggccgccgtccccgtgaggctagcaaggagccctgatccaacctctctggttcttttgccatcgatgtgattggggcggtctactatacagacgatgaataaatatttatttacaaaaaattgtattatagatataagatgcacaccgagttccgttgttgctgttgacttgttgaatgtaagaagtgacgactagaatgggtgtcgtctaagttgagttgtattgtatcgtagcatcttgatatatataaccctataatctgttgttggaaaaaaaaaaaaaaaaaaagcggccctcgagctccggcc

SEQ ID NO: 4845 - DNA, 1223 bp, Zea mays
cctggggccccccgcgcccgcccccgacctctctgccttttccttttccttcccccgctttctccttccttcctcctcctcccggctcccctcacccagccaccggccatgtcggtggagacggagcggagctccaccgagtcctccggggcttccgggctcgacttcgaggacaccgcgctcacgctcaccctccgcctcccgggctccgcgccttccgccgccgccgccgccgcggcttccctgtccctctcctcctcgtcgtcctccgccttccccgaccccgaccgcaagcgcgcctcctccgacgctgaccccggccgctcctccccgctcgccgcgtcctccgacgctgcaccggcacccaaggctcgtgtggtgggctggccgccggtgaggtcgtaccgcaagaacgcgctcgccgacgccgcgggctccagcaaggccgccaagttcgtcaaggtggccgtcgacggcgcgccctacctgcggaaggtggacctgcaggcgtacgccggctacgaccagctgctccgcgcgctccaggacaagttcttctcccacttcaccatcaggaagttcgccgacgacgagaggaagctggtggacgcggtgaacgggacggagtacgtacccacgtacgaggacaaggatggcgactggatgctcgtcggcgacgtcccctggaagatgttcgtggaaacctgccagcgccttcgtctgatgaaaggttcagaggccgtgaacttggcaccgagagccgcccgatgaggcacactagctccgttgggcgttggcacgcacgcacgcactggcgtcttgaaggaaagcgggaactctgctggtcttgatgaggatcttcacgtgagataggaacgtgtgtacagttgtcgccttatggtattgagttgaggaaacttggaagttccattacttgtctgtagtctctactttatatagatgcgaagaagcttgagatacacattgcctacaatgtctttttgatgaataagaccagacagcaccgaaccgaactcgtccttccacatctccacacggttgctttgccatctcggtggttttgtggtggtggtggtggtggtggtcgtgcttcctataggtgtgaggctgatggcgtggctgccatttatacaatctttaatcctgttttgttgagctttattatatggttttgttttgagagtccaaaaaaaaaaaaaaaa

SEQ ID NO: 4846 - DNA, 1259 bp, Zea mays
ttgggtacctcgagcgccggccccggcctctctgccttttccttttccttcccccgctttctccttccttcctcctcctcccggctcccctcacccagccaccggccatgtcggtggagacggagcggagctccaccgagtcctccggggcttccgggctcgacttcgaggacaccgcgctcacgctcaccctccgcctcccgggctccgcgccttccgccgccgccgccgccgcggcttccctgtccctctcctcctcgtcgtcctccgccttccccgaccccgaccgcaagcgcgcctcctccgacgctgaccccggccgctcctccccgctcgccgcgtcctccgacgctgcaccggcacccaaggctcgtgtggtgggctggccgccggtgaggtcgtaccgcaagaacgcgctcgccgacgccgcgggctccagcaaggccgccaagttcgtcaaggtggccgtcgacggcgcgccctacctgcggaaggtggacctgcaggcgtacgccggctacgaccagctgctccgcgcgctccaggacaagttcttctcccacttcaccatcaggaagttcgccgacgacgagaggaagctggtggacgcggtgaacgggacggagtacgtacccacgtacgaggacaaggatggcgactggatgctcgtcggcgacgtcccctggaagatgttcgtggaaacctgccagcgccttcgtctgatgaaaggttcagaggccgtgaacttggcaccaagagccgcccgatgaggcacactccgttgggcgttggcacgcacgcacgcactggcgtcttgaaggaaagggggaactctgctggtcttgatgaggatcttcacgtgagataggaacgtgtgtacagttgtcgccttatggtattgagttgaggaaacttggaagttccattacttgtctgtagtctctactttatatagatgcgaagaagcttgagatacacattgcctacaatgtcttttgatgaataagaccagacagcaccgaaccgaactcgtcctccacacggttgctttgccatctcggtggttttgtggtggtggtggtggtcgtgcttcctataggtgtgaggctgatggcgtggctgccatttatacaatctttaatcgtgttttgttgagctttattatatggttttgtttgagagttcaaaaaaaaaaaaaaaaattcctacgggatgctggtcagattttccctagcaagtacattctggtttgcttcgtc

SEQ ID NO: 4847 - DNA, 1183 bp, Zea mays
attgggtacctcgaggccgtcgggtcccccacgcccgccgccgacggcctctctgccttttccttttccttcccccgctttctccttccttcctccccgcctccccgctcccctcgcccagccaccggccatgtcggtggagacggagcgcagctccaccgagtcctccggggcctccgggctcgacttcgaggacaccgcgctcacgctcaccctccgcctcccgggctccgcgccttccgccgccgcggcctccctgtccctcatctcctcctcgtcgtcctccgccttccccgaccccgaccgcaagcgcgcctcctccgacgccgaccccggccgctcctccccgctcgccgcgtcctccgacgctgcaccggcacccaaggctcgtgtggtgggctggccgccggtgaggtcgtaccggaagaacgcgctcgccgacgccgcgggctccagcaagcccgccaagttcgtcaaggtggccgtcgacggcgcgccctatctgcggaaggtggacctccaggcgtacgccggctacgaccagctgctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgttcgtggaaacctgccagcgccttcgtctgatgaaaggttcagaggccgtgaacttggcaccaagagccgcccgatgaggcacactcccgttgggcgttggcacgcacgcacgcactggcgtcttgaaggaaagcgggaactctgctggtcttgatgaggatcttcacgtgagataggaacgtgtgtacagttgtcgccttatggtattgagttgaggaaacttggaggttccattacttgtctgtagtctctactttatatagatgcgaagaagcttgagatacccaatgcctccaatgttttttgatgaattagaccagacagccccgaacccgaacttgtcctccaccccggttgcttttcccatttccggtggttttgtggtggtggtggtggttgggcctccctaaaagggttagggttaaggggtggcttccctttaaaccattcttaatcggtgttttgttagcctt

SEQ ID NO: 4848 - DNA, 718 bp, Zea mays
cgttggccttctccttcccattcgcccttcctccctctctgtctctctccggcctccctcgcccacagagtcagagcggaagccgccgagctcggagcccagcacgcagcacgccgccgccggccatgtcggtggattcggagcggagctccaccgagtcgtccgcggcctccgggctcggctacgaggacaccgcgctcgccctcaccctccgcctcccgggctccgaccccgaccgttcctccccgctcgccgcgccctccgacgctgcgccgtctcccaaggcgcgggtggtggggtggccgccggtgaggtcgtaccgcaagaacgcgctcgccgactccagcaaggccaatttcgtgaaggtggccgtcgacggcgcggcctacctgcggaaggtggacctccaggcgtacgcaggctacgaccagctcctccgcgcgctccaggacaagttcttctcccactttcaccatcaggaagttcgccgacgacgagaggaagctggtggacgcggtgaacgggacggagtacgtgcccacgtacgaggacaaggatggcgactggatgctcgtcggcgacgtcccctgggagatgttcgtggagacctgcagacgccttcgcctgatggaaggttcagaggccgttaacttgggaccaagagccgcccgatgaggcgcaagcgcaactccagcgtcaccagtacgcactggctttt

SEQ ID NO: 4849 - DNA, 1202 bp, Zea mays
attggtacctcgaggccggccgggttggccttctcctccccttcgcccttcctccctcctctctcagtctctctccggcctccctcgcccacacagttagagcggaagccgccgagctcggagcccagcacgctgcacgccgccgccggccatgtcggtggatacggagcggagctccaccgagtcgtccgcggcctccgggctcggctacgaggacaccgcgctcgccctcaccctccgcctcccgggctccgaccccggccgttcctccccgctcgccgcgccctccgacgctgcgccgtcacccaaggcgcgggtggtggggtggccgccggtgaggtcgtaccgcaagaacgcgctcgccgactccagcaaggccagccgggcagccaatttcgtgaaggtggccgtcgacggcgcgccctacctgcggaaggtggacctccaggcgtacggcggctacgaccagctcctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgttcgtggagacctgccggcgccttcgcctgatgaaagattcagaggccgttaacttggcaccaagagccgcccgatgaggcgcaagcgcaactccaccgtcaccagtatgcactggcttttagtggcttggcttgttggaggaacgagggaacgtacttcgtcgctgttttgaggatcttcacttgacatatatatagcaatgtgtacagctgtcacctgctgcttttgcctgaggaaagtttgtagttccattactttacttatctgtagtgtctatctatctatctatagatccgaagctttgatatacacatggcggctacgatgtattttgatgaataagaccagaccagacaccgaaccgaactcgttcttccgcagctccacgcgcggttggcattttgagggttatgtggtggtgttttgcagtaggcgtgaaggctgatggcgtagctgccaattatttatacatcttaatctgtgttgagctatggtttttttgtttaatcgatcttggtttaaatcgcgacaatgcatgtcaaacgaaagaggtcctacttttctgct

SEQ ID NO: 4850 - DNA, 1862 bp, Zea mays
  misc_feature (8)..(9): n is a, c, g, or t
  misc_feature (19)..(19): n is a, c, g, or t
  misc_feature (35)..(35): n is a, c, g, or t
ggtccggnnaattcccggnggtgaggcaacagggnagggaaatctatacaaagcagtggaactgcgaactcgccgggccgggccgtcgtgttcacaaagccggcgccttttgctccccgatctcagttcccgcccacctctaagctcccaaggcgacgctgcggcggcgggacaagcggaaggacaagaggcggacttgtctccctgcccccaccccctccctcgcttcgcgcgtacccccttcagttcagccgggcggtaccgtcgacggcgccggcattgtacttctgctgcgcagctatcactgctctgagaaaatggttgcagcagcctttactgttgatttggacaagcctctagtattccaggttggccatctagaggagcagtatcaggagtgggttcaccagccgattgtttgcaaggaagggccacggttttttgaaaatgatatattggagttcttaacacgcacgaaatggtgggcagttcctcttatctggttgcctgttgtatgttggtgcctgagtacttctatcaagatgggcaatactatcacagatgtagctatgatgattgggtttggaatatttctgtggacactgatcgaatatgtgttacaccgattcttgttccacataaaaaccaaaagttactggggaaacacagcacattatcttcttcatggatgtcatcacaagcatccgatggatggacttcgacttgtctttccaccagctgccgcagctattttgtgctttccggtaaataatcttccttatgtattacgtaccagggtatgggtatctactctgctgttgctgacaatatgtcagatttccacaacactgatgttgaaattacttactacatttgttaaatgttgcatcctaatccttttttttctaaagctggttgaagtggcctgtttgtacatggaaatcgtcatggtttcaagctaatcagaattccttttaactttgttaactttcagttggatatcgataattttaatgccttttttttctgaactgttcatatagttctggaacatgatcaagctattttcgaccccgtctacaactcctggtctgtttggaggtggcctgttgggctacgtgatctatgattgcacacactactacctgcatcatggccagccatcatcagatcctgcaaagtatctcaagaagtaccatctcaaccatcacttcagaattcaaacaaagggctttggaataacttcgaccctgtgggatcacgtatttggcacgctgccttctacgaaaactgtcgacaagagcatttgattttgactggatcttctgctttgcgaagctcttatagtgatgttaggctttgctcgcattgcctgtgtccactttttgaggccagcttccctgttccatcatgtagatttggctttggcagtgtctctatttttttttatctctagcagaggactttaaaatcatcaattacagattggtcatcatcggtggaggttctgttggacaaatttctatccagtttctgattcttctccatggaccaactgtatgaaggcgatcaccagttgctggctcacagacgcgactgaagcgatcaccagtttggtttcaagtcaatgccatcagcggtcgtgttcacattatgtctagctagtgccagctgttagatcagcatgtaatgtatgtacagtgttttcttctctagtagcgtagcctctctgcaagggctgtttggtagcctgtgtctgcttaattttgctacaagtaattgcttgacaggttgaactttccccgttatatctctactatctaagccaggttttgtctaaaaaaaaaaaaaaaaaagcggcc

SEQ ID NO: 4851 - DNA, 1752 bp, Zea mays
gaagaaatgatgctgcttgggttcatatctctgcttctggctgcgacgtcaagtttcatttcggggatctgcatcgactccaagtactacaacagcagattctccccgtgcaccaaagaagaggtccaagaatcgataaatgcagagcatgccattgctcacgcgcgcaagcatctactggaggtcatcctgcaccattcaccgaggagaaatctgaaaactagttaccataaccatgaaggctgccgtgagggatatgagtcatttgtttcgcatgaaggtttggagcagctgcaccggtttatatttgtaatggctgtgactcatgtgacttatagctgcctgacgatgttactagcaatactcaagatccataaatggagaaaatgggaggatgaagcattcagggataatcatgaatcattttctcagatcgcatatgagtcagcaactagaaggcaaccagcacttaccaaatcctattcattccgctcttggagccaaaataatgtggtcatgtggcttgtttgctttattgcgcaatttggtcagtctgttgttcgagcagactatcttatcctccgcaagggttttataatgacccacaatcttccgccaacatatgatttccacaattacatgatacgctcaatggaagaggagtttgagaagattgtcggagtgagtggactgttgtggggcttcgttgttgcttttatgttatttaatgtagacggatccaacctgtacttttggatagcaattcttcctgtaactcttgttcttctggtgggtgcaaagctgcagcatgtgattgcgactctaacagcagagggcgcaaagatgagcacctacgggccaaggatacagccaagggatgatctcttttggttcaagaaaccagagtttctcctttggttgatacacttcgttctctttcagaatgccttcgagttggcttcgttcttctggttctggtggcaatttggttatgattcatgcttcatcaaaaaccaccttttggtatattgccgccttatactggggtttgctggacagttcctgtgcagttacagtacattacctgtatatgcgctggtcactcagatggggtccaagtacaaggctgcgctgatcccgcggaggatcagggagaccatacatgggtggggaaaggcgacgaggaagaagcgccggcgccgccgcggcgacgactcgacggtccgcacggagacgagcacggtgtgctcgctcacggacgacgacgaagacttcgaagacgacgaccaccaccaccaccacggaccgtcgtacgagaccccgagagccgggggccgcccgccgtacctgaagatcgagacgcatcgtcagtcgggcagcgggcacgacggccccaggcccggcggcaccccgtgcttccaccccagcggcagcggcagcgggcacgccatgctcctgcggcaggcctccgtctccgcgccgtcgtcgccgtcgtaccgcggaggcaataacgtgacaaggtcggcgtccatgcccgggatcgccgcgctgaggacaacgggctccggcacgccgacgcgcgtgagccatgaggagcccacttgatgcgcgcccgtgcatgccatggatggcttgctagtgcagacgtactgaggactgagctgctagtgtagcaccggatttgaaggtatatcgatatatatatacacacgaaaagatttggggtgacaaaaaaaaaaaaaaaaaaaaaaa

SEQ ID NO: 4852 - DNA, 871 bp, Zea mays
ggtacagtgctgcaactgctcccgcatgtcatggagtacgcaatacaaccgtagctccggggcttctgaggaaaagcctcgcaatagaggccataataaataagggcgacacgccatccccaccgaaccctacccctacccgcgacttcgctcagcttccgccgatcggcttgccccgtcgatttcgccaacccctcgacccgatcggctccattgatcgtacctcgtcgtccggttgtcgatggccaggacctctttcaaaatggagcacgacctcgagaaaaggcagtccgaatctgccaggatcagggataagtatcccgacagaattcctgtgattgttgagaaagctggcaaaactgatgtccccgagattgataagaagaagtaccttgtccctgctgatctcactgtcggccagtttgtctatgtggtgaggaagagaatcaagctgagcccagagaaggccatctttgtctttgtgaagaacaccttgccaccaactgcctctttgatgtctgcaatctacgaagagaacaaggacgaggatggcttcctttacatgacctacagtggtgaaaacaccttcggctctgcctagagcaatcgcccctgccactgtaaataaacgagcatgatggggctgctgctattgtaaacctgtgtatatacctcagtctctagtatgctgctgccggattgcttcaatggcttcaatgacacccttagctttcaactgtttggatttctcctgtgacattgaattccttcggtatcgaaacatttgatcatttcactattaaaaaaaaaaaaaaaaaaaaaaaagccccaaaaaaaaaaccggccctaaaaaaaaaaaaaaaaagcggcc

SEQ ID NO: 4853 - DNA, 1147 bp, Zea mays
  misc_feature (1)..(1): n is a, c, g, or t
  misc_feature (1036)..(1036): n is a, c, g, or t
  misc_feature (1045)..(1045): n is a, c, g, or t
  misc_feature (1053)..(1053): n is a, c, g, or t
  misc_feature (1064)..(1064): n is a, c, g, or t
  misc_feature (1072)..(1072): n is a, c, g, or t
  misc_feature (1088)..(1088): n is a, c, g, or t
  misc_feature (1090)..(1090): n is a, c, g, or t
  misc_feature (1098)..(1098): n is a, c, g, or t
  misc_feature (1113)..(1113): n is a, c, g, or t
  misc_feature (1118)..(1118): n is a, c, g, or t
  misc_feature (1122)..(1125): n is a, c, g, or t
  misc_feature (1127)..(1127): n is a, c, g, or t
  misc_feature (1129)..(1129): n is a, c, g, or t
  misc_feature (1131)..(1131): n is a, c, g, or t
  misc_feature (1134)..(1135): n is a, c, g, or t
  misc_feature (1145)..(1145): n is a, c, g, or t
  misc_feature (1147)..(1147): n is a, c, g, or t
natttacgggggtggtgcgccgctaggtttatagtgatagacgccgttatgtagccgccccgtgggtggggaacggtagaatgccgcctctttgcgcaccaacctgtgtaaaggggcggataaaaccgtggcaaggggctgtattgtcaaaagagaaggcggagaagagagccgcgcgcggtgaaagaataagggccgtgctgacataacaagagagggggggtgggccggatttcccaatttatatcgcagaggtgggccgacaaaccagagtgtttaaaccacgcgggggaagaaccgcgggtccaaggtaaaaggggcgcggacccacagagatgagtgggcgggaattaactgtgcccggtccgttaatgggcccacccaccagggcgggtatacccactgtgcgggactttaccagggctgggtaaaattggtgtgagaaaaaggggagggcgggataacaaatagggcgccaacggggaaaacaagggggtgaacccggggggtaacaccggggcgcgccaattataccctccgttaaagggagcacaaaccgggaactgccacaccggggacggaccgctataggggtaaatgatccgccggtctgcagggattcacacgggaccggtacctgggacaccgccacgccatccccacccccacccctacccgcgacttcgctccgcttccgccgatcggcttgccccgtcgatttcgccaacccctcgacccgatcggctccattgatcgtacctcgtcgtccggttgtcgatggccaggacctctttcaaaatggagcacgacctcgagaaaaggcagtccgaatctgccaggatcagggataagtatcccgacagaattcctgtgattgttgagaaagctggcaaaactgatgtccccgagattgataagaagaagtaccttgtccctgctgatctcactgtcggccagtttgtctatgtggtgaggaagagaatcaagctgagcccagagaaggccatctttgtcctttgcgaagaacaccttgccnccccactgncctctttngacgtcttgcnctctattnaccataccaaggcatnangacgcctntcctaccttccctgnaccanctcnnnntngntnaanncccctttttntn

SEQ ID NO: 4854 - DNA, 3311 bp, Zea mays
  misc_feature (1969)..(1969): n is a, c, g, or t
aaaaatactacacggaagaaaaaaatataaacgtgttcaacagctagtccgttatttcctttattttcccttctacgcaaaagaaaagaaagaaagttccggaaaaaagaaagtaactgaaaatcaaatattgccaagtcagggaaaaaaatgcacacaaggaaagagcatctacatatcccaaataccctacgtctacctcaacggacactctatatctcctctcatcgtcgcgcaaaatcctcgccaaccgatcctcctcctcctcgctcgacgagtcgtctgtgagaacaatggcaactgccgcgggtggagccaccgccggctcgcgccgtcgggcgctgctcctgatcgcgaactacgccgcgctgctggtggggtccgtctcgtcgagcctgctgtccaggttctacttcgcgcgaggcgggcggaaccggtgggtggtgacgctggtgcagtcggcgggcttcccactgctggtcgtcgccgtcctcgtcgccggccgccccgccgccgcgccgcgccccttcacgtggttctcgaggcggttcctcacggtgtgcctcgtcatcggcgcgctcatgggcgccaacaacctgctcttctcgtacagcacgtcgttcctgcccgtgtccacgtcgtcgctgctgctgtcgacgcagttggcgttcacgctcgtgctggccgccgtcatcgtccgccacccgctcaccttcgtcaacctcaatgccgtcgtgctcctgaccgtcagctccgtgctcctggcgctccgctcgggggactccggcgagaacccggacgggggcggcgcggccgcggcgcactacttcgccgggtacgtggtcacgctgggcgcggcggggctgttcgccgcgtacctgcccgtcatggagctcctgtaccgccaggccgtgtccggcgggttcgtcctggccgtggaggtgcaggcggtgatgcaggccatggcctcgctggtggcggcgatcgggctggcggccaagggaggcctgggcggcgacgtggcgcgctggaagggctcggcggcgctctactgggtcgtggtgtccaccctggtcctgacttggcaggcgtgcttcatgggcacggcgggggtgatctacctcacgtcgtcgctacacagcggcgtgtgcatgaccgccgtgctgacggcgaacgtgctgggcggcgtggtggtgttcggcgacccattcggcgccgagaagggcatcgccaccgcgctctgcgcctggggcctcgcctcctacctctacggcgagtacaccaagaaaaagaaagaagaggaggatgaggccgtcgccgtcgccgacacgtccgcttccgacgccgacagcgtccggaagagcctcacaggcggcgccggagacgagctagaagccgtctgaaaacaaactaaaggccacagggggtatgaaccgtgtgatcagggacgaagcaagaatggaaactgaaaagggtgtagctgcagttgttgagtcatgttagatcgatggattataggcaaagttacaagcaaccaaacttgtaactgatggccagctcttctggctgctagctagtagctattaatctagtcatgaggtttcactagcggtttaagtgatcagggtttagtactttagtgtagtgtggggtgggtggaatacaacatgtaaaccagctgttcctcctccttactcactgtcgtcatcaatattcaatagccgctgttgttgatatttgaccaggcttagctgtagtagttttttttttacaaatcacatgacgaacatttttaaatcttatattaaaatgaatttagaaaaaaaaaacgtgtcaactcgaggatttacaccctgctttattacaagtttcaccacaagtgatctaataaccagtttagtacatgactggatcctcgtctcggtcttaatttccatgcaacggcttgatcttttcctctgaaacaatntcagggggatccttttcctttaattgatacaatgacatgcatttatcctgttgtacatgagactatgtagaggcaacaagagtgtttaactaacaatgtgtagtgcaacagttttgccttcacttgttgagtgacacatgactcgatttttctgatagcagcgtgtgtttcttttgcagttcggcgatatcttttaatttcccccttttcttcgtctccggctttcattctttttcatctagtcggagagaatctgatatttgccattacaatgaaatacgttcgtaaaattgtcattgaatccatattttatagactcagatagacccagaattcatacacatagtgacaattataatgagccaacgtattaaatggcaaaataccaattatttccatcggttgtatgcctccgtagctgaaaaagtcaaacacagtcgtgcgcagcagatgcatgcacgtatttatatatatgcaacactacacagaaagttggtcttcctgtattgctctatgcatgaaacattccaatcacattccaagttaagctcagcggctcaggtacatgaacttgtagccgactttgtgtgtgatggaattccaatcagtggatagctgcacattctaggtatacactagctgctagcctgctcctaggtgaaacaccatatagttatgggccaggggtatatacacatctatggcgctagatgtggattgacacacaggaggacagtacttgtgagcctcaagatgatgagagctacactgctccgtagtgatcatttggtttgttctgactaggcctcgataacaagtcagatcgactcggctcgacttttaatagcttgttatcttaacaagtctgaaaactatctcaacttaattctgtttataaattcaactattcaagttggttggtttagctcgcatggcagatataaaaatacacacataaatataatatacatttatctctagcttgagaataataatacaaaagtaatgcatccataaaccttaaatcaaacaaattaactaatatatactgagatatatacaaacataacaatatactatagtatcacaccatacaacatacattatagattatcggtacatccattcagggatagcattctcggtccaactttgattgtagttcaatttggaattttaaaacataagtcaagttttggtcgacaaaacggtttttaaaaattacaacacgaaaatataatcgctgaatccattagaacagattgatgtaaaactaatatacatatgtcgacttaagcacgagccgaaatgttggcttaattcttgaaaagtaaaagaaccg

SEQ ID NO: 4855 - DNA, 1420 bp, Zea mays
attgtgagagagtacgaggcttattggatgatgaaaaatatctgaagcgaagctaatactggagttgctagaatctgattctagtccaatctagtgtaccgtgtgtatagagaaagaaagaagaggaaagaaagaaagcaaaggcgaaaggaaatatctcgaggttgggtgccacgggaaaatatcgcgatccacgtggaggcggaggggatctaaaaatcctatcctcaagtgcgcttttgccctttattcccatttggcccgttaaattatctccgacccgatccgacccgacacacaaatatctccaccccctgttccggcgacgactacgatttgggaggaaggtaagcgaatgggtgaggaggcggtcgacgactacgagctccacatggtgtgctacggcggcggcggcggcggcgaggacgagcgcgtgatggagtgggagtcaggtctcccgggcgccgacgagctgaccccgctgtcgcagccgctggtgccggcgggtctggcagcggcgttccgcatcccgccggaggccgggcggacgctgctggacgtgcaccgcgcgtcggctgccacggtgtcccggctgcgtcgcgcgccgccgccgtcgtcgtcgggcagcggagggagctcctccttcgcgcccttccatccggcggcgaggggggacgaaggggcggactcgtcggcggcgggcggcggggcggcggcgacgacgaacggcaacaataacatgagcagcagcagcaagcggccccggctggtgtggacgccgcagctgcacaagcggttcgtggacgtggtggcgcacctggggatgaagaacgcggtgcccaagaccatcatgcagctgatgaacgtggaagggctgacgcgggagaacgtggccagccacctgcagaagtaccgcctctacgtcaagcggatgcagggcctctccgacgagggcccgtcgccgtccgaccacatcttcgcatccacgccggtgccgcaaagcctggtgcatgaggtgcccatgtacggcaccatggccagcggcggacaggcgtaccacaaccacaacggaatgggaggaggagggtaccagtaccagtaccatcactaccaccacgcccacaaatgactcttctgttggattggatccctcaataatcccatcgatccttttggttttggatctcttgctaattcagttcttcgtgtgagcggtaaatggatctcttttaagaaataaagaaagaaagagaagtttcttttccctttccaacaaaaatgcccttcacttcttccttgatgattgaaccacgaatgttcatgattcttttatcgagacaataaaagaagaagaaaacgctgcgcacagtcgttaaccaaagcagaggtggagctttggacatagctgaggcaaaagcag

SEQ ID NO: 4856 - DNA, 1107 bp, Zea mays
gcacgagaccattacctagaacatcctaatcgaaaaccaccacatctaatccttcctcccagctggtccctgcggccgctgctgctcgtccctacaagtatatcaaccaacagtgctcacatcatgcactctgtggtgtcttggtagtagttgttggggtagctagctagagagagcagcaggccagcacagcagcatggggaggtcgccgtgctgcgagaaggcgcacacgaacaagggcgcctggaccaaggaggaggaccagcggctcgtcgcctacatcaaggcccacggcgaaggctgctggaggtcgctccccaaggccgcgggcctgctgcgctgcggcaagagctgccgcctccggtggatcaactacctgcgccccgacctcaagcgcggcaacttcacccaggaggaggacgacgtcatcatcaagctccaccaggtcctcggaaacaagtggtcgctgatcgccgcccagctgccggggcggacggacaacgagatcaagaactactggaacacgcacatcaagcgcaagctcatcgcccggggcatcgacccacggacgcaccagccggcgagtgccgccgcagttgcccccgccgccgccgccgccgcgcaaagcagctttcgccaccatggcgacgacgaggcggtggcgcggcgcagctgctcgcgagacagcggctgcatcgcggcgcacagcagcgacgacgacgacagcacgtccgggtccctgccacaccaacatgctgtcggcggcatcgacctcaacctctcgctaagcccaccgacgagccaaccgtcatcgccggccgccgccaagggagttgtagctagcggatatggccaagggagtgagagctagctgtacctcctctgcactgccacgatgatggttgtcaattgttgttagctcctcctcctcgtcttatgttcttccatgcaggccggaagatcctaaagagaacgtgtgcgtgcgtgtgagaattaaactcgtgtctgttgttcgatcgggcgctctaagatttggccatgccccatgcatgaggaaccctgcaggggccctcctactttttgagactcaaaaaaaaaaaaaaaaaa

SEQ ID NO: 4857 - DNA, 1666 bp, Zea mays
gaattgggtaccctcgaggccggccgggacacccactgcgccccggcctgctgcccggctcccatatgtatgccctccgttgcacttgcactgcaccccctgtctgtccccacccttctgccctggcttatctctttccgcttccccctgttataatagcaaccaaaccaaaccaaaccagagctcaggaggagcttccacgcaaactcaggggaggcgcgcgcaagcaagcacacgagggagaaccaggcatggggaggtctccgtgctgcgagaaggcgcacacgaacaagggcgcctggaccaaggaggaggaccagcgcctgatcgcctacatcagggcgcacggcgaagggagctggcgctcgctgcccaaggccgcgggactcctccgctgcggcaagagctgcaggctccgctggatgaactacctccgcccggacctcaagcgcggcaacttcaccggcgacgacgacgagctcatcatcaagctccacgccctgctcggcaacaagtggtcgctcatcgcggggcagctgcccggccggacggacaacgagatcaagaactactggaacacgcacatcaagcgcaagctgctcagccgcggcatcgacccgcagacgcaccgcccgctcagcggcggcgcgggcagcgcgctcaccaccacgtccagcaccgccggcttcccgtcccccgcgccggcgtccaggtccaggcccacgcccacgcccccgcccaccgtcgtcgtcccgcccaatgcgatcttcgtgcgcccggcgccgtcggaggacggccacagcagcagcggcgcgagcacggacgcgccgcgctgccccgacctcaacctggacctggacctgtccgtgggcccgccgcccaagacgccggcggccacgcagcagcagcggcggcggacgaccatctgcctgtgctaccacctcggtgtccgcggcggcgaggcctgcagctgcgagaccgcgtcgtcgctggcgggcttccggtttctccagccgctggaggagggccagtacatataggtaaaggtaggcgtcgttaaatcactgtaggcaggcagaggcaaccctcgcaaacctgtaaagacagccaggggaaaaaaatggagagtttctaatggacggagatggttgtgatggcggccctcgggccccctttctatcttcagaactgatgcgattcccctttccgtttttttgagttcgttgtacggttcttccgttgggtgcatcgtgtttggttgcgcatccgaatcgggcggggcctggcttggcttggcttgacatttgtgccatgtcatccatgcggtgcgcagtgcgttgatggtaggtacgcaacataattttatttttattattatttgggtgctcccaggaaataagaaacacacgaagcaaatttgtatctgggtgctcccagtaaataagaaaacttcggagaaactgacgtggccttgtttttccggaaaggtttcttcatcgtttaagcgtgagagcgacatcaatggtattgttttctctgaaagaggcatggatgaaaccgcgaacgtggtgccctagtggtagttagctaaccaacccaggtaggccaactgataaaaagggcagtgggaacacaagataaagcgccggcagccaggggtaccgag

SEQ ID NO: 4858 - DNA, 1017 bp, Zea mays
ggtaccctccggcctgccggatatggccatcacgagtgacagcccaatacccgtcccatcggtcgacgccctctgataaaaatctggcagaaaccgaaccgtagagcccgagcctcgcggtcgcggatccgtcctgcaaatctcctctcatacttctccaccggatccctgtaagattcccggagatgtcggacgaggagcaccagttcgagtccaaggccgacgccggcgcctccaagacctacccgcagcaggccggcaccatccgcaagaacggctacatcgtcatcaagggacgtccctgcaaggttgttgaggtctccacttccaagactgggaagcatgggcatgccaagtgccactttgttggcattgacgttttcactggaaagaagcttgaggatattgttccttcttctcacaactgtgatgttccccatgttgatcgcactgagtatcagctgattgacatcactgaagatggatttgtgagccttttgactgacagtggcaacactaaggatgacctcaggcttccgactgatgaagctctggaaggccaggtcagttagcggcggcagattcccctccaccgcttctgttccaggtctctgagactgagacatttcgctctacgtctgcagatcaagagcggatatgatgatggaaaggacctcctcctgacggtgatgtcttccatgggcgaggaacagatctgcgctgtcaaggagatcgggggcaagaactaaagccgctgctgctgtctcgtgtgcttagagttgagatgcatagataaagcgtataagttatctgtggttttgggtttacctggaaatttgtcgaggtggttggtgttactactctacttggttagcgatctgtggtattcttttcaacttagttatggtcaatatgtattcagttgaaatatttggttctaaattcttgcctacagtcttgttatgccttgtaggatcggcagcagctctatcctatgcctttgtattgagggttgcg

SEQ ID NO: 4859 - DNA, 910 bp, Zea mays
ggcccatcacgagtgacagcccaatacccgtcccatcggtcgacgccctctgataaaaatctggcagaaaccgaaccgtagagcccgagcctcgcggtcgcggatccgtcctgcaaatctcctctcatacttctccaccggatccctgtaagattcccggagatgtcggacgaggagcaccagttcgagtccaaggccgacgccggcgcctccaagacctacccgcagcaggccggcaccatccgcaagaacggctacatcgtcatcaagggacgtccctgcaaggttgttgaggtctccacttccaagactgggaagcatggccatgccaagtgccactttgttggcattgacgttttcactggaaagaagcttgaggatattgttccttcttctcacaactgtgatgttccccatgttgatcgcactgagtatcagctgattgacatcactgaagatggatttgtgagccttttgactgacagtggcaacactaaggatgacctcaggcttccgactgatgaagctctggaaggccagatcaagagcggatatgatgatggaaaggacctcctcctgacggtgatgtcttccatgggcgaggaacagatctgcgctgtcaaggagatcgggggcaagaactaaagccgctgctgctgtctcgtgtgcttagagttgagatgcatagataaagcgtataagttatctgtggttttgggtttacctggaaatttgtcgaggtggttggtgttactactctacttggttagcgatctgtggtattcttttcaacttagttatggtcaatatgtattcagttgaaatatttggtttaaattcttgcctacagtcttgttataaaaaataggatagaaaccgcctcgagcccagccctttgtattgagggttc

SEQ ID NO: 4860 - DNA, 681 bp, Zea mays
  misc_feature (33)..(33): n is a, c, g, or t
  misc_feature (61)..(61): n is a, c, g, or t
  misc_feature (63)..(63): n is a, c, g, or t
cagagaatgacaggccacggcatgccaagtaanccaggagaatgttaggcttgacttctcngnattggggttgtcttggcaaggacggcggtgctctagcaaagatgatacccctttttatgatgtttgctggtggtcctctggggacgggacgccaatggttttcttggattcatctggatgacctagtcaacctcatctatgaatctcttacgaaccctacatacaaaggtgtaatcaatggaactgcacctaatcctgtgcgtttgtctgagctatgcgaacgtctggggcgaatcgttgggcggccctcttggttgcccgtgccgggatttgctctcaaagcggtgctaggagaaggcgcttctgtggtgttggaaggacaaaaggttgttccggcgaaggccaaggatctaggcttctcctatagatacccctatgttgaagacgctctaaaggccattgcccgagacctgtagagctaggttgaggacgatacaggcaacttaatttaattatttcttatcttaactaggaacgtgcccgtgcgatgccacggaatacaaattgcgaccctttaatagacttagggccctgacgacgtgcggcgtgagtacaatagtgacggcaaaatatgtgattgttaaacatagatatagaacgatataaataagtctaccc

SEQ ID NO: 4861 - DNA, 1647 bp, Zea mays
  misc_feature (26)..(26): n is a, c, g, or t
gcacgagaccattacctagaacatcntaatcgaaaaacaagagtagggagtggtgcgagaaatcaatccgccccatgcccacatccgtcgccacccacgcaaccctcctcatcaaagccgcagccgccaagcccttcttctccccccgcccggcggcccggatccccgccccttctcctcaccctcctcccccgcccgccggccgccgcctgccgaacacggcggccgctctcgccgccgcagcccgtcggttccggtggccgtcggcggccgcgtcggcgcgggggctgtgcgcgccgccgcattccggcggcgaggggatgggatctgatgcgggggcgggggccaggaagaggcgggacccggccgtgaacgggctcgccaaggacgtgccgccagtgaacgggatgatgatgcccaaggaggagccggcgaccgcgccgcccaggttgctcacgctgcccaccgtgctcaccattggccgcgtcgctgctgtgccgcttctgatcagcactttctacatggagggtccatgggcagctacggccacaacaggcatctttcttgctgctgcagtcactgattggctagatggttatatcgctagaaagatgcagctaggaacaccttttggtgcatttcttgatcctgtggctgacaagcttatggtagccgcaacattagttttactatgcaccaaacctttggaaacatcactgctcaatgatgggccatggcttctaacagtcccttccattgctatcattgggagagagattacaatgtcagctgtgagagaatgggccgcatctcagaatagtgaagctcttgaggctgttgcagttaacaacttagggaagtggaagacagcaacgcagatgacagcattgactctgcttctcgccagcagagacccaagtgtacctgcgcaaggtgctctagttgcccccggtgttgctctactttacatttccgctggactcgccatatggtccctagtggtgtacatgagaaagatatggcggacacttctaaaatagtattagcacaatatatatagtgtagtagaagaaacagaagcaaggcgaggttctattcgtgatcgtacgatttttggaaggctgcttagttgattggtggactgggacctatctagagctgcttgtgatcctcattcctcagtaacttgtgcgtcatctatttttgccgccaaatttgctgaagtatgccaggattctagacatgatgtgaccctgcgtgcttaaggagatataagtctgcaatgcagaagattgtaacccaatacaaacacaaaacccggaggtttgtgcatgtggagttctatcattgtaatctgcacataatatcatatgccaggagcatgcaattattcttttcagtggggacgatatccctgtctccaaaaaaaaaaaaaaaatttgaatttgacatctgtttttgttcattggcaatttgctacagttgtttcttcttgatccaggctcgtggccgtgtgatccgaaaaagtgtagttagctccctctcaactatgatagatgtctattcaccctcacctattttgaggtagttttattgatgtgctatttttaatagtttatataaaccatagcttcgtttggatgtcga

SEQ ID NO: 4862 - DNA, 1803 bp, Zea mays
tgcaacatataactaaaaaaacacggtctaaaaaggaagatctgagatcgacgcaaagtctagtcgattacccggcggaaccgaatcctgctacgtggcatcgtaactacggtgcggcgtcgaatcatcaatcaaacttctcgcgcaaatcccagcacgatgaaccgatttgggccctcctcccgtcctccctctctctcccgttcgccacgaggcgagaccttcccgtgccgccctgtacgcgcctgcccacgtacgcctcctcccctcccacacccaaccccagcgcacccacaagaggaataggaggaatcaatccgccccatgcccacatccgtcgccacccacgcatccctcctcctcaaagccgcagccgccaagccttgcttctcagcccgcgcggcggcccggatccccgccccttctcaccgtcctcgcccgcccgctggccgtcgcctgccgaccacggcggccgctctcgccgccgcagcccgccggttccggtggccttcggcggccgcgtcggcgcgggggctgtgcgccgcgccgcatttcggcggagaggggatgggatctgatgcgggggcggggggcaggaagaggcgggtgccagcggtgaacgggctcgccaaggacgcgcctgcggtgaacgggatgcgcaaggaggagcccgtggccgcgcctcccaggttgctcacgctgcccactgtgctcaccattggccgcgtcgctgctgtgcctcttctgatcagcactttctacatggagggtccatgggcagctatggccacaacaggcatcttccttgctgccgcagtcactgattggctagatggttatattgctagaaagatgcagctaggaacaccttttggtgcatttcttgatcctgtggccgacaagcttatggtagcggcaacattagttttgctatgcaccaaacctttggaatcatcactgctcaatgatgggccatggcttctaacagtcccttccattgccatcattggaagagagattacaatgtcagctgtgagagagtgggctgcatctcagaatagcaaagttcttgaggctgttgcagttaacaacttagggaagtggaagacagcgacgcagatgacagcattgactctgcttctcgcaagcagagacccaagtctacctgcgcaaggcgctctagttgcccccggtgttgctctactttacgtctccacgggactcgccgtatggtccctagtggtgtacatgagaaagatatggcgtatactgctcaaatagtattagcacaatatatatataggtagtgtgtaatagaagaaacatgcaaggcgagcatccgttcgtgatcgtacaacttttggaaggctgttgggtggcctgagccctagagctggttgggatcctcattcctctgtaacttgtgcgtcagtttttggtggatttgccgctaaatttgctgaggcatgccaggatcctattagatttttagaaacaagacatggtgaccctccgtgcgtaatgagaattcttagaaacaagaagacatggtgtgaccctgcgtgcgtaatgagatattagtctgcgatgcagaagattgtaaccttatacaaacacaatctggaggtttctgcgtgtggagttctacctttgtactctacacataatatcataatataccaggagcgtacaattgttctttcagggtgtgtttgagagcaacaagactgaagacgcttaaatctccttatattcaaagcctctttaattcattctaatctacttgctccaaacaaaccctag

SEQ ID NO: 4863 - DNA, 771 bp, Zea mays
  misc_feature (747)..(747): n is a, c, g, or t
  misc_feature (763)..(763): n is a, c, g, or t
  misc_feature (770)..(770): n is a, c, g, or t
cccggtcgacccgccgcctccgtcctgatcgatcgtttgattattggcgagcttcattccattccatcagttcctttggcggaggatgtcgtgctgcggaggcaactgcgggtgcggctccggctgcaagtgcggcagcggctgcggagggtgcaagatgtacccggacatggctgagcagcaggtgaccaccaccgccaagactctcgtcatgggtgtcgcaccatcgtccaaggggcacgccgagggcgggttcgaggcggcggccggcgccggagctgagaacgaagggtgcaagtgcggccccaactgcagctgcaacccctgcacctgcaagtgagctgtataataaccccctgcactgcactgcagcccggaggaaggacggactcccctagctagtatagcagtgtcgtcactgcagtgtgtgtgtgtttgagtcagccagtcagtcgagtgccatggcaccatatgctagtggttctggtactgatgggaaccaataataattgtactgggatgttggcgtcgtgtcgtccttcccgtgctcctccgggggctcatctactagcagtcggtgttgtgttgtgtgtttgtgggtgcagtgcagcacagcagcaggccatgccccctgctctgtgggcacgtcgatcgtgtgcgactttgtttgtgctctgtcaccatccatctattacctataatatcccccgtctttgtgtactgtgcgtacccttattaaaaaaaaanaaaaaaataaaaaaanaaaaaana

SEQ ID NO: 4864 - DNA, 787 bp, Zea mays
tgggtacctccccgctcgccccgaaaccaaaacagaaaaaaagtaaagtcctgctggcagctgtcaaccacccgtggtcccgtggaagagaagagagcatcgccggacccggggacggcgcgccgagaaggaacaaaagaagacggcggcggggcggagatggggagccctctgggcgggtggccgtcatacaacccgcacaacttcagccagttggtccctgccgacccctccgcgcagccctcgaatgtcacaccagccacttatgttgcgacccacaggacagatccgccacccaatcaagtgataaccacggaggccaggaacatcctgctgaggcacttgtaccagaaatccgaggagaagctgaggccaaagagagctgcgccgaacaacctcgctccggagaacaacaacaagaagaagcagcccaggggacctgtgggcgacgtcgggggccagtcgagcgcaagaagctgaagacgcacagctggtggccgtcctcccctgcttctcatctatcggtgtcatgcagcctgcatctctcactcacagctgagctggtagctggtggtggttgccctcccctcccctgtgcgtcctcttcgcctctcacgtctcgtatgtacgtatggtatgaccaggagagctagtttgcatacaatggagatactggatgtgcatagcccccccagacgagacgagacgggactggacgaggtcggtgcgtgccatttcacacggcactaccgcactagtctgtgcggcagcctctctctctctctct

SEQ ID NO: 4865 - DNA, 923 bp, Zea mays
tgggacctcgaccaagaccaaccggaaaaaggaaagtgctactgggcattggctactgccaactacccgtggggtcccgtggaagagaagagagcatcgccggagttggggacggcgcgccgacgaggaacaaaagaagacggcggtggggcggagatggggagccctctgggcgggtggccgtcttacaacccgcacaacttcagccagctcgtcccggccgacccatccgcccagccctcgaatgtcacaccagccacttatgttgcgacccacaggactgatccgccacccaatcaagtgataacaacggagtccaggaacatcctgctgaggcacttctaccagaaatccgagaagctgaggccaaagagacctgccccggacaacctcgatacggagaacagcagcagcagcaacaacaagcagcccaggggaccggtcggcgacgtcggtgggcagtcgtcgagcgcgagaagctgaagccacagctggtggccgtccactcctcccctgcctgcctgcttctttctcatctctgggtgtcgtcatgcagaggcagaggcagaggcagatgcagccctgtgttgtctgtcctcttcgctactaacctaatctgaagttagggttacatacatggatatcggatagatgggtgtacataagctcctgagagcagtcttgtgttatcctaaatgctaaacggtaaacagcgggcaacatcctctgtttagcgtataatcggactacacgtgcctgtaggcggaataaaaaaacggattatacggggggagtaaacgacaaaaaaggccaacacggtgcgcccctgagtagtgtttaaacggcgtgtaaatagtttaagggtttgttcggttagcattcaatccatatagattgagtgtgattggatgagtttgaatcct

SEQ ID NO: 4866 - DNA, 1259 bp, Zea mays
  misc_feature (92)..(92): n is a, c, g, or t
aaacgagcgagcatcctccatgtccaggccgctctcttccttctgcctccaccggatcaaggtccggcggcaccgcgtccaccgccgcgccntccatcgatatgcgccaacaaggacgacggcggcggcggcggcggcggagagagcaggtccctaaaggatggcaagcaaaaggacgagtgggaggaggctaacgagaagggcagcgcagaggccgtcgtcgtggggaggaaggtgatggtggcggcggcggacggcggcggcgaagaggcccgcacggcgctgcagtgggcgctgtcgcacgccgtccggccctgcgacacgggtgtcctgctcgacgtcgccagcggcaagaaccgtacgtgcgtaagctgcgtgtgaccaataaccatctattttaagtcctgctggttacagtacaggctccgtcgcgtgcttgaaaacagagggagatggctcttccttgtttttgttgcgtggtcgtctcgatcaggacgcgatccgagagggagtccgcacctggaggccttgaggagcatctgccaggccaagagaccagaggtgtgcgtggaactttcgctggcggagggcggcaaggaccgggggccggcgatagtggaggcggcgaggaagcagggcgtttcgctcctcgtcgtggggcagaagaagcggtccgtcacgtggcggagatggggagccctctgggcgggtggccgtcatacaacccgcacaacttcagccagttggtccctgccgacccctccgcgcagccctcgaatgtcacaccagccacttatgttgcgacccacaggacagatccgccacccaatcaagtgataaccacggaggccaggaacatcctgctgaggcacttgtaccagaaatccgaggagaagctgaggccaaagagagctgcgccgaacaacctcgctccggagaacaacaacaagaagaagcagcccaggggacctgtgggcgacgtcgggggccagtcgagcgcaagaagctgaagacgcacagctggtggccgtcctcccctgcttctcatctatcggtgtcatgcagcctgcatctctcactcacagctgagctggtagctggtggtggttgccctcccctcccctgtgcgtcctcttcgcctctcacgtctcgtatgtacgtatggtatgactcggagagctagtttgcatacaatggaaaaaaaaaaaaaaaaaagcttatcgatacagtaaaaaaaaaaaagaaaaaaaaaaaaaaaa

SEQ ID NO: 4867 - DNA, 530 bp, Zea mays
gactcgatgaactgcttcttgattgaataagcaaatttacaatcaataatctgtacaattgatatccaattccgggagaacgaaaagatatgttggcctcccctgcttcaaatccaatctgcaagcttctcttcctcgttcttgccagcgaagaggaggcatcattgcatttggtccttggagcatcgaatcctattagtagtatcagtagcagcagctgccgacgggcggctaccggcggccggccaggcggttgagccaggcgttgcggagctggagctcgacagggtcgccgaagcactgcgcccgcgcgaggcagaagtgcgtgcagaacccggccgacgagcgcacgcggcaggtggaaagcacgtagcacgacgcgcgctccatgccgcgcgcctgcaccaccaggccccacacctgccgcgccgcctccgaggcggcggaggccccgccgccgtccgaggccacctgctcgaccaggatgatcccgtccggcctccgcgccccgcctgggcccccaccggcgc

SEQ ID NO: 4868 - DNA, 3386 bp, Zea mays
gccttttgctggtcaacaagtttggtagtatatacctctatggattcatcgtccaaattatcgcgccccactagatgcatcgtccaaaggagactcatttgtagccgatgtgtttggcacgggtggctccgtattcgattcatgcgagggaaaactaggggcagtatatttctcatatgaacacacccattccttaataaattcatctacgtatacctttaagagttctcctcgatgttccatgaaagccctaaaagatggagcctgaggcggaggtaggagagatgttatatcggagtcataaaaaatatcgaaatcactaaaaagtatgttggcgtcgatctagacgctaatcaccggaacgaaccacctggcggtgctttctgtggagacgtggacgatccgtgatacagagatggacagttcgtgacttgagcgcaggagcgaatccttttctgcacgttttcggacggtccgcgtctgggaccggaaagtccgcgatgttagaactatgcgatgttagaactatgagtgcatttgtttcaataagtgaacttgtatcggattgtagcgcctgtttcgtatggtatctgcttggacacctgtcttgaacttatttctgtgccagactactacctttgcttgttggactgcattaccaccttttttggtaccgtgtgcgcagtggtctggattctacagcaggtagttctttccttgcacgatgtatgcctcacatattgctttgtgtatgagaagcatgtggcgtgtgcgaacttcatatcttgtccatgcatcccgcacgcctgcagagcaagtgagcaacacgtgaccagagcttgagagcttccatggcaacttcgttggtgcgcttgttctaacatcgtgattcgtgcagctgctggcacttggcgaccagagttgctgtcaatattgacatcttcattgtcatgtcaaagtcgaaaaaaacatccattaaatgcttggatcatgctgatgccgaactggatcgcaaatccgggacggtgttaaatggccgaaactgataggcagcatgcccacagctgctcgcctgctgcaaacgctggagccagaaaaaagatctcccggagcaatggggccgcccgcccacaagtattattatccccacgttcttgccactgattattgtctccaagtcatcattatcttcccgtcaacacgatttgttcagtaaaaccaccgaaccaatactgacgtcataccaagtctcactcaaaagtcaaaaagaggaggggaaaaaagtagtagtaataaagaagcaactttacggcgcgatccaaatcgatggaatcgtgatcatgccgtcacttcccttcccttgcaacgataggaagacgctgcgatagattaggccttgttcggttattcctacagtacatagattggatgggattggaaaaaatttagaacaactttgacttgcttgggatttaaacccacccaattccactcaatccacatggattgagagctaaacgaacaagcccttaggtggtcgggcaaggttttgtttttttttttgactcgatgaattgcttcttgattgaataggcaaatttacattcaataatctgtacaattgatatccaattccgggagaaccccaagtgaacgaaaagatatgttcgtctcccctgcttcaaatccaatctgcaagcttctcttcctcgttcttgccagcgaagaggaggcatcattgcatttggtccttggagcatcgattcgaatcctattagtagtatcagtagcactagcagcagcagccgacgggcggctaccggcggccggccaggcggttgagccaggcgttgcggagctggagctcgacagggtcgccgaagcactgcgcccgcgcgaggcagaagtgcgtgcagaacccggccgacgagcgcacgcggcaggtggaaagcacgtagcacgacgcgcgctccatgccgcgcgcctgcaccaccagcccccacacctgccgcgccgcctccgaggcggcggaggccccgccgccgtccgaggccacctgctcgaccaggatgatcccgtccggcctccgcgccccgcctggcccccaccggcgccgcacgtccggccagctctccggcgccgcgggctcccgccgcaccgtcacgcgctcgccctcgccgctgctgaacaggtgcaccaggaacggcgcctccccgacgtgccgcacgatctccgcgatcgagtcccgcatccacctctccaccttctcctccccgaccttctccgacacctcatcgtcctcccctcggcccaacacggtccccggcagcccctcgtcctcctcccgccgctggagctgcaggccgccgcggggaggcgtgtccgcgcccgccgcgcgcaggcgcaccgacggcgccccccgccgcgtcgtcacgggcacgagcggtgcgggcacccgcgatcgcggccgaggcagcgccaccgacgacgacgacggcgacgctggcccgtagccccgcacggtaggcgccgccgccatcgcacgctggaccaccgatcctgccgccgcgacctcctgcggtagttgataatccgaggcgccgggagcggcggcggttccgaagtagaagtagaattagcacgatccgagacgagtcaccggcgacgaacgggtggggcgcgtagaaataggttgcgcgaggggagagaagtctccgacgcggaaccgcccgttccgcgtggcgtcctacgtggacgcgagtttgggatcccgtgcgggcgaggagggtctgttggtgggtatgtggccgatcggcgggcgacgattggtgtggatccgtggtcggtgtgctgcgggggcgagggagcgtggggcgcgcgggctcgcgcgcctcggcacgctccggcacgcagcgggcgggaggcgggctcgaggcgtggtggacggggcggacagctcagcgcaccacgtcacggacacgtcggacggtgggcggggtttcggccttccgcttcgcaccacggaaccatcgtggtgacgtgtttggtcgggctccggacctccggtggctgcctagccgagagccaatgtgggcctgaaccggcctgcgagctaacgcgcacggcgtggccgcgtggggatctcgttttgctcgtgatcctggcgcgcccgcgtctcgtgaaacacgggcacactctggtgcgggttttccaaatctttttttctcgcttttccaaggcagtcggtgatacgcaaactccacaccatctcaattgtttttctaacatgtgtttatatcaatatgatgcacgtttgcgctagtatgcatgtcatgacaaacaatttgaaatgaagtcagggcgtaaacagtaccagtgcgtgaacg

SEQ ID NO: 4869 - DNA, 1480 bp, Zea mays
ctgctaccactttcaggcgagcagagctgattctgctgtcaatattgacagcttcgttgtcacgtcaaggcaaaaagcatccctttaattaaatgtttggatcatgctgatgccgaactggatcgagaccgcaagttagggatgatgttcaataaaattagcgaaccaacactgtccaacactgtcgagaagaggagaaaaactactagtaaatgaacagccaactttacacggcgcaatccaaaccgatggaatcgtaatcatgtcgtcactagccttgcaacgaaagcaagagaggttgcaatagatgaggagatccgaaaatttcggagtaggtttttttttttttgtaatttgcctcgaagaatcgcttcttgattgaataagcgaagaacgccagtaagaattacagccaataatctgtacacatgatctccaactccaattcagggagaaacagaactgaacgaaaagatttgatggattctgatttcgcgtgcttctcttcctcgttcttgccagcgaagaggacccatcgtcattgcgtttggtccttggcgcatctaatactatcagtccagtggtagccgaggccacgggtggcggctatcggcggccggcgaggcggttgagccaggcgttgcggagctggagctcgacggggtcgccgaagcacttggcccgcgcgaggcagaagtgcgtgcagaacccggccgacgagcgcacgcggcaggtgtcgagcacgtaacacgaggcgtgctccatgccgcgcgcctgcaccaccagcccccacacctgccgcgccgcctccgacgccgaggcgccgccgtccacggccacggccgccacctgctcgaccaggatgaccccgtccggcctccgctgcccgcccatcccccaccggcgccgcacgtccggccagctctccggcgccgcggtctcccgccgcaccgtcacgtgctcgccgtcgccgtcgccgctgctgaacaggtgcaccaggaacggcgcctcgcctatgtgccgcacgatctccgcgatcgactcccgtatccacccgtccaccttctcctccccgaccttctccaacacctcatcctcttctctgccgaacacggtccccgacagtacctccacctcccgccgctggagctgcaggccgccgcggggcacgtccgcgaccgccgcacgcaggcgcaccgatggcgcccgccgcgtcggcacgggcacgagcgacgcaggcacccgcgatcgcgcccgaggcagcgccaccgacgacgacggcgacgctggcccgtagccccgcacggtaggcggcgccgccatcgcgcacggcaccaccgatcggaccgcccgcgacctcttgcgacaggttgatggttcgaggcgccgggagtggtggcgagaccggtggcaatccgaagtagaagtagcacgagccgagacgagtctccggcgacgaacgggtggtgcgcgtagaaat

SEQ ID NO: 4870 - DNA, 1523 bp, Zea mays
  misc_feature (1491)..(1491): n is a, c, g, or t
  misc_feature (1502)..(1502): n is a, c, g, or t
gcaccccgcgttattgcacgagcagggacccagttacaccactacaggtctacagctcccgcccagcatcatggccttccattccccaatctagggttgctgagctccccaccaccgccggccatgcccgacgcggatgttgacaccgtgattcgcgaagccgccgcggccgcggccccagccggcgacgacgacagcgagggtgacaccgaggaggaggaggaggagggggacgaggtcgacgaggacgaggacgacgacgaggaggagttacccgccgaggcgccggcgccggacgaggagcaacctgccccagcgcccatctcgaccttgccggggaatccaaaccagctgacgctggtcttccagggcgaggtttacgttttcgaatccgtcacccccgagaaggttcaagctgtgctgctacttttaggacgtggtgaactaccacctggtttagctggcatggttttacccaatcaaaatgaaaacaagggctatgacgatatacttcagaggacagacattccagcaaaaagggttgcttcactaattaggttccgtgagaaaaggaaggaaagaaattttgataagaaaatacgttatgctgttcgcaaagaagtggcactcaggatgcagcgtcggaaggggcaatttgctggaagagccagtctggagggagaatctccagctcctggatgtgatcctggttctcagggctcaggcctagattttgcatctcgagaatcaatgtgccagaactgtggtactagtgaaaaaatgaccccagcaatgcgtcgtggtccagcgggtccaaggactttgtgcaatgcttgtggattgatgtgggcaaacaagggtaccctgagaagttgccccagggcaaaagttgaatctcctgcggttgcaactgagcagggaacaagtgacaacaaagccctggcaacactgaataataacaatgttgctgcaagcaatggcgaagccacaagtgcagcagagaaaggagtgccaaaggcgccgtgacagtatatagacattattgtcagagacaaagatttcggattctttgcctatagctagacaagacaccccgttagaaatatttggtaatgataatgattgtcatcaagtgtacattcattcttgcttgacagtgttagacgtgtaattaatataagctgtccgattgtgtaaacagtaaacccatatggcatctgttgtgttacaacttacactttctaactttcttcattctcataacatcatgatcaaagattcgatgctacccattgattgtcaaaaaaaaaaaaaaaacctgcctctcctcctccagagctcgtcgccaccggccaccgccaccctcgatcacgccgtccgtcgaggtaaggtcagcatggtgagggtcggtttagtcggggattcgctcaagtccatgtacaacgctgagaagatcggcaagaggcaggtcatgatcaggccgtcgtccanggtcttcatcntgttcctggcggccttgcctg

SEQ ID NO: 4871 - DNA, 736 bp, Zea mays
ctattctgggcaccagtctcccttaagctaccacttctcggtccctaatggggccgctgcaatggcgcggttatcggacaggtctccagctccttttatcttatcttcaagggccatctcgttgacgcagcctgtgatgcaatctacaggagatgtgtctggctctagcccatctgcagtggatcacaagttagcaatgcaagaggatgagtttcacaaattagcagatgagacgattcatgatttgcttgaaaaacttgaggagtacggtgactccattcagatggatggtttcgacatagagtacgggaatcaggttttgacattaaggcttggggatttggggacatatgttataaacaagcaaactccaaacaaacaaatttggctatcttctcctgtgagtgggccttctaggtttgattgggatggaacagctaatggttggatatacaagaggactggagtgaaccttgtgcggcttctggagaaggagattggtgagctctgtggtactccagtagaactttagtaagagtactggaaatgccacacagctaggttgtatggagagcagtgctctgaatgtcgaagtgtagtacacaaaactttttttttgttctacacatttgcacatggtttggaataaataacttcccctctctggtagcggggaacagtattattcggaaatggtgggagtaaaggttgccctaaaaaagaacacgaaaaagaa

SEQ ID NO: 4872 - DNA, 2483 bp, Zea mays
gcaagcttggatcttctatccggctgtttggatgattgcatgaggggtggacctgtcccaccgcgtgcagacgttgcttgtttgataactgaatggtgtgtggagcctggttgagctcgtgcaaaagtggcttaagagcctggctcagctcatacgtccaattagaccgtttcttgggggcctggctgggcgtgtgcagccgcgcgtacgtgttagagagagctcgtgcaggctatcaagcaaccaaacaactactcgaataaaacaggcttggacgaatcaggtatccaaacacaacttgttgcatgagtggagcctgtccagacacaatctggttgagggaggcgatccaggattgactcattcaaccatccaaacacgccatatacgtacctaggaggactgcgctgctgtaacaagagttagggacaattttgacttttagatgataaatacatggaaacaaattataaaaaggaataatacatattaaatggtagtataattaattagaatatatttatagtctttttttacgaataaaatctttcgaatgatatttgtgcgaagcgcaatgtttagagtcaaaatatacaattatctgggagtaaaaccgcgcgtcgtcctcttccccaatctctctgtcggaaaccgagtcctcttccaccgcacgccaccggccaccgcgtcccctccaacggccaccccgccccctcgctccggcccctccaccggccaccgggcggcccgccccctcgccccggcccctccaccggccgccgcgcgcccgcgcagctccggcggcgcgcgcccccctcggcccggcagcgctaccaccgcgcctcggccccgccgcctccaccgcgcctcggccccgccaccgccctcggactgtagtttgagataagctagcaatttttttaggccagtacgcatcacttctctgttttttttttctgctgaagtaatttgagataaatttgtgttttacctgaagcttctgagctctagactggtgcttccatttttagcacaagctagttatgttagcttctgtttctctaatgaaggtgctagcttccatttgatctgaacacgcctaactgagtggcaagtcttccttgtcaattatgttacccagtcagtaggtttcccttgtggcatgtttaactttttaataaaaaaacaatctgacatgttattgctcagttacaggcttggcaactctgaatcggctataatgaacatgttcagttttagttccttctgccttgtgatgtaaaccacagtacagtactttcttgcattcaattgtaattttctaatagttcctctgatctcgtgttgaactttctgtgttgttatttatcctgatataggcagcaacttccactggacctcaagccgccatctcgccacatgacctgattgcagccttgcaggcacagcacagaagcagggttgcgccacctctctgagtgtcataggttggtgcataggcacacacacacaggtagccatggcatcgcgtaagcttctcgtgggcctcacagccaggaggcagctacaatcccgcacccagcaactattctgggccaccagtctccctgaagctaccacttctcggtccctaatggtggctgctgcaatggcgcggttatcggacaggtcttcagctccttttatcttatcttcaagggccatctcgttgacgcagcctgtgatgcaatctacaggagatgtgtctggctctagcccatctgcagtggatcacaagtttgtttcttgaccttgcagtcttagcacgttgatccattaatgcattctttgtgtaattttgattgctttcaagtatgaatggaaagggcaggcccgatgtagtggtgagagttgtctcaccgagtcaccagttcgcgggttcgaagtagcctctctgcatttgtgggggaaaggcttgcctcggtttatctcttcctcagagcccactcatgtggagcttatggcactgggctgggtctgtcttttttttcaagtatgaatggtaggaatagagcaaattagaaaaccaatcgagcatacgtgtaggatgtttgatagagcaatttttgtttagatttgagtcattttgacattctttacaagtcccaacttgcttgggactaagaacctttgttgtctccccctgtgtcaaccaggcaaccctaaattaggtactccaaacattctgtaatttgccaaatagtggcactggataataggtctttagaagagactacacttgcttgaatcaacaaactgaaatgtagaaagtttggctaactactgatattagttgattgcaacaatgcatagaataaaatttgatcttcagtatgtttaactgtttttttgctttatagtttggttatttgaacttttgttatatagtttttgctgcatggggtagtcggtgattatgattgtatacattgaacaggttagca

SEQ ID NO: 4873 - DNA, 1040 bp, Zea mays
gcgaattgggtaccgggcccccccccccggaaggtcgacggtatcgatattttttttttttttttttcttttttttttttttttttggcagcgagaactagcggtgttttttttctttctggccgccttttcaggattacggattacacagtggaggggaggaaaatgtaaacaaatagtagcaagaggagcagcagtcgaatcgcactccgatgcgcgatgaggacggctctcacgcaccgcgccaaggcaagggggcgcagacgccacagcaccgccaagcaaagcaactagctaaactacagctacagctccagttcctgtatactagagatgctcacgttacattggaacagcagaagcgccgtgagactgcaaatctccgccccgcaccgaacggaaggaagaacgtaaggctcgatcgaggtgctaaaggaacaagactacgagagcattaaagcaggagagaaaataataaaaaaaataataatcttctctttacacaaggttcgttcgtggttccctaattaagacgcggaggcggatcgagcgtctcttgacctgctcggcggcggcggcggcttcccctcctcctcctcctctcccctcggcttgctgctcgcgtcctgcatgcggctccgcatcatgtccggcgccattgcatcagggacaccgagggctcaggcgtcaggcgtactcgcgccagcacaccagcatcgtgacgcagcggcgcatgatgtagaaccgcgcgcgctgctccttgacgagccgcgcgcaccgcccggagaaggacgaccggcccttgtcggcgccgcgcacgcccatgcccgccttgccgccgctcctcttcctgctgaacagcctgctgctgcacggcttctgatcctcggctgatgctgctgctgcgaagagctccatggatggatggatggatgtccagtggagtgaggcgagtgagtgagtgagtgagatgtgtgtgttgatctgcggtggtcttgtatgtgggggaagcgcatagcattgggcgttttggatagacg

SEQ ID NO: 4874 - DNA, 4872 bp, Zea mays
  misc_feature (1727)..(1727): n is a, c, g, or t
gaataaacgagaatagaggtagtacacattaatttataggagaacaaccgtgcacatgtttgtttgtcctcacttcaacctaagtacgagtaaatatgtctgtgtgttataacaaaacgtattacactgttatttggatcaagacacaccaataataatgaactcctatctttgtcagatttaattaggtttagccaacctttttaattaatcaagataaatctaaaggtctacaataaataaaaagtgtaacaacaatataattaataattcattgtggtaaattgatggacgaagaatgtcgcagcttatgacttatggatggtcaactcaacttgaatcgatctggtccgactaattcaacgggtgggtacgagccatagtttttaatccgcaacaatctacgggtcagacacaggtcatgatttttaacatagaacacgacccaatccggaaaaaaacttgacctaaataaacctgaatgctataggagaacaacgtgcgctagctcacctgcatgtttgttcgtcctcacttcaacctaactacgtagttttattttttataatatctacaagtaaatatgtccttgtgttataacagaacgtatgaaactattatttagatcaaggcacgccaataataatgaactagctatctttatccaacagtgaagcacaggccgacccaatcccacattagacatgagtggagtatagactataccaaacaactcacggctctcgatattaaaccaactttaacctgacctgacatttaaacgggtctcatctcggcgagatcggatcggaagccacacaaagtagcacgacgcgagacgttactgagcatctgcaatggcccaggatgaccgggccgggaccatgggccggtgataccatgtgggcccaacgatgcagcgggtcccgccacctggcccggctgctcctccatctcgcggcagcgcgtgcgcggctgtcggccgcctcgccgtccgttcttccaccccgttcccccacgctctacagcgccgctgattgaaaagaccatttctaaccctacactgctgcactcggttctagaaccacaagtgaacccatagtatcgtgcgtccttctgcaggtgtggccactacaactaccccatctgttaaccaattgggtgctgtgctggcctggagcctgcttggtagtattgttgaatatataaaactgctggagtgatcactacactcatctcatctggggcattgtttacttgcttcacaggctcctgcatgcatggtgtggcgctgccctttcagctcatcttttcttggaaccgcacttgggcatgcacggctacctcctctaggcaccatgtggaggatgagcgtgactgcgtgagtggcatgatggaccggtggttcaaatgggaaagccacctttttagctgtgggttagttcttttttaacacgcagtttgtctggtccggcgcccttttcccttctgctaacactagattactagcttcccactgcaattagggttggagtgtagtaatactagtacctcatgaccggggaccgcgaggacggaggaggaacaggaagaactgcaatggctggactgcaggactggactggactggaccacttgcattgccggcccgcggccgggtcctcccatccatagagcgctgcactgaccagtgaccagagggagaggagaggacccccagtccttgnccccaaatcctgcaccatatcaaaatgtttcaggactgtttcttgcgtcatcatgatcttcttaaaataaaaggcagtcaaaccggagtcaatcaggcgtgcactgagaaggaaatcttcatcactcggctagtaccgcatttcatgcccagatcgatcccatgtgtccgattagtagccatttttcacatccagtgatctgagcttgacatgctaacaccttccttctcgtctagctaaaaagacatgttaaccgctccagttgaaagaacacggcgatggcaaaaaaaaaaaaaacccctcctgttctactaccacttcgatcacgacgatggtgttctggagcgtcccctgcttgtacctacccaccaaaaccctaacttggagatgggaacatgagcgacggtagaggaaaaggactgcccggtataaaaacacggttcaaagctgttgctgttgacgccttgttgtatatacacattgaaagaatagaggtccaccactgacgtattgctgccgtccaaaagcctatcctttcaccttgcattcggctggctcacaaaaagcttgcattcatcacccctcttttaccggacactcttttgcagtaattttctattacggccgaatgattacgcaaaggcgcgtgtaatttgtgtgcatggtggtccatttcttgaccctgtaggacagcagcagcagcagtagtcctgtttccctcttgttcctgggacctctgcaggaacaggggtggtcacagtggtgtaagcttttatcgttcggcttcggcacgcggcctagttaaaaatacgaccactgtgaaaggaatcttgcatcgttcgtgttttgtcccctgctgctctttttcttcagagtctagagagaagcggttcagacagacagagagaggcaggagctgccctgcactgcatgcttgctctgcttgtggattggattggagtggagtcggagatggtcagatggatgtgtatataagggtacccgtccccccctcggggccatacaatgatcaggaactgggagtggcaagcgccaaggagtagttagagctcagtagggatacagcagtttctgagtcacttcgtctctgacatccacgagtaccagctataccagttttgattccactctgatttgctcatcaagcgtcaatgctccctccaatcattcttaatctcaggaagttagcagtgagatgctttcagtcacacttgttttagtcttctcctttcagaaggctgatagtcttagccttataccgttggtcttctctatttctctccttcctctgcatgcaatgttgcatttctcgattccagttcagagacttccattcctagagttgcgtggtactcacctcttgtttaaatccacttcattgcatgcaggttgaaagagataggagtgagaggcagttcccttccctactctcacaatgcccatggagcaagcatccaggcactgcgataaagacacgctgaagatggccatgctgaaacacgaagagactttcagacagcaagttcacgagctccatcgcttatacaggatccagaagctcctgatgcgagacctcacacgggagctcaagctcaagagccagaggagcctgcccaccacctcgccgaacggcagctgcgccgagtacagcagaggggctctcggcatgtgcgcctacgagcgcctctacgccgctctcggccgcggcggacacgtagcagcagcagcgacgccgacgccgacgccgcgcaccgctctcggcctcgacgtcgtggcgccagtcgtcgagtacgtgcggagcgcggaggaggaggacgacgacgacagggcggaggaaaccgacgaagacgcggagctggagctcacgctcgcggtgggcggaggcggggccaagaagcggtacgacgagtacccgtccggtggggagagtctgtcttcgtcgtccacggagtccgacgtgctcaccgtctccggccgtgagtggcgtcgggcgcgcggcacgccgtatcacaagatgaggccggcgaccgggctggacgtggtgcaggtggaggacgacgtcggggtgccgccgccgctgctgttccactggctcagcctcaagatggcatgacgcgatgcgaggaagcaagagcacattgcatgtgtgttcgttgctgcttgctgtgtcagggtgttgacttgctactgttcttcagttgaatgcttttgtgtgttaggttttagtggtggatcaagtctagaaatcaataattggctggctgttcatgataacatgtaggagagtcttccctaacataagccgggtgtgggggcctttcagatgaagctgtgtgactgactttctgccaactacaatctgcaagtgttaccttctgccctgatcgacggacgtaatactgcaagacttcagtcgaaaaaaaaaaaaaaaaatgaacttctgacagtttttgcagatcaagtaaacaaataagtgcttctttggaacatagcaaagaaaaacatgggaaataggaaaaacataataatatacaaatattgtactaggattgtaagatacagaagtatataaaaattgtagaaatttttatggaatagccgtttggataagtcacggagaaaccataggaatcctaacaatttttatagggtaagtaaactgctaaagatagactaacgaagttgttttttttccactagttgatcagacatggctaaaatatttcttttacatacaggcaccgctattatctagtagcagcagcactgagtttctcattatccgtgcacacaaattttaccaaaaaaatatgattggacctggacgctagaaatccattggaactatgccggctatgctaaattaatattaaacaactatatagatagtcggtttgtttcttagcctttgataatgaatatatgacaatttataatttagattactcgaaatatttacacggttaatttactatataataaaataatatttatcaagggatgactcgtaagccgaatcgaatctcattcttaagctcatcaagtgagccaagcccctatcatggtggtacaagttagcgcccgctggccaacgacactggccaagtaatgtgcgacatttgta

SEQ ID NO: 4875 - DNA, 1057 bp, Zea mays
ccggccggaatacaatgatcagaaactgagagtggcaagcgccaaggagtagttagagctcagtagggatacagtttgtgagtcacttctctgacatcctccatcgggtaccagttacactagatcgaaaaagacagagtgagaagcactactctcacaatgcccatggagcgagcattcaggcactgcgataaagacacgctgaaggtggccatgctgaagcatgaagagactttcagacagcaagttcacgagctccatcgcttgtacaggattcagaagcttctgatgcgagacctcaaacgggggctcaagagccagaggaacctgtccacctcgccgaacggcagctgcaccgagtacaacagaggggccctcgccatgtgcgcctacgactacgagcaccgctacgctgctcgcggccgcggcggacacgtagcagcagcgacgccgacgccgcgccccgctctcagcctcgacgtcgcggcgccggtcgtcgagtacgtgcggagcgcggaggaggaagaggacgacgacgacgaggcggaggaaaccgacgacgacgcggagctggagctcacgctcgcggtgggtggagccggggccaagaagaggtacggcgagtacccgtccggtggggagagtctctcgtcgtcgtcgacggagtccgacgtgctcaccgtctccggccgtgactggcgccaggggcacggcacgccgtatcacaagaggaggccggcgaccgggctggacgtggtgcaggtggaggacggcgtcggggtgcagccgccgccgccgctgctgtttccactggctcagcctcgagatggcatgacgcgatgagaggaagcaagagcacgcattgcatgtgttccttagaaaaaagcttgtagtgtcagggcgttgacttgttactgttcttcagttgaatgcttctctgcgtgttcaggtttagtcatggatcaagtctagaaatcaataattgactggtttgttcaagagaatatgtaggagagtcatccaaaaaaaaaaaaaaaaaaaaaaaaaactcgagagt

SEQ ID NO: 4876 - DNA, 925 bp, Zea mays
agacagacagagagaggcaggagctgccctgcactgcatgcttgctctgcttgtggattggattggagtggagtcggagatggtcagatggatgtgtatataagggaaagcttgtggcctttggagccatacaatgatcaggaactgggagtggcaagcgccaaggagtagttagagcccagtagggatacaacagtttctgagtcacttcgtctctgacatccacgagtaccagctataccagttacactaggttgaaagagataggagtgagaggcagttcccttccctactctcacaatgcccatggagcaagcatccaggcactgcgataaagacacgctgaagatggccatgctgaaacacgaagagactttcagacagcaagttcacgagctccatcgcttatacaggatccagaagctcctgatgcgagacctcacacgggagctcaagctcaagagccagaggagcctgcccacctcctcgccgaacggcagctgcgccgagtacagcagaggggcgcctctcggcatgtgcgcctacgagcgcctctacgccgctctcggccgcggcggacacgtagcagcagcagcagcagcagcgacgccgacgccgcgcaccgctctcggcctcgacgtcgtggagccagtcgtcgagtacgtgcggagcgcggaggaggaggaggaggacgacagggcggaggaaaccgacgaagacgcggagctggagctcacgctcgcggtgggcggaggcggggccaagaagaggtacgacgactacccgtccggcggggagagtctgtcttcgtcgtccacggagtccgacgtgctcaccgtctccggccgtgagtggcgtcgggcgcacggcacgccgtatcacaagaggaggccggtgaccgggctggacgtggtgcaggtggagg

SEQ ID NO: 4877 - DNA, 757 bp, Zea mays
tttttggaccggaataccaattcttcaaatgagtttgccttggttttttagctggacgttgatgagtttctgggctaaataaaacctacaaagatggttcttctctggtctacgattctggggactgaaatgcaggcatgtgtgatctgtttgatgtctgccaaggaaaagcaaaaatataaaacctcgccgcatccgcattctcttcggacaatagattatgcattctgtaccaccctggtcttcaatttacaatgtgcagattttgttttcctcttcccccccgcctgttcttcttccctcagtctcgctacattccatatacagatgcatatatgcatgtgcgtacgcgagccccatacatatgtacatgtacatgcagactatcccaattgtgctaggtagcaccaccactgatggtgttcgatccttgaaatgtacatgatgtgataagagtaagcgtgactagagaatgggattccaaggcacaacaaatgatggtcctctctgtcatgtcaacatgatcatatctgatgaaccggtgatctatatccactcaaatacatttatggtagcagcatgttgtacctaatatgcttttttatcacctgttaatattgatgtagctgtacaaatggttccgattacttatatcctctgatgtacttctactaagcaccatgttctaacttacacattgcttagtcacctctccaaaaaaaaaaaaaaaaaaaaaaaaaaacccgagggggggccc

SEQ ID NO: 4878 - DNA, 753 bp, Zea mays
  misc_feature (684)..(684): n is a, c, g, or t
  misc_feature (737)..(737): n is a, c, g, or t
agccttatccccaaatcgcttcttctctgttgattccatggtacatcagccgagctcctctccctggccgatccatggtgctcgtctctagctcatgtcttgccgccggccgagcccctccccagcgcccttggagccggcgtcctctgccctcatctcattccccgacgccgccctctcccctcggtgctctgctggtcggcgtcttctccctgcccgacgtttctggcgccatggccgccgcgccttgggtcgcctgctccactgcgccgatccgcccatctccctgctgccgctctcccatggcgcgtccctgcatcttgcttcagctcgctctgccatctcccttggcgccctagccccaacgccgagctccctacccggtcgcgcccccggtggttgaactcgccgagcttccttttctatcgcctcgtcctcgcccattcggcgccctcatctcaagccagtccagcctctctactcgccactctcctctatccccctgctgttagaacatggcgagctaaccccatgtgccagtagagttcgtcattccctgagcagcacctccctccatggatgcctcgttgtcgacttgtgcagttcatatttatcggatttggtggagaagaagcacagttcaatttgacgcccgccaggtgttcgacgaaatgttcgaattgngtttcgtcgttgatattgtggatttgagtcgcgttttgtattggtgagctggntcgctatttctcttct

SEQ ID NO: 4879 - DNA, 2273 bp, Zea mays
  misc_feature (54)..(54): n is a, c, g, or t
tgtattttccttttatctactcatgattaattgaagtattatttcttttaaaanaatgttttgtccgggtttattttccgagcgtgtctacttcttgattgggttgtttcctttattgagggtctagagaacttggttgcatatgctagaatgctagatggtatccgtgctcactaatagtccaaggttttcttaggtaaattagctattgttttcctttaaaaactttgtcctaaaatgattcaagactggtatttggttggtttaatttataccttgtacattctctgtgaggggtgcaactaagaacctctagaagaatagcgaacaagtaattggtcatgcattatgttgttagtcattgtatgctcagttaactactcattttccacctatagaagaaagttctttaataggaagctaaccctcttactttgttgcgaggctttgtcaatatttgacaagttcagtaagttaggtgtttttattttggagtctgtaggtacgtaatgcttatgtactgttttagttgactagtgataaaagttttaactgatattaacattgacaatacatgggcaatagatgaggctatcatcagttcgaattctttctgtcttaggacatccaacatgatatactgggaagaaaaagatttttacacccttgtgaattccgccactttttacattctctgcaaattctgctagaagcattacttttgcactctccgtcttgtttgcagtttggtgttttcttctttggtatgtatacaagacagcctcaaatcatctcctaacaaaaaagggggttaatattaggtgcatcttagcagatatgaaatatagtactatataagagagccacatgttacaagacaattgggttatagctacaagttagttatatgttctgccagcttcgttatatgttctgacatgagttacttttgtgttatgcagaaaaacaagaatcgtgagtgcaatggcaaatggaaggtgaaggcccttttgattgacaacttaggtatatttactgtttcattacacaccttgcgcaggtaactataagcctgcttccttcctatgacgcttagccatttttagtctggatagctgccttcctagcaatacctatttattgaaaaattatagcaccctttcatattcacatgataataacaaagtagtatcaaggaactgaataatgtgtccacctgtaagcaaaatatgcctggtcgctggagcacttgtctcgggatatagtgaggcaaagtttggatcatgatattggtctagctattgctcatttcttgagctgtttcattgggaacatttcttggaaagtttggatcatgatattggtccaactattgcttgatgagatagcaaatgttcgagaacagttgctcgacttcttcatgaatgaggtgatagacattggtggattatgcagggttgaggatgcttcacataactaaatctagcattcatatgacctttttgatatgccataatataaggtgttcatctgtgtctaactactcactattgtcttctcttatttgtcgtataggaaaagatggaatggaactcaaattttggtggtcggtcaagtgtgtagagttgaaatcatatacacttagttaggctcaactttagcgcaaactgttggtgaccatgtttttcagttagtattttagtttggatttagagtacacttatgtatgagttatttagcaatgcttatttatgagatattgaatgatacttatctacattatattaactataatgttattaaatatatgtgtgtatgtatattataatgtggtatctcaaaaatgattataaattgaagaatgtattggcatgtaagtcatttcatttaaaccataataagatagttcccaaaacgtacaataccagtctcctaaaaaagtcggttcctaaaacgtctaatatcagtcacctaaataagatgattttcctattgcaagcgtctattattataggacattctagacaatttgataaatattttgtgacttataatgttcatattctcgatggttctttagaataagtgtcttaaacaaaatctaattcaagacggtttaccggacaaaatgacttaaacaaatatcttttttagacggttataaattaaaaatgtcttatataatatcttttaagacattttacatcccatcttaaatgtaggacatcttttacgactccgtcaaatttggacacttcataagtgtcttaata

SEQ ID NO: 4880 - DNA, 1384 bp, Zea mays
cgagtcaacgcgatccttttcacgggcgaccgcgtccgcggcacgggcgatccggtgatcgagcggctctctgacgccgcccacctggctggggtcctcgccgggaagctccctggggaggccaacgcgtgggtggtcgacgccgcgcgctttgctgggccgtttgcggtgtaccgagagctcgttccgaccgtcgacgccgctggagaccccaaggggtatgaccccactggcttccccgccgccgccggtgttgccaacatccttgcacgcagcattggtgagatacagaatcaagtcccggggttgtcggcgaaggattcggctggcaaccagcaccctccatcctaccatccaccggctaggactatcatccttggcttcagcaagggtggagtggtggtgaaccagctcgtgacggaactttctcggtggggggcatcaggatcaacgaaccaggcggcggcggccgacgttccacgaccagcagcagcaggtccaggtccaccaccccatccgacccagaacgaccttcttctcctgggggctcctactcggagcagcgacgacctgctgtcaagtatctccgagctccactacgtggacgccggcctcaaccgcgccggagcgtacgtggccgaccgcgcggtgatcgggaggatacgcgagcacgtcgtgcgcgccggcgacaagagcctccgcttcgccctccatggtaccccgaggcagtggtgtgatccgagccgcccgtggatccgggaggagaaggacgcgatggtccaggtacttgcggacgaggcccggaggagcgaggggaggcttgtgctctctgagaagctgtatttcgagggcagacctcgcagcctgctcatgcattttgaggtcttggaagcgatggatatataatgtaatgtaagctgatactcgataggtctgataagcgatggatatataatttgttgtcccctgctgatgcatggcttgccggtgggattgtgtgtttgtcagtcgggatccccccctcgtgctagttagtattcggccgtgaacaagtcaagatgagcagagccagcctggtatctgttgtcggattcggatatatggcacgaccgcggtgcgtggccaacagtggacgacgtgttgccggagctgaatcctgattggaggacgggcgcgcttagttattattatttatttgtgcattcggctagctgttgccatgtgcgaaggatactgcccggagtggttctgttagttaagtaagtggctagtgccatacgaacgaacacacacgcacatagattacaaaatcctcgctgttcttgtctcgcctgaaccggtcaaacgacagtgttcgctgttccagacaaatccggacctgcag

SEQ ID NO: 4881 - DNA, 1336 bp, Zea mays
aacaaggtcttttccctctccaccggtccaccccaaccaacctcctccccccctctctccaggcctctccactcccggcaacctcgccgccggggccatggaccggtggaccggcgtcctctacgtcccactctccagaggcgggcccctcttccgcgtcgctgcctcgctcctcctctcgccagccaaaacgctcgccgtaaggccaaaaactctgcccctgcgcctgcccccgcgcgttcccttttcctcttctcagagtttttcagagacactagcctgcccttctgcccgacagactcgcctacggagcctgaactatcccgatggaagcaggttccacgagtcaacgcgatccttttcacgggggaccgcgtccgcggcacgggcgatccggtgatcgagcggctctctgacgccgcccacctggctggggtcctcgccgggaagctccctggggaggccaatgcgtgggtggtcgacgccgcgcgctttgctggggccatttgcggtgtaccgagagctcgttccgaccgtcgacgccgctggagaccccaaggggtatgaccccactggcttccccgccgccgccggtgttgccaacatccttgcacgcagcattggtgagatacagaatcaagtcctggggttctcggcaaagcattcgactgtcaatcagcactctccagcaccattgccgtcctaccatccacctaggactatcatccttggcttcagcaagggtggagtcgtggtcaaccagctcgtgacggaactttctcggtgggcatcaggatcaacgaacccggcggcggccgatgttccacgaccagcagcaggtccagcaccccatccgacccagaacgaccttctcctggctcctactcggagcagcgacgacctgctgtcaagtatctccgagctccactacgtggacgccggcctcaaccgcgccggatcgtacgtggccgaccgcgcggtgatggggaggatacgcgagcacgtcgtgcggcgcgccggtgacaagacccgcctccgcttcgccctccacggtaccccgaggcagtggtgtgatccgagccgcccgtggatccgggaggagaaggacgccatggtccaggtactcgcggacgaggcccggaggagcgaggggaggctcgtgctctctgagaagctgtatttcgtgggcaggcctcgcagcctgctcatgcattttcaggtcttggaagcgatggatatataatgtaatgtaatgtaatgtaagctctgatactcgattggtcggtctgataagcgatgcatatacaatttgtttgtctcaaaaaaaaaaaaaaaa

SEQ ID NO: 4882 - DNA, 1602 bp, Zea mays
gcacgagaccattacctagaacatcctaatcgaaaagtaaataatatctctcgagcacgggcgggggccgcctgcctgcacgcgcctttctcactcgctcgctcgggacgtcgggtgcagtccgtgcgccccgcaccgcttttcgattcggttccgcagcggccggccggccggccgagcaatggccaccggcggggacaagcgggcggcgctgctgcggcagataacggaggagggcgggttcgcgttcgtggcctccgccgagaaggcggccgcgggggacctccgcgccgccgaggcggcgcgggagatggcgtgggagcagctgcactcggcgccccgcgccgaggtcggcgccgcgtggcgggacgcctacgcgctcgcctgcctccacgtcgccggcctccgcgccgccgtcggcgaccgccgcgcggcgctccgcgcgctcgacatgggcctcatcatgggcggcgacctcctacgcgccgagctcgacgccgccgtcgcggggctcggccacggcgacgcgggcgcaggcgcgggcgccgatggagatgtgcagaggtgggaggaagggatcgcgggcggccgagacctcgccgatgtacttcaacttctaccagtgaattccctatcttgtaagcaaattgagaggcgatcatgcatttctttggaggcatttatacgtgattactttttatgtgagtcccctgttatactcagtggatgcattgatcattggcctgcaaggaaaaagtggaaggacataaagtacctagagagtgtagctggagatcggactattcctgttcaggttggaaaaaattatgcatgtactgagttgaaacaggagcttatcacattttctcaatttcttgagaggatgtggtcaagtgattctgcaaacttggcatatattgcgcagcatcaattgtttgaccagataaaggagctccacgaagatattgctgttcctgagtactgttcagctggtggtggcaaactccagtcacttaatgcttggttcggccctcatgggacaataactcctttgcatcatgacccacatcacaacctttttgctcaggttttgggaaggaagtatgttagactctatcctgcttctacatctgtggggcctataccctaacacagaaagcgtgctaagcaatactagtgaggtagacctcgacaacactgacggaaaagagtacccggagactgcagctcttgagttcgtggactgcgtattggaggaaggtgacctgctttacattcccccgaaatggtggcgttacgtgagatctctctctattagcttttctgttagctttcggtggcgaacatcacagcttccttgaggggaggttcataacgatggttttgacaaatttgatcgtacgtccacgatgtcgttccaatcatcctattggtagagacttaataagaagacttcattgagctgagcccatatttcgtggtctaagtgttgtgtgcggtcgcctcactagactgggattgtaaattgttttcacgacaatgattggtttcaaacatactaagcggtaaaaaaaaaaaaaaagggcggccctcgcgatctag

SEQ ID NO: 4883 - DNA, 2233 bp, Zea mays
gcgcggtccctctcactctcacaggctccaattggcatctcgtctcgcgctcgctttccccagtccactcgcgctctcgtttcccggagcttcgcgatgcagcgccttctcgcgctggtggcagccctgctggtgctgctggcgtcgcgtccagcgctggccaccgacccctacgccttcttcgactgggacgtctcctacgtcactgcggcgccgctcggcgtcaagcagcaggtgataggcatcaacggcaagttcccagggcccgtcgtgaacgtcagcaccaactggaacgtcgtcgtcaacgtgctcaacgacctcgacgagcccctcctcatcacctggaacgggatccagcaccggaagaactgctggcaggacggggtgctcggcaccaactgccccatcccgcccggctggaactggacgtacgagttccaggtcaaggaccagatcggcagcttcttctacttcccctccaccggcctgcagcgcgccgccggcggcttcggcggcatcgtcgtcaacaaccgcgacgtcatcgccgtgcccttcgcccgccccgacggcgacatcaccatcttcatcggcgactggtacaacaagaaccacacggatctgaggaagatgctggacaaggggaaggacctcgggattcccgacggcgtgctgataaacggcaagggcccgtaccggtacaacgacagcctcgtgccgcccggcatcgagtacgagaccttcaatgtgcatccgggcaggacgtaccgcatccgggtgcacaacgtggggacgtcgacgagcctcaacttccggatccaggggcacagcatggtgctggtggagacggagggctcctacacgtcgcagcagaactacacgaacctggacgtccacgtgggccagtcctactccttcctcgtcgccacggaccagaacgccagctccgactactacgtggtcgccagcgcgcggcaggtgaacgagtcccagcccctctggcgccgcgtcacgggcgtcgccgtgctccgctactccacctccgggggccccgcgtcgggcgccctacccgacccgccgcaggaccagaacgacagggccttctccatgaaccaggcgcggtcggtccgctggaacctgagcgccggcgcggcgcggcccaacccgcagggctcgttccgctactcggccatcagcgtgacgcaggcgtacctgctgcggggcgcggggcccgtgtggatcggcggcaggcggcgcgcggcgctgaacgggctgtcgtacgcgccgccggagacgccgctgcggctggcggacgcgtacggggtggagggcgtgtactcgcccggcgtccccccccccccccccctcccggccgccgcccccaggatcgcgcggtccgtcatcaacggcacctaccgcgggttcatggagctcatcttccagaacaacgacaccaggatgcagagctaccatatggacggctacgccttcttcgtcgtcgggatggactacggcgagtggacggaggacagcaggggcacgtacaacaagggggacggcgtggcgcgcagcacgatacaggtgtacccgggcgcgtgggcggcggtgctggtgtcccttgacaacgtcggcgtctggaacgtgcggtcccagaacctggactcgtggtacctggggcaggaggtctacgtcagggtcgtcaaccctgaggacaccggcaacaagaccgagatggccatccccgccaacgctctctactgcggccagctccacaagtaccagaaggagcagactccgcaccacaagatgggggcgtctgctgcagcgccacgctcgttggtgtccctagcgcgccggctgctcgcgacggcgctgctcctcgccggatccttcgtgttggcgccgtagagtgagtggcaaccgtacttctgcaccgaggcggcacccgtttatgtaggtttgattaggattagaggcgtaggccgcgtcattacctatgaaaattgttcatatgccagcagtgctggcctccgcctggtttcctatggtacagttctccctcgctttcgttgtgtgtgtgtgcgcgcgcgcgcgcgcgttagttagcctctgttaggaagggtcgatggtttctctctgattagttcattccttttgatggtgattccgatcttagcgtttttgtatcgcccctcatgtagtcctgttcttcaactggctaagaacgttttactgg

SEQ ID NO: 4884 - DNA, 1119 bp, Zea mays
ctgcagcttgcaaagatatcatattgcgctcgtgtgcaaaggtattaagcaagtggatcggctggttgctttagcaaacaaagtttgcggagccgcggacacgcggctggcgtagcatgcatataaatacccagcaacacaagccctcgattaatttctacttccactcgtgccgcgccctcctcctcctgtcctgctccaccgctcattggcaccagcgcagcagcgcatctctcgctcgtcgttggtccttgtcaacgatctcgccgcttccatggccgccaaacctgcagagacgacagggacagggagcaacaaagctgagtcctccttctcctcctccatggcggtggcggccgacgtttacaaaggcgagctgacgccgctgcagcggcacgtcgccttcttcgaccggaacaaggacggcgtcatctaccccgccgagacataccaagggttccgcgcgatcggggccggcgtcacgttgtctgccttcagctccgtcttcatcaacggcctccttggacccaagaccataccggagaacgagaaggctccagctttcaagctccccatctacgtgaagaacatccaaaaaggaaagcacggaagtgattcgggcgtgtacgatgccaatggaaggttcgttgctgaaaaatttgaggagatcttcaagaagcatgcccacactaggccagacgccctgacaggcaaagagctgaaggagctgctcaaagcaaacagggagcctaatgacttcaaaggatggctgggtggtttcacagagtggaagatgctttactccctctgcaaagatgaaaaagggtttcttcacaaggacactgtcagggctgtctacgatggcagcctgtttgaaatgttggaacgcgagaggaacgctaaggagtctactaagacgaaatgagaagagcatcgtcttgcacccgttcgtgtggtcggtagtagaatttgtaaattgcggtgtgctgtgtgcatgtggaccagaaaaatagtacactagtttgattatgtacgtcattagatgcatatatgtttatttatatttatggagcaagagatttcttataaaaaaaaaaaaaaggaaaaaaaaaaaaaaaa

SEQ ID NO: 4885 - DNA, 2044 bp, Zea mays
aacaacaagtttggaccggctggagcagcacggccgcgacccgcgagacacgaaacccggcgtcgactggtttcttttcgcgttgcgcgcaggcagaggcagggcagtgcaagcgcaacgcaacacggctggagcggcggcattcatgcagataactcccacctcctcacgccacgccacgccaccaacgcatccgcagacagcgtcagtttccaccgatcgaaatcgaaactgccctcgattcctttccaccccgtcctctctgtcgcccgctacgtcgctgacacaccacaccgctttgaggggggcttgcagctggagcatctctgttccgagttccttcctctttcctccaaggcaaggctcctccaacttgcgctccctgtttctctacagatccttctctcctcctctcgtccttcgtcgtcgtcgtcgtcgtcgcgtgatctcggcctcctgcgacctccatggctggcaaagctgctgcagacactgggagcaacgaccgagtcgttgaggttgaggggtcctcctcctcctccatggcggacgtgtacaaaggcgagctcacgccgctgcagaggcacgtctccttcttcgaccgcaacaaggacggcgtcatctacccctccgagacataccaagggttccgagctatcgggtgtggcgtcgccctgtctgctgctgctgccgtcttcgtcaacggtggacttggacccaagaccgtactggtaccagagcttgagtcactttgatttctgcattgaaaaaaaaaaatctgaatcatccttagagcatgcctgcctgcctgcttggttcggtttggtttggtttcgccggccagcgtctgcagtagacggaagacgtaaccgtattctcaaaacctcagaagatcgaatgaagtgatattaacagcatcatctagaattctagagtcgtaaacaatataatggcaccctgatcagataaccaacccataacacaccttgaaagttgaaagagagatgccactacaccacctttgtcttcggaaaagaaaaaaaaggcaggcgtaaaagctacctgccgtgtcgtatggcgtatagcagtatagctacgtgcattcatccacgcgagattctttttttttggtggggcatcttttcaataattaatgtcacatttgatatttctctatcgtctccccctgatggagctgactctggctcgttcgtgtccgtgcatgccttctctggcgtcgcgcgctgaaggagaacgagaagcctgcgcctttcaagttccccatctacgtgaagaacatccacaggggcaagcacggcagcgattcgggcgtctacgattccaacggaagatttgtacctgaaaagtttgaggagattttcaagaagtatgcccacacgaggcctgatgcccttacaggcaaagagctacaggagatgatgaaagcaaacagagaacccaaggacttgaaaggatggctgggtggcttcacagagtggaaggtgctgtactccctgtgcaaagacaaggacgggtttctccacaaagacactgtcagggcggtctacgatggcagcctgtttgaaaggttggagcaagagaggaactcaaagaaagagtcgagtaagaagaaatgatgagaaatccagacgctcttatgtggacgagtttgcaagtcacgctgtgcgtgtggttgggtactatcataatttgatttattctatatgtttgtcgattcatataacgatattgcaagtatttgtcgaacgtgtttgaattagcaagacatatagctgtgagctttgatagcctcccatattttttcagttcatattttacattaacgtttttgtgcggtgcttgaaaatatttcgagcgtgctgttgtttttttcagttgtcttagtcatggactcatggtagattgctaccgcttttaaggctattgtttgtctaatttaagcctctttcatctatataatcagatgctcttgctcggttggttaaaaaaaaaaaaaaaaaaaaaaaaaaaaaaaaaaaaaaag

SEQ ID NO: 4886 - DNA, 1689 bp, Zea mays
tgcagtcaacagtgtgagtgcttggcccctcaggcactcaggcaaagctgccaccgcttagagtgcccttttccttttttttttgtcatttcagttggcaagtcgtcgagtaaagctacccaaccgtgcgctcctcatctgcacttttgttccatctgcttttacatgtcgagcggctcagagatgtcttgatcgatccccatccaaatggaacaaagaattttttttttttttttaggaagaaaaaacgtggagtaaaattgtgaaactggaactagaaatgtcacccattgaaactaccgatggagatcgagtgagggctctctgactctgagtagaggcaccaaaagaactagagcgtccaactcacaagaactgaaaagtacactagacttcattattcagaacacgtacacctgaaaacccccttccagaagatgaaggccgcctcgaacaagcatgcaaaatctatgttcataggaattttgtggggaaaactctcgcattctagacgacgaacaagcatcaagcacgcaggctactagctgcagtcttgtaaaggtcgtcgccacgtcccagcagcgtcgctgctgctgacgacacggacggttcgggcttcttctttgttagttaacgggcgcgcggttatttactgctagcaggagcagcagtagtgattttgtgtctgtaagcaggagctgggctcgcggcgaggctaccgacgctcttgcgccacttccacgagtcggctggcgtgctgggcagcggcggcagcgggaggaaggccggccgcggccgacggcacagcccgaacggccacccctcgcagtcccggaagcgctcccaggcctcgggcgaccgcagcgtcggcgggggcgggtctgtcagcatgcacgccgacgacgccacggtcgccgcccggctcgtgctgcgcgtgaagaagctcttcacggagaagaacgcctcgctctcgtcgtccgcgtcgcagtcccccccgtcggctgcctcctcctcctgctcctcctccgcggccgttccctccaccacgacgcacgtgcacgtcttgggacttgacaccgtgtcgaggacggttcttggatcgagcggggtgtacgaccaggcgaaagcagagctcgacgacagaggcagcgtcggcgagtccacgtccacgccgcacctggaccgcctcttcatctgccggctcctcatctcgtggaggatcacctgcgcaagaacgtgacgggtgcagcgcttttagcgaaccgcgtgaacggaccgagaactgggaccgggggctacgcgcaacgtatatataccaatcttattacctgtttggtgtcttgcgcttcgtcgaggacgttgtcgtcgtcgctgtcctcgccggagctccacccggcgccggcgggggtcctgacgcaggggacatggcagtgcgcgtaggtctcccggatgagcgacgacaaggacttgcagtagtgactggccgccggcagcttggggtggaactcttgcgccaagcaaggcattgtattgtattgctccctgatcaataatcacacacacatggaacgatcaccgatgtgttgcagctaagctacggatcgagctgtttcttccccggcgttcatccgatcgacgaggagtggtgggtataaatggtagagctcgatcggtcgcccatgtgtgtgg

SEQ ID NO: 4887 - DNA, 1435 bp, Zea mays
gccggccgggcctgggtcattgaactgctctgggaccgccctgtaacatccaccaactcgaggaggaggaggaggaggaggaggaggaggagagatccccccaccgagcctcggtttccaagcgccagcagaagaagaagagacaggacacatggcggcaggtttcggcccgaggttcgccgccggcgatgctccggcgagacggtgtaacctggagcggttcctcgaggccaccacgcccgtcgttgcgtcctccagctgctcgtccaaggagaccgcgaacggttgggggcagcggcggtcagacgacgcagacggctcgtcgccgttcttcgctctgggcgacctctgggactcgttcaaggagtgcagcgcgtacggcaccgctgtgccccttgctctgaacggctgcagcgacggcgtcgttcagtactacgtcccctacctgtctgcaatccagctttacggagccctcagcaggcacatcggcccttcgaggacgggtgcagaggagagcgacagcgacgcggagcgcgagacgagctccagcacgaacacgttatcggcgcgggaggaggcgagcgagagcagcaccagcggcagcgaagcctccggcgacgagggcgagccgggaccggggagctggtgccaggagcggctcctcttcgagttcctcgagtccgagcctccctaccagcgcgagcctctggctgacaagatttgtagccttgcccagcggtttccggagctcaagactctcaggagctgcgacctgtctccggcaagctggatctccgtggcgtggtacggtggacgaactagatagatgtacccgatctaccggatcccgacggggccaacgctgcgcgacctggacgcctgcttcctcacctaccactccctgtccacgcagttcgcagcaggcgccagcagcaacggccccagaccggcgacggcagccaccgcgacggcgatgatgtggctcccgacgttcgcgatggcgtcgtacaaggtgaaggcggcggcgtggacgccgggctggcgcgaccggcaggtggccgcgtccctcgcgcaggccgccgacgcctggctcaggctcctgcgcgccgaccacccggaccaccgcttcttcgccgcccggcggcctcccaggagatggtgatcatttgagtgtatagagtactctctctctctggcaagtctgaaggtagttgtcctgaaaaaagaaacggctgaggtagttagggttcactagcggaaccggagtgataaagtatgttcatcctgtagtttcaatgttttttccttttttttgtatccgccatgttctcaggaaaaaaatgtatcagaaaacgtataataggtgtagagcaaaaaaaaaaaaaaaattggtgtcatcctgtccattctggaccaccgcatgtgttaattttag

SEQ ID NO: 4888 - DNA, 1126 bp, Zea mays
  misc_feature (5)..(5): n is a, c, g, or t
tttantttttttttttattttttttttttttttttttttttttttttttttttttacgcaatgagattgcatcagataatttttacggatgtcccatttacaaacgcatcctctattccaaactccactctgttgcaacagtgttttgcacagtctgctggccatatagccttagcacactgatacagctagctgaagcgaatagcatgccgtcatccttttgttatgatgcttgatatccgctcgacgaacatacggcacattttcgtgctgaatcttatgtcttgcctcatccaatcagcggctatccttcccagggtgcccaacgacgagagcttatatgaccattcatcagatttttctaaccaagtgagagtgaagctgtaaccactagcttcatgagagactgaaaccgaaaatatctctgattcatcatttactgagaccttcatgcgaactaaagattgaagaagcaaacgaagcatatgagcactccgaatttcatttgtcccattccctctgatgcatgtacgtcttctagaacaaactagctcttgagattcctttgcggggctactgtgaggagcattttcactcaactgtaccctcttcttgccgtgggaaagtggtgtttttcttttgggtgacattagagttgaattttctaggatagcttcaggtgttaagcaatgaaacccagaagctgtagaattgtttttttcagctttctcatctaagagttgcttcagcctcagaatttcagtgtcccttgtaaggatatcttcaaggaattcctgacgggccttctcgagctcatcctgcttttccattagcttatcgttgagctccgcattgtctttcttgagttcgctgacccaatctttcatggcatcgtaaagctccttgagctccgcctctcgctttcgctctagcccctcgtctagcagcttcctcttcttgagaacagtgtacttctcgtggaacttggagtcgaaccgctccatcggcgccagggacggatccagaagcttgtagacgcaggtccgagcgcgcgcgggggggtttgaactcccaagttgcggagagtagagaactacagtactagacccgcgaccgcgcgccgcac

SEQ ID NO: 4889 - DNA, 1065 bp, Zea mays
ccgtagccgttatatagttcggtgcaaaccacaaagggtttttgtccggcacccaagcacaccacagggatacgggcgcaagtagcatgaaagacagctctgcaataagatagtgcatcaaatcatttttacatcaggatgcttccatgtacagtaggcagactgatataactagctgaagcgaagagcatgtcgtcatccttttgttatgatgcttgatatccgctcaaagaacatgcggcacattttcatgctgaatcttatgtcttgcctcatccaatcaacggctatcctttccagtgtgcccaacgaggagagcttatatgaccattcatcagatgtttctagccaggtgaggatgaaactgtaaccactagcttcatgagatactgaaaccgaaaatatttctgttccatcatttactgagatcttcatgcgaactaaagattgaagcagcaaagaaagcatatgagcgctccgaatctctgttgtcctattccctgagatgcgtgtatgtcttctggagcattctagctgcttgccgtgggaaaatggtgtctttcttttaggtgacaatggagttgaattttctaggacagcttcaggcgctaggcaaggaaacccagtagctgcagaattgtttttttcagccttctcatctaagagctgcttcagcttcagaatttcagcgtcccttgtacgaatatcttcaaggaattcctgacgggccttctcgagctcatcctgcttctccaccagcttctcgttgagttccgcattgtctttcctgagttcgctgacccaatctttcatggcatcgtaaagctcattgagttccgcctcccgcttccgctccagcccctcgtccagtagcttccgcttcttcagagcagtgtacttctcgtggaacttgtagtcgagctgctccatcggcgtcagggacggatccagaagcttctagacgcgtgtccgagcgggagcggcgactttggctggagagcgggaaggaaccaagggaggacagtttttgggggtaagttttttgaactcacacggtgcggtcgt

SEQ ID NO: 4890 - DNA, 1179 bp, Zea mays
ggcctttgtgctctgctggatctttagtgctggataccctatccattgcttgggattagaaataaagaggcacccgtgtatttgagctatggaaaggaagcaggaaggtgatcagttcatgatttcacgtgttgtgcaatgaagagtagagggaacaattatgcaaggatgaaataacgggtaagggagagattagcagacctcagtttagtttcctacatatagtccaaacaacatgttagttatgtaaacccagattaacagtctagcaaccttagactagttttccctgaaatctctgataaaattgtgtttttaccaaaaaatatctctattttatagaaccaaactactaaatgattgtagcattccatttaacagggatcttgtagccattgctcgttaacatttccaagagctagtgattcgttgtcctttgtttatggcggtcatatgcataaatatatcatgtaattaacctataattaacggggtcagttcaaaaggagtaacccaattcgtgtccacttctcatgactagacagaaaggaaggttggatagataatcttactaagaatatcttcaaggaattcctgacgggccttctcgagctcatcctgcttttccattctgaaatcatcaaattagccaccaacaaaacaaaagataatggatataagcaacgatatagaatgaattccaccacaaacaacaaaaccctaacccgcgcagaagcataacaatgcttttccattagcttatcgttgagctccgcattgtctttcttgagttcgctgacccaatctttcatggctgaatcatcaaaacaaaaggggaaaatcaaagcagggaaaaagaacaagcgcttcgcccaaaaccctccctcccattctcatagttccgcccaaatcgagtccagcacggagataggttcggccgggacttgtaccatcgtaaagctccttgagctccgcctctcgctttcgctctagcccctcgtctagcagcttcctcttctgcggtgcggcaatagattaaccggaaaacaaaatttgcggtgtcaaaccaccgcgggcgccacagaaatgggatgaggaagaagcgggcgtgcccgcgctaccttgagaacagtgtacttctcgtggaacttggagtcgaaccgctccatcggcgccagg

SEQ ID NO: 4891 - DNA, 1151 bp, Zea mays
ccctgaaactcaactagccgttggagtcaaggcagcggcggcggacgcggctgaaagctgtcgaccgtgccgcgccgcccccaacggtcactggagaggaagaagaaactcgcatttccatccccagccaattgtcgctcgcctttaaatcctgcgccccaccgccgcctccactcccaccgctctctatcctcccactcaaatactcctcaatagccatcgaggagaagggagatagaaacgggagggaacacccactcgatcgtcagccatgacccggggagagaaccaggagtcgcaaaccggtaacgtccccgccgcatccgcggcggcgccggggccgaagccggcgtcggcggggggcgggaaaggcgcggagggccagtcggtggtgcggcggctgcagtcggagctgatggcgctgatgatgggcggcgacccgggcgtgtcggcgtttcccgagggggacaacatgctccactgggtgggcaccatcgacggctccgccgggacggcctacgagggcacctcctaccgcctcgcgttggccttcaccgccgagtacccgtacaagccgcccaaggtgcggttcgacaccccctgcttccaccccaacgtcgacgtgcacggcaacatctgcctggacatcctccaggacaagtggtcctccgcctacgacgtgcgcaccatcctcctctccatccagagcctgcttggagagccgaacaacgactcgccgctcaacactcaggcggcagcgctctgggcgaaccaggaagagtttaggaagatggtggagaaaatctacaagcccgccgcgtagaggaggatgacagcgcctggtgaagatgtgggttcttcaagcactgatttcgcttggattgatcgacaagagataatatttggatggtttgggttcccagtctggtgctgtagcaggaaggaatatttgggtcgcctagagcctggcgattctgtaattgttctgagttctgaaatgttcagatattcatttttccatgaatcgttttcgtcccttcgcctcttcctaactgcaatattggtatgaaattatgaatatggactggacaagactgattgaattcaaaaaaaaaaaaaaaaacaaaaaaagaagaaaaaaaaaaaaaaaa

SEQ ID NO: 4892 - DNA, 1050 bp, Zea mays
  misc_feature (5)..(5): n is a, c, g, or t
ccggnattcccagccaatcgcctctcgcttttaaatcctgcgccctaccgccgcctccactcccaccgctctcaatcctcccgcctcttcctaatccgcctcctcccgctcagtcgccgccgtggaggaaggagcaactcgatcgccagtcatgacccggggagagaaccaggagtcgcagaccgggaacgtctccgccgcatctgcggctgcgccgggaccgaagccggcatcggcgggggccgggaagggcgcggagggccagtcggtggtgcggcggctgcagtcggagctgatggcgctgatgatgggcggcgacccgggcgtgtcggcgttccccgagggggacaacatgctccactgggtgggcaccatcgcgggatccgccgggacggcctacgagggcacctcctaccgcctcgcgctggccttcaccgccgagtacccgtacaagccgcccaaggtgcggttcgacaccccctgcttccaccccaacgtcgacgtgcacggcaacatctgcctggacatcctccaggacaagtggtcctccgcctacgacgtgcgcaccatcctcctctccatccagagcctgctcggagagccgaacaacgactcgccgctcaacacgcaggcggcggcgctttgggcgaaccaggaagagttcaggaagatggtggagaagctctacaaggccgccgcgtagaggacagcacacggcgcagatgccgactcaggttcttcaagcaccgatctcacttggatcgattgacgtggatggttttgttgggttgggttcccagtctggtgctgtagcggtgtagcaggaacgcgtgggtagccttgagcctggcgattctgtaattgtcctttgagttctgaaatgttaagagattcatttttacatgactttttgttttttcatttttacactctggatatggacgggactagttgaatttaggaagatcgtatgatctcgcaaaaaaaaaaaaaaaaaactgcatcaacacaatgttcaaatgaccttcgtcccaaaaaaaaaaaaaaaaa

SEQ ID NO: 4893 - DNA, 1247 bp, Zea mays
cactccatagggcgattgggttcctcgaggccggccgggaaaagcgcacttttcaaatcgacaaaggggaaaggttcgcttcttctcgcatcttgctttacttcgagtgccatggccgatccggcggaggagaacgttgtctcgccgccaccgacccctgcggccccagccgtgggcgcctcagactcgcccctgcagcctgttgctgacggcgcctcaacggagaaggtgtctgccccggcgccggaggtaaggtcccggggattcaggcttcttggagaggacacttccgtgcacaaatcccttgggggcggtaaaactgctgacgttctgttatggaaacccgccgggccttctgctgttgtaataggcggcgcaactgtcatctgggttctgttcgaagtgcttgattaccacctcctgaccctgatatcccatgtactgattggtgtgcttgccaccttattcctgtggtccaaagcaaccacgttcatcaagaagagtccaccggatattccactagtgcaggtatctgaagaccttgttgtgaatgtttcacgggcattacggaatgacatcaacagagcgcttcacttgttccgtgagatcgcaatggggcatgatctgaagaagtttttgggtgtgatcgtgggtctgtgggttctctccggagttggaagcagctgtgacttcctcacgttgacatacattgccgtcctgatgctccacacggtgccaatcttgtacgacaagtaccaggacaaggtggaccatttcgctggaagggcacacaccgaggccctcaagcagtacaaggtgctggatgccaaggtcctgagcaaaatccccaggggtgcggtcaaatccaagaagcagaactagttaggataagccgcagattgtgaatgcccgtatcctgagtatcgggcttgtggtttgcatggcatatgtaaatctgtctgttggcttcagcttggttcttctgcgactactttgttgatgttattctagtcctatgtatgtcactgtgtacatgacagagatgttcggatgctacgtctaggctactgctgtgctgtagcttgtaaattccagtggtgcgttgctaagcacgatgctccccttgttttatgtggtgttggactaatgattactacactaaggtttaatgactcgattaggatcaaacgcggcctactagtggaaattattatttttattcgaaaaaaaaaaaaaaaaaagcggcc

SEQ ID NO: 4894 - DNA, 5833 bp, Zea mays
  misc_feature (499)..(499): n is a, c, g, or t
  misc_feature (622)..(622): n is a, c, g, or t
  misc_feature (1729)..(1729): n is a, c, g, or t
  misc_feature (1744)..(1744): n is a, c, g, or t
tggagcaagaatcgtcgatcccaactctaggccagctctcacccgcagaaggaggacacggagggatgagataccaccctccacagtaggctttcttctcgtgggatggaaggctccacaagcgaaacaggaaggcggcgaggtgaggggaagaacgggagccaactaggtcataggaaaccctaggtctctcttccctcaaaaaggcggattaccgtgtctaaaaggcgacaacgccaacgagtcaccatgggccttgcgaaagtgatcaggagcctggatggcttccacgccaaaggtccacccacgccatttccaagggccaacttgctcggcccaaccctgttcatcaggagctttccacacggaccaagatgacctccgagaccatagagcccatgaaggcttcaaccagaggccaggatcccgcttagtgaccaaaatcgaatggctagggtggagcacaaaggagtcaacaatgtagggggtctaggggtgnggagggaggacgacgaggctctcacattcgtcatcgccaaaggcctattcccgaaccaagatttgttaggacatgtgcaaatgactttaaactgcaagcacacaactttgatgcatataaatntatgctataattaaattgcatattgttataactaaacgttatccaatatagtttagtagttttattatcaatatatatatatatataactatatataaaattgggtttgggtggaaaatttaaaaaagcgggaaagctatcactaatggccaagtttagaaaaccgctagtggaaaactatttccactagcggttggttaagagaaccatcagcgaaaatatatttttactggcggttcggttaagagaaccgcctatataaagatccatttgcactgactctagcgctagcggttctaaaaaacgatagtgaaatgggttgtaaactgcctctatagagcttatttgccctagtgaagggcaccttcggtgaatttgttagaaagagtcgtcctggcagtgtctccaacatacaacaaagactggcgcatagaaataataacatttttgaagggaaaacacccaacattaaaaagaatggaagcaaagatgaagctatataagatcataaaaggggagttgtacaaggaagatgtctgtgcatccctgtttaaataactatctagatccgaaggtcaagaactaatgagagatatttattctggtatttgtggggctcacatcggcccagagattttctaggaaaagtgcttcgtcaagatttctattggccgaaggtagcagcagatgcaacaaacttggtcaaaatatgtgatcattgattcaattgatccaacttactttgcatgtggtgagatagggtatggaggcccaatgtggccagctcaaaaaaacttaaaatatgtcgtggttgcattggaaaatactccttcaagtggattgaaacaaaatcattagctaccataacttcggctacaacagagatcaacagaggcatgtccgccaatgacgcgctatggatagtgggaggtcaaggataacaggtggggtcagggtgtcagtgagagagcgatcgcgggggacataagcgccgacacgtgactcaagagcatgggcaagtgcagggagagaagcgctgacaagcaggccccgcatgtgagtggaagcatagctcgagagcagtttggatcgagtggatctaggtcntaccattattttccntttttatttttgaatttaggtttgaattttgaattcaaattaaatgaactctaaatcatattaagattttacaagaaatcataaatatttatatggtcattcggatgaagtttgggctcttttcttgattagtaatgttgaatacttgttttcgattgcttcggcttttttgcgtaagatagtttgaaggtaatttgaagactaagcgagacggagcttgagtcctcgaaaggtgaatatatatatgatattgttcatctatttataagggatatgtacatctttgtacgaaattacaaacatccacaaagtttacatacatgatttacaaatgatataagaacattattgttgtttttctttctttcttgttgcacgagtcttagacttttctctttcatcactttgcatccggagttttcttcaggccgagactgtcggcttgcaccttcgccgcccgtgcgtattggacgaagcttctatacagcacttcggacgaaagctagcttaacacatatatttatgtcgaagtaaatatattttgagggtctttagcaggatagatcccttacaagtacatttgtgtaaaacaattttttccctctctctatttgagataaaattaggataaatatttaaaatggtggtgtgttgtcggagtttaaaggaaatttgtttaagggtgtcacaggaatctagagtaaaatacattttaacagaagtctttgaccaacagagaatgaaatgatgtatacagaggatatagaaaaataagatgtcgataaaatattttttagaaaaaataatagatattgaaaagatatagataacctctggagactctgaagtctgtcgttttcgcgtcgaaactagtgacacgaatcttttcgtggacacgtagcaggtcgatgatgaggagcggcgacacgtcgtgacggacgttactttcgcgccgtattctagtcttctagagatatccatccagttctcgctatatctttttctccccaagaaaaaaaaggcggcgagagcataagaaaaaaacacccccccccccccccccacaagcgcacttttcaaatcgacaaaggggaaaggttcgcttcttctcgcatcttgctttacttcgagtgccatggccgatccggcggaggagaacgttgtctcgccgccaccgacccctgcggccccagccgtgggcgcctcagactcgcccctgcagcctgttgctgacggcgcctcaacggagaaggtgtctgccccggcgccggaggtaaggtcccggggattcaggcttcttggagaggacacttccgtgcacaaatcccttgggggcggtaaaagtacgtatttctttcttcatttttctgctgactttcttcctgtgctccaattaatcgtatggtgttagcttggagttgtgcttttttataacaggaggtcaggagatgtgtttgtttctttctggttattattctaagtgcataggaaacaatagacgagataacgcacggaatgagattgattatttattcggagtttcttttgagaaagtatattcaaatcactccgtaccggttattaggtgtgttaaattttgttcaaaaataataacgggtgttaaaaaatatgttctaagaaaagctaataatttacgactacaaagaaacgtacctacatatataattattatcgattgaagaatattgatattagtttctccctaggaaaccagcagccaaaaaggaagacatggaaacagattctttagattcattgtttactgcactcgtagatacagtgatggtgataagtatgaaacgcgcaagttgtacagtgatggtgataagaaaaaaaaaagcgcaagttgaccttttcatcggaaacgatgttttttgtccatttttcctaggggcgcactccagaagatgttaatggcttttgacaggtggctacaccaacacacttgtaaaagtgaatctacacttgaatcatatggcttcgggctcctctttttcaatcattgacacttaaaactccagataatatgctttggcaacaaatttaaatttttaacactttgccatacacagtgatgggcaacatatatagtgtaaaagggattatggtgctaacattgtaacatcaaattttatccatcggatccaccataatctatggttgaattcaatcttgtatggggacaaaatataggagttctttagaaagtagtctatgaaattgatagatgaagacatctttaaaccatgagctaaccttaattgagattagcttaggtcattgctgttatctcttttgttctaattctgctccttgtggaggagaactttctgcagctgctgacgttctcttatggaaagacaagaaaacttctgctgttgtaataggcggcgcaactgtcatctgggttctgttcgaagtgcttgattaccacctcctgaccctgatatcccatgtactgattggtgtgcttgccaccttattcctgtggtccaaagcaaccacgttcatcaagaagtgagtattgcattgggacataggatgatcctcaacatgttccattttaagtagaaatccatcttatttgcgtccatgtgttgcctctgcaggagtccaccggatattccactagtgcaggtatctgaggaccttgttgtgaatgtttcacgggcattacggaatgacatcaacagagcgcttcacttgttccgtgagatcgcaatggggcatgatctgaagaagtttttgggtgtatgtttgtgctcttaacagctgctgaacatttatttcattttcatatcatgctggtcactggtttgagattcttttgcgtgttcactcaggtgatcgtgggtctgtgggttctctccggagttggaagcagctgtgacttcctcacgttgacatacattggtaactctcttagaacatacagagtactccctcttcgtctacaaactataagactttttagcttttttctagattgcttttccagacaatagtgcatgtctaagtgcatagctgttgttagtgtaagttgctgctactagactgatcatttggaatcaaacagcatacattgccgtcctgatgctccacacggtgccaatcttgtacgacaagtaccaggacaaggtggaccatgtcgctggaagggcacacaccgaggccctcaagcagtacaaggtgctggatgccaaggtcctgagcaaaatccccaggggtgcggtcaaatccaaaaagcagaactagttaggataagccgcagattgtgaatgcccgtatcatgagtatcgggcttgtggtttgcatggcatatgtaaatctgtctgttggcttcagcttggttcttctgcgactactttgttgatgttattatagtcctatgtatgtactgtgtacatgacagatgttcggacgtctcggctactgctgtagcttgtaaattccagtggtgcgttgctaagcacgatgctccccttgttttatgtggtgttggactaatgattactacactaaggtttaatgactcaattaggatcattttgtgaaagaaacagggtgtgaaaaaacatttggatcataatcttgaactaaaaactaaaatttatttagtattctatcattttgtgaataaatatttgatcataatctattatcacctataggtttaggtgtctataggtatccttgttttcacataaacactagttaccactggaaattattatttttatttgcatggtagagtacggagtgggaaattatttttttatttgcatggcagatcgcggagggttgattcatgtgattcgtttctttttttcaactggcaaggtagcacatgacaaacgtgcggtcacaattttttagtggacagtccggttaggcgccgagccgagctgcaacacggtttaataaaaagaaactatgttgccttcactgcaaaatgcttaggagaagaggaagcgatcctgttgaactacgtggatgtctttgacatcaaattgtaataggtttaaatactctattttattaaatttcgagcattatgcaatacagttc

SEQ ID NO: 4895 - DNA, 1247 bp, Zea mays
tacaccaacacacttgtaaaagtgaatctacacttgaatcatatggcttcgggctcctctttttcaatcattgacacttaaaactccagataatatgctctggcaacaaatttaaatttttaacactttgccatacacagtgatgggcaacatatatagtgtaaaagggattatggtgctaacattgtaacatcaaattttatccatcggatccaccataatctatggttgaattcaatcttgtatggggacaaaatatcccacgcctccgcccacgcgtccgtgaaattgatagatgaagacatctttaaaccatgagctacccttaattgagattagcttaggtcattgctgttatctcttttgttctaattctgctccttgtggaggagaactttctgcagctgctgacgttctgttatggaaagacaagaaaacttctgctgttgtaataggcggcgcaactgtcatctgggttctgttcgaagtgcttgattaccacctcctgaccctgatatcccatgtactgattggtgtgcttgccaccttattcctgtggtccaaagcaaccacgttcatcaagaagagtccaccggatattccagtagtgcaggtatctgaggaccttgttgtgaatgtttcacgggcattacggaatgacatcaacagagcgcttcacttgttccgtgagatcgcaatggggcatgatctgaagaagtttttgggtgtgatcgtggggctgtgggttctctccggagttggaagcagctgtgacttcctcacgttgacatacattgccgtcctgatgctccacacagtgccaatcttgtacgacaagtaccaggacaaggtggaccatttcgctggaagggcacacaccgaggccctcaagcagtacaaggtgctggatgccaaggtcctgagcaaaatccccaggggtgcggtcaaatccaagaagcagaactagttaggataagccgcagattgtgaatgcccgtatcgtgagtgtcgggcttgtggtttgcatggcatatgtaaatctgtctgttggcttcagcttggttcttctgcgactactttgttgatgttattctagtcctatgtatgtcactgtgtacatgacagagatgttcggatgctacgtctaggctactgctgtagcttgtaaattccagtggtgcgttgctaagcacgatgctccccttgttttaaaaaaaaaaaaaaaaaaaaaaaatacactaaggttt

SEQ ID NO: 4896 - DNA, 1267 bp, Zea mays
cattgggtacctcgaggccggccgggtgtaaaaacatgtgtgtggtgagtgaatatatctttttctccccaaggaaaaaaaaggcggcgagagcataagaaaaaaacacacacacacacacacacacaaagcgcacttttcaaatcgacaaaggggaaaggttcgcttcttctcgcatcttgctttacttcgagtgccatggccgatccggcggaggagaacgttgtctcgccgccaccgacccctgcggccccagccgtgggcgcctcagactcgcccctgcagcctgttgctgacggcgcctcaacggagaaggtgtctgccccggcgccggaggtaaggtcccggggattcaggcttcttggagaggacacttccgtgcacaaatcccttgggggcggtaaaactgctgacgttctgttatggaaagacaagaaaacttctgctgttgtaataggcggcgcaactgtcatctgggttctgttcgaagtgcttgattaccacctcctgaccctgatatcccatgtactgattggtgtgcttgccaccttattcctgtggtccaaagcaaccacgttcatcaagaagagtccaccggatattccagtagtgcaggtatctgaggaccttgttgtgaatgtttcacgggcattacggaatgacatcaacagagcgcttcacttgttccgtgagatcgcaatggggcatgatctgaagaagtttttgggtgtgatcgtgggtctgtgggttctctccggagttggaagcagctgtgacttcctcacgttgacatacattgccgtcctgatgctccacacggtgccaatcttgtacgacaagtaccaggacaaggtggaccatgtcgctggaagggcacacaccgaggccctcaagcagtacaaggtgctggatgccaaggtcctgagcaaaatccccaggggtgcggtcaaatccaaaaagcagaactagttaggataagccgcagattgtgaatgcccgtatcatgagtatcgggcttgtggtttgcatggcatatgtaaatctgtctgttggcttcagcttggttcttctgcgactactttgttgatgttattatagtcctatgtatgtactgtgtacatgacagatgttcggacgtctcggctactgctgtagcttgtaaattccagtggtgcgttgctaagcacgatgctccccttgttttgaaaaaaaaaaaaaaaatgattactacactaaggtttaatgactcaaaaaaaaaaaaaaaaaa

SEQ ID NO: 4897 - DNA, 1258 bp, Zea mays
gccggggccatatctttttctccccaagaaaaaaaaggcggcgagagcataagaagaaaaaaaacacacacacacacacacaaagcgcacttttcaaatcgacaaaggggaaaggttcgcttcttgtggcatcttgctttccttcgagtgccatggccgatccggcggaggagaacgttgtctcgccgccaccgacccctgcggccccagccgtgggcgcctcagacccgcccctgcagcctgctgctgacagcgcctcaacggagaaggtgtctgctccggcgccggaggtaaggtcccggggattcaggcttcttggagaggacacttccgtgcacaaatcccttgggggcggtaaaactgctgacgttctcttatggaaagacaagaaaacttctgctgttgtaataggcggcgcaactgtcatctgggttctgttcgaagtgcttgattaccacctcctgaccctgatatcccatgtactgattggtgtgcttgccaccttattcctgtggtccaaagcaaccaccttcatcaagaagagtccaccagatattccagtagtgcaggtatctgaggaccttgttgtgaatgtttcacgggcattacggaatgacatcaacagagcgcttcacttgttccgtgagatcgcaatggggcatgatctgaagaagtttttgggtgtgatcgtggggctgtgggttctctccggagttggaagcagctgtgacttcctcacgttgacatacattgccgtcctgatgctccacacggtgccaatcttgtacgacaagtaccaggacaaggtggaccatttcgctggaagggcacacaccgaggccctcaagcagtacaaggtgctggatgccaaggtcctgagcaaaatccccaggggtgcggtcaaatccaagaagcagaactagttaggataagccgcagattgtgaatgcccgtatcctgagtatcgggcttgtggttttgcatggcatatgtcaatctgtctgttggcttcagcttggttcttctgcgactactttgttgatgttattctagtcctatgtatgtcactgtgtacatgacagagatgttcgaatgctacgtctagactactgctgtagcttgtaaattccagtggtgcgttgctaagcacgatgctccccttgttttatgtggtgttggactaatgattactacactaaggtttaatgactcgattaggatcaaaaaaaaaaaaaaaaaaaaaaaaaaaaaaaaaaag

SEQ ID NO: 4898 - DNA, 824 bp, Zea mays
ccggccgggtattcgaagttcgccgactcccagctgactcccggcccccaccccccccgggacggccgatcgctcattcccctccggcatcacgacaaccgcaatcatgagctccaccaactccgttcagtgcttcggtaagaagaagacggctactgctgtcgcccactgcaaggccggtaagggtctcatcaaggtcaacggacgtcctctccagctcgtccagcctgagattctccgcttcaaggtctacgagcctctcctcgttgttggccttgacaagttcgccaatgtagatgtgcgcgttagagtatctggaggtggccaggtgtcacaggtctacgctatccgacaagctatcgccaagtccctgatcgcctactaccagaagttcgtcgatgagcactccaagaacctcctcaagcaggctctcgtccagttcgaccgaaccctcctcgttgccgacaaccgccgttgcgagccaagaaagttcggtggtcccggtgcccgtgcccgcttccagaagtcttaccgttaaacggttcaagatgttggtcggaatggggctcaaaagcgtcgagtcggggcgatgttgcagtggaggatacaacaggcagtgcgaaaaggggaccggagtcacaatttccctggtttgggaatgggttacctattgacatttgcatggccttgcttttggcggattgaacaggatctggcaggcaaatgaaatctttcaagttaactatgtggctcacgctgcaagggtttcccgcggccatgaactggcgaaaaaaaaaaaaaaaacgcggcctcgagctcagctt

SEQ ID NO: 4899 - DNA, 2260 bp, Zea mays
agaaaaaagaactttcaccatcctccctatcaatacaagattcatctacacaaattataatatactccgtgcgaaggaaagatcaaattagagattcattcgatcaattctgattgtttccttccattccaaaccaccttcaattctgatttctgcggggggggcctcgcggccgccccgggccattccaaatcctcctctgcaattttctcatggcagctgacgtttccatcccaactcgatccgcgtcaaccgcccgctaattcctcctagttctagtcccctctctcctgcgccgactcatctttttcctcgtgtcactcccctgctgctgctgctgccgggaagatcaaatcccgtcaaaaggctccaaaggatcagagttctgtcaagatggcatgcccaagaggaaggacaccatttcccctttgtttctttctgatgatttgcctcatggctcagctgggagcttccaatgttgtactcatggcgaacaacactaccttgtcgttggatgatgtcgaggcaacttttactccagcagtggaaggttcaggtgtaagtggcgttctttatgctgtggaacctaaggatgcatgcagtccattgagagcgaaagcgattcaaggctctgtctcaccttttgcgttgattataagaggcggttgccaatttgatgacaaaattagaaatgcacagaatgctggattcaaggctgctgtagtatataataatgaagataatgacatccttgtttcaatggctggaagctcgcttggtgtccagatatatgcagtgttcatctctaaggcatcaggggaggagctgaagaaatattcaggccaaactgatgcagagttatggataataccaacatatgagaactcagcttggccaatcatggcaatttcattcgtatcactgcttgctatgtctgctatcctagttgcatgtttctttgcgaggagacaccagatcagacgggacagggcaagacttccccgagctcaggagtcccatggaatgagcagtcaattagttaaggcaataccaagccttattttcacaaaagtgcaagaagacaactgtacatcagcaacatgcgccatttgcttggaagactacagtgttggagaaaagataagagtgctaccttgtcgacacaagttccatgcggcttgtgtggacctatggctcacctcatggagaacattctgccctgtatgcaagcgggacgcaagtgctggaacgtcagacccccctgtatcagagtctacccctttgctttcatcatccgccacacgcttgccggaatcaactgtgttggcttccttgcggtctacagcagcagcgtctccccccaggacgatcagccggcatcctttgttgcggtcaatatcccgcaattactctgtttcaggttccagtatccttcgcacccccgactctaggtttgatgcaaactcatctatctgcacaagtggaagcaacttggaccttgcaaatgtaccatccccatggtctggcacttggcaccgtgcgtctgctcactctttgtgcaggggctacttgtccccaccgatcggcatcaggaatacctcagcacatgtctcgcgttctgccaatggatctcccagtcgttacgtaggctcatcacgcatgtcccatggatcttcagggcagcagcatcctcacctgaggcactgcacattgtcaggcccgagcctgttcaccatggtgccccagtcaccgcaacagaaccagttgcagcatggtggatactcggaaacaaatctgtcggctgccgcatcggctcaatcattccgtcagctctacctgcagcattgccctgattctgacacgtcgtctcagtcacttccagggtgctgatctcttgctgcaatattcactgattcttgcgcccatgagaaatcttgcctggtgctgaattgacatgtggattttgagctcgtcagcatagttcaccatgatgataaaaaaaagagaaagaagtttggagtagttttacatgtggaaacaaaactgcttgtaagaagagagaatgtgcagccccagagtgtgagcaattttacatgcttgagtgtacaggggtttggagtagtcttggacttgcttattttgaggcatgtattgcagtcataggttacttctgctcaatagtttatgtgttgcctctgtctgggttctcaagcgtttagcttggaccgatatacagctttgtaggaatcctagttgctgt

SEQ ID NO: 4900 - DNA, 1111 bp, Zea mays
  misc_feature (1035)..(1035): n is a, c, g, or t
atattagtgtagccatcagtgtatttatcccgccccgttggggcacaccaaggctgctttgattcagctctgatggcttcgttccattgcaaaccacctcccgttctgatttctgcgggcggaattccataaggccctcccccctcccctatcctcctccccttgccactccaattcctctgcaaaattttctcatggcagccgacgtttccatccgcactcgatccgcctcaaccacccgctaattcctcctagttctagacttctagtctcctctctctctctctctctctctctctcctgcgccgactcatcttcatcctcgtctcacctccctgctgctgctgacgctgctgccggcaagatcaaatcgttcaaaaggtgttttaggtgattggtgctttcgacctcattagtgccttttgttcaattgctggacccaaggagcagagttctgtcgacatggcatctccaagaggaaggatgtcatttccccttcgttcctttctgatgatctgcctcatggctcagctgggagcttccaatgttgtactcatggcgaacaacactaccctgtcgttcgacgacgtcgaggcaatttttactccagcagtgaaaggttcaggtgtaaatggtgtcctttatgctgtggaacctatggatgcatgcagtccattgaaaacaaaagcgataggaggctctgtctcaccatttgcgttggttataagaggcggttgccatttcgatgacaaagttagaaatgctcagaatgctggattcaaggctgctgtagtatatgatactgaagacaacggtgtccttgtttcaatggctggaagctcgtctggagtcacatatatgccgtgtttgtctctaaagcgtcaggggaggagctgaagaaatattcaggccaaactgacgcagagttgtggctattaccaacatacgcgatctcggcttggtcatccgcggctctttcatttatatcactgcttgttctgtctgctgtcctagccgcgtgtttctttgcgaggngactcccgttttgacgggactgggctcgtcttcccctttctcggtcgttccctggcttgtccagccggttcgtttc

SEQ ID NO: 4901 - DNA, 1021 bp, Zea mays
  misc_feature (54)..(54): n is a, c, g, or t
  misc_feature (946)..(946): n is a, c, g, or t
ttgggtacccctccgaggtccggcaccgggaatcgcattgctgggactcgcggngatgtgggatagtggaccggatgacaaagcaagagcagaaaaaagaactttcaccatcctccctatcaatacaagattcatctacacaaattataatatactccgtgcgaaggaaagatcaaattagagattcattcgatcaattctgattgtttccttccattccaaaccaccttcaattctgatttctgcgggtgtgggatatcgtccccccttgccattccaaatcctcctctgcaattttctcatggcagctgacgtttccatcccaactcgatccgcgtcaaccgcccgctaattcctcctagttctagtcccctctctcctgcgccgactcatctttttcctcgtgtcactcccctgctgctgctgctgccgggaagatcaaatcccgtcaaaaggctccaaaggatcagagttctgtcaagatggcatgcccaagaggaaggacaccatttcccctttgtttctttctgatgatttgcctcatggctcagctgggagcttccaatgttgtactcatggcgaacaacactaccttgtcgttggatgatgtcgaggcaacttttactccagcagtggaaggttcaggtgtaagtggcgttctttatgctgtggaacctaaggatgcatgcagtccattgagagcgaaagcgattcaaggctctgtctcaccttttgcgttgattataagaggcggttgccaatttgatgacaaaattagaaatgcacagaatgctggattcaaggctgctgtagtatataataatgaagataatgacatccttgtttcaatggctggaagctcgcttggtgtccagatatatgcagtgttcatctctaaggcatcaggggaggagcttgaagaaatattcaggccaaactgatgcangagtggtggataataccaacatattgagaactcagcttggccaatcatggcaatttcattcatataactgcttgc

SEQ ID NO: 4902 - DNA, 2604 bp, Zea mays
acaaaccacctcccgttctgatttctgcaggcggaattccataaggccctcccccctcccctattctcctccccttgccactccaattcctctgcaaaattttctcatgtcagccgacgtttccatccgcactcgatccgcctcaaccacccgctaattcctcctagttctagacttctagtctcctctctctctctctctctctctctctctctctctctcctgcgccgactcatcttcaccctcgtctcacctccctgctgctgctgacgctgctgccggcaagatcaaatcgttcaaaaggtgttttaggtgattggtgctttcgacctcattagtgccttttgttcaattgctggacccaaggagcagagttctgtcgacatggcatctccaagaggaaggatgtcatttccccttcgttcctttctgatgatctgcctcatggctcagctgggagcttccaatgttgtactcatggcgaacaacactaccctgtcgttcgacgacgtcgaggcaatttttactccagcagtgaaaggttcaggtgtaaatggtgtcctttatgctgtggaacctatggatgcatgcagtccattgaaaacaaaagcgataggaggctctgtctcaccatttgcgttggttataagaggcggttgccatttcgatgacaaagttagaaatgctcagaatgctggattcaaggctgctgtagtatatgatactgaagacaacggtgtccttgtttcaatggctggaagctcgtctggagtccacatatatgcagtgtttgtctctaaagcgtcaggggaggagctgaagaaatattcaggccaaactgacgcagagttgtggataataccaacatacgcgaactcggcttggtcaatcatggcaatttcatttatatcactgcttgttatgtctgctgtcctagccgcgtgtttctttgcgaggagacaccagataagacgggacagggctcgacttccccaaactcgggagttccatggaatgaacagccggttagttaaagcaatgccaagtcttattttcacgaaagtgcaagaagacgactgcacatcagcaacatgcgccatttgcttggaagactacagtgctggagaaaagctaagggttctaccttgtcgacacaagttccacgcagcctgtgtggacctatggctcacctcctggagaacattctgccccgtatgcaagcgggacgcgaatgctggaacaccagagccccctgtatcagagtcgacgcctttgctctcatcatccgccattcgcttaccagaaccaaccgcttcggtttccttccggtctacagtggcagcagcagcagcgtctccccccaggccaatcagccggcatccgtcgccatcacggtccatatcccgcaagcactccgtttcaggttccagcatccctggcacccctatccccaggttccatgcaagctcatcatctcctacctgcacaagtggaagcagtttggacctcgcaaacatgccgtcgtctccatggcctcgcgcttcgcaccttgcatctgctcactcttcgtgcggtggccgcctgtccccgccgatccacatcaggaatacctctgcagcgcacgtctcgcgctctgcctatggatctcccagccgttacgtaggctcgtcgcacatgtcccgtggatctccgagttgctactaccttggatcttcttcagggcagcagcatccttacctgaggcactgcaccttgtcaggcacgagcctgttcaccatggtgccccaatcaccgcaacagaaccagctgcagcacggtggagactcggaaaaagatctgtcagctgctgcaccattccgtcagctctactacctgcagcattgtccagattctggcacgtcgtctcagtcgcttccagggtgctgattcttcattcttgctgcaaaattcaccattttaacattgatggtggctccagtaaagctcccggccgtgaggaatcttacatggcaccgaattgacatgtggatttgagctcctcagttcaccatgatgatgagagaaaaaaggtgcgacagaattgcttgtaagaagagagaattgcaccccccagaatgtgtggcttcatcttgaagaagcaaatgcccatgtcgggtttcaccagcgtttagcgtgtactgatacagctctgtagtaattctagttgctgtttgtctatcgaggtttgagccggtagcattccttcctctcttttttgttttcctaattttgaattagttatatgacagacaaggttttcaagaaaagaaataacaagttttacccctgcatttttacagagaggtatgttgaactcaaaaaaaaaaaaaaaaaacgccccgatggttttttaccactgtgttgtttatggtcagtgaaatgtgcatgaagcctcgatggcacttgttctcccgttcagtatgaactacttagtaagtcgctagcagactagcaaattcactataggaaatttaaatttatgggggagttgctctgatgaggcggaaagattgttggtgccaagaaacgcagcagcagatcgacttttattgatattcataattc

SEQ ID NO: 4903 - DNA, 2412 bp, Zea mays
attgcccaccaagtatcgacgagaggctacatttattgcatttgatcttaaaacagaagcaacaaaatctctctttttgcggactatatcatagagtccagggaaaagatccttaaacgttgcgttaccatgccatttatcctcccgaaaaacgaacttgagtcccatccccaattttgaaagagcctaggcgaataatgatgtccttaacacctaacagccctgcccaaaaatatgagtctttaggcatatgtttcacttgggtaattattttatttctcaggtacttattacgaagaattgactgccgcataccctctttgttaattaagttgaaaagtgatttacttagaagacatttattttgaaggtcaaggttgtcatctatttgaatatagtagatataaaattgaagggctaaaacgagtaatattttgggattgctatttttttctagctgtatggcttctactatatgttttatattagaaaaactacgtacatataaaagaagtcaaaacaaaactattaactattcattcggctgcccatgaaacgtttcagcctgctgtgtgcagcctggtgtagcggctgctagctgagggaacgacaggaaagggccgcatcgcgcgcagtacaagctgtactcgccgggcgcgtggtctgcggtaccgcgcgcgtactacaggagcgtactaccggccgtccgccacccacggacccacccctggtacatagcacaccacacagggctcatcccgccacgtgcccacgtcagatgcgaccgagatccatcttcacgaacggcgataaaatatgagctcatttggcgtcatagtgtgctcatctggtgccatataagtgccaaattatctgcccccgctccgggccttcgctttcattcctcggcctccgcagctagcgcaacgcaaaggcagttccggcgggggcggactgggaacacatgggaatgagatgagatcattgctcggtcgtgctggcctgggccgtcggcgcgcgttgatcttgcatgtgttctcaggtcgcccccggagggccttccttgctgctgtgttccgctagacctggagtatctcgacgacggtggcaggcacacgcagtgacggcaccactacgtctgttccgccacgagagcctatgtaacggtatgtttattttgctgctgcagcactcttcgtcctagctcatgtcaactgccccgacaataagaaaccagtgcaggcatgtctataaggaaaaagatctacgtggtacggtctgggcactgatgattagttgctcttgttcaggccaaccgataaccaagtgaatgaacatgtaagagtactactccatagattactctgctccgtttttttattactcgctccgttttttttatttgctacgttttagtttacaaataaattaatatgcgataaatattcgagaaaaaaaagaaaaaaaaaaaaaaaagttaaaatttggtttaggcgggaccagccaatttttctccttctttctgtttttatctccgatctaattaaaaattgtgacgtcgtcacagcgacaacaccttcacctggtaagttgcaacgagctttagatagtatgcattgacggcggttgtttaatcatttacatccgcaattgtttaatcaatgcagatttgtgtgcattgcgggtggaacgcgcatctgcacatcggcatgcgcaaaagttgaatgattgcaggtttatttaacatgtgtttggtttcggaatgacttggatcggatccgagccaacctatttttctaggttgggtcagactcgttccttgttttgtttcaatgacagattaaacctaatttcttgtatgattacagggtttaaagtgggttagatctacaccatctcttatttgttttgtgatgagagatgaacttaatatgatcaactttctagtcatattaccaaactaaggatgatatattaattcagtaagatgacaacattcaaaataaatgaaactgacactattttaataattgagaaatccataagcacaagatatacataaattaaagtcattattaaccaagtcataattttttagtgacgaggtctcactgttacatttcaatcataattaaaggaacatcccaacaacatcaagatgcatttcagtgaatttgtaacatttgtcatgactagcagacttgtctaggcgatgatgagcactgacctttacctgttcgatgacagcactagcaaggctcgcgatgtcggcatcgagggcagaccagcgggggactcatggtgggaggcgcaacaagccggtgggggagtctgacgacactgacggaggccagcatgctggagggcaggccagtgggggaatgacgacgggaggcaggcgggggattaacg

SEQ ID NO: 4904 - DNA, 1122 bp, Zea mays
  misc_feature (2)..(2): n is a, c, g, or t
tncccgaacccttcctaatcggaaaaatctggtgccatataagtgccaaattatctgccctcgcctcgctccttcgctttcattcctcggcctccgcagctagcgcaacgcaaaggcagttccggcgggggcggactgggaacacatgggaatgagatgagatcattgctcggtcgtgctggcctgggccgtcggcgcgcgttgatcttgcatgtgttctcaggtcgcccccggagggccttccttgctgctgtgttccgctagacctggagtatctcgacgacggtggcaggcacacgcagtgacggcaccactacgtctgttccgccacgagagcctatgtaacgcactagcaaggctcgcgatgtcggcatcgagggcagaccagcgggggactcatggtgggaggcgcaacaagccggtgggggagtctgacgacactgacggaggccagcatgctggagggcaggccagtgggggaatgacgacgggaggcaggcgggggattaacgtcggagggtaggccagcagggtcccttgtcccatcaagccggcagtggcgccgtgcctctgtgctagtctcgagtgtataaggcatggatgacgggagggtggagaggaagtgggtcgaaatggttcgtttgtttttaaggaatccctagaacccacattttcaagaagtattttgacccagaaccaacctaacccacgagcattttgaaccaaacgtgggttgttgtgggttgaactcgttccaacctgcatcaacccactaaccaaacacaaactccgagtgtatgttgtatttggttgagtagagtgggagaatagagttgctccattccatttttggatgtttggtttctaacaaaatgagagcggagtggctcctagatcttcatatgaaaatttattataaatagttggaaaaaaaaaaaagaaaaaaaaaaaaaaaaaagttatcgatcccggccgacccctcgcaggggggggcccgcgccccatcgccctaaagtgagtcgtaatacgcggcgttcctggccgtcgtttacaacgcctggaatgggaaaacccgggggttcccaacttaatcgctttgaaaaatccccttttgccattggg

SEQ ID NO: 4905 - DNA, 1217 bp, Zea mays
cccgaaggttctaggctcgattgaacaaattggagcagcactacactcctccacgcctccacctccagcctcccactgatctggcctctctcgaggtgagcgcgcctgattctatggattcgatgtgaagtcccaaagggtagcttttagggatggggaatgatgagatgttggaagttcacaagttgtgtctttcttaaaggctggtaaccttatgtgtagactgccccttgtcttttgtaatgtccttttcagttaatcctagatcaatatgagaaggggctacagttacagtccttcaccaccaaggggctacaggagaagggcccgcagtccaagtcctcatgatcattatggtggtcgtggtagggatctcccaaccagtcttctggtcaggaatctccgtcgggactgcaggccagaagacctccgtcgcccatttggacagtttggtcgagttaaagatatatatcttccaagagattattacactggggatccccgagggtttgggtttgtccagtattatgatcctgctgatgctgctgatgcgaagtactatatggatgggcaggtagttcttggtaggcaaataacagttgtttttgcagaagagaacagaaagaagcctcaagagatgagagctagggacagagtcaggggtcattcttatgatgacaggaggtattctcgctctaggtcccctcgttattataggggccgctctccttcacgcagccaaagctactcgaggtctccacctcagaatccaagacacagacttagagagaggtcctactccggctcacctgtggacagcagatcaagaagtgggagcccttatgaggatggatatcgcagatcgtcacggagagagaggtctctttctgttagtggatgaagcagttttacggtctagagctccttgctgtgaatctgcgcatggtggcctacttgctatgtctttctgaaccatatatgttctgtctagattatcattcccagtaccagagaagtatcgtgagactgtttgctgtactttctagtcttgaggatacagaagggggtcaccgattctctcagtagatggactaatgaccactagctacgccagttccactgctttgtgtatttataggcagctttgtggtttgaataaaattatttgcatcgtgaaagctaattggtaaaacagactggaaaaaaaaaaaaaaaaa

SEQ ID NO: 4906 - DNA, 1628 bp, Zea mays
  misc_feature (1614)..(1614): n is a, c, g, or t
cccatcccgaaggttctaggctcgattgaacaaattggagcagcactacactcctccacgcctccacctccagcctcccactgatctggcctctctcgaggtgagcgcgcctgtaagtgatcctttctcgcagattatttttgtagttttcgatggaggcggattagctttgaactggtggatcgtgtttggcatcgtattgtgattggttctgttctgtgaatttcgctagtttttttttttctcccacagattactctgaatatgcgtgcccttaattgtgttacgatttggcttcgtcgcggtagtctgttgtgatgcgcccattatttcgcgattaattgtatgtgattctgcgttcgattgattgagaataggcagtgaacccttccgtttcttatttcactgctaactgtatctaggattctatggattcgatgtgaagtcccaaagggtagcttttagggatggggaatgatgagatgttggaagttcacaagttgtgtctttcttaaaggctggtaaccttatgtgtagactgccccttgtcttttgtaatgtccttttcaggttcagatgttctctttgtgcatctactgtttcagcagggagttactgatgtttatatttaactataatgtctctgcttatattattagttaatcctagatcaatatgagaaggggctacagttacagtccttcaccaccaaggggctacaggagaagggcccgcagtccaagtcctcatgatcattatggtggtcgtggtagggatctcccaaccagtcttctggtcaggaatctccgtcgggactgcaggccagaagacctccgtcgcccatttggacagtttggtcgagttaaagatatatatcttccaagagattattacactggggatccccgagggtttgggtttgtccagtattatgatcctgctgatgctgctgatgcgaagtactatatggatgggcaggtagttcttggtaggcaaataacagttgtttttgcagaagagaacagaaagaagcctcaagagatgagagctagggacagagtcaggggtcattcttatgatgacaggaggtattctcgctctaggtcccctcgttattataggggccgctctccttcacgcagccaaagctactcgaggtctccacctcagaatccaagacacagacttagagagaggtcctactccggctcacctgtggacagcagatcaagaagtgggagcccttatgaggatggatatcgcagatcgtcacggagagagaggtctctttctgttagtggatgaagcagttttacggtctagagctccttgctgtgaatctgcgcatggtggcctacttgctatgtctttctgaaccatatatgttctgtctagattatcattcccagtaccagagaagtatcgtgagactgtttgctgtactttctagtcttgaggatacagaagggggtcaccgattctctcagtagatggactaatgaccactagctacgccagttccactgctttgtgtatttataggcagctttgtggtttgaataaaattatttgcatcgtgaaagctaattggtaaaaagactgaatcacaattanaaaaaaaaaaaaaa

SEQ ID NO: 4907 - DNA, 1595 bp, Zea mays
  misc_feature (1373)..(1373): n is a, c, g, or t
agatctggaattcgcggccgcgtcgaccgatgcgtgtcccgatccaacggtctccgtcgtcccgtccgcgtgataaagcgccggcgcctcttctcgcgtggcctcccgaaggttctaggctcgattgaacaaattggagcggcactacactcctccacgcctccacctccagcctcccactgatctggcctctctcgagttaatcctagatcaatatgagaaggggctacagttacagtccttcaccaccaaggggctacaggagaagggcgcgcagtccaagtcctcatgatcattatggtggtcgtggtagggatctcccaaccagtcttctggtcaggaatctccgtcgggactgcaggccagaagacctccgtcgcccatttggacagtttggtcgagttaaagatatatatcttccaagagattattacactggacgcaacacaagcctaaaagattattgttgaagagaaggaagaaatagagaaattcaattaagtgatctgcaacttaaaagagtactcagtactgttcaagagatgggaagaaatagagttacaagtttaagagatactcacatcatgaagagtttcaagtctgaatttaaactctcatgagtgcaagggatccccgagggtttgggtttgtccagtattatgatcctgctgatgctgctgatgcgaagtactatatggatgggcaggtagttcttggtaggcaaataacagttgtttttgcagaagagaacagaaagaagcctcaagagatgagagctagggacagagtcaggggtcattcttatgatgacaggaggtattctcgctctaggtcgcctcgttattataggggccgctctccttcacgcagccaaagctactcgaggtctccacctcagaatccaagacacagacttagagagaggtcctactccggctcacctgtggacagcagatcaagaagtgggagcccttatgaggatggatatcgcaaatcatcacggagagagaggtctctttctgtcagcggatgaagcagttttacggtctagagctattgctgtgaatctgcgcatggtggcctacttgctatgtctttctgaaccatatatgttctgtctagattatcattcccagtaccagagaagtatcgtgagactgtttgctgtactttctagtcttgaggatacagaagggggtcaccgattctctcagtagatggactattgaccactagctacgccagttccactgctttgtgtatttacaggcagctttgcggtttgaataaaattgtttgcatcggggaaagctaataaaaaaaaaaaaaaaaaaaaaaaaataaaaaaaaaaaaaaaatttttctatcccctncacccccgggggggggccccggaacccaaattccccccaaatagggagctataaaaaccgcccgttcccggggggccgctttttaaaaaacacgcggggggggagaaaaaacccccggtgggaccccccccaattaataccgcccgtggtagaaaaaaccccccccttttttttcggggggggtggagaaaaaaaaaaaaaaaacgcgcccccccccccccc

SEQ ID NO: 4908 - DNA, 1154 bp, Zea mays
gaagatcttaacgaccctcacggcccagcgccaggccgccagcatccgacgcatctaaccccttccgatgcgtgtcccgatccaacggtctccgtcgtcccgtccgcggccggccgcgccgggggcgcccccccgggcggctcccgaaggttctaggctcgattgaacaaattggagcggcactacactcctccacgcctccacctccagcctcccactgatctggcctctctcgagttaatcctagatcaatatgagaaggggctacagttacagtccttcaccaccaaggggctacaggagaagggcgcgcagtccaagtcctcatgatcattatggtggtcgtggtagggatctcccaaccagtcttctggtcaggaatctccgtcgggactgcaggccagaagacctccgtcgcccatttggacagtttggtcgagttaaagatatatatcttccaagagattattacactggggatccccgagggtttgggtttgtccagtattatgatcctgctgatgctgctgatgcgaagtactatatggatgggcaggtagttcttggtaggcaaataacagttgtttttgcagaagagaacagaaagaagcctcaagagatgagagctagggacagagtcaggggtcattcttatgatgacaggaggtattctcgctctaggtcccctcgttattataggggccgctctccttcacgcagccaaagctactcgaggtctccacctcagaatccaagacacagacttagagagaggtcctactccggctcacctgtggacagcagatcaagaagtgggagcccttatgaggatggatatcgcagatcgtcacggagagagaggtctctttctgttagcggatgaagcagttttacggtctagagctccttgctgtgaatctgcgcatggtggcctacttgctatgtctttctgaaccatatatgttctgtctagatatcattcccggtaccagagaagtatcgtgagactgtttgctgtactttctagtcttgaggatacagaagggggtcaccgattctctcagtagatggactaatgaccactatacgccagtccactgctttgtgtatttataggcagctttgtggtttgaataaaattatttgcatcgtgg

SEQ ID NO: 4909 - DNA, 1095 bp, Zea mays
tgggaccctccccgccggccggctcccgaaggttctaggctcgattgaacaaattggagcggcactacactcctccacgcctccacctccagcctcccactgatctggcctctctcgaggtgagcgcgcctttaatcctagatcaatatgagaaggggctacagttacagtccttcaccaccaaggggctacaggagaagggcgcgcagtccaagtcctcatgatcattatggtggtcgtggtagggatctcccaaccagtcttctggtcaggaatctccgtcgggactgcaggccagaagacctccgtcgcccatttggacagtttggtcgagttaaagatatatatcttccaagagattattacactggggatccccgagggtttgggtttgtccagtattatgatcctgctgatgctgctgatgcgaagtactatatggatgggcaggtagttcttggtaggcaaataacagttgtttttgcagaagagaacagaaagaagcctcaagagatgagagctagggacagagtcaggggtcattcttatgatgacaggaggtattctcgctctaggtcccctcgttattataggggccgctctccttcacgcagccaaagctactcgaggtctccacctcagaatccaagacacagacttagagagaggtcctactccggctcacctgtggacagcagatcaagaagtgggagcccttatgaggatggatatcgcagatcgtcacggagagagaggtctctttctgttagtggatgaagcagttttacggtctagagctccttgctgtgaatctgcgcatggtggcctacttgctatgtctttctgaaccatatatgttctgtctagattatcattcccagtaccagtgaagtatcgtgagactgtttgctgtactttctagtcttgaggatacagaagggggtcaccgattctctcagtagatggactattgaccactagctacgccagttccactgctttgtgtatttacaggcagctttgcggtttgaataaaattgtttgcatcgcgaaagctaattggtaaaaagactgaatcatgaaacgaaaaaaaaa

SEQ ID NO: 4910 - DNA, 1200 bp, Zea mays
acccccgaggccggccgggcccgaaggttctaggctcgattgaacaaattggagcggcactacactcctccacgcctccacctccagcctcccactgatctggcctctctcgaggaatctatggattcgatgtgaagtcccaaagggtagcttttagggagggggaatgatgagatgttggaagttcacaagttgtgtctttcttaaaggctggtaaccttaatcctagatcaatatgagaaggggctacagttacagtccttcaccaccaaggggctacaggagaagggcgcgcagtccaagtcctcatgatcattatggtggtcgtggtagggatctcccaaccagtcttctggtcaggaatctccgtcgggactgcaggccagaagacctccgtcgcccatttggacagtttggtcgagttaaagatatatatcttccaagagattattacactggggatccccgagggtttgggtttgtccagtattatgatcctgctgatgctgctgatgcgaagtactatatggatgggcaggtagttcttggtaggcaaataacagttgtttttgcagaagagaacagaaagaagcctcaagagatgagagctagggacagagtcaggggtcattcttatgatgacaggaggtattctcgctctaggtcccctcgttattataggggccgctctccttcacgcagccaaagctactcgaggtctccacctcagaatccaagacacagacttagagagaggtcctactccggctcacctgtggacagcagatcaagaagtgggagcccttatgaggatggatatcgcaaatcatcacggagagagaggtctctttctgtcagcggatgaagcagttttacggtctagagctattgctgtgaatctgcgcatggtggcctacttgctatgtctttctgaaccatatatgttctgtctagattatcattcccagtaccagagaagtatcgtgagactgtttgctgtactttctagtcttgaggatacagaagggggtcaccgattctctcagtagatggactattgaccactagctacgccagttccactgctttgtgtatttacaggcagctttgcggtttgaataaaattgtttgcatcgtgaaagctaattggtaaaaagactgaatcatgaaacgaacgtttgccatcccaaaaaaaaaaaa

SEQ ID NO: 4911 - DNA, 1136 bp, Zea mays
gacgcatctaaccccttccgatgcgtgtcccgatccaacggtctccgtcgtcccgtccgcgtgataaagcgccggcgcctcttctcgcgtggcctcccgaaggttctaggctcgattgaacaaattggagcggcactacactcctccacgcctccacctccagcctcccactgatctggcctctctcgaggtgagcgcgcctatcaatatgagaaggggctacagttacagtccttcaccaccaaggggctacaggagaagggcccgcagtccaagtcctcatgatcattatggtggtcgtggtagggatctcccaaccagtcttctggtcaggaatctccgtcgggactgcaggccagaagacctccgtcgcccatttggacagtttggtcgagttaaagatatatatcttccaagagattattacactggggatccccgagggtttgggtttgtccagtattatgatcctgctgatgctgctgatgcgaagtactatatggatgggcaggtagttcttggtaggcaaataacagttgtttttgcagaagagaacagaaagaagcctcaagagatgagagctagggacagagtcaggggtcattcttatgatgacaggaggtattctcgctctaggtcccctcgttattatagggggccgctctccttcacgcagccaaagctactcgaggtctccacctcagaatccaagacacagacttagagagaggtcctactccggctcacctgtggacagcagatcaagaagtgggagcccttatgaggatggatatcgcagatcgtcacggagagagaggtctctttctgtcagcggatgaagcagttttacggtctagagctccttgctgtgaatctgcgcatgggggcctacttgctatgtctttctgaaccatatatggtctgtctagatatcattcccagtacagagaaatatcgtgagactgtttgctgaactttctaggctggaggatacagaagggggtcaccgattctctcagaaaatggactattgaccactagctacgccagttccactggtttggggatttacgggcagctttgcgggttaaaaaaattggttgcatcgggaaaaaaaaaaaaaaaaaaaaaaaaaa

SEQ ID NO: 4912 - DNA, 2183 bp, Zea mays
ggtaccctcggggctcccgcgcggccgccgccgcccccgcacggcaccagtgacgcgaaagcaaaacgccaaacaggctcctctgaaactcccagagccggtagaggcacgccactccgcagtgtcagtcactgcccccccatcacgccgcccgccctttctcggccgttgccgcgagctcgctccgacccaccgccgatggcgacggcgatgggcgcgatggccgccacctgcatggcctcgatcccggccgccgctacgttccccggtgatctcggcgtcggacgacgccgagcggttgtaccagggtggcgcgccggtgggagacggctgcgtgcgacgccgcctgcccggaggccgttcctgttctcgccgaagggcgtttcggactcgcggagctcgcaaacgtgccttgatccggacgccagcacgagtgttcttgggatcatccttggagggggtgctgggacaaggctgtatccactgacgaagaagagggcgaaaccagcagtgccgttgggcgccaactacaggctcatagatatccctgtcagcaactgtctcaacagtaacgtctccaagatatatgtgctaacacagttcaactctgcttcgctcaaccgccacctctcgagggcctatggaaacaacattgccgggtacaagaatgagggattcgttgaggtccttgcagcacaacagagtccagagaatcccaactggtttcagggtactgcagatgccgtgcgtcaatatatgtggctatttgaggagcataatatcatggagttccttattctggctggagatcatctgtaccgtatggattaccaaaagttcattcaagctcatagagaaacagatgctgatataacagttgcagccctgccaatggatgaacaacgtgcaactgcatttggtcttatgaaaattgatgatgaagggaggatagttgagtttgcagaaaaaccaaaaggagagaagctgagatcaatgatggtagacaccactatattgggccttgatcctgaaagggccaaagaactgccttatattgctagtatgggaatctatgtttttagcaaagatgtgatgcttcggcttctcagagaaaattttcctgcagcaaatgactttggaagtgaggttattcctggcgcaacagaaattggattaagggtgcaagcttacttatatgatggttactgggaagatattggtactattgaagcattttataatgcaaacttgggaataaccaagaagcctgtaccggattttagcttctatgatcgttctgctccaatttatacgcaacctagatatttgcctccttcaaaggttcttgatgctgatgtgacagacagtgttattggagaagggtgtgttattaaacattgcacaatcaatcattccgtagttggactccgttcctgcatttctgaaggtgcagttatagaggactctttgctaatgggtgcagactattacgagactgagaatgataagaatgtcctttctgagactggtggcattcccattggtattgggaaaaattcacatatcagaaaagcaataattgacaaaaatgctcgcattggagaaaatgtgaagataatcaattttgataatgtccaagaagcagtaagggagacagaaggatattttatcaaaagtggaattgtcacggtgattaaagatgctttaattcctagtggaacaatcatataaagtcagccaacaccatgtatataaggttgggttgcatcatatggtgatcgccaatgcgcatcaagttctctcatcccttgcgagaccatgcttatttccattgcaaaatcatcaagctctgcatcaacttgttgtggataataatgaaataataaatggtgccattccatggcaacatttttctgtcactagtatgaggcactgttctaaatgtactgttgagtggaatttgaatatgtatgcttttgcaatcgcacacctaaataccttgtgcttatactccttgttacctaaatatgctcactgcattgcccaaggaatcagattaaaaatgtcatgcataacatgatttttgttagattgttgtaaagcttacataagtttcttctagcctcagagagatgtttagagtggaaaaaaaaaaaaaaaaaaaaaaaaaaaaaaaaaaaaaa

SEQ ID NO: 4913 - DNA, 5559 bp, Zea mays
ctcacaaaatagctctttacaaaccaagcttgaatatcagtttaacttataaaaaaattcaacgagtcagagttaaattgagctcacgagcatttcgttctgtctacttctaccatcaagcaccaaaaccagcggagcgggccggacgagggacgacaagaaaccatttctggtacggctcgcgacacgttacagcctagcagggacggccgccatgcacgcgcccacgtcgcgtccgctgacgcgccacgtcccgcgccaccgccgagccgctttatatatctgtactacaccgcagccggcgcagcggaatacacgccagaaactaatccagatagctagcctttgatttctcacttcaatctgacgaagtgcacacctaggcaacaaactcgaacgcgcgcggtagtggagccgagatgcagggaggggcgacggccaagcagcaggcgcgagacggtgaccgcggcgcggcgaagacgccgacgacggaggggaagggcgacgccgccggcgccaaggctagcgccgacgtggcgaagggcgacgccgccgtcgccaaggctgctggggacgacgtcgtcgtagggaagggcgacgcaggcaacaaggccggcgccggggccatgcaccacggcctgtcggccgtggaggcgaaggactcccagaccatcgtcgcgctgcagtcgccggtgaccgtcatgcgccccgtccgcggcgacctcgaggagcacctccccaagccatgtgagagcgcgcgcgcccgccacttcctctcgtcgctgaggcctgctggtgctttgttacattgttacttactgatgacgcgtcgtccactgagacgaggagcacagatctggcgcgagccctggtggcgccggacatctaccaccccgacggcaccgcggccgacgagcacggccaccaccacatgagcgtgttgcagcagcacgtcgccttcttcgaccgcgacgacaacggcatcatctacccttgggagacgtactccggtatgcgtgcatgcgaattgtattattaattgctgcgtcgatcgttctctagctagcgagttccaccagatcgagtagcagtcggtgctgattgctcgtgcaaattccaaatgtgatcgctccgccgcgctgagacgagatacactaactgcaaacgatgcaggatgtcgtgcgcttgggttcaacatgatcctgtctctcttaaaaaaaaaaaaaaaaaacgggaccatgagctatgccacgctgcctgtgagtacaaagctccgatccatgcatgtcgtcttcaatttggttcatgcaattaatccatgtcttttttttccctgtccgtctgtactgtacgtatttgtggttgtaggggtggctgccgtcccctctgttcccgatctacgtccacaacatccacaagagcaagcatggcagtgactctgggacctacgacaacgagggcaggtacactgatctgccgatatatggtgcttgtgcttgtgcttgtcctagtgcagtttgcagtctgcagtcccaaacgctaacgcgtcctggctcgtctggtccaggttcatgccagtgaacttcgagaacctgttcagcaagtacgcgcgcacttccccggacaggctcacctacagggagctctggtcgatgacggaggggttccgcgacgccttcgacctctacggctggtgagcgtccttctcctcctcctccaggctgcatgcctgcctgctctggcttactttgcgatctcgccgccgtcacaggattgcggcgaagctggagtggacgatcctgtacgtgctggcgcgggacgacgaggggtacctgtcgcgggaggccatgcggcgcgtgtacgacggcagcctcttcgagtacgtggagaggcagcgcgcgcagcacgccaagatgtcctagctagagggaagaggatgcgacgtgggcacgtggcctcgatcgcgcgtgaatgaaatggaagccaagtgaacctgtctcggctggtatgtagatagtgagaagggtgtcggccggaaaacaagcagccgtgtgtactactccctcagctcccatcaataacgcagagttcgccggaccggcccctccccatctttgctacttcaacctggtttttcgcgcggtttatgtggctgtctgaagcgagacatgaatttgcgtattgtttaattttacaaaactactgaaatgaacaaaattggcctattagctcagttggttagagcgtcgtgctaataacgcgaaggtcgcaggttcgagacctgcatgggccatataatttagttttttttagaaaaatagctcttcagttcgtttttgtctatattttaaaaatcaactgtagctcatatttttgtgagatttaaatactagtttttaaaaattaactctccaggtcatcataagatgtttttctttattttcatactactattataaactataatataaataatgactgccgtccatgataataaatcatggatatatatgttacaaagtgacctatagttttgtctatgacaattagtataaatcatgaatgtatattttccaatgtgacctatagtttttattgggtacatcctgatttcaggaatcaggaaattggaggtttttcctcatgaatctccttgaggaaattgtacgggacggggatttcttctaatgaatcacctcctcaccattttagataggaaggtgattctgatcccctctaatttggtagtcactaaaccaaaaccaatcctaagatacatatgcgtgtgacgacacatatatatacccacataaatacccatgtgttgtataaccaaccctcatgacacataaatccaatgtgatagtaaacacctttctccaattgattgttgattgttggaggcatgaagatgctcgcctccaaataacatgtccggacatccactttctcgaattgatattgttggaggcgcattatcactttctcgaattggttgttggaggcattatatatcaataggcattatatatccaatgtgatagtaaacacctctttcattctccactctatgagcgtagcgtaattacttcttcgattgctatttttatcctccactctatgagcgtaattacttcttcgattgctatttgcatagtgtaacggagcgaggttacgtatagttgttgacttcttgtctcggtagccgccctatcaccggtgcggtgtcactagagtttctgcagcacaaggcagagagcacacatgctatcagaattcagagcttgcagaggcgataagagagaggcaactgtttcgctcgctgtcgggaggccctagctagcgcgtccgtttcccagccgacgcggggccacgacgactgcacaccgccacattctgcggccgggcagcggacatccccagcgattatatcatagaaaggaggccgcgcggaaacccaatacgcacgtgaggcattgacgtggtggtggtggtggtggtgcagtgcgtgtggtcgccgggaggacaccgcgagcgaggacgagatcagcttgcagttgcacgctctcttgcccggccgcccgcacgcaccttccggccggtttctccacgttgtacctgcaaacacaacctgctggtccctcgcctggactgccctgcccctgcccatgcatgcataatggagtggggtttgatttgtagccgcagtgcacaagactagtctggatttagtccggccgcaactatacagtattgtatctctatagattataactgtcgctctagacagccgaacatgcgggacggtgtcgagttttttcgccgacgtgtacgatctttcgctgctaatgtttgtcatcagctactgtttactttcgctgttactgtttgtcagctactgtttactatgcgtgtacccactacccggacagagagccatttttcagcagtttgacacggtatataatgcagcaacgatatgcaacatgatggtattgaatccatcatctccaatcgagctgtcgagattacccaacagggtgcaaagcagccgtgtccactagtggctagctagaatagacatctatactgaatcttgttattaattagtaaaacttgaattaccggtccatgcttcatgaatattaattaattaatgctaacgaataatgacgacaaatagaatgatgtgaatatcacgttcagaatactgtttttttgataccctaataatataatagacttccaaagttacgtatctgggtttatgtgttggagacttgcattgagagattcaaacatggctgcgcgagcacatgaccaacccgctgatggtacgcgcgacccatgacttgtgccagcaccaccaccaatcctttgcagtacaggtgtgtgattgggcactgataaagtagctcatcccagtcactcgcatcgcatcgcgaggctacacaaattgacctccggtcgatcgagtcagcggtagctggtattactcccaggtcccagcccgtacggtcgtactacctcgccgcaacaacttgtgtcgcctcttgttggtgtcgggtcaagtcttttctcgctgttgtagctgcagcctagtacagtagtacgtagtacgattttcgccttgtgttgtttaccgccacgcacactatcttgtataagcgctccatgcatctaaaaaagaatatttttttaaatagtcatttattctaactaaatctatatgtagaagggtataaatatttataatacagaataggtaatatcaaatcagttataaaaaatatattttcataataaatttatttggggatataaatactagtaatatttactataaatttcggttaagtttaaactaaactaaactggctgacacgaatatcatgattgtgtcctctcatgtaagagcgggtttggaaacgaccgaacacccatgttgaaagcttgtgccaggtaggggttggatatcggctcgtctgagtttaagctatctcgttaagctaacgagctacataatttgttcggttcgacttgtttataagcttgagatgactcgtttagctcgcgagtcagaacagaaaaaaaaacaaatgtatataattattattttctagttaattttgaactaatttaacaatataaaatagtgattatacttatagtttcatgtaccacatcaatgtaacaacaaattaacgtaacttatcactcatcaattcacaattcacatacatattcatcacctataccattatattcatatagaacaatttaacacgtagacacaattcattgatcattagtttaactcataaaccatacgtataatatatttatcaatttttatgtaaatatttatcagctcgtgaaaaaacattctaacgagccgagccgagctcaccacaaatcgaacgaagccaacgagcattacgtcctgctctaattaccctaccatgtttcagagatgcccgcgtgatcgttccccttctccatgactccatgtacctgacgaaagctccgcagcatcggtcacgagagatagaacaaaac

SEQ ID NO: 4914 - DNA, 1432 bp, Zea mays
cattgggtccctcgaggccggccgccggccggacgccagaaactaattcagctagctagcctttgatttctcacttcaatctgacgaactgacgaactgcacacctaggcaacaaactcgaacgcgcgcggtagtggagccgagatgcagggaggggcgacggccaagcagcaggcgcgagacggtgaccgcggcgcggcgaagacgccgacgacggaggggaagggagacgccgccggcgccaaggctagcgccgacgtggcgaagggcgacgccgccgtctccaaggctgctggggacgacgtcgtcgtagggaagggcgacgcaggcaacaaggccggcgccggggccatgcaccacggcctgtcggccgtggaggcgaaggactcccagaccatcgtcgcgctgcagtcgccggtgaccgtcatgcgccccgtccgcggcgacctcgaggagcacctccccaagccatatctggcgcgagccctggtggcgccggacatctaccaccccgacggcaccgcggccgacgagcacgggcaccaccacatgagcgtgttgcagcagcacgtcgccttcttcgaccgcgacgacaacggcatcatctacccttgggagacgtactcgggatgccgtgcgcttgggttcaacatgatcctgtctctcttgatcgctcttgtcgtgaacgggaccatgagctatgccacgctgcctgggtggctgccgtcccctctgttcccgatctacgtccacaacatccacaagagcaagcatggcagtgactctgggacctacgacaacgagggcaggttcatgccagtgaacttcgagaacctgttcagcaagtacgcgcgcacttccccggacaggctcacctacagggagctctggtcgatgacggaggggttccgcgacgccttcgacctctacggctggattgcggcgaagctggagtggacgatcctgtacgtgctggcgcgggacgacgaggggtacctgtcgcgggaggccatgcggcgcgtgtacgacggcagcctcttcgagtacgtggagaggcagcgcgcgcagcacgccaagatgtcctagctagagggaagaggatgcgacgtgggcacgtggcctcgatcgcgcgtgaatgaaatggaagccaagtgaacctgtctcggtatgtagatagtgtggaaaacaagcagccgtgtgtactactccctcagctcccatcaataacgcagagttcgccggaccgggacctccccatctttgctacttcaacctggtttttcgcgcggtttatgtggctgtctgaaactgtgcagatccatgccgtggtggtagagcgagacatgaatttgaatattgtttaattttacaaaaaaaaaaaaaaaaaaaaaaaaaaaaaaaaaaaaaaaaaaaaaaaaaaaaaaaaaaaaaa

SEQ ID NO: 4915 - DNA, 1403 bp, Zea mays
gtcgactcgacgcgagctcgtccctcgtcttctccttttctttttctttccgagacgcgggatttccttcgccgccgccgcccccagtgaccaccttgccgaccggagcgtgtgaaccgtacggagtcgcccgcgtgagatgacggccacctccgcgttcgagtcgtccccggagatggagcggttcctctgcgagcggctgctgaacacggagcagcccatcgcggagcgcttccgggcgctcttctccctccgcaacctccgcggggatgcgccgcgccgcgccctcctccaagctgcaagggatccttctaacttgcttgcccatgaggctgcatttgcacttggacaaatgcaggatgctgaggctattcctgcactggtggcagttctcaaagatctttcgctacatccaattgtccgccatgaggcagcggaagctcttggagctattggcctggaaaagagcatccctgtgttggaggaaagtctaacaactgatcctgctgtggaggtccaagaaacttgcgagctggcactaagacgaatagaggagaataagaaagttaatggggctgagagtacaaccacttcaccctttctctcagttgatccagcgctgccttcaaagcatgggctttcagtagatcaattaaggggccttcttctcaatgagcaagagagcatgtaccaacgttatgcagctctttttgcgcttaggaatgatggtggagatgctgctgtttctgctattgttgcagctctgagcgtcaaaagtgctcttctacgtcatgaggttgcttatgtgttaggtcagctgcaaaacaaagccgcttcagatgcgctttctacagtcctgaaggatgtctgtgagcatccaatggtcaggcatgaagctgctgaagcccttggctcaatcgcagaccaagaaagcattgcccttttggaggagtttgcaaaggatcctgagcccatagtctcgcagagctgtgaagtagctctcagtatgctcgagtatgagagatcggggaaatcctttgagtttctcttccttcagactcctcatgtgcagtcctaggttcctcttcgtcgatgatcactcaatgcgaagtgactgaaagcttcttgtattggttaatgtgactggaccagccatatatccactggctttgatgatactctttatcctgataggatctgtttttttttttttttggttaatcgtgatatggaggttgaaacacggagcagcatgaaaacaaatggaaaagaaaccatgaaaactatgaagacttataaatttcgacaaaagaatacatgtaaactaggtcagtggatggtttcggcaattatacactcgcagcaaagaaaactgggctatcctcaccaaaaaaaaaaaaaaa

SEQ ID NO: 4916 - DNA, 1525 bp, Zea mays
attcggctcgagggcaccggcaccggcaccgttttcctttgccaatctagctagccagtttagcttcgctccttcgcttgcttgcaagtaacagcctctctcgtgtccaaaaagaaagtctttctctggaaaggagagaaggatcatcatcaccaggatcaagaaagaactcgtcgattccttaccccttccgtcttcttctgatctcagctctatccactagctaggagatggacatgaacaacgggtggcttggcttctccttgtctccttcggcagcgagcaggggcggctacggctacggcgacggaggcggcggagcgagcgcgagcgcgtgcggggatggagagggctcttgcccctcgcctgccgcggctgcctcgcctctccctctcgtggccatgccgctcgatgactctctgcactatagctctgctccagattggaggcacggcgcagcagaagccaaagggcccaagctcgaggacttcatgagcatcacttgcagcaacaagagcagtggccgcagcctctacgacagctgcggccaccacgacgacgagcaggccagcaagtaccacgaggtccacggcatccaccccctctcgtgcgggtcgtactaccacggctgcatcaacagcggcggcggcggcggaggcggcattggcctggggatcaacatgaacgcgccgccctgcaccggcgggttcccggaccaccagcaccaccagttcgtgccgtcgtcgcaccacggccagtacttcctggggcgccccacccgcaagcgcgggcccgccagcaggcgcagcaatgccgatgtacaacgccggcggcggcagcgttgtcggcggctccatgtccatctccggcatcaagtcctggctccgggaggccatgtacgtgcctccggagcgaccggcggcggctgcgctgtcgctcgccgtgacggatgacgtcccgccggccgagccgccgcagctgctgccggcgccgttgccggtgcaccgcaagcccgcgcagacgttcgggcagcggacgtcgcagttccgtggcgtcaccaggcacagatggaccgggcggtacgaggctcacctgtgggacaacacttgcaggaaggaaggccagactaggaaagggaggcaagtctacctaggcggctatgacagggaggagaaggctgcgagggcttatgacctggcagctctcaagtactggggcccctcgactcacataaatttcccgctgagccactacgagaaggagctggaggagatgaagcacatgtcgaggcaggagttcattgcacacctgagaaggcatcaccagcacgggagatggcaggccaggattgggagggtcgctggcaataaggacctgtaccttggcacattcagtaagttcttgtcacttgtgcagtactactgtactgtacttagcttttttttacgccaagttcactataatataaagtctccagttttagtaaaaaagtaaaaaaaaaaaaaaaaaagcttatcgataccgt

SEQ ID NO: 4917 - DNA, 3741 bp, Zea mays
  misc_feature (72)..(72): n is a, c, g, or t
  misc_feature (91)..(91): n is a, c, g, or t
tgggacctcgagccggccggcttcttttcgtgcatacatccttggttcatacacctccattggtacagtacntttttggaggactatactntgtgaaataaacaaggaaaatccactaggcctccagggggaacttgcaatagcatttggagagctactcgggaaactttggtcgtctggtcgaacttctattgctccacgggcatttaaatcgaaactttctcgatttgccccccagttcagtggatataatcagcatgattctcaggagctacttgcgtttctgttggatggtctgcatgaagatctgaaccgtgtaaaagagaaaccatatattgaggcaaaagatgcagatggccgcccagatgatgaatttgctgaagaatgctggaattaccataaagctcgaaatgactccataattgttgataagtttcaaggtcaatacaagtccacattggtgtgcccagtttgtaacaaaatctctgttacctttgatccatttatgtatttgtcgctaccattgccatcaacagttactcggatgattactgtaactgtattcagtggtacgggagatgttcttccaatgccttacactgtgactgtacagaaaaatggaaactgccgtgatcttactaaagcccttgctgatgtctgctgcttaaaaaattctgagacattgttgcttgcagaggtatacgaacgtcggatctaccgctacctaacaaatccaatcgagggacttcatatcataaaagatgaagatatacttgttgcatacaggctccctgttggtcatgaaaaacttttgaggttggagattctgcattcgagggcagacagatttcttgtggagcctcagtttaatatcaataggaagctcattgggtgccccattgtgacttgtattccaaatgactctactgcaaaatctgatatttatgcggctgtatcttctgtcttggttccatttgtaagagcaaaagcacatagccctgatgtgtctgctgtcaagttaaatggcaatgggccaagtttggacggtattgtcctgaccgataatggcaccaccagtgaggagggtctctctacatcaagatcaagggaggacgataatgcagctgacaatgagcttttaccgtttcagctttcattgactgatgaaaaaggtagtacaagaaatgctatagacatggattctaatcgtgttctaggactagttattagggttttgatggattggggtgagaaagagcatgggatgtacaatattgatcacatggatgtacttcctgaagtcttcaagcctggttttatgtcaaagaagacccgtcaagaagcagtcaatttattttcatgcttggatgcttttctgaaggaggagcctctagggccagatgatatgtggtactgtcctgggtgcaaggaacacaggcaagctagcaagaaactggacttgtggaggttgcctgagatattggtagttcatttgaaaaggttctcgtacagccggtatatgaagaataagcttgatacatttgtgaactttccgatccatgacctcaatatgagcaagtatgtgaagcctacatcaagaggtgaccagcaccccgtgtatgaactctatgcagtgataaatcattatggcggtctcggtggtggacactactctgcatatgcgaaggtacctgcatttttgtgtcgctgttaaattatgtatgtatatatgtttgcattattgtatgcgtgcttgccagcttcctgaactgtatactgtcacttgcagctagttgaagaggacaattggtaccattttgatgacagtcatgtttcctctgttaatgaggatgagatcaggcgatctgcagcatatgttcttttctaccgacgagttggaggttcaagtacagcggcaaacggtggtccagttgacattgaaatggttgattcgctagagacatagttccccagatcaaagcctgagtataacatgtggatcgagatatggagatcagaagagttatggaatttgcatgtctgctccggaatggaatatttgtgtatgaagcctttgacattttgaggcatggcagacaactgaggtcgaaatagcgtggtagcttggatctgcacatctatatgattgagggcctggtgtttaggattataatctgcccagattatataacctatcttattttgaactaagtgttagttcaaaataagttagattatataatatggacaaattatattcccaatcaaacaggctatgattggacttactgatacccatttgagtagaactgatcttgacaggtatccgagaaaacgatgaccttaattgaaaattttgctgatacgctgatgcagcacttagggtctactattgttattggtgtagccaagggattgcaactgggaaaaatggtgtaaaaacgctgcatattttttttttgcctaagctacagctgtgctacagcaaattttgattacaaatgtttttttaaaatgcccaatcatcagcacttagccttattcggtgtgattggttgagtggagtgtggcctgcctcatgtgagcttggctcgtaggaaacgggacgctcgctgcgtacttacccatgcagccggaggtgatcattttggcctccgctgcagccccggtgcagagccttgcgtgcaagcaaccaggagctgccctttggtcaattcatctagagagtctgaataagtaagcacaggtaaccaatcacaccaggagctgccctttggtcaattcatctagagaggctgaataagtaagcacaggtaaccaatcacaccgattgtgattccgtgtgcttccccaatcacaccgattgtgattccgtgtgcttccccatccctatttattcgtcggggaaaaattttcccgtttacattcctgcggggaagtaacctctccatcctcatcctataagggctagtttgggagtctaaaaactagaggggattggaggggctaaaatctcctcattcaaaattgaataagaagggaattttagcccgtccaatctcctttggatttatggctcctaaactggccctaatagaagaattcgccacgggggatcgggtctccattgccatctctattcaggactatgatttcgtggggttggtataaaattattcaccatgtaactaattacacaatgtaacatttcgttttgttctattttttcacatgcaaattgttttcttcgtaccgcaccatgcctctccctgcgtagaccgtcgaggcgctcttcgatctctactttgtacttgtagtcgacgtgtaggtggtcgtccactcggagatggccctcctcgtccacgtgctccccaaggagcgtcccgctgagcaagccgaacgccatgggccgacacggtcgacctccagtgtctcccttgtcgatgtggtaagggtctgtgtccggggtcaccgatgcgaagtccataatttggtctagcagcacgatgacgttcttggaccacagtcacttgggcgccttggccgacgcccgggcgcccatgagcttgagcagccgcggtgcgtcgtggacgtcacacgcttctcagggctctacgtcactcaatttttcagtgctcgagctaggttataagttaaacataccaaaaaattgttaaaatttaggcttctttggctgtggagagaggtgtattccttgatagctatgcagaaggtggatcc

SEQ ID NO: 4918 - DNA, 1231 bp, Zea mays
ccacgcgtccttgttgtacaagaaatgctatagacatggattctaatcgtgttctaggactagttattagggttttgatggattggggtgagaaagagcatgggatgtacaatattgatcacatggatgtacttcctgaagtcttcaagcctggttttatgtcaaagaagacccgtcaagaagcagtcaatttattttcatgcttggatgcttttctgaaggaggagcctctagggccagatgatatgtggtactgtcctgggtgcaaggaacacaggcaagctagcaagaaactggacttgtggaggttgcctgagatattggtagttcatttgaaaaggttctcgtacagccggtatatgaagaataagcttgatacatttgtgaactttccgatccatgacctcaatatgagcaagtatgtgaagcctacatcaagaggtgaccagcaccccgtgtatgaactctatgcagtgataaatcattatggcggtctcggtggtggacactactctgcatatgcgaagctagttgaagaggacaattggtatcattttgatgacagtcatgtttcctctgttaatgaggatgagatcaggcgatctgcagcatatgttcttttctaccgacgagttggaggttcaagtacagcggcaaacggtggtccagttgacattgaaatggttgattcgctagagacatagttccccagatcaaagcctgagtataacatgtggatcgagatatggagatcagaagagttatggaatttgcatgtctgctccggaatggaatatttgtgtatgaagcctttgacattttgaggcatggcagacaactgaggtcgaaatagcgtggtagcttggatctgcacatctatatgattgagggcctggtgtttaggattataatctgcccagattatataacctatcttattttgaactaagtgttagttcaaaataagttagattatataatatggacaaattatattcccaatcaaacaggctatgattggacttactgatacccatttgagtagaactgatcttgacaggtatccgagaaaacgatgaccttaattgaaaattttgctgatacgctgatgcagcacttagggtctactattgttattggtgtagccaagggattgcaactgggaaaaatggtgtaaaaacgctgcatatttttttttgcctaagctacagctgtgctacagcaaattttg

SEQ ID NO: 4919 - DNA, 5023 bp, Zea mays
  misc_feature (778)..(778): n is a, c, g, or t
gactctagagatccccctggtctacgcgacacatacgactgcaattgaggctattttgttaactacatattttctaatcattgtatatttgatattcaaaacaatcttgaatgaaaaggttattaacaacaaagttgtagatcttgttgagtagtacaactttgatgttgacattgtctccattccatgttgctaatcatgttaagtctggtccaagcaatcatattaagtatttagactcgtaaaccatttcaaatttagaagttatcgactatagaattttagatatctttaactcaataatttttatataaaatttattttcatctaatctcacatgaaaaataacatatacttttttaaatgcaaaatagttatcactattgattgaagccacaaaccaacaataatatgtgaattatcgctgttgttttgtaacttgaaccgccagcgatagcactatgtctgtcattgctagtctaagatattgatagtccaccggttgtgctattattgtcggtagagccaataaccgacaataatactttatcactaccagttctgaagtatttttagactttaccatcctcccatgcgcattctaaaagaaaaaaaacggaactttccctgtccacattatcgcctcttcactagcaaggtttagaaaaaaattctgcagctggctaccgaagcggttctgtagtctgcttcggatttagtcacatgtccatctactaattatctgttttcttttttatatgctttgatcgtgctggtnagaaagaaataaccacacaacctttgccaattaattaattaatattgttactgcataataaatacttatacgaaactaatgtaactggaacgagtcaatttagaattaaaacgaagttaaaacgaaggagttacgatacgaaactaacgcacaagggacacgtactcccaccttatctagttgcagttgcagctcaataattggaaagccacacagtcgacaggccgcactgataagtttgcttccgtctggatattcgcatgcgatcgacgtcattctcccttctccttcggaatcttttgcagacatcgttgaattttactttcttttgtgagctagaggacactgaaccatgtgaaatgaaatacggagtatctgtcatctagtctcgcagctcatgaatgagtgatggaaatgtcgacagcaaattttgactcttgcgccacgtgctgtctattctaaatatcgagttcttgccgatccatttatcgaggaattcacacgggagaagaaccagtaggcacgtaagatcagttcgtttataggcaggacggcgacggttgcctgtccttttgtagtttcagtatttgcagcatacacatcttggttgcaattgcaatccaagatgggtgacgctggtgagattcagctgcaaatcgcaggtctgttttttagtattaccagatactgcaatgaattagcgagacagcagtgtcatgtcaaacagctgaaattatggagcgggcatgcaggccggtccggtgcccagaagccggagacgatcttggacagagagcagagagcggtggagcatgccctggccctgcaacggaggcgccgcggccgccgctgtcgaaacggctcgcgtggtgggcggtggtccttatcaacgtcgtgttcatcctcggcgggcagagcgtggccacgctcctcggcaggatctactacgaccagggtggcaacagcctgtggatgcagacggtggtgcagtcctgcggcacaccgctcgccatcccgctgctcctctacttccggttccgggtcaggccgacgtcctcctccgccgtggcggctagccggccgccactcgtcaagctcgccgccatctacgccggcctgggcgtcctcctcgccgccgacaacctcatgtactcgtacggcctcctgtacctgcccatgtcaacatattccatcatctgcgcgagccaggtctcgttcaacgccgtcttcgcctacttcctgaacaaggagaagttccgggcgctcgtcctcaactccgtcgtgctgctgacgttctcagccgcgctcgtcggcgtgaaccacggctcggacgagaccggaagcagcatcccgaaggggaagttcccggcggggttcgcgctcacgctgtcggcgtcggcgctcttctccctgatcctgtccctgacgcagctgaccttcgacgaggtgctgaagagcgacgcgctccacaccgtgctggagatgcagttctggagcaacaccgcggcggcgtgcgtgtctgtggccgggctcttcgcctccggggagtggcgcaccatcgccggggagatggaggcgtacaagaagggggaggtggcgtacgcgatgacgctggcgtcgacggccttctcgtggcagctgtgcacgatgggcctcatggggctggttgcggcggtgtcatcactgttcaccaacgtgatcagcacggtgggcacgccgctgtcgccggtcctcgccgtgatcttcctcggcgaccggatggacggggtgaagctcatggccatgctcatagcagtgtgggggctcctgtcctacgtgtatcagcactacctcgacgaccgtgccaaggctaagaggataaccgagaaatctgacgaacaataccaagctgcaaaaatctccgtagaatagtgcttgtttttttttctgccactgtcacatcgcaaaactactttaattgctctacggaagtccctgccgatgccagtggaaaatactaagtttagttcagttctttgttgacagaagtatagtactagttctccgctacttgcgtgtcaaggccaccaaacccttccataaatccggctagccggcctattaatccgtaatccgttccgacaggtttgaccgtatcactggtttatccatttgaatttaggatattttataaattttatgtcaattttcctataaatactatggattgtttttagactttccactgagactaattttgaaaacacgctagagatttcaaactaaaaatcaaacaagtttcgaaaaaataaaaattggtcaattttattgattagccgcccctgctagccgattaatcggtccaaggtagagataaatcggtggcctctagtagttaggttttgaggattttcttccaacttctaatcttttaacttgtgataacatgcaggccatcttttgtttaaatttgtgacctcaatgtactttatttgccaaatgacaagtggtttggtttcttcacacatgataactatttatcaattcaatgaccaacttatcggtcttatcgaccgattaacaatttttatgccgttttaatttaaaaattggtttggatgtgaatttggtcggtttataccgatcgattcaatgacaaatttatcggtcttatcgaccaattaatcggtttcgagccgtttcaattcaaaaattggtttggatgtgaatttctaccgatttatcgcgatccgattggtccctaccggtttttggaagggaaccggtttggtcaaccctgcaaactattcactaaatttggacaaaatagtggcgtgtttggactgcagtagtgatgccaaaacttgctgcatttgtgattttgacatgtggactcaatttccatttattgtctcttactagaagtctataatatagcaaggggcacccctttctttatgtagattttatagttgggaaggcaacagtgcgaatgggaactgtgaatatgtgattcagtgaagctacctaatacaaaaactcagcatgaaggttctgtttaaaacctctagagctaataattaattagctaataaattattagctggattgaatcaactaataaactaattgttagctgtgaggtagctaacaattaattatgatattagccgatggtatttggaacctaacaactaatttttagtagctaactattaattttagaggttccaaagaggaccttaatgcaaccaatttggtggcaccactgcaccagtttcatggccatttgcacctcatccactattttggaaatgaactggtggacagacactactacagcgcacaccaattttggcaacaatcaaaatggtagccatggtgaggtgagactcacaggtttggatccaaaccaaatagccctcaagagttgtatggtagtgcagccaagcagatgtctgctggtccctccgctctcttcctgccgctcctccttcagcccagtgaagcaatttaggtggtgtttggctcaccgaaatataacgtaaatatattacatgaggtaatggataccgatacttttgtttggttgagctctttctagtaatactatcgaatccaattataactagtaaccattaccattcccttaacaaggtctgaatcaaacaacaccttattgcggattcgcttgcagcgactaacctgaatctatccatcctgatgccgactaatctgagtctatccactcaatttaatgctttgttttgtccagggctgtctgcataccattttgctctgagaaagaaaattttctctctggttcacttgaccatactgttctcttataggatcgacgggctgaaaaattacaggtaaaactaatggtgctgtacacacttacgtggcacgagttaaacttcagattctgcttcactacctgtttatgccaaactaaaccaactgcagttttaaccgagcaaagctattttggattttcccctcttattacttgttccttgttaaaactcttggaatcacttgtattattgctgcaactgaaacagtaaaacccccgttacctactagttttctattactcatgggatggtggattccagacatccatgtaaaattagagaacaaactaccttgggcatggtcattttgtttatcagaattctgtaacatcttcttcctccaatccagaattctggaaccaattcaacactggaggcatcgttcagtcagtcctgatggaaaaca

SEQ ID NO: 4920 - DNA, 1329 bp, Zea mays
aattcggcacgagggaagccggcccagcagcaacgatggtttgcactatgcattgttggttgcgttgcgtccgtggcctctcttctgcacccattcttcgatttcgatctcaccgaggccgacggagcagacgactaggagtccactattcccgagaagaatccaggagaggagaggagctaagcagcagctgctgtagctgcgtttggtggatcgaatcggtcgtcgtctggtgctgtgtttttgctactgaggagagggagggatctgagggaggggggtgatgtcgtcgtcctcttcctcgtcggtggtatacgaggggtggatgatccgttacggtcggcgcaagatcggtaggtccttcgtccacacccgctacttcgtgctggagccacggatgctgtcctactacaagcgcaagccgcagcacaaggccgacaaggtcgggggaaagctccccatcaagtcccttcacatcgatggcaactgcagggtcgaggacagggggctcaagatgcaccatggacatatgctttatgtcttatgcgtctataacaaaagggagaagcacaaccgcatcacgatggcggcattcaacatacaggaagctctaatttggaaggagaaaattgagatggtaatcgatcagcgacaaggagtagcgttgagtgatgggaacaaggcctttagcacatcgcagcaagaggctagcttagaaaatggaaggaaatcttcttcatctgaccacgaaagtcagtacagtcatgaagaggaagatgaagaggaaaatcagcgatcattgctaaggagaacaacaatcgggaatggccctcccgaatcattatatgattggacccgtgaaaatgatttgggaatatcaaatcaaggaagccctgaccaagttttctctagaggacactggcgccttgtcagatgcccagaatggcctccgcatttttgaggagctccaagatgttgattaccttgcaagaagttgtagcagagcaatgaaggctgttggtgtggttgaagcctcctgtgaagctatatttcagcttgttatgagcatggatacttcacgttttgagtgggactgcagctttcagtatggtagtctggtagaggaggttgatggccacactgcaatactataccataggctgcagctggattggttcccaatgtatgttttactttttgctggatatattcttctgtgaccttctgtattccacatgaagtgtggaatcattgcaaaatcatgtcacattgttttttttggtcaaataatgacatgatgccacatgtgttataaaaaaaaaaaaaaaa

SEQ ID NO: 4921 - DNA, 1474 bp, Zea mays
  misc_feature (1433)..(1433): n is a, c, g, or t
cgcttcaccatcggaaaggccacagctagggttcgatacttcgatccccactccatctccaccgaagaccgtcgcgtcgctccgccaccgaagcagctcaaatttctctataagatgagctggagatttcctctcttcggctctcagcagcagcaagcagatccaagtttccaggacatccctacgcagtcttggtaccctccctcggtggtaggttcctcttcacgtccatccacccctacctcttctagtgctagtctacaccaaagagcttcagatagtccgcagtcttcatcccgtgggcaaccatctcctgctgaggctgcagggataattgcccgtttgaaggataagagtattgaggagttacaaaggctattgaaagacagagaggcatataatgcattctttaactcattcgatcaagtgaaaacccagaacaatgtgcgtggcgagcttagaaaggagacattgcaacttgcaagggaaaatttagaaaaggagcagcggattttggagcttgggaatcagtgcacaataattagaaccacacaactggctgctgctcaagaccggcttactgatttggagaggcaaaaggatgatattatgaggtcctattcccctgctgcactactcgacaaactccaaacgtcgatggcaaagctggacgaggagtctgaggagctgcagcagaagttcctggcaaaggacatcgacttcccacacttggtacagaagtacaagaagctccgcacggcttatcacaagcaggcgttgctccatctcgccggccagacataactccactgacatccggcctgcatcatgtcaactttgctgtattcctctgcttggccctgttttattgctgcagcttcctatagggcttgccaaacactttgcacgatttgttggatgataataaagctttcgtatgcttcatgtttcgtggatgctggctctggtgagaggggaattggagggaatccatggagaaattctcttgctattcaaaattgtcccataatctcctcttattagggtaaattcttcttagggtctgtttgtttccgttcattttgatgaattgtaatttaactaacacagtaggctattttttagaatgtgacatttcacaactttctaaagtgtatatataagcttatctcaaattcatgaggtgaaagatgaaaattaattccacagatttacatgctactgtccgcgcggccgcgttttcggctcattcttatacttgtttttctataagataaatgtagtgtataactatctatctgatatgatttaggataatatgtgtgaattgaaatatatgtgaattgtactttatttgttggtattaaatacatgaattgtgtaccactttttttggcattgtcatgtttcatattaaattgttatgtacttangtggtgtttttgtgtttagggactattttttagtctctaca

SEQ ID NO: 4922 - DNA, 1156 bp, Zea mays
ttgggaccctcgaggcgcgtgctcgcggcccaggcgcttcaccatcggaaaggccacagctagggttcgatacttcgatccccactccatctccaccgaagaccgtcgcgtcgctccgccaccgaagcagctcaaatttctctataagatgagctggagatttcctctcttcggctctcagcagcagcaagcagatccaagtttccaggacatccctacgcagtcttggtaccctccctcggtggtaggttcctcttcacgtccatccacccctacctcttctagtgctagtctacaccaaagagcttcagatagtccgcagtcttcatcccgtgggcaaccatctcctgctgaggctgcagggataattgcccgtttgaaggataagagtattgaggagttacaaaggctattgaaagacagagaggcatataatgcattctttaactcacttgatcaagtgaaaacccagaacaatgtgcgtgatgagcttaaaaaagagacattgcaacttgcaagggaaaatttagaaaaggagcagcggattttggaacttaggaatcagtgcacaataattagaaccacggaactggctgctgctcaagaccgcctaactgatttggagaggcaaaaggatgatattatgaggtcctattcccctgccgcactgctcaacaagctccaaacatcaatggcaaagttggatgaggagtccgaggagctgcaccagaagttcctggagaaggacatcgaccttccaacctttgtgcagaagtacaagaagctccgcacggcttaccacaagcaggcgttgctccatctcgccggccagacatcactccgctgacatccggccaggcgtcatggcaactttgttgtatttctgctcgcctgttcttgttctacactatgcttggccctgttttacgagtgcagcctcttgtagggatttgccgaacatcagcggatattgcatgtatagttttatgtcttgcaaaaacgtcttatgtactctgtcctggtgtagtggtgtttacgtatctagtgtccaagttgggattcatttgtggtaactaaacactttgcctattttgttcaattcgatgataataaagcttttgtacgtttgtgttcacctcaaaaaaaaaaaaaaaaa

SEQ ID NO: 4923 - DNA, 668 bp, Zea mays
aagacaaagccagcaccacacaagcaggaaggaagggaagccctcgctctcgctcaccacccctgtctgccgtctgcttatccctggagcagaccggagtaaggccagccaaccaaattgtctatctactgaagggaaggaggaaaaaaaaagagaatcaacaagttgttgcagctgcagctttaccaattcccatgggttccaagccgggcgaggcgccaacctgggcggaccagtgggcctccggcgagggcgacgggagcagcgcgaacggcaaggcggccggtaagaggacggtggccggcaacgtgaaggcggcggcgtcggagggactcgtcaaggccaaggcggcggcgctggtcggagcgcacaagctcaagaccgggacgagctcgggcatcaagtgggtcagggagcagtaccagaagaagaggacgtcgtccaagtgagctgcaatgtgtcaattgtgatggaggagcactgctactctctgttctgatctttcttagtgaagcccattagaggaacaggtttttctcttgggtggagactcttcttggacgctttggttcctttggatggtgagcttgtaagccgctggccttttttttcattattatgccagactagtatgatttttgcgtaaaaaaaaaaaaaaaaaagcggcc

SEQ ID NO: 4924 - DNA, 764 bp, Zea mays
gtagcgtattcatactatggaaaaccataaaaagaggaattgaattattctatccttgtggaaggtaaatcaaacaatgcaatcgaggcatccatctttgctagtatctcctgttggtgaagcaaaaaagccaaatttctactcccccgtagcatagcatatataagacacagcctgcaccacacaagcaggcaggaaggaagggaagccctcgctctcgctcaccacccctgtctgccgtctgcttatccctggagcagaccggagtaaggccagccaaccaaattgtctatctactgaagggaaggaggaaaaaaaaagagctttaccaattcccatgggttccaagccgggcgaggcgccaacctgggcggaccagtgggcctccggcgagggcgacgggagcagcgcgaacggcaaggcggccggtaagaggacggtggccggcaacgtgaaggcggcggcgtcggagggactcgtcaaggccaaggcggcggcgctggtcggagcgcacaagctcaagaccgggacgagctcgggcatcaagtgggtcagggagcagtaccagaagaagaggacgtcgtccaagtgagctgcaatgtgtcaattgtgatggaggagcactgctactctctgttctgatctttcttagtgaagcccattagaggaacaggtttttctcttgggtggagactcttcttggacgctttggttcctttggatggtgagcttgtaagccgctggccttttttttcattattatg

SEQ ID NO: 4925 - DNA, 3062 bp, Zea mays
caaccggaaaatattatgtacgtatctagattaattttaaatacttaatttaaatttaatctagatacgtacataatattttccggttgacagaaaatgcaatgttgatacaaactaaattgaattaggaatttagttatcattgttgatatagagtaccaaatttagaggatattgttggagatgaggaagatatagatgacggaattttttagagggtgctgtaaagtatagagaatatttttttagtggatgaaatttagaggatgttgttggagacagccttagtctgaggcacagcgcatttgtttcccttttttttttttgctgctccgtgcgtggacatggcgttgaggactggagctgacgactgctgctgaagctgaactgtgtgtagtgtggtagtggcctagtgctattgtgctaagtgtgcaatactgtggctgctaatgctaggtaaggccgtaaggttatttcatattttcatttttttgtattttggcttgatgatctatttgctagccgtcccggtttgctaggttaattagtagcctcctcttgatccgttcctagatccgccactgctccacgcgaggaaacgttgattgaatcttctgaaacgaccatgcaagatcacacgtaacacttgaagatacagtatctgtggatgattttaagtcaaaacctaacacacgattacgactatgggtgcttctcctaggtatcgcaaaccggccgcttcaaggtgaagattcctccctcctcgctcctaatagtctgttgttaaggcgtcataactataacaatatccgccatctcataaacaccagaagatcaactcataaatatccaactcaaactttatgcaattccactattccagcgtcctcctaccctaccgtggaaacctaaacgtgagtcaacgaaggcggtggatctgtctagtgcgattcgtcaatggtacgtcaagatcaatgccctcatcggcgcctacccgcaaagcagggacaacgagtactgacgacgaacaatggtgttggtgcgtggatgatcgatgtttccacgggaggtgccggtgccgcgttgaaagaaaaaacaaaaacaaaacaaaacaaggacacctcgttggcttcagcgcttggcgactacttggacggacctaatcgtcaaggcctcgggttcagacattggattctactccgcagaaagaaatcaaagaatggatctcgaaaaataacagtgatgctagtacgcgtcaattattggggtcactgttcatgaggtctcgatcaggatgaaactattcagtactaaaaagacctgctccaaagaaaaagagatgcggtcactacacgcaccgagacccggttacagttaactacactagtaaaatttgaggacagcaataaatgtagtactcctcctgcaaggccccacctcgggacccctgagctgagtagctgacaagagccaacttggtgagatttttcttcagtatcgttccagccaaggcgcgtgacgtatatgaattcttcataatttaatgccaattggggcactgcccgctgcccgggccgcccgccccaaaccctagcgaccaatcctgagagcaaaccattgccacgaagaggaagattgtttggcagtggtagccgccgcgggcagggtaggggtagcctccgacctccctataaaatgcagggcaagctcagagtttcatttcatccacaccttcagggcgccgttcttggtactatagcaactatataggagtagtgtttgggtttcactttgatctcttgtgttctttctcgcagcgtgtccgggtggtgttgtgctttcttgcagtgagcctgctctgtttttaccaatggtttctttgttcatgtggtggttttgagctccatttttcttcttcttcttcttctctctccctgggactgttgtttttttggtgtggtgcaaaaacttccaatccggctgcgacgaatctcgtctgggcagcccggccaccttttgcacataaggatgggctacgtgtgttgaacattagtggcgaagcgcccgattcactctgcttgggggcctggagttccatctgccttccagtcctctcagtgaagcgggcgcacatcagttggtttttctttaccccccctcgcctccccttttgttttcctgcgatggcttctgttttcgtgttcaaacagaaggtcgtcgtctcttggatctgcttgagttttgtcatggtttatgtggcctgcgcaatgcaaagggtctggaactaaaaggttttctgtggcgaaattgatgcccgtgccaagtacatgaacagagttggaatgcaatgaactccaatggcaacacgcgccttttagcggaagtaaaagccgccacagtgaatgcgaaccctaaaagctgcgcgcttgaaaacgttccagtttcgttcttctaagaaaaagaaaacacactctatcgttttggattaaagctggtgtttgtactgctgtacataaaagcggttctttttaaaatcaacaaaactgtactatgtctgaagctgacatcctgacaagactgggacataaacggctcgtagtcttacggcttctttggctaatctcttctccggagggattggtggatttaaaatctatctatctcgaaccgaagaagccctgcatggagaaaccggacgaaaacagttgattgacataattgaaattatgcatgtttccaacgaacagaacgatctcaaatatcttggaagtatattcgcagaatattccgttcttatgtgtcgccacatgcaagtcctccaagaacgtcctctccatgtatgaaatgaagacattatactagcccaacgtagcaaaaaaaaaagaagagtaaggtccctttggtaggcttatttttcagtttcggctctgactcatgcaaaagttgtatcaaacacctctttttcaaatggcttcatcagtgaagtgtttttccaaaataaactagagggcatgagccaaaaaagtggctcacccggcttcagctcaaaaaaaaaaaaaaaa

SEQ ID NO: 4926 - DNA, 1598 bp, Zea mays
ggcgtccacatccattatcgcgctcaggctcgtgccgctcgtggtcgtacgctgcagcaggcgatcggagcaaactaagaagcgaacaggccgcccgtcgacgccatggcgccggatctggtgaacggcgtgctcaactgggtggggacgccggccatggtggccagcctgctgctcttctacccgccctactatctcttcaagacatgctactccttcctttcctggctcttccccgaggacctcgccggcaaggtcgtcctcatcactggcgcttcctccggcatcggcgagcaactggcctaccagtacgcgctgaatcgggcgtccctcgccctcgtcgcgagaagggagtcgagcctccggcacgtcgccgaccgagcactcgagctcggcgcgcgcgacgtcgtcgtcctcccaggcgacgtctccgcccccgacgactgcgacaggttcgttcggaccgcgatcagtcactacgaccgattggaccatctcgtgtgcaatgccggcgtcgcgagcgtcggcgcgttcgaggagatcccggacgtcaccagctacagctcccagcttgacgtcaatttctggggttccgttcaaacaaccttcgctgccctgcctcacctgaagaggagccgaggaagaatcgtggtgacggcatctgcgaccggatggaacccagttcctagaatgagcatctacaacgctgccaacgctgcgctcatcaacttcttcgagacgctgcggaccgagctagggaaccaggtcgggatcacggtggtgacgcccgggtgggtcgagtccgagatgtccagagggaagttcctcaaggagcacggccaagtggaggtcgatcaagagatgcgcgacgtgagtgaggaacacgaccatgcaccggtcgagtgcctgctgatgaatcaaccccctgcgacgcgtgatcgtagtagttaataatacgctgctaactaatagcgacgtgtttccaggctcagatcggcctgttcccggtggagtacgccaagaactgcgccaaggccatggtgcaggcggcgcggcaaggcgagcggtacctcaccgtgccggcgtggttcggggcgatgtacctgtggcggctgttcgcgccggaggtggtggaggcctgctaccgcctcctgtacatgcacggccatggcgccaggcaggccgacgcgcccagcaggaccatggccgaggcgggtggcaagcagctgctgtacccgacctcgctgcgctctgaggagattaaggagtgacctaactgccaactgttgtgtgtgtgtgtgtgtgtgtgtgtttgtgtgtgcagcagagctctcagaacacctgtggtcatgtttaatatgtgctagctgtgtgccttgacaatgaataagctgctgctctctcttttgcatagtttaaatctacaattctgtagtcgatataattgttttgtttgaagctgttgaagtctacaattctgcagttgataattgtttttgtatcaagttgtttagagcatcggatataacgttctatttttcaagattttagaatttgaattgaaagtttcccaaataacatcaaatgttgacatggtc

SEQ ID NO: 4927 - DNA, 1302 bp, Zea mays
atccattatcacgctcagggtcagggtcaggctcgtggtcgtgttcctcctgcttccccttgcgcgcactcgcatgcaaccgactacgctgcagcaggcgatcgaagcaaactaagaagcgaacaggccgtcgacaccatggcgccggatctggtgaacggcgtgctcaactgggtggggacgccggccatggtggccagcctgctgctcttctacccgccctactacctcttcaagacatgctactccttcctttcctggctcttccccgaggacctcgccggcaaggtcgtcctcatcaccggcgcttcctccggcatcggcgagcaactggcctaccagtacgcgctgaatcgggcgtccctcgccctcgtcgcgagaagggagtcgagcctccggcacgtcgccgaccgagcactcgagctcggcgcgcgcgacgtcgtcgtcctcccaggcgacgtctccgcccccgacgactgcgacaggttcgttcggaccgcgatcagtcactacgaccgattggcccatctcgtgtgcaatgccggcgtcgcgagcgtcggcgcgttcgaggagatcccggacgtcaccagctacagctcccagcttgacgtcaatttctggggttccgttcaaacaaccttcgctgccctgcctcacctgaagaggagccgaggaagaatcgtggtgacggcatctgcgaccggatggaacccagttcctagaatgagcatctacaacgctgccaacgctgcgctcatcaacttcttcgagacgctgcggaccgagctagggaaccaggtcgggatcacggtggtgacgcccgggtgggtcgagtccgagatgtccagagggaagttcctcaaggagcacggccaagtggaggtcgatcaagagatgcgcgacgctcagatcggcctgttcccggtggagtacgccaagaactgcgccaaggccatggtgcaggcggcgcggcaaggcgagcggtacctcaccgtgccggcgtggttcggggcgatgtacctgtggcggctgttcgcgccggaggtggtggaggcctgctaccgcctcctgtacatgcacggccatggcgccaggcaggccgacgcgcccagcaggaccatggccgaggcgggtggcaagcagctgctgtacccgacctcgctgcgctctgacgagattaagaagtgacccaactgccaactgttgtgtgtgtgcagcagagctctcagaacacctgtggtcatgtttaatagtatgtgctagctgtgtgcctttgacaatgaataatatggatcatctctg

SEQ ID NO: 4928 - DNA, 2290 bp, Zea mays
gatatttacatgcctcctagtcgttgtttcaagttttaattagctcccttaacttacccgcgagcaatcctacattccaactatctaatgggatcctagttggtttgatcagcttccttaccctccacacccatttgtgatgtgaagagtgttgcacatttttttattacactcggacactgatgtagtgtgccactaagtaattatccgatccttgcttacttgacactgccctgatcgtgacatgcatgtcaccaagggtgctgacctggcccttgcccctttaacaccataaccgggttctgatatggtgcgtcgctaagagggttacgctccagcagatttttttcgtgttttagaatgactgggtttaacgtcggcttgccaagcctatatcgttagtctttgtttataatctttggattgagatctgttatgtcaagacaacataagcggagttgaaacccaatatcgttagtctttgtttataaaatttgcatgtgatgacttgcaagatgatgtgtacattgtctgacacatctgtatgataataatttcaagagctgaggcttcaaacatggccgtaatttatcttgtatgtgttttttcattttcaagtgagcacatacttgcagaggttggtatttgctgctacattcgttcagctcttttggagttgcccatgatgagttgcggaattattgcctacattgtttgacaaacatccctgcgtgcactcagcagctgaggcatacattaacgccgttagatttcattggtatcagatttgttgcttttggcttgaaagaaatgctatgttgttacagtttttgcatcccattgcttgctagttgttccagaagctatatggttgagttgcattcccaacattgtttgctcggctgggtgagaaaaaactgaggacgacaataaaatatttcgttgatatagagctaggattctgatgagcagtacaaggctgacttgctgtgggttgacgtctgtttgaacacttcatgaggcatatgggtattggttatattattactatatcctaactaactgctggattattcactctctttctaagaaacaggttgttcttcccccgatgcgagcagtgtggttcgtcgaggtctgttgctcccatcaaggctggattcgttgcccaagtgggccgtcgtaaggctggatcttaagctacctactacttgcctgaagtcgcttcccgatgaagacaatgcaaactagtttgctggtccacaaaaatcattgttgcactttcccttgtgcctacacagttcactggatttctgctgttcgctatacttggattggtgctgtgaatttatttcgtgtgatgagaggatttgtgtttgcggctcacttgtgtttactacgtttgttttgctcgtgattttgctgtggaaggcactgtcgggagcttcccgagttaggacgagtaacaaaaaaacgtgttgcttccattcagataaaaagcaaggctgcagcattctgaactaaaaaaaaaaaaaaaaaaaaactgttcctcagcttcttttccctgcacttatttgggtataaaaagctaagaagatgtgattttatgctttgggtagagaagattgcagagaggcttccaaattggaaagcgcacctccttaaccttactggtaggacagcttttgtgcgttttgttctttcagctatccccatctaccttctcattgcaatgaatgcctccaagtcggtgataaaagaaattgataaaattagaaggggatttatagaagggaaggaagctaaggaaacgattataaagcttatctctctcgggggtcttggtatctctaacctaaagtttaagagctggacactgcaagtaaagtggttctggctagaaaaaactgatccaaatagaccatggcagagtcttaacattcttgtgcagcaacatgtcaaagaattatttgcaaaatctttgatatctattattgggaatggggtcagtaccctgttctggactgacaattggatgcatggggaggcaatcagggacattgcaccagaagtagctgccaaggtgggcaaaagagcactgtcctctacaacaggagctcatgcccttgataattcccgctgggtcaatgatattagagctcttaccagcgtccaaaaactgttattcaaaattctcccgaaaatccaatttcatttttcaatagggttagatgatctagttcttaatattattagtttacttaactgacagattccgcaacaaatctct

SEQ ID NO: 4929 - DNA, 1354 bp, Zea mays
gatcgcaacgaatattggtagcggctcccccagctctggaccttctcaaacccttccccgtgggccgtggccgccgtctgcctgtctccttccactcgccactccgatttccctcggtcagacgccgaagccgaaccctgactccaattctctcgtgcgagtgacatctaggtttccagacgccttcggtgagtacagggaaggaagtcgccatggctgacgacgaacaggcggagaagaaggaggaggtccccgagcttgctccttttgacccaaccaagaaaaagaagaagaagaaggtggtaatacaagagccatcagatgaggtggataacttggcagagaagacagagagcttgactgtaaccgagtctagtgagccaagctttgcgggcatgaaaaagaagaagaagaaacatgtggaacttgattcttctcttaccgagaccggagatgttgatgacacaggagacgatcaagttagagaggatgaagaaggagaagggattgtgctcgctggtgccgctgccaccagatacccttgggaaggaactgacagagattataagtatgaagagctgcttggcagagtattcaacattttgcgtgagaacaacccggatcttgctggtgatagaagaagaactgttatgaggccccctcaagtcctcagggaaggaacaaagaagacagtttttgtgaacttcatggacttgtgcaaaacaatgcataggcaaccagaacatgtgatgatgttcttgcttgctgagatgggaacaagtggatccctggatgggcaacaaaggttggttatcaaaggaagatttgcaccaaaaaatttcgaagcgatacttaggagatatatcaatgaatatgtcatatgcaatggttgcaagagtccggataccattctttctaaagagaacaggttgttcttcctccgatgcgagcagtgtggttcatcgaggtctgttgctcccatcaaggctggattcgttgcccaagtgggccgtcgtaaggctggatcttaagctacctactacttgcctgaagtcgcttcccgatgaagacaatgcaaactagtttgctggtccacaaaaatcattgttgcactttcccttgtgcctacacagttcactggatttctgctgttcgctatacttggattggtgctgtgaatttatttcgtgtgatgagaggatttgtgtttgcggctcacttgtgtttactacgtttgttttgctcgtgattttgctgtggaaggcactgtcgggagcttcccgagttaggacgagtaacaaaaaaacgtgttgcttccattcagataaaaagcaaggctgcagcattctgaact

SEQ ID NO: 4930 - DNA, 1693 bp, Zea mays
  misc_feature (101)..(101): n is a, c, g, or t
aactgattagctcatgcatggtcattcaatcacacattcaatacctgcaagatctgcggcgatagattactttcccatgctcatgcttctatatgagaganaacaataaccgataagtaagtaagcatgttctataagttagtgtcgttccttacaacgcatgcagtgaagaagctagaaacccagtgtcattcagaggccatccctgcagaagtttcagttctagtgccggaaatcatagttctcaacagatcgatcgatcgagatggctcagaaggatctctatctaccgttcctggctctttccatcattgcctgctgcttgatgaacctgcaaagtgttctcagctcaagcagcaggatgcggaattctacagacgaaattagtgatgacaaatgccccccacaacctcatcccttaggtatgtgcaggtcccgagtagcagcttacggctatccatgtgaggaataccatgtgacaacggaggatggctacatccttagcttaaagaggatcccctatggtctctctggtgccaccgagatgacgaggacaccagtactactgttccatgggctactggtggatggtttctgctgggtactgagcacaccaaaacaatcactgggcttcatcttggctgatggtgggtttgatgtttggatcgccaactctcgcggaacagagtccagccgcaggcacacgaccctctccccacaagacccggccttttgggactggacatgggaccagcttgctgactatgatcttcctgctgtgcttgagttcgtctataacagaacaggaggcatgaaagtccactacgttggtcactctctggggaccttgattattcttgcggccttctcggagaacaggttaacagacatcgtgcgatcagcagcgttgctctgcccaatcgcttatctcaacagcatggaatcgaggctcatcctgcttgccactcgcatcttcctcgcagaaacgattcacatgctaggttatcacgagttcaaccctgttgggccagtggcaaaggaagtgttgggaaaagtctgcgtcgacccagaggtcgattgctatgatttattttcagctgtagcaggaccggactgctgcctcaacacctcgaccacatgcatcttcttgcagcacggtccacagtcaagctccatcaagaacatgatccacatgtcgcagctggtcaggaaagagacgatcaggaagtacgactacggaagcgagaaggagaacacgaagcgctacaaccagacgcggcccccaacctacaacctctcgtccatcccaagccacgtccccctgttcctcacccacggcggccaggacttcctcggcgacgtcgccgacaccaggcacctcctgcggacgctgctcagccagcacgacagcgacgacatcgaggtgctgtacatgcctgactacgcgcacggcgacttcatcatgggctacaacgccccgcagctcatatacaagcccatggtggagtttttcaagcgccactaagaacttgctagcaataagctgctgctgctatatgcagcaacaattgtttcatgaagccgatttgattggtgtattattgccgtaagtaagtaaaaaaagaatttcatgggttgactctcttgaaattgtgcaaaaaaaaaaaataaattcttaaaaaaaaaaaaaaaa

SEQ ID NO: 4931 - DNA, 1716 bp, Zea mays
gcgctgccgctgccgctgccgctgctgccgtgccaagtcgccgggcaagctccggatcggggggcgcgcccccggggcccccgccgccccctcgaggccggcctagttaggccagctggtcattgcatcggagagatgtatccggccactacgccctacgagacggcgtccggggtgggcgtggcgccggtggccggcttgttccccgtcgccggagaggccagggagtggtcgtcgaggctcctggactgcttcgacgacttcgacatctgctgcatgacgttttggtgcccgtgcatcacgttcgggcggacggcggagatcgtggaccacggcatgacgtcgtgcgggacgagcgcggcgctgttcgcgctgatccagtggctgtcggggtcgcagtgcacgtgggccttctcctgcacgtaccgcaccaggctgcgcgcgcagcacgggctccccgaggcgccctgcgccgacttcctcgtccacctctgctgcctccactgcgcgctctgccaggagtacagggagctcaaggcgcgcggctacgagcccgtcctcggctgggacttcaacgcccagagggccgccgccggcgtcgccatgtgcccgccggcctcgcaggggatggggcgctgatcatccgtcgaccagccagccagcccgtcggggtttgattcatgtctccgatctgttggttcatgcatgcatgtctccatttaattcatctgttcatatattcatgtctccagatccagacggtacgtataatatattcagttgttttacgtactgttcatcgtccgacaacacagcaccattaattactgtcgcctctttctcttagcacttaacgattctggcgtgtaaatcgcaagatatttccttcaagttatgctgcatacatcacttaattgtattgcatcatcttatcgatttgtttcgtttgttttgattcgcttttgttgtcccgctaatcatgtttttatctggtttccaatggccccattttcaaactaaaaatgtgaaaataaaaatgagagagggttatctcgaccaatctcattcgtcttcatccctaattgtgaccaacggagccaccgtgacacaaaaagacatttacactgacatttgtcataaaggtgccacaagtgaatatacgtttgtaacgacggttttcgaagtgacaccaatagtaatatttcatcatttctacttgtctttcacacggttttaccgccaatttactgctaatagaaacatgaaactgtgctgataagcattgtttgttttgtgctctatatatgctagttagttgttgtacattgcacagtttctatatatcataaccttgccttaaatgagatatttattcaaatacgattatatttttattttaaaattattagtatatatatttatagtatgtcttcttcttacaggataaatagacatgagttgtagtggtagaagctgagcgcttcgaaccaaggcgagtaaggttcaaaaccccacacctcatttggaaatttatttgaacccttacaccttaattaataaaagggcaaaaaagtatcaccagatagttagagtatagatggccaaacgagcggcacggcttgacacgacactggcacgacacgtttagggcacgactcgttggacctatttaatagtcgtgtcatgccggcacaacactagtgcctaaacccagcc

SEQ ID NO: 4932 - DNA, 4239 bp, Zea mays
gcaaagaatgtatgtcttaattataattaaaatgaggatggggatccccgttgaggatttatctccgcggggaacatgaatggaaaaaatgttccccgcaaacgttcgtgaggatccccgcgggaaagttttttttgtcgcgaggacgagaatagagagctatttctcggtggaaaattccccgttgccatcccaaagtacaagcttgttctagacacgctttctcggaactacattgaaagacaaagactacaactctttggaataacaagcatgctttgcctaatgagtttatgccgtagccgttttattctacaagtggaaagcttcaatattcatagaaaatgattgtgcagtcgcagcgtagccattaccattagccattgacgttgactaccattgtttgctaggatctggtatgatccggtaaagcattggcattcagcgcaatcgagttctaatggcctccatgtcgtattaaggatgaggggacgcagccgcgcaggttaaatgcagattgacatcgagatcgaattccaatttcgagtccattcgagctagcaaatatcaattcccaattctatattatttacaaccaaacataaaaatgtgtcatgttatggtcaaaggtattaagagactagatcggttatcaaaccggcaagaacgtgaggttgctagtttatttgtctaactatatctataccactatataattcaccggtttaaatattttataaaactcattcaatcaagccacctcatacgtataatccccactaaatctataaaacaaattgcacatatacttaacatcatcaaaatcaaaattaatggttcaggttgctagataaacatctctcccttaaccacttaaacctaatagataatattatttagatgtattctttatcatcactcatcactctctcttctctcagtgacctagccactttttactcatgctgccgtcgacccctcgtatcgacccctcatatcctgtaagatcgtagtgttaataagaactacatgctaatagctttaggacagcaggtgcgggacaaccgggatgagatgaaagagtttttctttggtccagtaggtaagatctgtgtgccgctaactgcacggcggtggaagacgccctcttttttccaaagcgcacttaattgagaaagcgacggccataagccgtgagcccgtgaccgggagcatgttcgaccgcgctccgcggcgccatgcgccatccccagcgacgtgtcctggactcgagggggagagaagtgccggtgtcgctgtcagcgaagacttgggccgcggatctaagtcagtctcctgccgagtcatccaaaggaattgttgagttgtaggaggtaggagctgtgctgtagtaaatctcccccgcgccgcgcgcctgcatgcggctgtagaaccggccagcgcccggctgccggcgcgtccatggctgctagcatgctactgattcggccatatggcgcgctagcttgcttgcttagctgattagctctgctctttgctgttgcaaacgcgttgtgccattgtgctgtgtccacgtgagaattcttgacgtctcatacgtatcatgtaacgccatctgcttgtcggaccagtatatattaggttgatctcaagccagactcagtcagaggatcgagttacttattcctcatgccctgcatctgttgttgtttctgaggtcaaccgcatacagagttgcttgactcctcggccatgccggccaggacatggctcgccgacctgcggtcgaggctccgcgtcggccccaggaagaacgacgggcttggcatcctggccttcgaggcagcagccaacatgtcgcggctggtatccctccaccggacggtgtccgacgtcgaggtcaggaggctccgcgccgacgtcttgcgcgccgagggcgtcgcgcggctaacgtctacggaccagtctctcctgctccgcttcgcgtgcggcgagctcctggcggacctcgaccgcgccgccggcagcgtggcgtgcctcggcgcgcggtgctgcgccggcgacgcgccgctgctgagggacttcgatcgggtctacgccgaggcgaagcgtggccggctcgcgcagctggacgccacggtcgggttctccaggggcgccacgaggcggttcaaggagatggagcgccatgtggtcgtggcggcgaagctgtacgcggagatggacgcgctcagcgagctggaggcgtcagagcggcggatggagcggtggaagcagcacagcgggccaatcccggcgcagacgacggggacgggcaaggggtcagcggccgatcccggagagaagctgatgagtaagctcagggagcagcggcagaaggtgcgacgggtcatggagggatcgctgtggaacgtcgccgccagcaaggcggcgaggctcatggccaagtcggtcctcgccgtgctcgcgcgcatctccctcgcctttgccgcgttcgttccaggccttcccccttggacggtaggacgcgcgtgggcgctcggtcactcatccggatccggcccgttacaccggtcggcgacgcccgcggcgctccagcattcggctcccatcttcggccagagagactccgcctccctactgtcggcgtcgtcgatcaagccgtcagtgagcacggtcggcggctcgagcatggagctgcgatacgcgaacgtgatcttagccgccaagacgttgctcgcggcgctgaggccgccggcaggtgacaacgaggaggcgcacgaagggatgatcgacctgtcgaagagagacgcgctgtacaagatgctacccgtcggcatccgcaaggccatgaacgctaagctgagagagatctggaagaaagcgcaaccggtggacgaggtgtctgccgcggcatcgaaggatgcggtggagtgtctgctgcggtggttgagcccgatggcgcacgacactgtgcggtggaacgacgagcagagtatggagcgggcgcagcggttcagcatgcagcctcgcgcgctgatggtgcagacgttgcacttcgccgaccgcaagaagacggatgctgctattgttgatgtgctcatcggcctcacctgcgtatgctggtacgacgatgagcagcgaaggctggagtctccagacagggacgacgacgacgagtatcagctatagatttttgagctgtgattgtatcgtggtgtgtgtgaatatcatgtaactgcaagtcgcgtgtacatagaacaacttaacagcctttatataatcaaatctagccgttttagataaataaaaggaacttgccatatttcaggttctgaaatgtagtatgttttcacgcaacgatctttatcttatattttagttcatgagcatgtaagcaagagggtggatacaataactcttgagaagttagtaatcacgcatctaaccattaggaaactgtaaaataaaacaccctcggagcaactccaagagggtactaaaaaaatgcttccccaagatcacttattggtggccgttgttaaaataatttctccccaaaaatcttagcccacaacagactgctataaagtgatcgctaatttttttgaaacaacttaagtgggccacggcaaaccaactgtgttttttcgttccaatgcctcatgcagcagcaggcatcggacatgcatactgtagtctccaattaaagcatgaaccatagagcagcaattccacgaccacaattcaaaagcaggcgtctctcttcactgcaacctgaaacacttactggaattgacaatggagcacaagtggcatctctcttttggttgtgtagatcagctagagaagttggcaaccctccaattcaagcatgaaaaccacacagtgacatattcattaatcaaaacagactcccagcaaaacttctagaaagtatactggaacaactaccacaagctactgagttttagccaatatacagcacaatgcatggacagaagctagctaattcgagggattctccatgcttaaagctacttcaaaaattccagtgcacaaaccttgaaattaaagacagattataaatattttacctcaatctaatttcttctggtaacttctctttacagttctatgattaaatcgcagccaacataatcaagatgatcccacttccatcgcagttcttatcaatgaaccactcctagtcggtcagccatccgcgcacaagcaggg

SEQ ID NO: 4933 - DNA, 452 bp, Zea mays
gttctagatcgcgagtggccgcccttttttttttttttttttttttttttttttttttttaagccccttccgatcggtttttttataataataacggcaacaactcacaaaccagtcacacgcctcttggcagcccgttgatgttaaacattacacgagctgaataatcacacagtgctccatttgatctccacgtgtatcatcccgttcctggagttgatgaggtggtacttctcgttgatccggccgttgttcaccacatccaccaggtttatattcacatgccccagcgattccttgttgcggaagggaagcccgcggcgtttgcttttgacttggatgcggatcttatcttccaccggaggctcgtctaccatgaactggaactcctcgctccattttggctctcttgttttccttatcacctgcaacggcagggcacatagggttca

SEQ ID NO: 4934 - DNA, 3767 bp, Zea mays
aatccggccccaggcccctccgctctacaatagccgaaaccctagcggccttgcgccggccatggcggcaccgcgcgccaccaagcgccccaagtttgcctccggcgcggcgccgccccagcgaggggaggacgactacgtgccggggaacatagtagagattgagctcttcaacttcatgacctacgaccgcctcgtctgctgccccggcccgcgcctcaacctcgtcgtcgggcccaacgggtctgggaagagctcgctcgtctgcgccatcgccctcggtctcgccggagaccccagcattctcgggagggcgtccagcgtgggtgcatttgtcaagagaggggaggttgccgggcacgtcaagatatctctccgcggggatacagctgacgacaagatctgcgttactaggaaaattgatacgaagaacaagtccgagtggctcctcaacggtgcaactgtcacaaaaaaggaagttattgacgtgattaagaaattcaatattcaagttaacaacttaactcagttcttgccacaagaccgggtatctgaatttgcaaagctaagtcccattcaacttctagaagagactgaaaaggctgttggtgaccctgatttacctattcagcatcgccaacttgtagagagaagtaaggaactgaaagcgtttgaagtggctatagggcaaaacgaacagactttgaataatttgaaggccccctcaatgctgaacaagaaagagatgttgagcgtgttcgactaagagataatctccttagaaaggctgaatcaatgaagaagaaggtgccatggctgaaatacgacatgatgaagaaggaattcatagaagtgatacaagagaaggagaaaattgcaaagcaagaaatggaagaagcagctagagtctgggaagattcaaaaggccctattgacaaactcaagaaacacaaggcaactcatacttcaaatataaagaagataagcggccaagtaaatcaaaacatggacaaccgtcataaagttatggaccacgatttaaagctgaatgcagaactgaaagctacatttgatgacccggtcgtccggaaaaagcaagaaaaatctcgccagcgaaggatcctgaaaactaaggaagatcttgctgctgctgaaaaggaacttgaagatctacagccttatgaacttcctaaagctgaaatggcacaactaacagaccaaattgcacgaataagtgttgagataaaaaacttaaaagcggaaaggaatgccatggagtctcagttagctcgagaggaagaaagcttgaggagatgttctgataggttgaaggaaatggaaagcaagaatagtaagctactccaagcattacgaagtgctggtgctgataaaattattgaagcataccactgggtgcaagctaacaaaaagaatctcaggcaagaagtttacgggcctgttctccttgaggtaaatgttcaggataagcttcatgccacttacttggaagaccatgttccaaactatttatggaagtcattcatcactctggatgcttcggaccgtgactacattgctagagaaatgaagcagtatggcattcctgttctgaactacttagtgcgcgaaggcacaaggagacggccattaaacatcactccagagatggagcaacttgggatctactcccgacttgatcaagtatttcaagcccctgacactgtgaaagatgttttgattagtcaggcgggtttggatgattcgtacataggtacagatgaaactcatcgcagagcagatgaggtgtcaaagctaggcatctatgacttttggactccggataatcattatcgatggtccaaatcaagatatagtcggtttcccgcggcgtccctgcgtccgatccatccttctcgtctcttcaagagcaatctggatgtaagcggcattgaagatcttcgacttcagaaagaagaccatgtaacaaatattgaaggaatgcgtgaagctataaagacgcttcatagaaaacagagacagttagaagacgaagaggcaaatatacacaggcagaaggaagaaattattaatgcgatgagataccacaagaagacacgagaagagatacaaagacgtgttgatatcaaaaagcgaatactgaaggacatatccagagaagacgatgtagaatccagcacgagaaagcttgttaatcaggttgctaagataaatgatgagaggtttcatgcaatgataaaacttaaggatttgcttactgaagctgttgctctcaaatggagtcacacagaaaagaatatgactttaattgagctcgatacaaagatatgggagatggaaaagggtgtgaaaaaacttgaaaaggatgctaatcaggcggctagaaactacgaagattgtagaagaatcactcaggagcataggcggaggctgtctattgcaaaacagaatgcagagtcgatagccatgattactaaagaccttgaaaaagagttttgtgcgatgcccactaccttagaagagctcgaaactgcaatacaagatactgaatcagaggcaaattctatgctatttcttaaccaaaatgttttgcaggagtatcaaaaccggcaacatgagatagaatcaatctcaaataaacttaaggatgataagggtgaacatgagatctgctgttctgaaatcgaaacagtaaagggtaaatggcttccgactctgcggattcttgtttcaaaaataaacgacacattcagtcgtaactttcaagaaatggcagtcgctggagaagtttcactggatgagcacggtattgattttgatcactatggtattcttataaaggtgaaatttaggcaaactagtcagctgcaggtgctaagctctcatcaccaatctggaggggagcgatctgtatcgaccatcttgtatcttgtgtcacttcaagatcttaccaactgcccttttcgggttgttgatgagataaatcaaggaatggaccccataaacgagaggaaaatgtttcagcagcttgtcagagctgccagccaaattaacacgccgcagtgcttccttctgacgcccaagctcctacctgatctggagtacagcgatgcctgcagcattctcaacattatgaacggcccatggattgaggagccagcaaaagcttggagctccggtgattgttggaggacagtggtcagcgcagctggacactgagcgccgagtattttgccttggaccgtaggaggcttgtaaagtttagcgtgtagagctggatgcagcttttgggtggttaatttaagtttgtagttgtactacatgtaagtttaggaaagttaaggtagctggtggcattatcaatgtggaaccagatgttgagctgctcaaatcacttggcagcccttttgacacgggagggtaaggtactgtggaatgatccctaccctgtaccggccagtattcctggaagtgaccagtttacttaagtaattgttttgcagcggaaaagcaggcaggcatgcaatgtctgtctacttgctgtgacaagtctgactcctttagggctttagtacttttgttaggagtagagatggaaggggattaaattaattggtagtaaaaaatgaataggaacggatttaatctcaatctccttcgattcaatgcaagggtgctgttggttcaagaaatgtaacgcaaagggtaatgatttacatttgattacgtcgggaaaaaaaaaaaaaaaa

SEQ ID NO: 4935 - DNA, 741 bp, Zea mays
cggttccccccctcggcccgaagcgcctccctcttcctcaggaacacacacgcacgcagacggcagacctcccccaaccgctctctctccctccctgtctctctgttcaatctctcggctcgccatggacgctccgagcaactgcacgcgtcctgcgcgcgccaagtgaccgaacaagctgagctctgctgctacagttgcttgcccctgtgccaaactggcaggaggtaggtagcttatagcatagcagctagagctaagctgtggtgcgtagcggcagctagagctagcttgtgcacgcgcaggtgcgtgctagctagctagcttgttagctgtggactagctgtgtagcagcagcagcagcacagtagcagtagtcggtgataaaaggaatttctttggggacatgtcggcggagagagccccggtgctggtgaggcacggcggcggcggcgtggaggcgctccggcagctcccgccggggttccggttccgccccacggacgaggagctcgtggtgcagtacctccggcgcaaggccatcggcgtgccgctccccgccgccgtcatccccgtcttccgcgacctctacagccgcgacccctgggacgtcgtcgccgtctctgcccctgaatacgaggagcgagggggagaaatacttcttcgcggtgcggccggcaagcggcggcaagagcagcggcgctggtactggtagcagggcggccgccgacatataagctc

SEQ ID NO: 4936 - DNA, 7558 bp, Zea mays
gtttttgtagtagtacgtgggttggaaaatggaaggtcgagcgtttgaagaccccattcgatatttccatgccgcacggctctcgggcgcatattgtgttgccatacgctgatacgcatgcagccgttgccccccatccgtccgtttcccccaaaacacagacggaaccggcgggaggcgggggaagtagaagaaagaagaagcgtaacagaatactagaatggaacggaacgcggacgggtgggggaaacggctcccaattccaatccccacacgcaatgcaagcctcactagctcatgccccccgggcccggcgggacgcgtgagcggcactgggggcgaaacgcttttgttatgctgcgaggcatggggcgggcgggaggaggccggccgccgccgcctccgcgtcgcgcgcgggccgggccctggctgctagcagcgcggcattattgcgcccgatcgcgtgcgtactgtgtaaccgcaccgcgcctcgggtgggtcgtatcgtactagtagtagtagtagaccgtatagacatgggatgcctaggggccggcctgggggcagctggtggctggccgctctgtctctgtgctcgcctgctcggcatcaatgcgcgcggcgccagtgcatgccgtctgcagtccgtagaatcgctgtagatggccagcagtccggggccacacacacgcagagaggcaacacgtgagccgaggggactctctcgcagcctctgaccgcgtggggccggatgataaatcacgcacggcgagcgtagacggctagcacagcgagtgtcactctctctgggttttcaaaggtttgagaatatcaaactttcttaaatttggttttataaatttataaaacggaggtcgaaaagagacgtgcgccagcggccgagcctgccctgcacctgcgcggttataaaacgctagggagagggcgggagcaagagcgcttggcgaggtcctggatgactgactgaccacactagcgcagcgcgcacaggagcaaaggggggcatcctctatcgcgcgcgcgccatggccaccaggccgggccctttgactgaatggccatggcaaaggcttggaaacttcaaggtgcgtatatggcaagcgttcacgcatggtgtgcttgctactctcctatcctctttctttcatcttcaccacgccttcttcttccttggtttcgtttcgcctgcgggcgcgtgagatctatccgatgcgcgcgtcggaggccatggctgtgctccggcggtttcggtgctgtaggactaccgtcactcgtactgtttgcatgcgtgtgatggtaagcttcatctaggaggttactgtctgtgcgtgtacagaggggcgtgatgagtatattaaaacgagattactgtagtagctcatgcacatgtaactgctttccgcaacgaggtggtgccttttttccccccacttcagatatggtaatgacggtgttatcattagagaagtataataagtggccgtaatcaggctaaatgttgatgtggagcggaaagaagaggaggaaaatgagaagtaaacttatagccagcttcaacgcaaaggtcactgcagcagcagtgggctgaattattaaacttgttcttagaacgctgttctgtatgctgtatagcttttggcttgcttccatcgtatgtatgaagtcatcgaacacggctcttaggctgtcttggatagatcgtgtagaataggagatacggaactaactatagatgagattgtttgacactgttttgcagagtaaattttgaaatagacgatacggtaagggatatgatagggatacgctggagataaccttgactgtacactgtagagtagataacgtccctagaaacaaagaaagtggtgtagagtagataacatcacaagcaccatattcttttactatctctaaaagtttttttgtcctctgtattttatttttctccaacaacaacgtacctatatgttaaatacttatatataagacatattttactatatgttggtagatttatgtatgtaaatatctgttataccttaaatatcttacttatacatattttaattttgcttaaaccgttgtctaaagtataaaaaaatagatagaagagaggagatagagtctctctctatatataaatttgaggatcatcttttatatttatatttagcggacactttagagaatatcattgaagcgtatggacgagaaaattttatctaaatataagttggggagatcgtttagagaaaataaaaaaagaccttcattctcgtcatcattcgcgtatgctcgcatttatgcatatacgaaatataatacacgaaaagccgagaatactgggtacatataaatgtgtgtgctcctgaccccattgctcttttgggatgcatatggtatggttagcaatcggtaccactaccagatccgatcatcatatctgagaatgagatgtgtggacaggggatgggaattatgacctcatttcgttctcagctcattcgtccaagggggggcgcgtgcagcggtcctaaaattaagggtctgtttggcagtcgttaagaaactgttttatgaaaattgatgtggtaaatataccagattatatctgatttcgagtttcttaaaaagcaagaagttggtctcttctaactaaaagataaaaactagttccttacaaatttgattggacctaaggcaaccgtacctgaaatgaagcccgcgctgttcattgaatcattctgttgggtttgtggtgtcatgcatgcatggctctgtctgtggtatgaatgcatgcacgacacgcgaatgcagtacttggtgatggctcccgtggcggtccacggcgcgcggcgggtggtcgcgcggggctggggcgacatcgacctggccttcgcgctcatcctgccgtcgctgctgctgcggatggtgcacaaccagatctggaccagcgccgcgcgctaccagacggcgcgcagcaagcaccgcatcgtcgaccgcggcatcgagttcgaccaggtcgaccgggagcgcggctggtgagaagtactactggagcaaagcaagcaatagctagctaggctgtcgttggaccggccggctgacgaacatgcgtgcattgcagggacgaccagatcatcctcaacggcctgctcttctacgttggctacctggcgatccccagcgcgaggcgcatgccggcgtggaggtcggacggcgccgtggcgatggcgctgctccacgccgggcccgtggagttcctctactactggttccaccgggcgctgcaccaccacttcctctactcgcgctaccactcgcaccaccactcctccatcgtcaccgagcccatcacatgtgagtaaataacacagtgcattgtttgagtcagtaacacgtcacacaccagtacaggaaaacacggcacaccaagtggagcatccattttattactacttcctccaaactaaaagcacatccaaccagaaatatcctgggcgggcctgtctggtccatcaacagtgcgggcccagaccggcctagtacagtacaggacaccacatgcatccggcccgttccactgaccaagcatgttggtgccataaaatcggcgcatgtgatcgcctctgagaaagctgcagtggtgccacgtttgtccggctaagagttaagatgcctttcgaatgtgaacccaataataatgcggtgcgggtgcggccgggaaatcacaggccgaaccgaactgctgaatgaaagagaccactcacgctgctgctgtgtcaggtcagcgacgagacttttgctccagctgccggggaccatccaaaaccagccattatagatcaaatcaagtagagtttaagtgctaggaaataattcaatgcatggtgtatctttggtaacgtgacatgacaacaatgcaatgcaacgcggcgggtttcattcttgctgcttttcagcgttttttttttttgttctttctccttttctttgtatgaaaaaaaaatagcaaatcggttcctaatgcatacggatgcagccgtgatccatcccttcgctgagcacatggtctactacgtcctgttcgccatccccatgctttcgactctctacatggggaacgcctccgtcctgggcatcgtgctctacatcgcctacatcgacttcatgaacaacatggggcactgcaacttcgagctggtgcccaggtggatgttccagctcttccctcccctcaagtacctcatgtacacgccgtcgtaagtgccgtcggatcttgctacacaaaacacacacacacaactatagcaaaaaaaaacaagattttgttgttgtgcaggttccattctctgcaccacacgcagttccgcacgaactactcgctgttcatgccgctctacgactacgtatacagcaccatggacaagtcgtctgaccagctgtacgagacctcgctcaggggagcggaggagacgcctggcctcgtccacctcacgcacatgaccgacctgcagtcggtctaccacctgcggatcggcttcgcctccgtggcgtccagaccgtctgccaccggcgccatgtggtggtacatgtgggtgctgtggcccgtggcgtggctgtccatggcgctcgcgtgggcctacgggtcctccgcgttcgtcgtcgagaggatcaaactcgggaagctgaggatgcaaacgtgggcagtgccaagatacaacttccaggtcggcctgtgcgaccaacactttctctacgtctactacgtgcatggtgtggctttctttgtatgcgacctgagctgacggttcttgttcttctcccgccccgcccgcccgcccgcccgctgcagtacggcctgagctgggagagagaatcgatcaacggcctaatcgaaagggcgatactagatgctgatgcgagaggtgtcaaggtgctcagcctaggactgttgaaccaggcgaaacagctgaacggcggcggcgagctgttcaggcacaggtatcccaagctcagagttcgcctcgtcgacggaagtggcctagcgactgctgtggtgctcaggagcattcctcgtgacgcgaagcaggttctcctccacgcaggcccttctaaggtagcgtgcgccacggctgctgcgttgtgcgagaggggcgtccaggtatctctttttgctgcatttatttgtatgcatgtacagtatctgtcttgttgttttattttacggtttcttttcattgaagatggcacactacactacaacgcttgtttaatttggtgtcttgtggaacaggtcgtcatgaacccaaacaaggaatatgatatgctcaagtcacagattgcagatagcaaagcaagctatttggaacgacgctccgacaaccaccacacgcctcaggtaaaacgttttttgtttagaatgggattttttttcccattttaaactgctgcagtaagtcagtcagcttaaaatggtgagtgcttaaactgctgcaggtttggctagtagacagcatcgacgacgaggaacagaagatggcaccgaaaggagccgtattcgtcccaatctcacagttccccatcaagaaaatccgcaaggattgcacctacctgagcactccagcaatgaagatccctgaaaccatgcaaaatatccatgcctgcgaggtaaccaggatagcgagcgtagttaatccacttaaccaaatttgaggaggaaaaagaaggaaaatataggaaacattcttaccgatcgaggcttctctgagcacacgatcttgtttatctcgttcattgacagaactggctgccaagacgggtgatgagcgcctggcgcatcggcgggatacttcacgccctggaagggtggaccgtgcacgagtgtggggacgccatggtgcatgctgacaaagcatggtcagcggcccttaggcacggattcgttcctttgacgaaagcctgaaagcctgcgaagcccggggttctgtggctggggcctgcgatagatatatgtacgcagatctggacgccattcgacgatggctggaaaactacgtttcagcaatcggtagcacaaattctcccccgctagagaaggcgacttatatggtcggcgtgatgaatgacgaccttgattccaacagcatatagtaactacagttatgttgtggcattgtatgatgcaagtgcgagaaactgctttgtggctgtctgggtgacatatacaattataataaaatgtcgatttggcttgtccttttgaaatgtgccgaggaatactcttttgctgaaaaacggatagggctagtttggatattacaattttccaagaaattactatttttccaagtaaaaataaactaactttctttgggaaaaattaaaatctcgtggaaaaataggatttccaagctagccctaagcagttttttttatacacaatgttagatctcggtggtaagagctgactgctatttcagggggttcaggaaatggtaccacatccagtcatctatgatcccgcttcagaacctgtattatacggtggtgcaaagaccatcgctagcggaagattatctgattctactgtacgtgcactccagggcattgacagtccagtcctaagcacatttttttttctggcgcaatcacgttacggcccgatgttgtgtggccttgaacgggcacgacacgaggtatatgttatacctaggccgtattccgacattgtaggagtgacataacattaaccattaaatagctttggcccgataacaggttaaaagacttttttttgttttttcgggttagtttgacaacttcattttttaatataaaatttattaggaaaataaaaattctttagaaaaatgaggttctcaaactagccctttaaaaaagtttaaggatgcatttggttgcggaacaactggatataggtagtacagagacgttccttagcatcctctttcgaccctccaattttaatacaactaggtacaatactaagataatcatgttttaactcatgacactgaatcaaacaactttatttaagtgatcgtcttatctcatcccgtttgatcattacaaccaaatgcacagcagaaaaaaccaccggatatattatggtcttggaggccaagtaaacacaccaaaaggaaaaacattgagaactacaagtatgagaggacgtgagaaagacatccgcaccaagtgatcacttgtgcagactcattgtcctttagatggtatgcccagaggcggacattcgtaaggcaagcacggagggtagcaactaccgaagaccaattcacctcgaaaaacaaggttgttgtgacgtttccataggtgccagcagcagagggtgacgagggtgggaccgtgggaaaggcgtcctggtggagattagcggggcgtgtgagccgatgcaagtcggtggatcagaaccggtccacaggaacccctgacatttcttaacagcatggatcctcatcgcatccatgatgtagtttattgcccatcgagaacc

SEQ ID NO: 4937 - DNA, 2338 bp, Zea mays
gcacgagaccattacgccggccgggccgggaagagcgcttggcgaggtcctgggtgactgactgaccacactagcgcagagcgcacaggagcaaaggggggcatcctctctcgcgcgcgcgccatggccaccaggccgggccctttgactgaatggccatggcaaaggcttggaaacttcaagtacttggtgatggctcccgtggtggtccacggcgcgcggcgggtgttggcgcggggctggggcgacatcgaccttgccttcgcgctcatcctgccgtcgctgctgctgcggatggtgcacaaccagatctggatcagcgccgcgcgctaccagacggcgcgcggcaagcaccgcatcgtcgaccgcggcatcgagttcgaccaggtcgaccgggagcgcggctgggacgaccagatcatcctcaacggcctgctcttctacgttggctacctggcgatccccagcgcgaggcgcatgccggcgtggaggtcggacggcgccgtggcgatggcgctgctccacgccgggcccgtggagttcctctactactggttccaccgggcgctgcaccaccacttcctctactcgcgctaccactcgcaccaccactcctccatcgtcaccgagcccatcacatccgtgatccatcccttcgctgagcacatggtctactacgtcctgttcgccatccccatgctgtcgactctctacatggggaacgcctccgtcctgggcatcgtgctctacatcgcctacatcgacttcatgaacaacatggggcactgcaacttcgagctggtgcccaggtggatgttccagctcttccctcccctcaagtacctcatgtacacgccgtcgttccattctctgcaccacacgcagttccgcacgaactactcgctgttcatgccgctctacgactacgtatacagcaccatggacaagtcgtccgaccagctgtacgagacctcgctcaggggagcggaggagacgcctggcctcgtccacctcacgcacatgacggacctgcagtcggtctaccacctgcggatcggcttcgcctccgtggcgtccagaccgtctgccaccagcgccatgtggtggtacatgtgggtgctgtggcccgtggcgtggctgtccatggcgctcgcgtgggcctacgggtcctccgcgttcgtcgtcgagaggatcaaactcgggaagctgaggatgcaaacgtgggcagtgccaagatacaacttccagtacggcctgagctgggagagagaatcgatcaacggcctcatcgaaagggcgatactagatgctgatgcgagaggtgtcaaggtgctcagcctaggactgctaaaccaggcgaaacagctgaacggcggcggcgagctgttcaggcacaggtatccgaagctcagagttcgcctcgtcgacggaagtggcctagcgactgctgtggtgctcaggagcattcctcgtgacgcgaagcaggttctcctccacgcgggcccttctaagatagcgtgcgccacggctgctgcgttgtgcgagaggggcgtccaggtcgtcatgaacccaaacaaggaatatgacatgctcaagtcacagattgcagatagcaaagcaagctattgggaacgacgctccgacaaccaccacacgcctcaggtttggctagtagacagcatcgacgacgaggaacagaagatggcaccgaaaggagccgtattcgtctcaatctcacagttccccatcaagaaaatccgcaaggattgcacctacctgagcactccagcaatgaagatccctgaaaccatgcaaaatatccatgcctgcgagaactggctgccaagacgggtgatgagcgcctggcgcatcggcgggatacttcacgccctggaagggtggaccgtgcacgagtgtggggacgccatggtgcatgctgacaaagcatggtcagctgctattaggcacggattcgttcctttgacgaaagcctgaaagcctgtacgcaactctagacgccattcgacgatggctggaaaactacgtttcagcaatcggtagcacaaattctccccagctacagaagccgactatatggtctgcttgacgagtcgtccagggaggcacggcgtgatgaatggcgaccttgattccaacagcatatagtaactatatatatagttatgttgtggcattgtatgatgcaagtgcgagaaactgctttgtggctgtgtgggtgacatatacaattataataaaatgtcgatttggcttgtccttttgaaaaaagccgaggacaaaaaaaaaaaaaaaaactagttctcctcgtgccgaattc

SEQ ID NO: 4938 - DNA, 2273 bp, Zea mays
ccacgcgtccgggatgactgactgaccacactagcgcagcgcgcacaggagcaaaggggggcatcctctatcgcgcgcgcgccatggccaccaggccgggccctttgactgaatggccatggcaaaggcttggaaacttcaagtacttggtgatggctcccgtggcggtccacggcgcgcggcgggtggtcgcgcggggctggggcgacatcgacctggccttcgcgctcatcctgccgtcgctgctgctgcggatggtgcacaaccagatctggatcagcgccgcgcgctaccagacggcgcgcagcaagcaccgcatcgtcgaccgcggcatcgagttcgaccaggtcgaccgggagcgcggctgggacgaccagatcatcctcaacggcctgctcttctacgttggctacctggcgatccccagcgcgaggcgcatgccggcgtggaggtcggacggcgccgtggcgatggcgctgctccacgccgggcccgtggagttcctctactactggttccaccgggcgctgcaccaccacttcctctactcgcgctaccactcgcaccaccactcctccatcgtcaccgagcccatcacatccgtgatccatcccttcgctgagcacatggtctactacgtcctgttcgccatccccatgctgtcgactctctacatggggaacgcctccgtcctgggcatcgtgctctacatcgcctacatcgacttcatgaacaacatggggcactgcaacttcgagctggtgcccaggtggatgttccagctcttccctcccctcaagtacctcatgtacacgccgtcgttccattctctgcaccacacgcagttccgcacgaactactcgctgttcatgccgctctacgactacgtatacagcaccatggacaagtcgtctgaccagctgtacgagacctcgctcaggggagcggaggagacgcctgccctcgtccacctcacgcacatgaccgacctgcagtcggtctaccacctgcggatcggcttcgcctccgtggcgtccagaccgtctgccaccggctccatgtggtacatgtgggtgctgtggcccgtggcgtggctgtccatggcgctcgcgtgggcctacgggtcctccgcgttcgtcgtcgagaggatcaaactcgggaagctgaggatgcaaacgtgggcagtgccaagatacaacttccagtacggcctgagctgggagagagaatcgatcaacggcctaatcgaaagggcgatactagatgctgatgcgagaggtgtcaaggtgctcagcctaggactgttgaaccaggcgaaacagctgaacggcggcggcgagctgttcaggcacaggtatcccaagctcagagttcgcctcgtcgacggaagtggcctagcgactgctgtggtgctcaggagcattcctcgtgacgcgaagcaggttctcctccacgcaggcccttctaaggtagcgtgcgccacggctgctgcgttgtgcgagaggggcgtccaggtcgtcatgaacccaaacaaggaatatgatatgctcaagtcacagattgcagatagcaaagcaagctatttggaacgacgctccgacaaccaccacacgcctcaggtttggctagtagacagcatcgacgacgaggaacagaagatggcaccgaaaggagccgtattcgtcccaatctcacagttccccatcaagaaaatccgcaaggattgcacctacctgagcactccagcaatgaagatccctgaaaccatgcaaaatatccatgcctgcgagaactggctgccaagacgggtgatgagcgcctggcgcatcggcgggatacttcacgccctggaagggtggaccgtgcacgagtgtggggacgccatggtgcatgctgacaaagcatggtcagctgctattaggcacggattcgttcctttgacgaaagcctgaaagcctgcgaagcccggggttctgtggctggggcctgcgatagatatatgtacgcagatctggacgccattcgacgatggctggaaaactacgtttcagcaatcggtagcacaaattctcccccgctagagaaggcgacttatatggtcggcgtgatgaatgacgaccttgattccaacagcatatagtaactacagttatgttgtggcattgtatgatgcaagtgcgagaaactgctttgtggctgtctgggtgacatatacaattataataaaatgtcgatttggcttgtcctttaaaaaaaaaaaaaaaaaaaaaaaa

SEQ ID NO: 4939 - DNA, 1242 bp, Zea mays
cgccccgcgcgccggccggccggtcgattcccccactccactcgccgcccgcggctgggctgcgctgcgcatcgacgacggacgacgacacaatcacccccaccccccgtccaatcagcagcggacgagggacgaccacggccccccgtctgccgcacgcgcgcccgctctgccagctgctgctactactgctaaacctcgcccaccagtcgcgtgaggaaatagcaacctgctgagctcgctcgttcgctcgctcgcctgccttcttccctgggcaagctagctagctaggatcgaggaggagctctgcccggccatgcagcgtggggatccgctggtggtgggccgcatcatcggcgacgtggtggaccccttcgtgcgccgggtgccgctccgcgtcgcctacgccgcgcgcgaggtctccaacggctgcgagctcaggccctccgccatcgccgaccagccgcgcgtcgaggtcggcggacccgacatgcgcaccttctacaccctcgtgatggtagatcctgatgcgccgagccccagcgatcccaacctcagggagtacctgcactggctggtcactgatattccggcgacgactggagtatcttttgggaccgaggtcgtgtgctacgagagcccacggccggtgctggggatccaccgggtcgtgtttctgctcttccagcagctcggccggcagacggtgtacgccccggggtggcggcagaacttcagcacccgcgacttcgccgagctctacaacctcggcttgccggtcgccgccgtctacttcaactgccagagggagtccggaaccggtgggagaagaatgtgatctcgacccggccgggtggaaattaataagatgacgggtaatcgggtatatgtatatatttatatatatatgtatatgtacgtgtatttgatctggtggcctttggttatatttgggtggggtgtatttgatatattatctgtggcagattggcgcattctctggcgcatatttgatagctacatgtatctatttatacagatataaagcgagcaataatatgcatatgagagggttcagccacatcagtcattactctctcctttttactgtgacgatgactacttatctgaatcatctgattacaactacatgcttgcttgctgctcactcactggtcgagctgctggatgcagccatgcatgcagagaaatgaacccacacatgccgagggagacgagcag

SEQ ID NO: 4940 - DNA, 3558 bp, Zea mays
cccctgcaaaagcatataccaccgggtttaatgtaaagcgaacagactcgcgactataaacctttttttaaataaatttcaacgttgacaagaacaatcgctgctcctgcgatcgccgttttgtttgtgacatcttacaatgaaaaatactattgtacaaaggctctcgttcctgcgacccatgaataaagctcgaatagcccctttcgtcccggcacatgaatttcatggtaatagtacataaattttataggaattcatttatttttgctttcacgagtaaaatacagaagcaggaaaaaaccaaatcaactccagcaagaagcataataaaatacttttgatttaaactagttagaacttgttggattattcatatcctatgtaaattgaatgagattggaaaaaaatatgaattttttaaacttgtttaggaattaaatccactcaattcatgcgaattgagcgcttaggagaaacggagcttcaaatccaatccgcttcgcatgcggccccaccagtcaggctaaccagtttaccaatctgacgccgtcacaggtcacaccgtctttactagagagagcgccaatcctccccatcccgaccgccgcccccacctcctccgcggccgcctcgcggcgattccgtccgcatctgaccccgatcccaggggcatcgtcctcacctcctccgccagctgccgctcttccgtcctcttccgcagcttctgcgtggggaagaggcggtggcggccgaaccggcgtagtcgtcgccgacgccgctgccagccgccatggaggcgtacaagctctgggtgcgcaggaacagggacctcgtccgctccctcgagtccctcgccaacgggctcacatggatactccccgagcgcttcgccaactccgagatcgcaccagaagcagtatatgcactactgggtattgtgagttctgtcaatcagcacataattgatgcgcccactgagaatcactcatttgcctccaaggaacaatctatcccatggggtcttgttgtctctgtactaaaggatgtggaggcggttgttgaggttgctgcccagcactttgttggcgatgatcgcaagtggagctttcttgctgttacagaagcagtgaaagcaggtgtcaggttagctgcttttcgggagagtggatacaagatgctcttacaaggaggggaggtggtaaatgaagaagaggtgaccgttcttgaaaataattatggagtaaatggtaatggagtaccagccatctatccgatggatggacatgcagaaaatggtcacaaaactatggccaagggtctggatggtaaaaatggatttgtatctaagagtcttgagaaaagagcagtagctgctttgaacaaatttggtgagaacgcaaagatgatgtctgatcctatgtggatgcggaggccccaacctactcctgagccaactgtgatggttgccgagaagccaacattgacaagtatttggtctgctaaaagcggtactgggcgcttgtttgttttaggggaggttgttcacatattcaggccacttgtatatgtacttctgatcagaaagtttggaatcaaatcgtggaccccgtggctagtgtcgctagctgtggaactcacaagtctaggcgtccattcccatgcaaccgatctgaatcacagattagggaaagtgcatcagctcagttctgccgagagggacgagttgaaaaggcgaaagatgatgtgggctctttatgtgatgagagatcctttctttgccagttacagcaagcgtcacctcctgaaggctgaacaggttctgaatccggtgccattgattggcttccttacagggaaacttgtagagctactggaggggattcagacgagatacacgtacacatcaggttcatagagatggccaatctgagcctgctgctcgcctctcgatttgccctggcggacatgtgctttgtgcgagttggttgatggttaatggttaatggctaggaactggtgcttaatcctgaaacccgtactgctgtttttcttgccaactgtggcatcgtcgtcttgtggctgcgaagctgcagccacctcgttcgtgtatggcggcagatgagacaattcataatctaagtatatagatataaatagtagtattaccggtttgtttgtatttacgatttatcgtgaactgatggaacataatgtgtatacagcgaaaatttatctgattccaaacatttgttgtttaacaacaaaaaaaaaaaaaaaaatgccaaatgccagtaaggggcaggtaccttaccactgattcgttgtgccagaatcagatgaggatgttgaaagttcatctgaatttgcccgttgtttaggtctagtttgggtactctggtaatgagaggggttagagtgaattggcatgtattgtgagaatttttaatttattggagatttaaacgctcttcaatccctcgaaaccacttcaatccaaaagtaaccaaattagatcttaagggcttatttggaagcaaaaagtaatgaagggattgaggggattagaatcctccactattcaaatattcatttgaatagtctcaatcatctctattactcttgctcgccttccaactaagccttaattgggactcggtaggtcaagggttaaggttgtctccatcatcgtcttctatatacatcctctatatttgtcatttacagtctgctctaaaagatttcatcatctatatctcatttctctccaacaaggtccaataaataacgtcctctatactcaaaaatatctatattagggacattttttatttttattttttgtacatacatatttgtcatactctcaaatgtattgtgcatattttagtttttctaaaccggttatttaaagtattcaaaatgaatagaggaccatttagagaaactctatatatagagaatccagcaacgttctctaaatttagaggatcgtttagaggaccgtttagaggacactgctagatagcgtagaggatcatttgatcctctatatttagggtacagaaccctttagggtcccttgctggagctagcctaacatctaggtacgcctgaataatccggtcatgtggtccagacaatccagagttctagtccggatggttcgtgattagattaacttagacaaaagtatttatctcacgcgtgcttatccaactaaccacgctagaatctgttggtatacttgtaggaacgggtccagacccatatattatgatcaattaatacgcgacacgatcgatctaatcattatatttaccagtttctttacattttttgctctaaaagtagcaggaattagtcttctttatccctaatcttcacctctatctcgactctgctatttagagcatcttaggttgcctgtcgacctcaagacgatcctagaatatttttctagaggtgagattcagattttacccaggatctatgaagtcctctacccgtctcgtggacggtccactatccatacacgaacagtccacttgcctgcag

SEQ ID NO: 4941 - DNA, 2044 bp, Zea mays
aaaaatttggaaggggaatggtcggagagagaaagcttcctccctcttccctggtctggtcgcttctcctgtagctgtaattttttagagtccctctcaaactttgcttgcttgcgctctccatatatcctgtggaccggagaggatgctctgatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagatcggaggcgcagcaatccgagcacgcagctagtagggaaagtatccgagaaaagttgcagattttgctgggggcaacggagcgagaacaagttactgcagaaggaaagggcaaaggtgggggaggcgccggagatgagggatgctatcagctctgatggattatttgaaatcttgctcgggtccggcatcaccggctgggcgtccccgcaaaggatcggatgccaccggccgccaggacgggctcctgtggtacaaggacggcgggcaggtcgtcgatggtgagttctccatggccgtggtccaggccaataacctattggaggaccatagccaggttgaatccgggccgcttagcacatcggagcctggactgcaaggcaccttcgtcggggtctacgatgggcacggtggcccggagacagcgcgttacatcaatgaccatctcttcaaccacttgaggagattcgcatctgagcacaagtgcatgtcagcggatgtgattcggaaggtattccgagcgactgaggagggtttcatttctgtggttagtaaccaatggtcattgagacctcaattagcagctgtaggctcttgctgtctagttggtgtggtttgcagcggaactctatatgttgcaaaccttggggactcccgtgctgttctggggagacttgtcaagggaactggggaggttttggcaatgcagctctcagcagaacacaatgcatcctatgtggaggttagacgagagctgcaggcatcacatcctgatgatccccatattgtggtcctaaaacacaatgtttggcgtgtaaagggtattatccagataacaaggtcaattggagatgtgtatctgaagaaaccagaatttaatagagaacctttgcacagcaagtttcgtcttcaggaaacttttaggagaccacttcttagttctgatccagcaattactgtccaccaaatacagccaactgataagttcatcatttttgcatctgatggactctgggaacatcttagtaatcaggaagtggttgacatggtccaaagtagcccgcgtaatggaatcgcacgaaagttagtaaagtctgcagtgcaggaagcagcgaagaagagggagatgcggtattcagacctcaagaaagttgatcggggggtgaggcggcacttccacgacgatataactgtcattgtggtatttttcgattcaaacgccatgacaactgctgcctggagcagaccctcggtctctctccgagggggtgggtttccaatccattcaaacacccttgctccattctcagttcctacagagctaaacaactactgaaaccacgcggtatgtgaaggagccaggcaagaggataaaaaaaaagtaaaggaaaaaggagaaggaaaaacagctgttgtgatcagttgtagtgtatttcaccgttcatgttcatgcaaaacattttttagattctcaagtctcaacctggtgaccagtgcactgatagcaaggtataagattagattattcttagcttttttatcctctttttctctctctcttccttaccctttagattcactcatgggatatcaggtgcttgtacattctttggttcaacttgtgataatagtccatcgcccccctctttcgtcaaaaaaaaaaaaaaaa

SEQ ID NO: 4942 - DNA, 2830 bp, Zea mays
caaactttgcttgcttgcgctctccatatatcctgtggatcggagaggatgctctgatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagatcggaggcgcagcaatccgagcacgcagctagtagggaaagtatccgagaaaagttgcagattttgctgggggcaacggagcgagaacaagttactgcagaaggaaagggcaaaggtgggggaggcgccggagatgagggatgctatcagctctgatggattatttgaaatcttgctggggtccggcatcaccggctgggcgtccccgcaaaggatcggatgccaccggccgccaggacgggctcctgtggtacaaggacggcgggcaggtcgtcgatggtgagttctccatggccgtggtccaggccaataacctattggaggaccatagccaggttgaatccgggccgcttagcacatcggagcctggactgcaaggcaccttcgtcggggtctacgatgggcacggtggcccggagacagcgcgttacatcaatgaccatctcttcaaccacttgaggagattcgcatctgagcacaagtgcatgtcagcggatgtgattcggaaggcattccgagcgactgaggagggtttcatttctgtggttagtaaccaatggtcattgagacctcaattagcagctgtaggctcttgctgtctagttggtgtggtttgcagcggaactctatatgttgcaaaccttggggactcccgtgctgttctggggagacttgtcaagggaactggggaggttttggcaatgcagctctcagcagaacacaatgcatcctatgaggaggttagacgagagctgcaggcatcacatcctgatgatccccatattgtggtcctaaaacacaatgtttggcgtgtaaagggtattatccagataacaaggtcaattggagatgtgtatctgaagaaaccagaatttaatagagaacctttgcacagcaagtttcgtcttcaggaaacttttaggagaccacttcttagttctgatccagcaattactgtccaccaaatacagccaactgataagttcatcatttttgcatctgatggactctgggaacatcttagtaatcaggaagtggttgacatggtccaaagtagcccgcgtaatggaatcgcacgaaagttagtaaagtctgcagtgcaggaagcagcgaagaagagggagatgcggtattcagacctcaagaaagttgatcggggggtgaggcggcacttccacgacgatataactgtcattgtggtatttttcgattcaaacgccatgacaactgctgcctggagcagaccctcggtctctctccgagggggtgggtttccaatccattcaaacacccttgctccattctcggttcctacagagctaaacaactcctactgaaaccacgcggtatgtgaaggagccaggcaagaggataaaaaaaaagtaaaggaaaacggagaaggaaaaacagctgttgtgatcagttgtagtgtatttcaccgttcatgttcatttaaaacattttttagattctcaagtctcaacctggtgaccagtgcactgatagcaaggtataagattagattattcttagcttttttatcctcttttttttttctcgtccttaccctttagattcactcatgggatatccgatatcaggtgcttgtacattctttggttcaacttgtgataatagttcatcgcccccctcttttcgccgaaaaaaaaaaaaaaaacatgttatctccagcaggtacctcgtgatatatgcttaaagcctcagatgtctccaatctccatgcaccaggtcattgttgccttaagcaagaggcaaatgcttagcagattcactgttccttcacaccttcctgctttttctttctcatgtcgttccatggtctccgacttcaacggcaaggccacaccactccatgacctcgcacgataggccgctgcatagcatagaatgaggccttattcggaggccttattcggttgtatgaggctttgttgggttgcacgtgaattgaggggttaaatctcttatgttcaattttgactagcaagagatttaatctctctaattttcttcaatctccctctaaccgaataaggtctgaaggaacgacgacagaacatacgagaacacattattctccatagaacatacaaagatgtagccgaaatttcctacgaaactcgagcgccgctatacctagagtatagttgaccagatgggtcggactatatgagccggcacgatgcacgatcattttgatacgacatgggcacgacatgacacaatagtaatcatgtcaaagacggcacgaggcttgccataggccatgcttgggcttgtggacaagcccatcggcacatcgacacaactcattttttgtcggctcatttagaccgatgctagccacagatggcctatcagactgagcaaacacaacccatttgtggctcgatcttactcgtccaatctagcccatcatatgcgcacatatgaccgactcaaccgccgctttcaagctattttcgagctatgttacaaaaaacagaaaatgagcaaaattattttcgagctctgttacaagggagaccg

SEQ ID NO: 4943 - DNA, 3100 bp, Zea mays
tttctttcgagatatgtttccaaaaaaaattcaccttattaatataaatactttattaattatattaaaccttagagcctgtgggcacctccgagccgcccgggcccgcactagttccctctccaatcacgaattcacgattcacgccgcacgccccgacgccccgacgcccgcagccccgcatccgcacttccgcaggccgcagcgcacaggagtcccgatctcgactcccgactcgaactcgacgactcccagtcccagttcctctcgtccgcaaccgcaaaatccaagaccctggccgccggagccgaactgccccgcgcctcgggccctgcccgatttgtgtgctttgcggcctgtgggcatgctagccagccggcggcggcaccggagtccatagcagcaaccacgcggctacgagctacgacgggctggctaaggcgcaggttgagcgctgaaggctacccagctgtggtctcacgcgggtggccggtgagagcagccaagcggcaggtacatctcccctctgccgctccaccctccgaggcggccctccctctcaatccctccagcatctggtatctctctattatctgtagaatcataaatctaaaaattatagattattcacaattaaaagtagaagtgtactatgtaatgttattaacaattttatgtgaaacatgcggcttaatcgtcgtatcaattagtttttttttaaaaaaaaattgtagctactttccgtcgctggctagagtcctactctttgtcaaattctaggtgcgctggacgctggacgaaccctaccacgcgcaccgtcacgttgtggtctgtctctccctctacctccattcccccgcgatctcggtttctgttcaattttcgcgctcccttcccctcgcatatgacactctgtgacattgcagaattgaatcactctctggtgatgggcagcctgagcgctccgccagtgctgtcgccgctcgtttctgggctcatcttttcatctgacagagtcctcaaatctagaggtgcacgcttgttggtttattatattttttgatgttgctgctcctgccagccacgacgagttcctaaggtttgttggtctctgtttcatagaatctagcattgcttcctgattttcagggttaactaccagtagcgtgatgaagtcatgtaggctatccgagctcagcaatgctgaggttagcagcctcaaggctcgtcctcgcatcgattcctcgtccatgtccatatttggcacggtgagatgacagatgacaccaggattactcatggtgttgaagtccagtatgttttcatttcatagtttaataatcatgggattctgttctgtgcaattaggtgaatccaattgttgagggtgtctgtgtcagaggtgatgcagcagataagcagtaagtgttactgttatggatggccttttcttggatgactgggagattgtgcttacttttttgggtttggtctttcagctacacaaaagtttgctttctctgtgttgcactatgtccttaaatggtacccaaaaaaaatcctcttatttattgtcccaagcaagttggtgtaactaccaggggtggagctttgtttagaccaaattgggccatggccccctttaaccttgaaattttattaaaataacacttaattccaccacttacgtgctgatgaatttttaatctagcccccccccctaattagtgcctgaagtttgatggccccctctcaatttcgagttcaaaccctgccactggtagctactacatgcttaaaacagttttaaataaagaaaatgaaaatagttgaatcaacctatttctaaacaatatatgctttggggcatccaattttgaccatagggataaaaagcattgatgcattgtttttcttatttgcaacaactacaacatttaatcaaaccattaatgtctagaatttgttttggaggatatctaaagcatggaagcacaactcaaggtctagtgatattattttaacattgccaattaaatattctttatatgcattagtgttaacaaagtatcagtttagttttgaccaattgtttcctactcttagtttattatcaattcatcagcttgttagcttaagcaccaaaggtttatcaaattagcttgaggcaagaatatatggttccctttttctattacattcttgtggtgaactatttctctgcccctgagaagtacaatggtttgatacctctactttattctaggtaccaggtgaaaaactgcagatggaggccaacttttgccttggagactgatgggccatctaacactgatggccaagactttgatgaggacagtggttttcttggtaggactagactgggaagactcatccaagctgctgcaagggagctacttgacaagctgaactctgcgagaaccaattcgccaacaaagatattccttgtcctccttggtttttacacagccaatgccttggcaacaatactagggcagaccggtgactgggatgttcttgttgctggtgttgtagtggctgccattgagggaattggcatgctcatgtacagaaaaccaattgccaggcctcctggtaggttccaatctttgatttcaatggtgaactactggaaagccggtgtatgcctgggcctttttgtggatgccttcaagctgggtagctgagtttatacaatcatctgctgctatctgcctatggtaattttttgggtatattgggatcacaataacgccatgatatggttccatgatggccattgctcgttgctcgaattctaatagctgcatttggctctaattctgggagcattggctgctgaggtatcagatttcttcaaagttaatgaagatgtttggagcagatattattctgaggtgactattcatttttccataatcgaaggccatgtttgtcaaccattgtttggcccgtaaactgtagatatgctgtagtttttccacctccatgtcatttagccctaatatgcatttatgcgtactgagagaagttaagaaaaaaaataaaccaggtccggctttaagggcatgttgggagc

SEQ ID NO: 4944 - DNA, 1490 bp, Zea mays
cacgattcacgccgcacgccccgacgccccgacgcccgcggcccccccgccgcccgcccgccggccgcagcgctccggagtcccgatctcgactcccgactcgaactcgacgactcccagtcccagttcctctcgtccgcaaccgcaaaatccaagaccctggccgccggagccgaactgccccgcgcctcgggccctgcccgatttgtgtgctttgcggcctgtgggcatgctagccagccggcggcggcaccggagtccatagcagcaaccacgcggctacgagctacgacgggctggctaaggcgcaggttgagcgctgaaggctacccagctgtggtctcacgcgggtggccggtgagagcagccaagcggcaggtgcgctggacgctggacgaaccctaccacgcgcaccgtcacgttgtgaattgaatcactctctgttgatgggcagcctgagcgctccgccagtgctgtcgccgctcgtttctgggctcatcttttcatctgacagagtcctcaaatctagagggttaactaccagtagcgtgatgaagtcatgtaggctatccgagctcagcaatgctgaggttagcagcctcaaggctcgtcctcgcatcgattcctcgtccatgtccatatttggcacggtgaatccaattgttgagggtgtctgtgtcagaggtgatgcagcagataagcagtaccaggtgaaaaactgcagatggaggccaacttttgccttggagactgatgggccatctaacactgatggccaagactttgatgaggacagtggttttcttggtaggactagactgggaagactcatccaagctgctgcaagggagctacttgacaagctgaactctgcgagaaccaattcgccaacaaagatattccttgtcctccttggtttttacacagccaatgccttggcaacaatactagggcagaccggtgactgggatgttcttgttgctggtgttgtagtggctgccattgagggaattggcatgctcatgtacagaaaaccaattgccaggcctcctggtaggttccaatctttgatttcaatggtgaactactggaaagccggtgtatgcctgggcctttttgtggatgccttcaagctgggtagctgagtttatacaatcatctgctgctatctgcctatggtaattttttgggtatattgggatcacaataacgccatgatatggttccatgatggccattgctcgttgctcgaattctaatagctgcatttggctctaattctgggagcattggctgctgaggtatcagatttcttcaaagttaatgaagatgtttggagcagatattattctgaggtgactattcatttttccataatcgaaggccatgtttgtcaaccattgtttggcccgtaaactgtagatatgctgtagtttttccacctccatgtcatttagccctaatatgcatttatgcgtactgagagaagt

SEQ ID NO: 4945 - DNA, 1844 bp, Zea mays
  misc_feature (697)..(697): n is a, c, g, or t
gggtaccctccgggttcggccgggtataacaaaacgcgtgggagctattgagatcgtgcgtgctgtacgtgcatcctccatatgtcgcttagaactactgcttggctatcggccaggccagggcaccaccagccggtgcagtgtttgtcggcgccggagaaaccacgccgccggtcggcgaactaccagcccacgtcttgggactacaacgctcttctgtcacttgattctggcagacctggtgatcaggtccatccttctagttattataagatgaagagaaggataagagatatgttgctcaagaaagtagaaccatcttctaaacttcagactattgatgcaatgcaacgacttggaatctcttaccactttgaggatgagattagtaacatcctatactccgtctccaatgagagtaccaaagctcagtacacatatgacaacattgctttcacagccttaaaattccggttacttagagaaaatggtttcccaacaatcctaggaccattaggctaccataattatgaaaaattcatcacaaagacaccaagtctggaggacgcaaacacacttctattactatacgaggcctcatatctggcatttggagatgaggaaaaattggatgtagcaaggacattttcagctaaagcacttaagcaacttatgccgttcatgctaccacacttanagggagggtgtggcacattctttagaacttccactgcattggagagcttcaagactagaaacaagatggttcattgattactatgctagagacagaaacatgtgccccttgctactccaatttgctgaaattgacttcaaccaggttcaatatgaacatcaaaaagatcttgcagtagtgacacggtggtggaagaaaattgggcttggtgaaaagttgccatttgcaagggatcgtctgatggagtgtttccattatgctaatggagtccgttgggatccaaagcttggaacatgtcgtcaaatgcttgctaaagtttccaatctaattgtttacttggatgatctttatgatgtatatggaaccatagaagaacttgtactcttcacaaatgcaattgcaaggtgggatgcgataccaaatgagacacttccagagtacatgaaagcactttattctattatatatgacacatcaaatgaagttgctgaacacgctttgaagaaacatggttgtagtatgcattatcttctacaaaaatcgtggtatgacatatgcctggcatttttggtggaggcgaaatggcaccatggaaactatagaccaagcattcaaaagtatctagagaatggatgggtatcatcttcagcaccattgttgttgttacatgccttcgcaatgcttgattcagttgtcaacatgagtacgatatcccctttgcaaaccaaactgagattagttcaacatgtttccttaattttgcgtctctgcaatgactctgcaacacacttagatgagttgggaagaggagatgctccatctttcatagctttacacatgatcgagaatggtggtaatgagaatgattctcgtaaggccatgcaagagcatatcttgaagtcatggaaagtaattaatgaggaggcatttgatagttgccagtattctatgccctttaataaagcttgtattgacttggctcgcatttcacattgtgtttatcaaggtggagatggttttggtacaccaaatggtctaaagaagaaacaaattagagatttgttcttggatcccattgatatatgtaataaacaataatatataaagatttattgagaatacgaagataatagtttgttagtgaaat

SEQ ID NO: 4946 - DNA, 888 bp, Zea mays
cccccggccgggaccgccctgtcttgtgctgagctccgtatctcttttctttaaacctcccatcagcctctccctccctctttcaaccatcaaccatctcccctcacaaatcaatcacaatggcctcttctcgtgtctttgcctctcgcctggcctcccagatggccgtcaaggccgctcgccctgctgtccgcgccaacgtcgctgctgccagcaagcgaaccatctctggcgtcagccccctccaggccatgaagcgtcagactcttctccaggccaccacccgcaacgccttccaggtccagcgccgtgcctactcctccgagatcgcccaggccatggttgaggtctccaagaacttgggtatgggtgccgccgccatcggtcttaccggtgccggtattggtatcggtcttgtcttcgccgctctcctcaacggtgttgcccgcaaccctgccctccgtggtcagctcttctcttacgccattctgggtttcgctttcgtcgaggccatcggtcttttcgatctgatggttgccctcatggccaagttcacttaagttattacccaacccattgggtagactcgtgccgaatgatcgagtcaacgacacggaggaggctgctgagcgttgtgcattaaactgtgtcttgaaaaattcgacacgggtgcacctgacgccagcttgcacgatagaagggggaggttgtcttgtaatagacgggatagagaactgggatggacattgatcatagacacttgctatgattagagttggggaaattctgcataattcctcccagggatcgacttgtaaaataaaaagcctcattcatcccgaaaaaaaaaaaaaaaaacccgcggccccttttttcatcacccaatga

SEQ ID NO: 4947 - DNA, 1793 bp, Zea mays
ttttttttttttttttaaaatcatcagtggaattccttggatatacccttgaagtttgaacgtagaatatgcagtttttggagaactggcctctcgggacaataacatcatgaactgatccgtggaatcttcgaaatcaccttctgatccggtgagttccggattcaacagatcccatacttcctggatagcatgcagctgaactgtctgagcgcacttgtgacccttgtcccatttttcagcgcaatattgacacagacctcaggcatgacgataagcacgaagggatgcgagcttgtcagtagaagaacccggctgagggaccacaggcttggtggcgacagtttcccctcccagcgatttatcccacctaggaggaggaggagcaggtaacttcggatatgaacgccctgggaacgcaccctccgacccacgatgctaacgacgccgggatgaatctgcctcttcctgtaacaaagcaagagcgcaggcagtatccatccaaagtgctggggcgttgaaccaatataacagatttaatatcgtcacggaggccatcaatgaatttcatggtataatacaaaggatctgtagtgtgctcataggtgacaaggacatcaataagttcacaaaaacgatcaacataatcctggaccgaagatgtctgacggatatggaacagcttgcgaataacaagctcgtgttgttcacgcccaaaacgatcgtgcacagcttgacaaaactgttgccatgaccaggaagacacttgtggttcaatagactgaaaccaacacccagcaaccccctcaaagtgcatggacgctactctgacccaaacagtgatttcagtggcatacatagcaaaataatcctcgcatcgtttctgccataattttgggctagtaccgtcaaacttgggaaatgaaagcttgggcaaatcccctaactgacggtgcaagggaacatggccactatgatcatactgagtaggaaacgtaaacgaaggagaaggattgttccacgcacccgtgaccgggcagcggaaattgggttgattatacccaataccactgtcccggtgaaaaattgcagcgccgggcccaaaacgtgagcaatcggtgttgtcgaaggtagcaggggaacgcccaatcaccgatctgggggttccgaggatgccggctgcgccgaacccgccggaacggctgttgggaggttgttgggtcacgatctgcgcgatgtcggcgcgaatcgtctggatgttggcatagagcccgtcaatcgacgcatcgatttggggccgccagagctcaacggcttgagaagacgactcgagcgccgcgacacgggagatcgtactcgcctccagatagcggatccgatcatccacagcttcatcggctgtcaccaaacgggcctccaggtcttcatggatccccctggagaacgactccaaacgcctggtggaatcggccacttgagtctccaggattcccacgcggtttgcccacttggagtcgatggcatggatgcgcttgtccaattcagacagcagggagcgcgtttgagattccaacgcgagggtgagctgggcatcaactgcgcctgtggtcgccatgcgagatccaaggatcgacggacttctgataccaaatgttaacctatctaacagaacagaagcacacaggaagcagagagagggagagatacggaggaagacggagtaggcagtctattattacaggaatatgtttttgctttttttgattaggatgttctaggtaatggtctcgtgc

SEQ ID NO: 4948 - DNA, 2731 bp, Zea mays
cttcgggttcgcgtcgcgagtggtacatacattcctataataagcagtcccaaaaactcaaacttctcgatcaggttcctcttcttcttcggcgcgcccgtctcggtggacgccacaggaattggctcctgacttttttccacaggtggtttcgctgggcccgatgcccgacgttatggccgcagccctaaccggcttctcgcctcgcggggtgattccgagcagaggcagagcatctcttcccggggtcgctagagcgtatgccgagaggcggttggttgcagaaaacacaagcctgccaaacatgcataaggaagatcttgagactataataaggaatcagctccggaagccccagttgccaccttcttcatacgacacagcgtgggtttctatggtgccagtgcggggctctcatcagactccccgcttcccacagtgtgttgagtggatactgcagaaccagcaggatgatgggatcttggggtgtcagccaatctgactcatcggtcagcaaggatgttctcctatccacgttggcatgtgttcttgcgttgaagagatggaatgttggcagagagaacatttggagaggactgcatttcatcgggaggaatttctctgttgctatggacgagcagttcacttctcctataggtttcaacttcaccctttcctggtttgcttagcctcggcatttgatatggggtttagaatttcctgtaagacaaactgatgtctgtggcattcttcaccgccgggagatggaattgaaaaggctggctgtggatagttcttttggaagaaaagcatatatggcttttatcccagaaggattcggaaatatgctggactgggatcaagttatgaagtttcagaggaagaatggatcattgttcagcactccttccacaactgctgttgcattaatccacaaatacaacgaccaagcccttcaatacctaaatttgcttgtcagtgaatttggcagtgcagtaccagcaatgtatccttcaatggtacattgtcagctttcaatggtggacgcgcttgaaaaaatgggaatttctcagcgctttgtcagtgaaatagaaagcatcctggacatggcatacaattgctggttacagaaagatgaggaaatcatgatggacatagcaacatgtgcaatggcatttcgccttttgaggatgaatggttacaatgtttcctcagatgagctgtctcacgttgctggagcttccactttccatgattcactacaaggatatttaaatgatacaaaatccctactggaattgtacaagacctcaaaagtcaccttatcagaaaacgatatgatcttagatcgcataggttcctggtctggcaacttattgaaggataagatgtgctgtagtagggtgcaaaaagactcgatttttggagaggtgctgcaaaaaaaatttaaattctcattttcacctgggaggttcagtttatgtctgtgttttgtgatttcagatggagtatgctgttaattttcccttgtattccacactggagcgtctagaacacaagagaaacatcgaacattttgatgcttggggttctctgatgctaacaacaaaatcctcatcttttcgtatcaatcaagaattcctagctttggcagtcgaagatttcagtttctctcaacgtgtttaccgggatgaacttcggcatcttgatagttgggtgaaggagaacaagctggaccagctacaatttgctcggcagaaactgacatattgctatctgtctgctgctgctaccgtattttcttctgaattgtctgacgctcgcatttcatgggccaaaaatggtgtcctcacaactgtggttgatgacttcttcgatgttggtggatcaaaagaagaattagaaaacctgatagcactagttgagaaatggcatgcgcaccatgcagttgagttctattcggaacaggtgaaaatagtattttctgctatttatacaacagtgaaccatcttggagcaatggcttctgcagcacaaggccgtgatcttacaaaccacctagtagaaatatggctggatttgttaagatctatgatggtcgaggcagaatggcagagatgccaatatgtaccaacagttgaagaatacatgacaaatgctgttgtctcatttgcactgggcccaattgtgctcccagcattgtattttgtagggcaagagctattagagcatgctgtcaaagatgaagagtacgataaattatttaggctagtgagcacttgcgggaggctcctcaatgactaccaaagtttagagagggaaggcaaccaggggaagctgaatagtgtttctctacttgtgctccacagtggtggttctatgtccatagaagccgctaaaaaggcaatgcagaagtccatagacgtgtctaggagagacttgctaagattggttctcaggaaagaaagtgctgttcctaggccatgcaaggagctcttctggaagatgtgtaagatacttcacctgttttactctcagaatgatggatttagctccccaaaggaaatggtcagtgcagtgaatgctgttatcaacgagccactcaaagtccaaaatagtactacgtttttgtctagttcatcaaggtagcgaggatatcatgtaatttatcctgttcatatggatcagaagcaacagcagcaagcttaagatacaaaaaaaaaatataagg

SEQ ID NO: 4949 - DNA, 2450 bp, Zea mays
actggagcgtctagaacccaagagaaacatcgaacattttgatgcttggggttctctgatgctaacaacaaaatcctcgtaagattttattttcacagaagtacatctcatcagttttaagtagtttagatgctgcgtaccaatgttgtacactttgctgtatcagatcttttcgtatcaatcaagaattcctagctttggcagtcgaagatttcagtttctctcaacgtgtttaccgggatgaacttcggcatcttgataggtaatctaaatgccatatgttcacttttattttaaattttctcccttgggtaaattgattaaatttgttgcaacagttgggtgaaggagaacaagctggaccagctacaatttgctcggcagaaactgacatattgctatctgtctgctgctgctaccgtattttcttctgaattgtctgacgctcgcatttcatgggccaaaaatggtgtcctcacaactgtggttgatgacttcttcgatgttggtggatcaaaagaagaattagaaaacctgatagcactagttgagaagtatgtctactcttttatgaagtaacactgatcacttatgcatggctaattaatctcctgtttctggctgatggttttcatagatggcatgcgcaccatgcagttgagttctattcggaacaggtgaaaatagtattttctgctatttatacaacagtgaaccatcttggagcaatggcttctgcagcacaaggccgtgatcttacaaaccacctagtagaaatagtaagtctgatgtgcgtcccaataatcttgcattcggttatgttaagcactgacaactgagaacacatttgcagtggctggatttgttaagatctatgatggtcgaggcagaatggcagagatgccaatatgtaccaaccgttgaagaatacatgacaaatgctgttgtctcatttgcactgggcccaattgtgctcccagcattgtattttgtagggcaagagctattagagcatgctgtcaaagatgaagagtacgataaattatttaggctagtgagcacttgcgggaggctcctcaatgactaccaaagtctagaggtatttgaacccgttcacacataaaagacatgattgtctactatattagcatatctgctcgaatttttccatattttctcactttatgctctagaattcacacagcattaaacaaaaactccctttttatttctaaaatgtgtaagattacaagcaccacaaagttatgaaaaactcacttatttatgaaaataaagatttatgatcatgttctgtttctggttatagctattatacttgacaagggtactgttgattgttgaaccatgatttatatattcactataagcttgctactggaagattcttacaaaatctttgatccatggctgcagggcgaaggcaaccaggggaagctgaatagtgtttctctacttgtgctccacagtggtggttctatgtccatagaagccgctaaaaaggcaatgcagaagtccatagacgtgtctaggagagacttgctaagattggttctcaggaaagaaagtgctgttcctaggccatgcaaggagctcttctggaagatgtgtaagatacttcacctgttttactctcagaatgatggatttagctccccaaaggaaatggtcagtgcagtgaatgctgttatcaacgagccactcaaagtccaaaacagtactacgtttttgtctagttcatcaaggtagcgaggatatcatgtaatttatcctgttcatatggatcagaagcaacagcagcaagcttaagatatttgtaagtttgtgactgggctgctgtggatctgtgaagctacaactttgctgtatgtggatcaaggtattaggaagatctggttcacatattgataacataatggataaaccataacgttaaattatgtttgcttaatttcaaccgtaatcgataccacactagaaatgaatatcggcttattcaaacttgttaccatcggtattcgagtgtgaatcattactattaccatttaggttatatttcgtgaaccaaacggcacatgagtctttgacagtgagagtgtagttattagttaaataggcacacaatacactagttaacgtgcgagtaaaggattatgaatcattattacaagacccacaaaacaatcgaataagagtgagccgtatgtccttgtgtatcagcatcaacgacacgtttgactgctctcgtgtttgttggttgctgatcagtactgtagcaacaatagaatttgcaaaattttgtcgagaatttgcagtatccttaccaaaaatccgcaccccatccgtagtctttctctgtttccccataacataaatagtaagctgtcttatgagctcatattttgtgaatttatataaggattatgaagtgc

SEQ ID NO: 4950 - DNA, 3319 bp, Zea mays
tgttcttattatgcctgcgacgaatcttccacgactggtgtcctgattgctatctgattcctttcttccaacagcgtatgccgagaggcggttggttgcagaaaacacaagcctgccaaacatgcataaggaagaacttgagactataataaggaatcagctccggaagccccagttgccaccttcttcatacgacacagcgtgggtttctatggtgccagtgcggggctctcatcagactccccgcttcccacagtgtgttgagtggatattgcagaatcagcaggatgatggatcttggggtgtcagccaatctgactcatcggtcagcaaggatgttctcctatccacgttggcatgtgttcttgcgttgaagagatggaatgttggcagagagaacatttggagaggactgcatttcatcgggaggaatttctctgttgctatggaccagcagttcacttctcctataggtttcaacatcacctttcctggtttgcttaacctcggcattgatatgggtttagaatttcctgtaagacaaactgatgtctgtggcattcttcaccgccgggagatggaattgaaaaggctggctgtggatagttcttttggaagaaaagcatatatggcttttatcccagaaggattcggaaatatgctggactgggatcaagttatgaagtttcagaggaagaatggatcattgttcagcactccttccacaactgctgttgcattaatccacaaatacaacgaccaagcccttcaatacctaaatttgcttgtcagtgaatttggcagtgcagtaccagcaatgtatccttcaatggtacattgtcagctttcaatggtggacgcgcttgaaaaaatgggaatttctcagcgctttgtcagtgaaatagaaagcatcctggacatggcatacaattgctggttacagaaagatgaggaaatcatgatggacatagcaacatgtgcaatggcatttcgccttttgaggatgaatggttacaatgtttcctcagatgagctgtctcacgttgctggagcttccactttccatgattcactacaaggatatttaaacgatacaaaatccctactggaattgtacaagacctcaaaagtcaccttatcagaaaacgatatgatcttagatcgcataggttcctggtctggcaacttattgaaggataagatgtgctgtagtagggtgcaaaaagactcgatttttggagagatggagtatgctgttaattttcccttgtattccacactggagcgtctagaacacaagagaaacatcgaacattttgatgcttggggttctctgatgctaacaacaaaatcctcatcttttcgtatcaatcaagaattcctagctttggcagtcgaagatttcagtttctctcaacgtgtttaccgggatgaacttcggcatcttgatagttgggtgaaggagaacaagctggaccagctacaatttgctcggcagaaactgacatattgctatctgtctgctgctgctaccgtattttcttctgaattgtctgacgctcgcatttcatgggccaaaaatggtgtcctcacaactgtggttgatgacttcttcgatgttggtggatcaaaagaagaattagaaaacctgatagcactagttgagaaatggcatgcgcaccatgcagttgagttctattcggaacaggtgaaaatagtattttctgctatttatacaacagtgaaccatcttggagcaatggcttctgcagcacaaggccgtgatcttacaaaccacctagtagaaatatggctggatttgttaagatctatgatggtcgaggcagaatggcagagatgccaatatgtaccaacagttgaagaatacatgacaaatgctgttgtctcatttgcactgggcccaattgtgctcccagcattgtattttgtagggcaagagctattagagcatgctgtcaaagatgaagagtacgataaattatttaggctagtgagcacttgcgggaggctcctcaatgactaccaaagtttagagagggaaggcaaccaggggaagctgaatagtgtttctctacttgtgctccacagtggtggttctatgtccatagaagccgctaaaaaggcaatgcagaagtccatagacgtgtctaggagagacttgctaagattggttctcaggaaagaaagtgctgttcctaggccatgcaaggagctcttctggaagatgtgtaagatacttcacctgttttactctcagaatgatggatttagctccccaaaggaaatggtcagtgcagtgaatgctgttatcaacgagccactcaaagtccaaaatagtactacgtttttgtctagttcatcaaggtagcgaggatatcatgtaatttatcctgttcatatggatcagaagcaacagcagcaagcttaagatatttgtaagtttgtgactgggctggtgtggatctgtgaagctacaactttgctgtatgtggatcaaggtattaggaagatctggttcacatattgataacataatggataaaccataacgttaaattatgtttgcttaatttcaaccgtaatcgataccacactagaaatgaatatcggcttattcaaacttgttaccatcggtattcgagtgtgaatcattactattaccatttaggttatatttcgtgaaccaaacggcacatgagtctttgacagtgagagtgtagttattagttaaataggcacacaatacactagttaacgtgcgagtaaaggattatgaatcattattacaagacccacaaaacaatcgaataagagtgagccgtatgtccttgtgtatcagcatcaacgacacgtttgactgctctcgtgtttgttggttgctgatcagtactgtagcaacaatagaatttgcaaaattttgtcgagaatttgcagtatccttaccaaaaatccgcaccccatccgtagtctttctctgtttccccataacataaatagtaagctgtcttatgagctcatattttgtgaatttatgataaggattatgaagtgccgtcacgactgagattttcttgctatccagctagtcacacttctgcactgcacatgcttggctgttgtctccaaatcaaacaccgtcaaaagaatgcatcttgatcagagataacaaatcctactacagcttaacatcagagataaaggtctccggagtaggcgtgagcatcaagttagcatgcttggctcaaaaataattgggcgaaaggtctgaaagtggaaagatggcaagctgcaggcatgc

SEQ ID NO: 4951 - DNA, 775 bp, Zea mays
ggcgattgggttcctcgaggccggccggccgccaaaaaaaggtcttccaaattgagaatttctcgatcgccatccaactaaccgcccaaacaccacagccaagatgacgaagggtacctccagcttcggtaagcgtcacaacaagacgcacaccctgtgccgacgatgcggtcgccgctctctccacatccagaagcatgagtgctcttcttgcggttacccttctgccaagatccgcaagtacaactggtccgagaaggctaagcgaagaaagaccgtcggtaccggccgcactcgctacctcaaggatgtgtcccgacgattcaagaacggtttccagactggcacacccaagggcgctcgtggccttactgccgagaaggcctaaatgggaccgcatcccttctgaccccctccaccacctctccggccctacccctcttctatcacggacgtttgaaacacccattccctcgagcacgcacacatcaacaatgacggctctctcatagcgtgagctgagaccgtaggggaatatggttggaactggagcaaggcggtgactgggacgggcggctgtgtttgttggttcgtggatgaaggacctctaaaggggtggcttggagcatgggcacggtgttttacatgtttgagcaaggaagtaaaaaaaagaacccctttgctcttcagagattccatagggtttcgggttacgaggttctgaaatggcatcttgattctgcatgaacaaaaaaaaaaaaaaaaacccgcggcc

SEQ ID NO: 4952 - DNA, 10003 bp, Zea mays
  misc_feature (2216)..(2216): n is a, c, g, or t
  misc_feature (9996)..(9996): n is a, c, g, or t
taaccacttatcttatcaaaaaataatgaaaaatcaaaaaagtaagtcatatataaagtatatttgataataaacaaaataacaataatgattttgaggccgaattgatccaaaattcgttaataatacccaggggtggatctacacccgagctacccggtctgtgatcgagggtatgatccaattaactttatataagtacatatttgatctagttgaaaatagtcaagataaaaagaaatcgagggtatgatccaattaactgtatataagtacatatttgatctagttgaaaatagtcaagataaaaagaacagaagaaaatttagtagtctcagctcgggacatgggacatgagaaaattctagatctgtccttaaccataccgatcgtcgggtactcgggtcgcagatcgtagagggaaaaatgcaatgtgtgacgatcacacccttgtcaccttttccttagaaacgccgaaatggtagaagaaaagaaacggaattttctgaataagcccttcagaaaaaaaagacacaagcttcctcgatcaagtgatgaatgagtgatctggagacgagtgtacgaggaccgcgtccacggaatccccaaccacctcccatcacgcccacgtcagcgccgtcaccttcccgcagccctcgcatagtcgcatcgcactcaaactcaagcaaacgaacccccgcaccggacggataggtttccccgtccgacatgtgggacttacctatttgaccccacctgtcagtaaagttacccggataacgcggcgtagctgtgatctcctccccctcgcaagtcccgcgtttaccagtggaacatttttgggtcggcctccacacgcaagcctcgccaagtttttaaaacccccgagctgaaaaaaaaaacacaaggtaaaaaaatatagggagagaaatctctcgcctcccgtcggagagtatcggtgaccgatgtgtcccgacggcggcggaagctgagggaggtcctggcggcgtcgtcagctcaggggtggcgctgtggcaacctgcgcgcgcgcggttttggctaccgagaggcgggtcgggcgtcggcgggatggcggcgtcgctgaggtggtggtggtcggcggtggtattttcggtggtggtcggcgtgatcccggttgtcgccaacacggagggtatgcgtatgccactgcttcatgcaatttgtgttttgttttcttcaaggcttgacgagttgcccacagcgagtgaattcccttctagggggcgataatggctgaaaatctggggatgtcgtccagaaacccctagtgtttgttatcgttctccaagcctctgttggtgggcggggactaaacaggggatgaaacggtagcctacagttctcatttccagcgctttgaccgattgctttgggggcgcggggtgtttgtctctcctggtgtttttgtcattttgtactatgcagcaatgtttgtatgacatgacttaccctgttacatctggaaaggcgattgcacaaaactcgttccggaacaaatgcagcctatgcacagaagtgtagattctgttttctactcatgtcagcgtctagaactattttgggcctcgatattccaaaggaactattttaggctctgtcaaaattgtttccttcaagtttttttttctatgaaggtgcatatgcagggttttttttcctgatgcaaaactttggcctttcattcactactacacagtaaatttccattctgtttcaccattgcatctgaactaagatgattgtttttgtttatttggctaaagatagcacattagtactcatggaagctggaggaaagaaattctgattaccgaacctttgctgtttgggttggtacttagttacaaattcctaattaatttgttctggcatcgtagatatgcactgatatattaacggtaaattgttaacgaacaacctgtacttgctatttaaataaagtggtgccatttagaatgaactgaggctgcataacgaaaaaattaatgcgtacgttactttcttaaaactaaatgtcttgcgaactaattgcgaagaatcggaaagcatggtttaatcattaagagtgcattgtttatagaatatttttttatcattcttcccagtacatgtgttgaaagaaaccatgttgtcttaaaatgctaatggtttttacctggtgtctgaatccttgnaatggatagtacatttgggtatgtactcatgattaaaatatgataccaccaaggtaactgaacctttgtaaggacagcagaccgtgcatatgaccgtgcaaaacactgtttttttgcactgtagactacactgtttatagagtgaagtttgaaataagagatgtggatgagtaagctgctgaatatagagtgctcttgatgctagtcatattatgtgttgaatccatgatgcttaacatttgatactctagtcttttctacctattgaaaagggtattgtctgccgaagtaaaagatctgcataagtcaaaataaaaagagtgctcttgatgctagtcatattatgtgttgaatccatgatgcttaacatttgatactcttttctacctattgaaaaatgtattgtctgccgaaataaaagatctgcataagtcaaaataaaaactagaatttaaccacatataagatcgttactaacggcatattaatgaaggggaaagcttatgcatcctattaaatgtcttgtgtgtagattattgcttattgtgatgatacctcaatggcaggtgatgctctatacagcctacgacaaagcctgaaagataacaacaacgtgctgcagagttgggatccaactctggttaatccatgtacatggcctccatgttacttgtaaccctgataacagtgtcatcagactgtaagttgatcaattatcttgctcattctcccttggaggtgaaagactgaccatttgaatattgtctgtttcccttttgctagtgatcttggaaatgcacaactatcaggtccattggtgccacagcttgggcaattgaaaaatatgcaatatctgtaagtttccacatccatggttttgataactgagctaatagttccatgatgacgtatagctgtatctttcaatcccaatattgatttagcatgattgcttagtttttgtggagtttctgaaacatgtgtgcatgcttttgggtgcatagtctccctttgtctgacgcccaacagttctcactcttactagttcttaccgtatactattttccaataaatattgtaccctccagtagcctaaaatatataggctgtcttcatgttgaatgtatgtttcatcattttgcaacagggaactttacagtaacaacataagtgggccaataccacctgaactggggaacttgactaacctggtcagtttggacctgtacctcaacaacttcactggcggtattcctgacaccttgggccaactatcaaagttgcggtttctgtaagttaattcaattgccctggcaacagaagtgatatattcatgtggtactgtccatcaatacaggttgatcctgttagtataaattatctggttgttattcggtcttggtcatgatttatctgacaatgatgtggagaaatagaaaattcttacataacattaatatatgcatgatgtgcccattaatagatttgcacaaagttttcctccaaatgcactcttcagtttgtgttagtagacactaaggttttcataacttcagtcattcacttgtccgtttgtgtctccttctcttgattcttaaaatgaaaggcaaaaggcaaaatccattgtctagttcttgtcttgttacttattacattatctataagcttatctattgactattggagggattgtaacatttttatttccttggatatctacttgcaaggacagccgtcttaataacaacagtctttctggtcaaattccgaaaaccttgaccaatatcaacactctccaagttctgtaagttacctgttgcccttttatacatcattacagctgtccaggatggtagataacagcaaaagtgtttttgacaatcttgcagggatctatcaaacaacaatctctcgggaggggtgccatcaagcggttcgttttctctctttacacctataaggtaatctctggatgaattttggatgcttagttgcatcttctgatgcagctctcctgccagttgaaaacaaaaacctgtgtcttatgatgttgacaactctgaccctttttgtaacagttttgctaacaacccaaatctttgcggccctggtactacaaagccttgtcctggggctcctccattttctccaccccctccatacaatcccccagcaccaacttcatcaaaaggtacggtgattggctgtatattccgtcataccatgctactgtatgtgatatgcataagagcgaagcactggcacgatcaaactctggtacatgacatatcctgactgggttaattctgttctgttccctcaggcgtgtccagcactggagcagtagctggaggcgttgcagctggcacagcgttgctgatcgcagtgcctgctattgggtacgcattgtggcggaggcgaaaacccgaagagcaattcttcgatgtccctggtcggtattatagttatacaccacagtgcggttgctgccatcttgtgctattcactcatttcatctatatgtggtctcctttccattcagccgaggaggatcccgaagttcaccttggacagctcaagaggttctcgctgagagagctgcaagtcgccacggacaattttaacaacaggaatgtcctgggaagaggcggttttggaaaggtgtacaaagggagactaacggacggttcactggtagccgtgaagagattgaaggaggaacgcacccccggcggagagctccagttccaaacggaggttgaactgattagcatggcggtgcacaggaaccttctccggctccgtggattctgcatgacccctacagagcggctgctagtgtatccatacatggctaacgggagcgtcgcatcgcgccttcgaggtaaccagaccttattctttctcgccgctcaaatcttttcttcggcatttaattggaaacagagtgtctactgttcctgatcctttgattgtctactgttcctgatgctttgatttcgtagaacgcgcgccaaatgagccccccctcgaatgggaaacgagggctcggatcgcgctggggtcagccagaggcctgtcctacctgcacgaccgctgcgatcccaagatcatccaccgcgacgtgaaggccgccaacatcctgctggacgaggacttcgaagccgtcgtgggtgacttcggcctggccaagctcatggactacaaggacacccacgtgacgaccgccgtccgtgggacgatcggccacatcgcccccgagtacctctccacggggaagtcctccgagaagacggacgtcttcggctacgggatcatgctcctggaactcatcaccgggcagagggcgttcgacctcgctcgtctcgcgaacgatgacgacgtcatgctccttgactgggtaggtggagtcgatctttgagtatgagtacactatgaggtaccttgtacctagcctcggtgctaaggcctgagagggagggaagaaagaaatgaagaagctgctgctgctgctgcatatgcttgtggcggggtgttgtgtgcttgcaggtgaaggcgctgctgaaggagaagaagctggagcagctggtggacccggacctgcagggccggtacgtggaccaggaggtggagtcgctgatccaggtggcgctgctgtgcacgcagggctccccgatggaccggcccaagatgtcggaggtggcgcggatgctggagggcgacgggctggcggagcggtgggagcagtggcagaaggtggaggtgatgcggcaggaggcggagctcgccccgcgccacaacgactggatcgtcgactccacctacaacctcagggccgtcgaactgtccggcccgaggtagggaggtagatgatcgccgtcgggatccttgtcgtctgtgaatatgacagcggataggtagcttggtggttggtcctgtctttaatgatagctgcgaaactgtagatgaaattgtgtgctcgtcttctgtaacctgagtacctgacatctctgacattttttttctgatattagagagccgtatgacaccagcctctgttgagccaagccgtttgtttattaataggagtagttgtgttttttttttttggcgatggcgtcccggtccgtagctggcgagcacgtcgttgctgtggctgcgtttgggtgaaggctcgcttcgaacagcggggtgacgcgcgtacgggttagagagcagtgacctgccgactgtatcgtgctggctgctgggcgggcaggcatagcaaagcacagcattgctgcgctgggcgcgcgcgctcaggttgtcagtcatgcatcggtggtagaccccggtcagcccgccgctcaccgatcactcactgctactgcacgtccatgctgggcactacgccactaccaatcccgctcgtggtacggtggtgggccgtcgtttccccagaaacggaccatgcaatctgcaacagtgtcactcatgcagcgcaggcagtcacaagacagccttatacaggtaattaaggacctgttcgcagcgtgagatttctcgtgtttccaacgggccgggattgaagtacaagtacaaccaaacgagatcagcatgcatcacaactcctagtactcatttaacccctagcagtgtagcactagtgtgacactgagagagaacaaacggctactcatatacagtacagtacaacaccgacgacgagtgtccctgacatatatcacatcacatagctttggcgccaaatgcatgcctagctcctaaccaaagatcgacgagtgtccatgcatatgtatgagcagcagtccagtgtcctcctctaggctagtctagcggggaaggcacccgaaagaacctgccgcggcacatgcagcggtaggcgacggggcaggactcggaggcctgcatcgcgcacctgaagctcacgatgacgcgccggcacggggagcacggcccgcacgcgtgcgcgcagtccggcagccgcgaccccgtcgccgccgcgcgctccttgagccaccacagcttatcctcctcctcctcctcctccgccgccgccgccaccaccaccgacggcgacccgtcctcactccggcccgctggtctgtagtaggttgccctgctgctgccgctgctcgcgtgagcaccagcagcagccgatgcctccgcgtggagcagggcggcgtggtcacctgcgtgtggttgttttcagttacacaggcagctgtatgcaatatacatacataggaacaacaacaagaaaagaacgtcgtcagcgtgtgtcgtcgttcggatggcacatgtgctgtgtcatgccatctctgatggtaacgggaggcgcgccacgtcgacctgacacgtcagtacttactgcgctgcgcatgtactctacacgctacagtacgtcggaccgatcgacactgctgcaagtgaagtttgtgcaagcttttccaagttctggaacatgcatggaaggtgaaccgacagaggaatcaaaaaaataaattaagtagctacagcctacagctcagatataatcatgcatcaactcacgtggtgtcgtcgttctggcgccgtcgtcggcaacgacgtgcgacgacgacgaactgacgatgagcagcaggaacaccaacacgaccgctgctgctgctgctggggctgacggagttggagcccgccatatcccgcaactagcagaggactcgcgcattctcattattcctcgctttcctggtagtaggtgctctgtggtggttcgacgagctagtagaacggcaagaaacacaatatgccgaggagaatgaaagagagagaccaaacacagctgctagcaaagctacccagcgatcagagttgggagttgggagttgggacttgggaggggacgcttgtgcttgcatgcgggtatataatagccttaataggacacaggcatgcgcaggcgcatcagagcttggtccaggtggccataaataactggatggatgcatgcgccgggcgggcgatcgatagatcacaggatccccggttggattcacatggatgaacaaccctcgggccggccggccggcccgggcaggaaatcggctgggcatgcaccaagacgatgccgacacgcgcgcgacaatgacgagggcgcgacggaagatagatagcagtagatgtgggcgtatgaaggccgtgctagctcgatcgcacgcacgcctgtgcgcgagggaaagcaatggcgcggcggggcgtggctcgttgcatatttatggctggcagctggctgggtgggtagcttggctctcactctcagaagcgccgcccgggcctcgcagttactacttactagggcgcgccgcgcgcgtcgtcgtcgtcatctcggactcggagtgttttttctcggtgcagcagcgcatgcatgcatgcatgatgcatggcgcttcctctctctctctcccgtggccgcacgcctcagctagcaggccggcgcgtacccagaattcgttgacagggggtggaggtccattgttaaacaaacaaacaaaaaacgctactataatatagcttacttactgtcaaattaagttaagtaggacatatgtggacatcataaaactatacgagtccagactccagattgcttattaactgtagtagtcccggaaggagatatatatatagaagaagaaagccttcttttttatgggtattttgaaaaataaaggcgatatcttaactcccctcttcatgttttaacaaatctgcaagatatatatagtcatatagtatgcttcatttgaacaatagataaattctctctcgtattctctttcttcatttgattaactacctgttatgtgaaaaggaatacggggttcactactagtactactgcaagtttgttgcacgtacaacattcttttcaaaaccaaacacttgattactgcaagtaccagacaactcacaagacttcgtaaacacgcgcgcgcgcacacacaatatatatatatatatatatgattaaatatgatttttattaattagaatgaaacagataaaagttgagcacacattgacatatattttgaagatgcttggtttctagtgactaatttttagtccatacatttaattccattttagttctttaattgctatatacgaaaactaaaataaagttttagtttcagtatttcataatttagagaaaaatagaataaaataaagagactgtaaattagaccctagaaaccaaacaccgatccgctgtccacactaggaccacctatgtatatatagctccaccctgagtacatactcctataaaatactgcggctgtgctgccgttctgtacgttattctgctcttgctgctctcaacaaggttctgaatgcgcgtacaaaattattcttctgccagctcggtttggtttgcatggttaatgaacagacccagtcaagctgaatcagtcggcgtcaatgaatctgtgagctccatatatataaataaatgctaccagtgtaatatataatggaccggctagtaggatgccgacgtgtctgattcgggtgggatagaatatactccctccctgtaatttaaatcaagagacgatttgtattttttagaatacatttcttttcgtttctacttatatacgtttaaaatcatacagtgtatatctcaatatatagcgcaagctatgcatctagaaaagaatagaagttgcattcacagattgatctctatatttagattttgccaactaacacttgatggattgattttagntctactg

SEQ ID NO: 4953 - DNA, 2501 bp, Zea mays
  misc_feature (2466)..(2466): n is a, c, g, or t
ccccggcccggcgggtagtaaaatatagggagagaaatctctcgcctcccgtcggagagtatcggtgaccgatgtgtcccgacggcggcggaagctgagggaggtcctggcggcgtcgtcagctcaggggtggcgctgtggcaacctgcgcgcgcgcggttttggctaccgagaggcgggtcgggcgtcggcgggatggcggcgtcgctgaggtggtggtggtcggcggtggtattttcggtggtggtcggcgtgatcccggttgtcgccaacacggagggtgatgctctatacagcctacgacaaagcctgaaagataacaacaacgtgctgcagagttgggatccaactctggttaatccatgtacatggttccatgttacttgtaaccctgataacagtgtcatcagacttgatcttggaaatgcacaactatcaggtccattggtgccacagcttgggcaattgaaaaatatgcaatatctggaactttacagtaacaacataagtgggccaataccacctgaactggggaacttgactaacctggtcagtttggacctgtacctcaacaacttcactggcggtattcctgacaccttgggccaactatcaaagttgcggtttctccgtcttaataacaacagtctttctggtcaaattccgaaaaccttgaccaatatcaacactctccaagttctggatctatcaaacaacaatctctcgggaggggtgccatcaagcggttcgttttctctctttacacctataagttttgctaacaacccaaatctttgcggccctggtactacaaagccttgtcctggggctcctccattttctccaccccctccatacaatcccccagcaccaacttcatcaaaaggcgtgtccagcactggagcagtagctggaggcgttgcagctggcacagcgttgctgatcgcagtgcctgctattgggtacgcattgtggcggaggcgaaaacccgaagagcaattcttcgatgtccctgccgaggaggatcccgaagttcaccttggacagctcaagaggttctcgctgagagagctgcaagtcgccacggacaattttaacaacaggaatgtcctgggaagaggcggttttggaaaggtgtacaaagggagactaacggacggttcactggtagccgtgaagagattgaaggaggaacgcacccccggcggagagctccagttccaaacggaggttgaactgattagcatggcggtgcacaggaaccttctccggctccgtggattctgcatgacccctacagagcggctgctagtgtatccatacatggctaacgggagcgtcgcatcgcgccttcgagaacgcgcgccaaatgagccccccctcgaatgggaaacgagggctcggatcgcgctggggtcagccagaggcctgtcctacctgcacgaccactgcgatcccaagatcatccaccgcgacgtgaaggccgccaacatcctgctggacgaggacttcgaagccgtcgtgggtgacttcggcctggccaagctcatggactacaaggacacccacgtgacgaccgccgtccgtgggacgatcggccacatcgcccccgagtacctctccacggggaagtcctccgagaagacggacgtcttcggctacgggatcatgctcctggaactcatcaccgggcagagggcgttcgacctcgctcgtctcgcgaacgatgacgacgtcatgctccttgactgggtgaaggcgctgctgaaggagaagaagctggagcagctggtggacccggacctgcagggccggtacgtggaccaggaggtggagtcgctgatccaggtggcgctgctgtgcacgcagggctccccgatggagcggcccaagatgtcggaggtggcgcggatgctggagggcgacgggctggcggagcggtgggagcagtggcagaaggtggaggtgatgcggcaggaggcggagctcgccccgcgccacaacgactggatcgtcgactccacctacaacctcagggccgtcgaactgtccggcccgaggtagggaggtagatgatcgccgtcgggatccttgtcgtctgtgaatatgacagcggataggtagcttggtggttggtcctgtctttattgatagctgcgaaactgtagatgaaattgtgtgcccgtcttctgtaacctgagtacctgacatctctgacatttttttttctgatattagagagccgtatgacaccagcatctgttgagccctgccgccgctttattagtagtcgtagctggcgagcgcgtcgttgctgtggctgcgtttgggtgaaggctcgcttcgaacagcggggtgacgcgcgtacgggttagagagcagtgacctgccgactgtatcgtgctggctgctgggcgggcaggcatagcaaagcacagcattgctgcgctgggcgcccgcgctcangttgtcagtcatgcattggtggtagacccccggtc

SEQ ID NO: 4954 - DNA, 1392 bp, Zea mays
ggccgcttttttttttttttttttctttggttttttgggggtttttttttttttttttttttgaaaaatcaggatgtagagggattacattaagttaaaaggaacaacataagacaagtatccataaatcagaccaatctgctccactcctttatcacaccaatgtttttttttttttttttcttttttttttagaaaactgaaaatgaacaccttattatttattgcagtaaattgctcctaacaaacacagaatcactcgtgtgacatatttcaacttagttcttatagcccaccaaatgaagagtttacaagtactagagcagacatgttttacaggcgtgactaaaattaacaaacacaggtgtgcatgacaaccagatgtccagactcccatataattttttcagtcacttctacctgagggctactggccagtgcaaatggcacgggtcagtcgaggaatccagtcttccgccagacagcattgcgtacctggcggagatcccgccccttcagtgtgcgcccggctccctccagcattgagaacgtcgtcatcggcgactcccgagcccgcgcgcgcgctaacatctcgtgtggcggtagcatctcctcgtattcatcctccgcttcccccatcaccatcaccacgggcggcttccgcagccgcgccgcaggaacgttgaccggcaatgattgcggcacatacggcgccggtgccggcgccgggcggggaacggcagggatcatgcggggaggggccgcagccggggaagcgggggacgaggacgtggatgaagaggactgaggcggcgagcggcggcgctcggggagggcgtccaggatgccctccggcgggcggcgtaggcgtggaacagggctagggtttgcatggcggacggaggacaggatgagtgggcggcgcaacggctgcggcggctcgggcgagccggatcctgcggagaagaggtcgtcctcgtcaagctcgaaggccgtagaggccgactgttctccggcagctgcggagcgggcgaaggagccaaggaagcgctcggagctgacggagttcctgtgtcgcatgcgatccatggttgagctagcgcgtgccgtcgcgtgtgccagtgtgagtgtgggactgtgagggtgggggagatgtcacgtcactggtgagaggtgacgagacggcgacgagcgcgcaggtgatcaacgaaatgggaggcgtgccgatgcagatttggggtccacgagtctgtggtggaggtggagccagccctttggagaagacgatgccatagttttgagattcgtgcgccgtttcgacgggtcagattctggatcgaccactcttgggcccagtcctgaacgcgggctcggatcaagtcgggactcgag

SEQ ID NO: 4955 - DNA, 580 bp, Zea mays
ctccatggcccgacaccaatcctggtctcatcccttctggattgaaccctgctgtgatgcgagacagcgcaatgctggcggcgcgggaggcgaataagcggccgcgcgcagcgccgacgacgaccctccccattgccttctcactgatccctacaacaccaattatagttggggaaggtgaacctccctcttgggatccggtaccaactctaaaagttctacaatgagtatgtcattacgagatcatattagaaagaggagggaagaagaagatgatgacatgatgttgtttattttccctgccttatatctgatgggttcaactagaagtgggggacaaaagaagaaacgccatacatcagatgagacaactccgtatgtgtattgtcaagtattgggaagacaactccgtaggtgtgaccattgttattactgtatttgcttatgtagctgattacttatatatctgtttcttggcgagtatgcgtgaacaattgcaagtctttttgttattactgtatgtattaaattgatttgaacagattgagtgcatcctgattgtgtacaaaaaaaaaaaaaa

SEQ ID NO: 4956 - DNA, 551 bp, Zea mays
gggtaccctccgggcccgcccggccacggcccgaccccagcctggcccctgccctcatcccttccggattgaaccctgctgtgatgcgagacagcgcaatgctggcggcgcgggaggcgaataagcggctgcgcgcagcgccgacggcgaccctccccaccgccttctcactgttctacaatgagtatgtcattacgagatcatattagaaagaggagggaagaagaagatgatgacatgatgttgtttattttccctgccttatatctgatgggttcaactagaagtgggggacaaaagaagaaacgccatacatcagatgagacaactccgtatgtgtattgtcaagtattgggaagacaactccgtatgtgtgaccattgttattactgtatttgcttatgtagctgattacttatataactgtttcttggcgagtatgcgtgaacaattgcaagtctttttgttattactgtatgtattaaattgatttgaacaaattgagtgcatcctgattgtgtacagaaaaaaaaaaaaaaaaaaggccccta

SEQ ID NO: 4957 - DNA, 3996 bp, Zea mays
gtatatgggccaggcccattacagtgagggtatgacaggtaattacaggggaacaccccaaaccctagacgggtagtctaacattgacatctggattctgttggaaaatggaacctccactgtgatgatatatggcaatgaaccatcaaatttctttgtggaacttggtggcaacgactgacatgtaggatttggttaacgataaaggcagccattctgatgtaaattctgtcgtataacattgtaagctttaggccccgttcgtttcggccggattggcccattcccggccttgttccgggtggaacaaattggctcggtttagaatttggtggaacaaattggtcccgttcgtttcggtcggatctggaactaaaattggcctggtttgaagtttaccctctctccacagcccgacaccaatcctggtctcatcccttctggattgaaccctgctgtgatgcgagacagcgcaatgctggcggcgcgggaggcgaataagcggccgcgcgcagcgcccgacgacgaccctccccattgccttctcactggtaagacgctgccctctcttcctatcctcgcgttacgcgttacttctgcgtcgcgtgcctgcgcgagcgcctccacgatctcgaggcgtccgccgctgccgcctccgcgctggggcgcaagtccacatcggccatgtggtccctgttcgccaggctgttcgccgccggcagctcttctgcgtccgaccccgcggagttctcgtgcggccgcggtggacaccacacacttacgacatgaattgccgagatctgaggtcaggaccgggctacagcaatactcctaccctgcttgagcgaatccattgagcgccgaacgatccagaatggccaactgaaaataaaacacgcagcccggtcgtcgtttatcccagtagtttgcggcctgtgattcaggatggcaaccacgaccagtgccttcaccatcggggtatttagtagcaagtagtaagcaattcatttgtgtgtctagattcatgtgttttcttccagaattaagtgtatattttatgatcaaaaaaaaaaaaaaaatatttgagttgttatatatagatccctacaacaccaattatagttggggaaggtgaacctccctcttgggatccggtaccaactctaaaaggtattaaattctttgtgcgtatatatggtttgctttagtcttattacttgtaattttgaaatgatacatgatttgctttaattctattttattatttaacttctacctgacaataaatctatattctttagttctacaatgagtatgtctttacgagatcatattagaaagaggagggaagaagaagatgatgacatgatgttgtttattttccctgccttatatctgatgggttcaactagaagtggggggacaaaagaagaaacgccatacatcagatgagacaactccgtatgtgtattgtcaagtattgggaagacaactccgtatgtgtgaccattgttattactgtatttgcttatgtagctgattacttatataactgtttcttggcgagtatgcgtgaacaattgcaagtctttttgttattactgtatgtattaaattgatttgaacaaattgagtgcatcgtgattgtgtacatgtgctgaaatcctgcaatgttaggattctaggatggcgcaatggtatgctgctctgattttgcactggtttgactgcatggaatggaaccaaattgaactacaatgcatggaatggtatgcgctgcaggctacagctatcagacctgtcttcaatcctggctgaaacgaacaagcttcggtgaaccaccaagtttcatttcagagatggatttattactgaccaggatttagtgaaccaccaggattcactctatttgggccaggaacaaaaacgtgtcagttttcaaccctaagcaaacgaacgagcccttaggttaatccacagaaattttggacagtacaaaatacataagtggcgcattgaaatggaagatctgtatgaccacacaactgcattccatggataccaataataccatatcaatctctgttatcttaacaaagcaatgagctcgaacaaaacttacaagtttagcatataccaaatgggtgggagatctgcataatacacatttctgttattttagcattcacttgtgaaggagatttgtgtgacaggcaacttgatgaccctatggtccaatcaactaagcatttggtctatccaatccacagtgcaacaggatggacgagcaattgggatgctcatcgttctaaaaccctgatgtccatgtctcctaaatctagctaagccaccagtgacagtttggaagctggagaacctggttgcacttcatcttggaaatcatttcactagaaatacgggagaacaaatcggaacacaggatgcagaacagctatgatggatggaagatcagctagcatgccaaagagtaggatatacggtgaggagactctgaaatgcgatccttacactttgcaagatcactgcacggcaaacctcagtctctcctcagactgtttcgctgcacaaaatcacgctaacacaatggaatagggggaggaagaagcagattacagcaccaacaatctcacgactgcaaggtcccaaacagaggagggcgatcctgatcatccctcggtggaggcgcagagcctgcaagaatgtcacagcaacaatcagtaaacaagggagtagcagattggattcccatctgcagtggttcaatgtaacaaaatcgcccaccttgcgcttcttgtttcacgacaggcttcttctcctcccttgatgagggagtcggcaatggcaccgaagtggctgccgccgccgcagctgcagccgccgcgaacgccagcgcaggctgctgcatggcgttgagcttgagcatcttgtccctgtccctattggcctcgtgcttcttcttggggggcgcgggctgggctgcctcgggcttcttcttgggggctgggggctgggcggccgcgggcgtgggcgcgggcgcggccggcctcatcttggcgtccctggcctccgcctcgagcgcgcggaaggcggcgtcgagcatctcgcgggtgcgcttcctggccgaggcggcctcggcgacgcggcgctccgcctcctcgcgggcggcggccgcggcgcggctgacggagtcgtgcgcgagacgcgcggcgacgaggaggacccgcgcgtcgcgctcctcgagcgggcggcggccgggcgctggcgcgaacgagaaggcgctgccgtcggcagcggcggcgcagggcgggcagacgaagggcgctgggtgctccgccgggacgcacgagaggtgcgcgacggagacgccgcaggcggagcagggcgctgtgggcccgggcggggcgacggcagggtcgcccgggggagcggcggcagcggcggggcaggaggagaggaggtggaggcaggcggagcagaaggcggacgggctgtagaggaggacgcaggaggagcagaggaggcagaagacgccctcgtgacggaagtggtggagcggccaggcgtcgcggcccgaggcgcagcggtcgccgccgcagccgcccttggcagagggcgccggcggggacgggcggaagggggtcgtcatggcgatggcggcttcaagaggaggggccggggtgggtgggacgattggacgaggattagggtttgggtggagacgcgaccaaacggctcactcgacgagcaggtcgcagaggtttttcttcagctctttgacgtgggaaaaaaagagagggaaaagctccaagaaaaaaagaaataaggagaaacaatcatttctattttatgtttattacataaaaattattttttaccgaaccttgttactcgcatacagtaacatgagctccaaattctttttattagacagagacgtagattcggttctagtactgaaactagatagaacgcaca

SEQ ID NO: 4958 - DNA, 1465 bp, Zea mays
cattgggtacctcgaggccggccgggatctccctcttccatggagaacacccacctctctctctctctctctccctctctctctctctctcttgttgggacctggagaagaggaaggaacagggagcaggggggaagaagaggttgctgcgacggctcaagcctcaaatttttggatccaggcagacaagcagagaaacaccagttggtcaagatgtcagccggtttccagctcggtgtgatcgggtcacttgcactctctgtcgcatcctcagttgccattgtcatctgcaacaaagctctaatcagcacgcttggttttccgttcgccacaacattaacaagctggcatctgatggtgaccttctgcaccctccatgtggcacatcgcttgcatttcttcgagcccaaggcgattgatggacagacggtgatactctttgggttgctgaatggcacgtcaattggccttctcaacctgagcttaggattcaactccattggattctaccagatgacaaaattggcgatcatacctttcactgtgctattggagactatcttcttgaacaaaagattcagcgagagtatcaaactctctcttctggtcttacttcttggagtaggaattgcttcaattactgatctcaagctaaacatgcttggttccatcctttctggcctcgccattgccactacttgtgttggccaaattctcacaaatacaatacagaagaggttgaaggtctcctcaacgcagcttctgtaccaatctgcgccttaccaggcaggaattctgtttgcaactggcccttttgtggatcaacttcttactgaccggagtgtctttgcacacaaatactctgctccagttctgggtttcattgtcctatcttgcttgattgcggtgtctgtgaacttcagtacatttcttgtgatcggaacaacatccccagtgacataccaggtgcttggtcaccttaagacatgtctggttctatcatttggttacactctattacatgatcctttcactctaaggaacatattgggcattctaattgccatatttggtatggcactatactcctacttctctgtaagagagggcaagaagaagtcagcaaatgatgctctaccagtttcacagatggcagataaggaggctgaaccacttttggcaactaaagacaacaacgacaccaagaaagcaaatggtttatctcacgactgctgaggcttttcttgtagtttaggtctagtatgaactgcccttcgaatttaaaggacctggaaagccattcttttcattcttgagttcctttttaggaaacggagcttttaaaatttgtatagaatgcatattttgacattaaaattattatttgattgtattctacacacagcagttccagctgaagttttactagtgcagatctcccaaaaaaaaaaaaaaaaaagcggcc

SEQ ID NO: 4959 - DNA, 1210 bp, Zea mays
ttgggtaccccgggcccgcccggcctccccggttcctctctctctttctcttccaaggagaacaaccaccgcctctctctcccccgtctatctcttcttggagcctggagaagaggaaggatcagggaacgggggaagaggttgctgccacagctcaggtctcaagtttggattcagacaagtagacaaacaccagttggttaagatggcagctggtttccagatcggtgtgatcgggtcacttgcactctctgttgcatcttcagtttccattgtcctctgcaacaaagctctcatcagcacacttggttttccattcgctacaacattaacaagctggcatctgatggtgaccttctgcaccctccatgtggcacagcgcttacgtttcttcgagcccaaggcaattgatggacagacagtcatactctttgggttgctgaatggcacgtcaattggtcttctcaatctgagtttaggattcaactccattggattctaccagatgacaaaattggcgatcatacctttcactgtgctattggagactatcttcttgaagaaaagattcagcgagagtatcaagctttctcttctggtcttacttcttggagtaggaattgcttcagttactgatctcaagctaaatctgcttgggtccatcctttctggcctcgccattgccaccacctgtgttggccaaattctcacaaatacaatacagaagaggttgaaggtctcctcaacgcagcttctgtaccaatctgcgccttaccaggcggcaattctgtttgcatctgggccttttgtagatcaactccttactaaccggagtgtctttgcacacaaatactctgctacagttctggtatggtcttaatttacctaaatacatgaaataatgttcttacaattatttagggaactcaattgatttaagacacacaaccagccaattccataatttgcagaatattaagattcagagacctgcaagattgctaacaaactaattggtagttgctgtatatgtagatctttaatcatgtgaaagcgctttaagtgtaaacatgttttatgtactgtaaaatactacctccatccttttttatttgacgtcaaatagtgtaaaaatgaactgcaaaacgtcaaataaaaaaatggagggagtagttcagtgatacctacagaaataaaaatgaaatcaaac

SEQ ID NO: 4960 - DNA, 1475 bp, Zea mays
  misc_feature (1467)..(1467): n is a, c, g, or t
  misc_feature (1470)..(1470): n is a, c, g, or t
  misc_feature (1472)..(1475): n is a, c, g, or t
ttgggtccctcgaggccggccgggatctcccttcttccaggagaacacccacatctctctcttccaaggagaacacccacctctctctctctctcttgttgggacctggagaagaggaaggaacagggagcaggggggaagaagaggttgctgcgacggctcaagcctcaagcagacaagcagagaaacaccagttggtcaagatgtcagccggtttccagcttggtgtgatcgggtcacttgcactctctgtcgcatcctcagttgccattgtcatctgcaacaaagctctaatcagcacgcttggttttccgttcgccacaacattaacaagctggcatctgatggtgaccttctgcaccctccatgtggcacatcgcttgcatttcttcgagcccaaggcgattgatggacagacggtgatactctttgggttgctgaatggcacgtcaattggccttctcaacctgagcttaggattcaactccattggattctaccagatgacaaaattggcgatcatacctttcactgtgctattggagactatcttcttgaacaaaagattcagcgagagtatcaagctctctcttctggtcttacttcttggagtaggaattgcttcaattactgatctcaagctaaacatgcttggttccatcctttctggcctcgccattgccactacttgtgttggccaaattctcacaaatacaatacagaagaggttgaaggtctccctcaacgcagcttctgtacccatctgcgccttaccagggcaggaattctggttgcaactggcccttttgtggatcaactccttactaaccggagtgtctttgcacacaaatactctgctacagttctgggtttcgttgtcctctcttgcttgattgcggtgtctgtgaacttcagtacatttcttgtgattggaacaacatccccagtgacgtaccaggtgcttggccaccttaagacatgtctggttctatcatttggctacactctattacatgatcctttcactctaaggaacatattgggcattctaattgccatatttgggatggcactatactcctatttctctgtaagagagggcaagaagaagtcagcaaatgatgccctgccagtttcacagatgccagataaggaggttgaaccgcttttggcaactaaagacagcaatgacaccgagaaagcaaatggtttatctcacgactgctagggcttttcttgtagtttaggtctagtatgaactgcccttagaatttaatggacttggaaagccattcttttcattcttgatttcctttttaggaaaggaagattttaaaatttgtagagaatgtgtattttgacgttaaagttattgtttgattgtattctacacacagcagttccagctgaagttttattaaaaaaaatctccacctataaaaaaaaaaaaaaaaaaaaaaaaaaaanaanannnn

SEQ ID NO: 4961 - DNA, 3351 bp, Zea mays
  misc_feature (1835)..(1835): n is a, c, g, or t
  misc_feature (1887)..(1887): n is a, c, g, or t
  misc_feature (3270)..(3270): n is a, c, g, or t
aaatatgggtaaaaactgttctaacttgtaagattttgaaatatgagggtcattacatcaaaatggccctaattaacgcatcacaattaaatgcaaagacatcaaaatgaatttgtgattattcactagagggccgtttcattcatcaaaacgaaacatctagaaggatagcattttagattcgtcaaaagtcaaaaactatcttatatttgtatgacaatatttatattaaaaataatatttatacggttttatatattagtttcgtgattcatcatgaaagatagttttagatgaagctaattgctgtaaaaaatgtttgatcaaattttaaataacttgatctaagataaaggtagagtgatatatttttgggacagaggaaataataaaataacacatttttaaagattgacctgagggatgaaatgttgagaacagggtagatctggcttcatgcttgagcaaaacccagtcacaccagaacactgtttgctaagcaaatcttcaccgccatcccatttctctaccaccatgtccctctggcgcgcggccgcctcccgcctcctcctcacacgccactcgccgtcgtctccctccgccgccactgccgctctcctcctccacgcgcgctccttctccccgccgccgccgcgcccggcccaggcgcagcccgaggcggaggtcacgccggccgaggcgcggcgcctggtgcgcctcgtcggcgtggaggcgctgaagcggcgcctgcgggacggccgggacgaggtggtggggtacgaccagctcctcgacgcctgcgtcgaggccggagccgcgcgcacgcacgccgaggccgaggcgctcgcgcgggccctggaccacgccggcgtcgtgctgctcttccgcgacaaggcctacctccaccccgagaaggtcgcatttctcgagcgttacatcactttgtcactgcatcgtcataggttcttcgtccgcagccacctcgttccgaattcgaattcgaaactgcttgctgctcccgtaacggtttattccagattccaaaattcgggtgaacctctttttgttatcctgtttcaaattgggtctacacccttgctagtcagttaaaatccgaactcgtttcgtagaaatccgtcttttatgaaaataaacccccaccaaattttccagagcaatgccctgtttcagtcttcttaaatatagttatgttattggagactaaccggcaaaagtgaaatgacatattcctttgtgtgaaatggggttttagcatcagttagcagatggctgagcaaaatagtaaaattgggaataatcaagaagggggtcgtaagtcaaggcgcgctcatggaatcctcagtaacgtaaggacgcggttaggaatcctcggtagagtgaggatgcaggtagctggaaagtatcaagattgtacatgggattggagcaacgtgcagattcacataactgccacatcacatgctctttgatttggtaccttccggtcctccacagctactgtctgttcttcacctactctgatcggaacaaacaaagaccatagcatgcatgcgctgtagaaagcatccacctggaattaaggtattaatttatcctttgaagtgtggacagcacattgacaaaggctaaaatgtttagtatctgaaaaggattgcctcgtcagggtgagatttttcttcttcttctttcccggttctttcagctgttgcctgtaggaaggtctcaatttcactattattgacagcgaaaacaatgaatatccagccaatttgcttgcagtcaaagttcatttcccccctcaattacgtgcaaancgagcaaaaggagtcatgatgcaatctctctgactgaatctgtgcttgcatngattaattactgaccgttttcaggtggtggacctggttagaagggccgtgccgctcgcgctcgcgccagagaacgacccaagaaaagaggagttcgagcggctccgagagaagaaggaagcgatcgacaggctggcgcacaagcaagtccggcgcatcctgtggtccggcctagggttcttcatgtgccaggtcgggctcttcttccgcctcacgttctgggagttctcgtgggacgtgatggagccgatcgccttcttcaccaccgcgtccggcctgctcgtcggctacgcctacttcctcatcacctcgagggacccgacgtaccaggacttcatggagaggctgttcctgtcgaggcagaggaagctttgtgcggcgcacaagttcgatatggagaggttcatggagcttcagaagcactgtagatgtcccctggaaggccatggccctcgtggtccctgagcttcatgacttgtaacaccctataggttgcacgatagccactacttatttacacgacctcatcgttcgagacagcaatgtgatcctgacagacatggatcatatactagttagctaccctttgcctgcttatcagaggcgaactgacctatgtgtattttgacaaattgttttgaaggacccttgcatgctgaagtatgcttgaatatattccaaattttgcaaaaaaaaaaaccgttccttctttttttttcatttgctgtgcttggttgcaggaccaaaatccaaagtatgtcagacacaactatctgaattctcattcctttgagattcggacagcaaaaataacctaatatttttttaaaaaaatggttacaagggcatacttgctgattcaggcatcatttgttgtttcatgtacatgatgtgccgccgcagtcagcattggactccctcagtattgctattgcatagtgactgatgagcaaaaagaatattaccaaatatttcatactaaaaacgaacagcaaggaactgcacttttgcaactccaagttgcataatgaaaaaaaaatcatcaaaccataacgaacagtgaaataatccacatcatatcttggtattctgcaacataactcaggtttcgtgctggcatccttcagacatcgtactcttacggcagcattggggcactgcctcgtcgaggtggtaatgacatctaggttttatactataaattttaagaattaaatcagattaaaatcaatctctattcctattcggttttgaactaaaaataattaagaccacccctaggtgtatcagtggcatcatagatacacatgtgcgattctgtttattttcatgataaacatagcccgtgaagtctgttgttctgttgttcacatgcccaaaaaangagtgtttggttagtttcatgtcctatgaattagtgaatatttcattccgtcatgaacttctctcccattagtcatggtac

SEQ ID NO: 4962 - DNA, 3959 bp, Zea mays
tgccttcaagcttgttgttcatttttagcatgtttggcagctcaatgcccttcatcaactccataccatcggctgcgaaccaagaatggtccatggcgtcaccaccggcacaggaggagtcggtcatggaagagctgaataatgtcatgaagtgcgcatatgaagagggcactgagttcggaaaggaaatcggctgggtgtacaacattgctacggaggacgtggtgaccggcttccgagtacaccggacagggtggcgatctatgtactgccgcatggagccggatgccttccgtggcactgcaccaatcaacctcacggagcgcctctgccagatcctgcgctggtcgggcggctcccttgaaatgttcttctcacactgcccgctccttgctggccgtcgactgaacttgatgcaacggatcgcctacaccaacatgacagcctacccaatctcatcggtcttccttgtgttctacctcctcttccccgtcatatggatcttccgtggcgagttctacatccagaagccgttcccgacatacgtgctgtacctcgtcgtcatcatagcaatgacagagctgatcggcatggtggagatcaagtgggcaggcctcacgctgctggactggatccgcaacgagcagttctacatcatcggggcgacagccgtgtacccgttagcgacgctgcacatcgtgctgaagctagtccttcgcgggaacggcgtttcgttcaagctgacggcgaagcaggctaagagcaccgtgaacgagaagtacgctgagatgtacgtggtgcagtggacgccactgctgatccccacaatagcggtgatcgccgtgaacgtcggcgccatcggggcggcgatcggcaaggcggtcgtcggggggtggtcgctcctgcagatggccgacgcggtcccttggactggtgttcaacgcgtggatcctgctgctgatctacccgttcgcgctcggggtcatggggcggtggagcaagaggccctatatcctgttcgtcctgttcgtgattgggttcgctgtagtggcggcggtggttgttgccatccatgctgcgcgcactggctctgttcggttccattccggacattcaggcggtgctagcttccctacaagctgggggttttagatcgcgttcatcattggttagtggcattggttgcaggttgttccattagctgagagcttcttcgctgtggagttcctacttgatgtaaatcgtgcattgattgtacatgtttgttcagtggatggtttgtaaggaacaaaaaatggtggtaaagtgaaagcacatttctgcctcgattttgacatgtaccggtacgtgagtgcaacgtggcactggtttcctggacctggaacttggatctggggtactcgtaagaaactgtctgaatgtcagtggttgtgattgctgacagcccccggttactcgcgtgcgttttctgctcctgcacaggtattcgtacctggtgaggagagccgagcaacgccacaagagctcaagcagactgcagacccattgtctcgtgcagttcttgttccgtaggctacgtctatgtgctcagtgcccatatattggtttcttgtattatcttcatttcaaattacaagctattccattttttaaaaaacaaaacaattttagtttaactaaaaaattatatgataagataataacatttaagatgtcaattaagtatttttagatccttaattaattatttttacagtatatatatttgatgttctaaatctttatagttttctctataattttgattaaatttaacatgtttttgagttctttaaaaaaattagaatatcttataaattaaaagagaaggaacactatggttatagtcgaattttctttcttgcaatgctctgctagattaccaggttggttactagtccatttcatgttaattaagcccccgggggcccggggaaacatgataataaactaataaaatcgatagccataggtgatgcgtcagtcaagtggtggctagacgattccgctaccagaatgttgttccttgcaactgaaacaaatgactgcaggctggactggacgatgattggcatgcgcggtgcgcttttgactccaacaaggaaaaagggcgcgagtgcgagtgatcatccgtgcctaatgctgcaaggtaatgattggcggggccggggcctcgtcctagcatgagttgcagccttgcaccactttgcgactgatgatcacgtggagcgtggaggaggaaactggtatgtgcggtgcagcaggataggccaacacaacaatttcgcctgatgcgcgccgtttagtagcacagatcacagaccaacccagcgtcatgaagatcttttgcgctacacgagttcaaagagatcgcggcagcggaagctgcagttgttctagctctatcgctgttcgtggtctcagagaatttgtaaggaattcttcgctagaagagtgtcttgtacgaccctactctaaacaaaacagcggcattttcttgttcttttcttttgattgaatcggtacatgctaaggtacacgtacttatccgtagtatatacgaaatgacgaaataggaacaggaacagcgagctggccaagttggtccaaaagccgttggatcttaggaggcgtccttatccatcctccacgtgcagccgaccagccgtcgaattccgttccaaggcaaactaggcaaagggtcctcgtggcctcctcctctccagactccagagtccagaccgtgacaagttcatcatccagccccgcttgcgcttgaccccttcaagtccaagcattccattccatccagtaccttccttgtcaccttgaccttccccctcccttcctagtcccctactcgccagtccacaggacctcgaccccgctaagcaagctccaagagcgatcgccgcagaagatcccgcgatgcaggccccgccggcgccctcctccgtcgacctgccgctggcggtggcgccgccgccggtgaaggcgccgaccccgcggcccccgccgccggcctcgctgcagcccgagtccccgggggtcttcttctccgccgccgccgccgccgcgcccctgggcaccgcccaccgccgcatcgccatcgccgtcgacctctccgacgagtccgcctacgccgtgcgctgggccgtcgccaactacctccgccccggggacgccgtcatcctgctccacgtgcgccccacctccgtgctctacggcgccgactggggcgccgtcgacgtctccctccccaaccctagcgccaccgccgcctccgaggacggcgacggcgactgcgagaccgccgcctgccgcgcgcaggatggaggacgactacgacgccttcacggccaccaaggccgaccacttcgccagcccgctcaaggacgccggcatcccctacaagatccacatcgtcagggaccacgacatgaaggagcgcctctgcctcgaggtcgagcgcctctcgctcagcgccgtcatcatggggagcaagggcttcggcgccgcgcggaggaccagcaagggcaggctcggcagcgtcagcgactactgcgtgcaccactgtgtctgccccgttgtggtggtgcgcttccctgatgacggctctgccgagggtggggaggccgctggtttgtccgccgcggttggtgctgaggatgtgctgcaccccgtgccggaggaagaaggcgagtaccatgacgctgcggaggagcacaaggctggtcggcccttctgctcccattgctccttgttgtgcatgtcatagggaggttgccttcatcatccatacgaaaatgcaccaaaatttaactcacaataacaatgggataggacaatgcccgcaacaaatttactatcgattcattgactctgacgaactctgggttattctgctcccaaccacagag

SEQ ID NO: 4963 - DNA, 3864 bp, Zea mays
gtcttatgaacatctacaagaaattgagctggtagattttatgatcgatattaaaatcgatgtgcatgtcgtctatcattaaaaatgatagtattaatttccaaaataattctaaaaaatatgaacacttatcttatgtcaacaaacttgcttggaaggtcaagcaacgggctgcaacgctagctcaaaaattatgaacatgcattttgtcatcccacccccagcagccagcacccgcccggcacgacttcttctttccggtaccttctccccttcctctccctccctagtccctagtcggcagtcccccgaccccgacctcgctaagcaaactcccagagcgatcgccgcagaagatcccgcatgcatgccccggcgccgccctcctccgtcgatctgccgttgtcggcgccgccgccgccggtgaaggcgccgtccccgcggcctccgccgccggcctcgctgcagcccgagtccccgggcgtctttttctccgccaccgcacccctgggcacctcccaccgccgcatcgccatcgccgtcgacctatccgacgagtccgccttcgccgtgcgctgggccgtcgccaactacctacgctccggggacgccgtcatcctgctccacgtgcgccccacctccgtgctctacggcgccgactggggcgccgtcgacgtctccctccccatccctagcgcctactccgaggatggctttggcggcggcgacgccgattccgaggccgccgctgcgcgcaggatggaggacgactacgacgccttcacggcctccaaggccgacgacatcgccaggccgctcaaggaggcgggcatcccctacaagatccacatcgtcagggaccacgacatgaaagagcgcctctgcctcgaggtcgagcgcctctcgctcagcgccgtcatcatggggagcaagggcttcggctccacgcggaggaccagcaaggggaggctcggcagcgtcagcgactactgcgtgcatcactgtatctgccccgttgtggtagtgcgcttccctgatgagtgatgacggctctgccgagtgtggggaggcaggtggtttgcccgccgcggttggtgctgaggatgtgctgcaccccgtgccggaggaggaggaggccgagtatcatgattcatgacgccgctgaggagcacaagggtaattgattctattcttgcagttgctggttgtgcatgtcataggggggtttgccttcattatccatacgatacgaaatgcaccaacatttaactcgcgaagtcacaacaacaataggataggacaatgtgcacaacaaatttactatcgattaattggttctgatgaactctgggttattctacttcccactaagtagtcattctttcttttattcatgaccggaagcccaaagtttatttgccacacagcaacaaagtgttcagagtttctttatcatgaaaacaggtactgaacttctaaaatcgcatcaccgcatctgaacatgcagggttcagcatgctgcatgcacatcactcagaacaatcatctccataaccaagcaacaccaaacatcgtaaaaccttaagctttatctaatactggttggtggttgcatgcccaaatggacaccgcttgcagcacacaggctgtacaagttctaactaagatctacttgcaactcctgcaacttaatagtcattcaaactttaatagaaatatgtagtgaggattgccggtacacatttccttgatatggacagtatttggttcagggtatcttttagggtgtctgctttatatggtattacagtactttgtggaacttgattgtttggcggaacaacctggtgtatgaagattagttttagtggctatatgcctttttttagtaatgtaagattgccctgtagggttgcagtaaccacgtttcaattatatgtgtgttctccttgcttcattttttcctactgaaggatctataatttagaccgcgagtattctactattctgcatgctctgtcaacaatccatttggttctattaagttttgaaattgaaaacaactaattctgaaaccttattttcactgagcctgagaggacagtttatcctcagttattcagcactttacatctgttctttgcctattagaagttagaatatttggctggaaccacctgaattacattttcaatggtatatttagcttattttccataaaagaaagagccaaagaggcattgatacgtggttatgtcacaacttattcatgatattttaagtggggatttactagtacatgtttttttatggctaagttcattaaggttcattgtatatgatagcttcttgagtccagataaagcaataaataccaaaaagaagtcaggacagcattcatatacctagaacttatgttatgttcttgcaattccataccccgttgaagaaaatgccaatattttggaaacctgacttctctactatccactttagcaattacacatggccttctcccctactattgtcaattagggatggaaggagactgagcttgtgccttgtggtgatcaaatcgatctttgtgcttagtctcctgtactggtatgagtgcaagtcacctcagtatggagatcacagcgaagtgctagcttcaaccgtctattccaggatgcccatacttcatgtcctttttggagatggaggtgaccggaatccatgataatatgatatctggccacagtatgatgtcatctgtttgcttcatgcaaccaattcatcaatggattaaaatatgtcttgtgtaaagaagtttgtctttccctcatacattatgtgagcggtatgcctgccctgcagcatctgtagctacccagttatgtgcatttgtagttggctttagctaaaatggagaaaaccacagttgcagtttggtgtgcttgtatgagttagtcttccatggggttctttggttacccttttccaaaataactaccatgagggcattaggggaacggaatagggtgatactggattttaggatttataagtttttaggtagtgggatcatccatttaggttaaatccaaaccatgctacaaggggaaaaggcatgtagttttgcttgacaggtttttaggaaataaataacctattttagggcctattacagttgttgtgctggctgtccattccaaacagttaaaatctgcactaagctgactaaggttatgttgttaattgttatggctccagaaaagaaaattctgttagtttttacctaaaagtataatgaaaatattttttctaaatgccaccttaataccataagcagtcttggcaatatgaacatggtttaagaaaaagatacatcacatgatgggcagtgacaggccaaagttatacgggccatacccattggccaaggtaacaatccaggcatggccggtcaagattagcattggtccgtgggccaaaatagcgggtcatgggctggcctcatgctttttggacagctataggctcagcgggttgtttagcttttggcagctcaggtgggtggcttttctcttgtgtttagttggttcttgatgttaactgttagagtggacgcactaatcagttcaacctaaaagcttaagctattaggagaaggtagacaattcacttatacacttcaacacccccactcacgtgcagcacgtgcagccagagaaaaatgcacaaacgtggaaataaaagggcggagacaaaaataaagactctgtcaggattcaaactcgagatctctgactctgatattgtgttagagtggacgcactaaccacccaaaagcttaagctattaggagaagggaagacctcg

SEQ ID NO: 4964 - DNA, 975 bp, Zea mays
cacaggcgtatagccatcgccgtcgacctttccgactagtccgcctacgccgtgcgctgggccatgggcaactacctccggggcggggacgccgtcatcctgctccacgtgcgccccacctccgtgctctacggcgcctactggggcgccgtcgacatctccctccccaaccctagcgccaccgccgactacgaggacggcgactgcgactgcgactgcgaaaccgccgtcgcacgcgcgcacgatggaggacgactacgacgccttcacggccaccaaggccgacgacttcgccagcccgctcaaggacgccggcatcccctacaagatccacatcgtcagggaccacgacatgaaggagcgcctctgcctcgaggtcgagcgcctctcgctcagcgccgtcatcatggggagcaagggcttcggcgccgcgcggaggaccagcaagggcaggctcggcagcgtcagcgactactgcgtgcaccactgtgtctgccccgttgtggtggtgcgcttccctgatgacggctctgccgagggtggggaggccgctggtttgtccgccgcggttggtgctgaggatgtgctgcaccccgtgccggaggaagaaggcgagtaccatgacgctgcggaggagcacaaggatgcttgacctcgttgatgcattgtgaagtcctcttggattcagcatgtagaggttctagcattcgactgttggctgggtgctaagctgggatttctacttgagtgcatgtgatgtttatgaactcccattaccggtgtctatccgtgctttcgctttgtttgtatcctccgttacctttgttcatgtagcttgtctgacttccactgcgtggtggatatatgtctgaacatttgtagctactttgcgttgcactgtgtttctgatgaaagttacaggttactggtcacttctatagaacccaaaaaaaaacaggatgcaaattcgtcctg

SEQ ID NO: 4965 - DNA, 1476 bp, Zea mays
  misc_feature (1326)..(1327): n is a, c, g, or t
  misc_feature (1330)..(1330): n is a, c, g, or t
  misc_feature (1335)..(1335): n is a, c, g, or t
ctcgagccgctgcgtgctgctcctctcctctccactctcctccatttgctgccgcagctctccgagctcgccctcgccgccgccacctcagcgcagcacagcacagattcggagaggcttagcacgcagcgccagtgaagaaggccgagataatggaggtggagacgatgctggacgacgacgtgttcttcgccgagctcagcaagcggatatcgctgctcatcaccgacgacgacgagggcgcggacttcgccgccgcgcagttcatccccgccgccgccgccgccgccgcgcccctccaggggttcgcgtcgcgcgcccatgtgccgtcgcaggcgtcgctgctggcgccaccggcctacgcgctgtaccactaccaccacggcgccagctacggcggggacgacagcgccagggcggcgtggcagcagctgcagtgcggcagcaagggcaccggcgtgttcatcccacggtccacgcccgggtccgcgcaccccaagaagaagggcaagagccggggcgccgccgccaaggccgcgcggccggccggcgcgggcgcaccgcccaggaagcgcgtctgatctccgcttctctgcatcgtgatttataatggctcagcaaggagaaaaaaaaagaagaagaaaaaggaggggtaaaaaaaagagcaccagaactacgaactaaccccagatgcagcgctcgtcggaaccagccggattagctatgtttaattaatcattaaattttcagtgttgctgtcattcttatatggtaaataataaaaaaaccatagctactccccccctgggttaaaatgtataatgtgagccctaggggatcaggctgtgggctggggcaccaccgcaccaataatctctatgtgtgtatagtaaaagctagcggttggtggtgtcgtagttttcctggctaagtcgatttattaattatttctttgtatttcctttcttcccacatttttgtaagatgaagaaatgaattgtgctattggtgtaccactactatactagagcatagtgcagtgctaaaaaaaaaaaaaaaaaaaaaaaaaaaaaaaaaaaaaaaaaaaaaaaaaattttgggggaaggggccttttttgggccaagcccggtttgggggtttttgggggggggaaaacctttggggtgggagggggggggggggttttgggtccttgggcttaaaaaaggggggggggggggaagggtttttttaagggttgggttgggggggggggaattttgggtttttaaaaaggggtttttaaaaatgggttttggggtccaaaaaaaaaaaaaaaaaaaaanncanaaaancccccttttgggggaaaggcccctttttttcccaacccccttgggaagggtttggaagggggggaaacctttttgttggggggggggagggggttttccgaaccttcgcctaaaaaagggggggggggggaaaggtttttt

SEQ ID NO: 4966 - DNA, 1072 bp, Zea mays
gcacgagaccattacctagaacatcctaatcgaaaaataacgcaagcaaagcctctgctgcgtgctctgctcctatctctcctccatttgctgccgcagctctccgagctcgccgccgccgcctcagcgcaggcgcagcacagcacagattcggagagcctgcccttagcacgcagcgccagtgaagaaggccgagataatggaggtggagacgatgctggacgacgacgtgttcttcgccgagctcagcaagcggatatcgctgctcatcaccgacgacgacgagggcgcggacttctccgccgcgcagttcatccccgccgccgccgccgccgccgcgcccctccaggggttcgcgtcgcgcgcccatgtgccgtcgcaggcgtcgctgctggcgccaccggcgtacgcgctgtaccactaccaccacggcgccagctacggcggggacgacagcgccagggcggcgtggcagcagctgcagtgcggcagcaagggcaccggcgtgttcatcccacggtccacgcccgggtccgcgcaccccaagaagaagggcaagagccggggcgccgccgccaaggccgcgcggccggccggcgcgggcgcaccgcccaggaagcgcgtctgatctccgcttctctgcatcgtgatttaatggatcagcaaggagaaaaaaaagaagaagaaaaaggaggggcaaaaaaaaaagagcaccagaactacgaactaaccccagatgcagcgctcgtcggaaccagccggattagctatgtttaattaatcattaaattttcagtgttgttgtcattcttatatggtaaataataaaaaaaccatagctactcccccctgggttaaaatgtataatgtgagccctaggggtaggggatcaggctgtgggctggggcaccaccgcaccaataatctctctgtgtgtatagtaaaagctagcggttagtggtgccctagttttcctggctaagtcgatttattaattatttctttgcatttcctttcttcccacatttttgtaagatgaagaaatgaattgtgctattggtgtaccactact

SEQ ID NO: 4967 - DNA, 1272 bp, Zea mays
gggaaaacgacaccaaaggttcccggtgccgtccaccgaccaccggtgacacggcgccgatagcaagagttcaggaggagcgcggagccgtttctggtggtagcggtgtccgtgaggcgcggcgagatgtctgtgcggataaaggcggtggtggacaggttcgtgatggagctcaaggaggcactggacgcggacatccaggaccgcgtcatgaaggagcgggagatgcagagctacatcgcggagcgcgagcgcgaggttgccgagagggaggccgcgtggaaggccgagctctcccgccgcgaggctgagatcgcgaggcaggaggcgaggctgaaggtggagagggagaacctggagaaagagaagagcgtcctcatggggacggcttcgagccaggacagccaagacggagcgctggagatcaccgtcagcggcgagaagtacaggtgcctccggttctcgaaggcgaagaagtgagaggttgaaccagaacgacacagtcactcagggtcaggggggggtagtggtacaccgaaatctcagtttggaggctagtgtaagagtatctgtcaatctggcacacaggctgtcgctgtacgtgctggtttgatgctcactgcgtcgtgcgtcctcattgatgatttaacgatagggtcattgaaccagcgcacaacctgagaaaatggttgcgctgtccgtcctggggtcacggtagcatgaacctcagaactgataacctctgtttcggacggatacaatcgggttgaatgggagcctttcgtgtgcatgtggaaggtaaagtcctgcggtctctgtgtctggaacatgcttgttgccttgttggaacgaaaaggggagtttcggcttcactgcactggcaacaatacggtgcatgggactgggacgttatctcgaacgtgcatgggactgggacgttatctcgaacgaagagcacgttgggccccaggttttacagcgtcggtcctgtcctatcatatcctatcctgacaaggaccgttacctgaaaaggcagaggtggtctgtcgaagcgtgtgatgtgatcacctcaaccgcctgcctgccctatccctacccaacgttgccaatccattgacgaccaccgcagaaaccaaaccagcggcagcagtaatactactattcaaacacgtcaccctgttactcttttgccaagtgattaagaagcgagtccaggatggagatgcgggtagtacactactaggcgtcttcagatgagatgagaatggagac

SEQ ID NO: 4968 - DNA, 2910 bp, Zea mays
  misc_feature (2781)..(2781): n is a, c, g, or t
gaatgaaccaacgcaaggcaagaaagtgacctgtgaccctgtatcgtgcagtagaggaaacaactcccacatggatgatggataacagtaggcgtgggctggaactaggaagagtttcttcgactcctgtattggccaggttggcggattggatgagaaagtatatagagatgagtgtttggggctttgggccctgctaggtagggaacagggatacaacaatcttgttttgcgtggagtctctacattacatgcacccatactgattcgttgctctgtttccagcttataaggatgttgttgcgtagtgtgtgctgatacattggagactaaagtactgggaaaggtgaaagtgcctttagctgagttagttagatggtctgattagtctcttcaggtcctgagtttgattctccgtgggagcgaatttcaggctattgtttgaaaaaaatctcttcatctgtcccagtcaaaacacaagtctaatgtctagttttgatcgcggtcgtttctcacatggactatagtgtcgttgtgtatgggtgcttcttgctataatgaccaggggctatcttatcccttatgtcgagttctttttaagcaacgaaaggggtagtgaattagagccaatcaatttgtcgtggtgacactgattgcaaaacagcatatgctgccagattgtggtcaacaaactatatattagtctatacattggatgagcagcaatcaaatgagcaagatggatgtcataatcatcaacagaccagatttacgtttggaagctaaacctaatcttcctgcactcatgacgacaccgagttactgctatcatgcaaaaaggccacgatggactggtgtggtgttcgcttagcaaatggagatctttatcatgcactgtaatcaagctgtccacttcctccgacacagcaacatccttacctgaatccatcaatcctctaggtaaagtgaagaaagaaaatcgatgcaggtagtgcagtgggctgtgaaatcaacatttgtctgggaccccgcgcggtttgacatgttcgttttcggtttccggcaggctgagatcgcgaggcaggaggcgaggctgaaggtggagagggagaacctggagaaagagaagagcgtcctcatggggacggcttcgagccaggacagccaagacggagcgctggagatcaccgtcagcggcgagaagtacaggtgcctccggttctcgaaggcgaagaagtgagaggttgaaccaggacgacacagtcactcagggtcaggggggcgtagtggtacaccgaaatctcagtttggaggctagtgtaagagtatctgtcaatctggcacacaggctgtcgctgtacgtgctggtttgatgctcactgcgtcgtgcgtcctcattgatgatttaacgatagggtcattgaaccagcgcacaacctgagaaaatggttgcgctgtccgtcctggggtcacggtagcatgaacctcacaactgataacctctgtttcggacggatacaatcgggttgaatgggagcctttcgtgtgcatgtggaaggtaaagaaaaaaaaaaaaaaaatctggaacatgcttgttgccttgttggaacgaaaaggggagtttcggcttcactgcactggcaacaatacggtgcatgggactgggacgttatctcgaacgaagagcacgttgggccccaggttttacagcgtcggtcctgtcctatcatatcctatcctgacaaggaccgttacctgaaaaggcagaggtggtctgtcgaagcgtgtgatgtgatcacctcaaccgcctgcctgccctatccctacccaacgttgccaatccattgacgaccaccgcagaaaccaaaccagcggcagcagtaatactactattcaaacacgtcaccctgttactcttttgccaagtgattaagaagcgagtccaggatggagatgcgggtagtacactactaggcgtcttcagatgagatgagaatggagactgcgtctgctgtgctgggtgctctcatctgcacgaacaaacacatctccctgtcgtccggatgcggcggcagccatgtgcacgccacggctgccagccaccgcgacgcactcaccccgtcacccgcagtcctcagatacgaaaactatcctgcactcgcactgcactcgcaccgcaccatggtggtgtgtctgccatgtgggccggacgcgtcgtcggacccacatggcgcgtgccgagggataacccgtgggcgcgcgccgacgtgctgctggccagcccagcggtggagcggtggctggctggcccatgcgccgctgccggacagcggttcgaggaggcttccgctcgcacgtggacccgctgccttgctggtccggcccgcggcccttcgcctttgccagggcaggatcaaaaggcctcgaattacctagcggtggtgcagcagggtcatcaccgagacaccgatgaactccgatccactcagagctcaagcttcgtcgagtcgagagattctctccggacactaggactcgacggaggaaggtgtcgtcgatagatggttattaactaactaactaactaactaactaatcactcaccccacttttaccttgacaaatgacagtgcagggagaatttaattaattaattaattaattaatcaaccaccgggcagcgcatgaaacctggtggtatcttgttcctcggacgccgttaaacaacgtgcgattcatgcaagctatacttctacagttctactagtagcatagagacgncaatcgccaccagatctacaactagggggcgtttggttacttgtatgggtgagcctgactcgtatctagtgagcctggctcagactggactggctgagtgcatgcagtatagcgtgtttggttgtgtgt

SEQ ID NO: 4969 - DNA, 763 bp, Zea mays
gggtacctcgaggccggccgggccgaaaaaaaaaatttcttatcagtactctacacaagcagaagccggactaggcccatcaccaagacccactgaaccctcgccgtttcgtcgcacccaccaacacgagagatgagctccggcggcgcggacaagcccggcagtggcggcggcgcggtgaagacgccgtcggacttcctcaagtccatcaggggccgccccgtagtcgtaaagctcaactccggcgtcgactacagaggtatattggcttgtctggatggttatatgaacatcgcaatggagcagaccgaggagtacgtgaatggccagttgaagaacaagtatggcgacgccttcataaggggcaacaacgttctgtacatcagcacgacgaagcggacccttgccgatggcgcgtagccggattggagtccctctgtcctcctcccgtgtgtgtgccgtgcaacttcgaagccgttagcttcggttgcgctctgactctgatgcatcccttcaaatctctgtaccccccctgtctggaagggagttgggggggagagggaaagtgtatcgcacggtttcgtgggctttgtcagatgctattttgatgtaactgacatttgttcagcttcccatgttatgttatatgtggtgttgctttggggatatggataagatatcgtgttctcagcactgcgttatgtcctttcgtcgtcaatggtcggtatcaattcgtcccctagggccgtgaaaatttgcggcc

SEQ ID NO: 4970 - DNA, 1192 bp, Zea mays
ctcgaggccggccgggagtgagtggcccttcttcctctccattcggtacccccccgccgggcggtagcgttgtgcgtcttttcctcagcagcaaccggagagcggctgctcgcctgctcctcctcctagggaaaggacagcggcggcggcggcggcggcgagaagttgggcctgaagcccggacgctttctcccgagataccgcaatactgctagagcactgtcactaatgtttgcttatgacaatggagtcacctacaactgccgctggtggtgaactggagagctacttctccttgggtttgacagtatcccactcacagaaagataatgctgaatttccaaaggttctgttgcttctctcagcgtatcttgacaagacagttcagcagaatgaagagttactagactccagtaaaataaaggagtcgaccactatctttcatggtcagagggtgcctgaacttagtataaagctgtatgcagagcgtattttcaagtatgcaaagtgcagcccatcttgctttgtgctagcacttatctacatggagagatatctacaacaaccaaacatttacatgacgtcatttagtgttcatcgcctgcttattacaagtgttgttgttgctgccaaattcatagatgatgcgtttttcaataatgcatactacgggagagttggaggaattagcacaagagagatgaatatgcttgaactggatttattgttcggtctggacttcaggctcaaagtggatatagagactttcgaaagctactgcttacagttggaggaagcactggttcttgttttggagagaccaattcaggtccaagaggccaacgtaactaaacacttgatttgtaacagcagcgccgatgagacttgcaaacacgagctcgggcttgaaaggtacagcagtcaggctgtccaagggtgtagttggtaaatgtgattgggcagatagttttgaaaaaagtgtatgggtccgagtattggtaattcttttatttgacatttaagttgttcagttggccttgtttagtagggccgttattctacttctctacaacactagtgcttgtgagccacgccgttcagtttttttgcggagtgagtttgaaaacattactggagtccggccacgttcaagtatcatttcattaattatatttttactaaaaaaaaaaaa

SEQ ID NO: 4971 - DNA, 856 bp, Zea mays
ttttttttttttttttgtaagtcaattctaatacaagtttccttatataagtcaggtatacaacccatcacccaacaaacatgtacttacacttgcaactggacacccacaagtatgcaccaatgtagctacaaattgcaattacacaacgacgagctcgacacaagcagctcatgagcgcaccaacaacctgcctgatcaaaattacaggcgcatggatgcagagagcagcaaggtgccaagccaaggtcaagggcacaggctacgcaggcttctgatcgcgcaagtagcgcacagcggctgcggctcgcgcgtcaccgacaacccgaactggttccaagcgtccaggtactccatcctccagtcctctctcagctccgcggagtcgcggtaccattgcttgcagacgagggagcagctaaggaggtcgacgcagtcgagctgcgagaacacccgcgccatcacgtgtgcgggggcccgcagcgccggcgccgaatcgcgaacacccgcctccgcctgctcccccccttgccgtggcggcgccatggccgatccgccgctccggctcttgtgttggagtggacaagtgggctgcagaaagcctcgatcaattcgcgacccctctgcttctggtgtcaccgaggttgaagaattggaggcggcgatttttattgggattggttacgccacggatccaaactcgattcgtcgacgaggggaggaggggaaaaaatgccatctgattctgacgcgacgagatgttgatggttgtttgtcttgtctgattaggatgttctaggtaatggtctcgtgcataaaaccgctgaaaccgttcatgctaaaaaaaaaaaaaaaa

SEQ ID NO: 4972 - DNA, 2688 bp, Zea mays
tattcggcacgaggctacttccttcggttttactatcccttcgtttccgctagccttctccttccgggcaaccgcgccattcctctcctcctccgtctcgttcgcagtgcagcacatacagcctcgtcctcctcgtctggtgaagtgaaagaacgacaagatctgtggtacggcggtgccggccgacatccacccactgtgctaccccttgcggttccagccagcgcagcgatcgattcccgctggccgctgccgtcggtgcctgcccggtcctccgctactagtacgcggccctgcccgccccggtccggactccactgccagtgccatcccattcccatccgagctgcagcgctcgacgacggggagaatagcgtggcgtgggcggcgccatgaagtacagcaaggaagataagcccgagagggcgggcggcgccggcgcagggtccagggcggtgccggtggcgctcgtcgtcgtcgtgctctgcgccttctccttctacctgggcggcatctacagcacgggacggagcctgctggactccatccagccggcgccgacggctctcctcgccctcggcgccgccacgacgacccgccgtccctccgacgacggccaggctcggccggcactggcgtccacggccgccgtggcgttccccgagtgccccgccgactaccaggactacaccccctgcaccgaccccaagcgctggcggaggtacggcaactaccgcctcagcttcatggagcggcactgcccgccgccgcccgaccggcagcagtgcctggtgccgccgcccaaggggtacaagccgcccatccggtggcccaagagcaaggaccagtgctggtaccggaacgtcccctacgactggatcaacagccagaagtccaaccagcactggctcgtcaaggagggcgaccgcttccggttccccggcggcggcaccatgttccccaacggcgtcggcgcgtacgtggacctgatgcagggcctggtcccgggcatgcgcgacggcaccgtccgcaccgcgctcgacaccggctgcggcgtcgccagctggggcggcgacctgctggggcggggcatcctcaccgtgtcgctggcgcccagggacaaccacgaggcccaggtgcagttcgcgctggagcgcggcatcccggccatcctcggcatcatctccacgcagcgcctgccgttcccgtccgccgccttcgacatggcgcactgctcgcgctgcctcatcccctggaccgagttcggcggcctctacctcctggagatccaccgcgtcctccgcccgggcggcttctgggtgctctccggcccgcccgtcaactacgagaaccgctggcacggctggaacaccaccgcgcaggcgcagaaggccgacctggacaggctcaagaagatgctggccagcatgtgcttcaagctctacagcatgaagggggacatcgccgtgtggcagaagtccgccgacgcctgctacgacaagctcaccccggtcaccacgcccgccaagtgcgacgacagcgtcgaccccgacgccgcctggtacgtgcccatgcgctcctgcgtcacggctcccagccccaagtacaggaagctggggctcaacgccacgcccaagtggccccagaggctcagcgtcgccccggagcgcatcagcgtcgtcccgggcagcagcgccgccgccttcaagcaggacgacgcccggtggaagctcagggccaagcactacaagacgctgctgccggcgctggggagcgacaagatcaggaacgtcatggacatgaacaccgtgtacggaggattcgcaggcagcctcatcaaggaccccgtctgggtcatgaacgtcgtctcctcctacggcccaaactccctcggcgtcgtctacgacagagggctcatcggcgtcaaccacgactggtgtgaggcgttctcgacatatccacgcacctatgacctgttgcatcttgatggcctgttcacagcagagtctcacaggtgcgagatgaagtacgtgctccttgagatggaccgtatccttcgtcccacgggctacgccataatccgggagagcacctacttcctcgattctgtggcacccattgccaaagggatgcgatggagctgcgagaagcacagcagcgagaacaaggccgacaaggacaagatcctcgtctgccagaaaaagctttgggcaggaaagcagtgacgagagaggatcatccttcttccttccgagtataaaaaagtaggcatccagatcggccaacaaggcaagaggcgcttcaatacacatggaagatgagcgagtacttctgatacaaagagtgttcggcagttattatcaaaataaataagccgagtaaaactccatataggatccaacagttaccatttttcattaatcacagtttaattctttttctgtaccgacagtttgtaggcaaggagtgggtcaattcatataccatatggtgagcaaatgtaagtttactccacactagatgtgtatagcttggttggtgctactgctatcgatgtaatagcgggccacgtatttacttcacatgttttgtggatcaatatactatgactgtgatgtcctaaagcgacggattttgttgaaaaaaaaaaaaaaacgagctgtcgccccgggaattattccggaccgg

SEQ ID NO: 4973 - DNA, 1364 bp, Zea mays
cattgggtacctcgaggccggccgggaattccaagtcgcccaccgtgacgcccatcgagtcaaccgaacccaagccgtgtggcgactggcgaggcgagtgccccagttcctaactccggtgggcgcgctcccaccgccgcgcggctcaaaacccgccctcagcctcccgcgctccagtccacacgggagcgggtggtgtcgtctgaagcggcgcgatcaaggagtcttcgggcgctccggacgtaacgtgctggcggttgcttatcaccggatatatatatataagcggaaatgttctccttgttctatggcctgtggaagtatgtgttcgccaaggacgagttccgtgttctgattcttggtgttgacagagctggcaagacgactttgctggagaagttgaaatcgatatatctcaagggggaaggacttccgcctgaccgtgtcgttccaacagttgggctcaacattggccgcatcgaagacgcaaaggcaaaacttgttttctgggatctaggtggtcaggttagcctacgaacaatctgggagaaatactatgaagaggcccatgccataatgtacgttattgacgctgccacagcatcgtcatttgaagattccaaatctgctctggagaaggttattcgccatgaacatctgagaggagcaccactcttgatagttgcaaacaaacaggatttacctggagccattgatgaggaagaattggctaaatttctgcataaagaactggatgagaggccatatacatttcaggctgtatctgcatatgatgggagggggatcaaatctggcatagactggctggtggaacaaatggaaaaaagcaaacgtaccgagacactgcaggctcgtgctggcgtagctggacaaatttagaatggtagcttgcagctgcgaccggatgaatttgttaaagaacaaagcattggataggacggcttccttcgtatcgcgtaagcagccatttgctggattacagggattatcgttccaggccgcccagagtgctgcaagaaatgtttggctggttgctcctgtggtggtggtgattggtgaggcgattcgtttggtattagaggttgcattcatatgtacctaaaggtcacgagcatacatgtctatatgatgcttttcaattttcgtagcaaactagtagcttcaacacagaggatcaaagagagccgtgttctttaacttgtttgtgataaaaaaaaggaagaaaggaaagcgaagaaggaatcactggtgcatctgaaagtctttattggatatgtctaaaccatttcaactgatgctggataagtttttcttaaaaaaaaaaaataaaaaaaaaaaaaaaa

SEQ ID NO: 4974 - DNA, 3044 bp, Zea mays
gccgcgttggataataatttttacatagaaaatcttgttaggctatctatatcagatctactatcctattttctattctgcatctcgttttaaacttcactctacagaatatattgtacgatcatatacatatatgttggacatataggcctgtttggtgtggcgccgaaaccgccacaccgcgcctaagccgcgacgtttgatttggccgccagaactagggcacaaaatatgtggcgcgtgtgggcgtttgcggcggccaaccaaacatagccatagtcttttacactgtttttattgatgtggtgatattatacggtatctgttgttggatgggagtgcaataatgatcttatcctccaaaatttaacttatacgattttaggccctttttaacggataacaagtttgagcctattctgaaatatagggttaaaatcgtaaaataattaaattaaaaacatgagcaaaatcgcaattgtaaatgaaaagaaattatgaccttgtctcctgtattttactctgtcaagtgtctctactctaacagaacatcattaaacatgttcgttatttttaaactcgtgccgttttttttttttttttttggagataaatttataattgcatttctattcagagaatgatacactatgttgtcctttgattgacgatgacgacgaaagacccgatggtcagttggtcacaccaaaactccaaaaggcccagccaggataccagagaaagtcacccaagtgctacagaaagcccatttgcagacaacggctgaagcccacgagccccgctcgcgttaaccctttcggcggcgtttcgacgccccatcccggcggcgtccgctggcgtgcgtcgtcggcgagcatggcacggtggtcgtcccctaaggaccctgccctggaggcggcgctccggcgcaaccgccgctgggtcgtcaacaaccagatcaagcgcctcctactccgcttcccgtcccgcacggcgcccgtgcgtttcctccaatcccgcttcaagacactcgatctcatgggtcgcgccgccaactggctcagcaagtacccttcctgcttcgaggtcttctccgcggacgatggtggcggtgagcaggaaccccatttcggcttcaccaagcggatggcggcgctcgtccacgcggaggaggctgccgtcgcggcttccgagccggccatggcggaccgcctcgcgcgcgtgctcatgctcgcccgcggccgccgcctacaggtttccaagctcgccgcgctgcggggccctctcggcctccccgatgactacctcctccgcctcgtccccgccaacaccgatctcttccgcctcacaaacccctacccgcaccgccgcaacgccgctgagctagagctcgtcagatgggctccctctctcgccgtctccgccgtcgaggccgcgagcgactcgaccccacggttcagctgctcgctgccggcctcatgggtcaagtcacacgccaagatggaggatttcaacgcctccacgccttacatctcgccctactcggagtgggccttgccgggcacggatgccgaagccgagaagcgatcggtggccttggtgcacgagctcctctctctcaccctgtggagaaagatgtcgattttgaagctggagcattttaggagggagtttgggctaccggaggacacggcgaggatgctgctccggcacccctgcctcttttacgtgtcgaatcggtacaagatacatacagtggtgctccgcgaaggttacgaggggtcagagctgagggagaaggatccggtggtcttggccaaggatcggctcggggagctgatgcaggaggggctgcatgagtataaccaacggcggcgagggatgaatattgagaagaagaggaggagaggggaggttgaggtaaagaaagagaaagaggtggaggatgaggaagcggcgcgcttggatagtgcagagaaaagagaggagaggaggcggttttataaggtgttgtttggtgatggcaatcggtaattcccagttttgctctgttgatattgaaggtgaacatcatcagtgcatagctgctgctgattgggctgtgttgatattcagaggaaggtgaacatcatcggtgcatagctgctggttggggtttgagcattaccctcttcccattatgtgatcgaaaacatttgcccgtggccttgttctcgcgggtgcaataaggttgacaaactgtctgcaagtgaaaatggtaccaatgtgtgctgttttcttgtcacagggcatgggatctgttaactgttaactagaatgtatgagtgaagaaaggattcccacaggcaccagatgctttgatctgtctaccaatcgcaacaatttaaacactttggaccaaggtaataagtcaagtattgttacagaggcagcagaatatattgttggcatggatgtcggccttcacactcggcaatggggaaaacacaacagaacggtttctgatcttgtgttagggtacaatggtttggcgtgatgccatggagtgatccttggaggtgcctggtgtcctccctgccagtgcctgaagcaaaccatcctccatcagatttctctatcctcctttctttatacttacaatctctctgtttgaatgtgaaacatagtggtagagtagctaaactatttaggacctgagactgacgtgttcatgttgttagggagaagaaagatcccatggtccactgactcgggtgcatggggccttgaccaggatgcttaagctcgtcttggcattagttgagggtaacctcgtgtgttaacagaagacgaacaactttgttgaaggacttgagttcttttagcttgttgcttctattcttttgagtctgcttggttgtgctatggctgtgaaaaaagttgttgttggttgtgagctgtggaaaaagctgttgtaggttgtgagctgttaaaaagctaaacacagtttagtgaaaccactaatagtcgttaaaagttcttcgatataaaaaaaaaaaaaaaaa

SEQ ID NO: 4975 - DNA, 777 bp, Zea mays
agcgcattccctgaaggggccccgagagaaacctagctcagtggctcgagcgcaaactctgcaagggcttcggatcccacaccgaggaaaggagaagagagggtcggaataatggcggccgaggagggtgccgtgatcgcgtgccacaccaaggacgagttcgacgcccgcatggccaaggccaaggagcagggcaagctggtggtcatcgacttcgttcatggccccctggtgcagtgggtgccagatgatggccccggtgtacgcggactgcgccagcaagtacccttccgcggtcttcctcgaggtcgacgtcgacgaactgctggaagtcgcgaagatctacggcgtccatgtgatgccgaccttctgcttcatcaggaacggcgagacgctcgagagctttgctaccgtcgacgaggacgagctccgggacgccgtcaggaagtacgccgccgctggcactacgacggctcctgcctcggcgtccgcctaattcaggagatgtgatgtgtagcaaatagcgcgcgcgcaccagtcgtcaataaataaataaataaataaataaataaataaataaataaataaataaaggccaacgtacgacgacaaattagtggcgcgcgcggtagtagctagcagagtatgcgccgccactgtgtcgatctgcagtttggtcgtttaagagtgattgtagtgtgtactatgttcagctcgatgatctcggagtcgctatatacgctcgctcccgtgctggacgggttatcgatctggtga

SEQ ID NO: 4976 - DNA, 821 bp, Zea mays
cattgggtacctcgaggccggccgggaacaatggggtcctccaggcccggcggggagcgcaaactctgcaagggcttcggatcccacaccgaggaaaggagaagagagcgagggtcggaataatggcggccgaggagggtgccgtgatcgcgtgccacaccaaggacgagttcgacgcccgcatggccaaggccaaggagcagggcaagctggtggtcatcgacttcatggccccctggtgcagtgggtgccagatgatggccccggtgtacgcggactgcgccagcaagtacccttccgcggtcttcctcgaggtcgacgtggacgaactgctggaagtcgcgaagatctacggcgtccatgtgatgccgaccttctgcttcatcaggaacggcgagacgctcgagagctttgctaccgtcgacgaggacgagctccgggacgccgtcaggaagtacgccgccgctggcactacgacggctcctgcctcggcgtccgcctaattcaggagatgtgatgtgtagcaaatagcgcgcgcgcaccagtcgtcaataaataaataaataaataaataaataaataaataaaggccaacgtacgacgacaaattagtggcgcgcgcggtagtagctagcagagtatgcgccgccactgtgtcgatctgcagtttggtcgtttaaaagtgattgtagtgtgtactatgttcagctcgatgatctcggagtcgctatatacgctcgctcccgtgctggacgggttatcgatctgatgaacaagaatacaataatatgtatggatacttgtgacggggtttccgcggc

SEQ ID NO: 4977 - DNA, 1035 bp, Zea mays
agtacagtaataggggagggggcgcgtgggggcatgcgtcgaagacagtctcagatgtctggcggcgcaggatcgtagcaccgagggtttccagtccacgttctagaagattcccgtctacattggccgaccccgcggcccacaccgtatatcaccgcctcctatccggcctctgcccttctcgccgaacggaaaaccctgcccggaccttcgttgcagcgctacgagcttcgacgggccgctcgatctccacctctgaagtggctgcttgtgatctagatctgaaagctgcagtggttgacagctgagtgtgaaactgtgaatcgaagatgagcgtggtgggcttcgacctcggcaatgagagctgcatcgtggcggtcgcgcggcagcgcggcatcgacgtggtcctcaacgaggagtccaagcgcgagacacccgccatcgtctgcttcggggacaagcagcggttcatcggcaccgccggcgccgcgtcctctaccatgaaccccaagaactccatttctcagatcaagcgcttgctaggccgcaagtactccgaccccgagctacagagagatctcgcctccttcccgttccgtgtcacggagggccccgatggttttcccctggtccatgtacgatacctgggcgaggaacggacgttcacctctacccagctgcttgccatggtgctgtccaatttgaagggcattgctgagggtaacctgaatgctgcagttgttgattgttgcattggtattccagtctactttacggatctgcagcgcagggctgttcttgatgctgctactattgcgggtctccagccattgcgattgttccatgagacaacagccactgcactggcatatggtatttataagactgatctcccggagaatgaccagttgaacgttgcatttgttgatgtcggtcatgcaagcatgcacgtcagtgttgtcggttaccagaagggacagctcaagatgttgtcgcatacgtatgaccagtctcttggcgggagggactttgatg

SEQ ID NO: 4978 - DNA, 1476 bp, Zea mays
gcagagcgacgagcgacgagctaaaccccgaccgagtcgctgcttgggtgcccaagatagccctaccgcctcgcctctctcgttccccctcatcgccacgccagtcgcctccactcccagtcatctcccatcaccgacgacgtgtcgaggcgagagaagagggcgagtccaagtctagggttcccgccgcatcgacacgggcatcgcaccgcaccgcgaggggcgggcacggaggaagatggcaccgcgcgggcgcgtggagctgcggcggatcgaggacaaggcgagccggcaggtgcgcttctccaagcgccgcgcggggctgttcaagaaggccttcgagctggccctgctctgcgacgccgaggtcgcgctcctcgtcttttcccccggcggcaagctctatgagtactcctcctccagcatagaagatacatatgaccgctatcatcaatttgcgggagcaggaagaaaagtgaacggacataacaacgataaccgggatgtagctgcttcagatttacagtcgagacttaaggagatcgcaacatggtctaaacaaaacaacgctgaggagtcggatgccaatgaacttgagaaacttgaggaactcctgacaaatgctttgaggaatacgaaagccaaaaagatgttggcaaaagaaaacaatggtggtgccggtgcaagtacaagcagccagatgttgctttactcggcagagcgtgcaaccgacaaatgaaacggggcgtgcatctgttgctaacggggcggtgccggtgccgcatactattgttgtgtagctgaggtttgtcaaggtggctgctggcaaggttagccgaggaagtggagttcaataacaggatgcggaaactgtgccgctccttgccgaacttaagccccgttacgttgtcgcacaaagtttatttcctagcactgtgcttgctgcttatgtttgtttggatgtgccaacctgcagtgaccctcgtggagcctgggtctcacgctcctcttacctagtgtgatgtgcagaaaaagtgtgatgctgtaaaattatgtgattgcctagcagatgtcaaattttcaatcagtagctaactccttttaatggtaaaaaaaaaaaaaaaaaaaactccaaaaaagagagggcgggttgggtgtcaaatctagccggatgttttcgcaagtttgtgataaaaattgtgctgtacacttgtgtttatgcagttgccctaggcgtcagtgggctgaaaggtaatatctgtgaattatatactgtgtgctgaaagcagttgtcataataatgatacgaaaacaaaatcttatgtcgttaacctatataattttttttaaaaaaaattgccgatcaaatcgaaatatttgatataataaaacataatactactagatggaggaaagttagactgaccgagtatggaggaagtatctaaggggggtgtttggtttctaggaaacaaa

SEQ ID NO: 4979 - DNA, 1626 bp, Zea mays
ttgggaccctcgaggccggccgggattaaacaggaagcagaacagttcaggcaatggaaagtacccgcgagaaggaacttcttcagttacgcaaggagggacggagaaatgagtatgaacgccacaagcttcaggcacttaatcagcggcagaaattggttccgctccggaagtcccgggtcgcccctcgcgcccccaaaaggctgaaagagatattagaagctaggaaatcttccgcccgtgacagttccgctggcagcaatggtacttctccaggctataatatgggtgagagatcgctgcaaaaatggtttgatcaagagcttgaagttatggtgcatgtgcatgaagtccgaaatgagtacgaaaaacaaagccaactgcgtgctgcgcttggtgaggagcttgccattttgaaacaagaagatatacgggctggtggatctagtccccaaagagggaagaatggaaactctaggacaaataccttgtcaccaaatgcaagacaagctaggatagcatcacttgagagcatggtgacaatctcttcaaacactcttgttgcaatggcttctcaactctcagaagctgaagaaagagagcgtgccttctctgggcgtagtcgttggaatcaattgcgatcaatgggggaggcaaagagcttactgcaatatgtctttaatgttgctgctgatgccagatgccaagtaaaggagaaggaagtggagatcaaggaaatgaaggaacaaatgacagagctggtgggcattcttcgacacagtgaatcacgcagaagagaaatggagaagcagctcaagcaaagagaacagacaactccaatggccactacacctccgaaaagtggaaatggcacgacgaagcactctgctgatgaccccaacacaccactgtcccctgtcgccgttcctgcacagaagcagctcaagtattctgctggaattgtaaatagccccagcaaaggagttgctgcgataaaaaaagagcaacttaagatggttccaattgcacagttgtctgcggggaagagagtttcaatagcagggcattcaggaaagctctggaggtggaaaagaagccatcaccagtggctgatgcagttcaagtggaagtggcagaagccgtggaagttgtctgaggtgatacgacacagtgatgaaacaatcacgaggattaggcccagacctccacttcttccacataaacctcataactgatgtgaaacggacttgtttttgtctcaacaagaactgacacggtttgcaaacctacacagctaactgcctgcacaagccttcactgacggtgacatgtcaatagttggtgttcgtcttcacaaaggaatctgtcaaaggaaggcgccttgtaaagtctttcttgtgctgttgtgtgatagttttgtgtgaagggtaactgaaagttgaatgggttttgtgctcgagtgatagtctattttcccctcttcttttgtttgttgatactaaaatgagaaaagacaagtgatattggtttggtttgctaggagtattgtgatgtaatgcagaaacttgttcccctatatcagtacacccttttaatctatatatcgtggagtactgattgctgact

SEQ ID NO: 4980 - DNA, 4705 bp, Zea mays
tggcacttaatcagcggcagaaattggtcaatttctttcctaaagagatgacataagaaatgttgttctatgtaaatgacaaaaaaaaaacaaatgaaacaaaaaaaattattgcatattaggtgctagacaatatttatacagcaccctttttctcacaaaagagcctccttctaaacattttccttccatttttcaaatttttacatcttttattctatagatcctttctaaacatttttatttcactttcaatctattctaacagctagagtcgacaacttttttttgcaggttttgcaaaggaagaccgaagaggctgctatggctacaaaaaggctgaaagagatattagaagctaggaaatcttccgcccgtgacagttccggtatctttctctgcatcttgacattatgtatttgtgtacactaaaaatactttgaatctaatggttcccctgttcttccctctaaacatagctggcagcaatggtacatctcaaggctataatgtaagattatctatacctaacattcctaagtttatttacacaattgatacctaaagccattcttgatataacacagatgggtgagagatcgctgcaaaaatggtttgatcaagagcttgaagttatggtgcatgtgcatgaagtccgaaatgagtacgaaaaacaaagccaactgtacgtaactcttatttttgctgtcaaatgtggacttttttagacatgtattttttcactgatttttttttgttattgaaggcgtgctgcgcttggtgaggagcttgccattttgaaacaagaagatatacgggctggtggatctagtccccaaagagggaagaatggaaactctaggtgattgttttcttttcatttgcgaaagggactctagtgtaatggttaaggcttccgattagcacctttaggttctgggttcgatctccctcgggggtgaatttcttgcttggttaaaaaaatatcctcgttgtgtcccgctcgctcccgggttacgtcctgcgtgccaccctccggctacaccgttgcagagtgggttgtgacggcccgctagtgatgggggctagggttcgggagttttctcggccggagtttcggtgtcttcttaatataatactgagaggacggtctttgactccccggccgagtttttttattgttttcttctcatttatttgatactaggtatccattgcttgtaattaattcatgtaagaaaaaatagcacaccctttacacgtagcaagatgtccaatccagtcctctaatacgtttttaacatatttaatctgttttgatcttaagtggcaattagggcatccaaatactaatgcatatttgactgcattttatttctcaggacaaataccttgtcaccaaatgcaagacaagctaggatagcatcacttgagagcatggtgacaatctcttcaaacactcttgttgcaatggcttctcaactctcagaagctgaagaaagagagcgtgccttctctgggcgtagtcgttggaatcaattgcgatcaatgggggaggcaaagagcttactgcaatatgtctttaatgttgctgctgatgccaggttatcttttttttggttcttcatttcatgttatgacatgagctatacctctggaagttctcaactagtaatgtttggaactaaaaaatcgtcccttaaaaaagaaatagatgaaaaaccattaccttatgctttttcttagaatctgataccactttgaagtagaatagttacctgttatcttgttatttggttagacacctattggggaaaaactcaactacgggaagaggcccacggctgtcttgcaaagccaagttattgtcatatttttgccttaaaaaaatcagtgataatcctctaaactattaaaatatttttcagatgccaagtaaaggagaaggaagtggagatcaaggaaatgaaggaacaaatgacagagctggtgggcattcttcgacacagtgaatcacgcagaagagaaatggagaagcagctcaagcaaagagaacagacaactccaatggccactacacctccggtatgatttctcgcagcatcgtgcatgatttcaaccaaagttgatgtgcaatcaatgtgtacagttttaagcaggagaaaatcagcttgtcctaggatacaatagacgagctaactgatatatataaagtgatacactatgaccataacaatataataaaaagaagcaatgaacattcaagttactaatttcacttcttacagaaaagtggaaatggcacgacgaagcactctgctgatgaccccaacacaccactgtcccctgtcgccgttcctgcacagaagcagctcaagtattctgctggaattgtaaatagccccagcaaaggagttgctgcgataaaaaaagagcaacttaaggtatctagtatcgtactgtatctcatcatcattgttgccatctgtcagtatttaatatcttcattgacaattttcaatgcagatggttccaattgcacagttgtctgcggggaagagagtttcaatagcagggcattcaggaaagctctggaggtggaaaagaagccatcaccagtggctgatgcagttcaagtggagagtggcagaagccgtggaagttgtccggcgtcgtacgacacagtgatgaaacaatcacgaggattaggcccagacctccacttcttccacataaacctcataactgatgtgaaacggacttgtttttgtctcaacaagaactgacacggtttgcaaacctacacagctaactgcctgcacaaggtaacaatgcagttaatactccatgagatctccttcgtgcttgtttttacttggccacgggatcgacaagtatgtgttcatgggtgactcttgtctatggatagatgtaaattccctgtgggttggtataaagtgagatgtcaacgtagagaaagaaaatagttagtgggtgagtgagcagagtgaatgggcattctttcatgcaaatactgagcacaatgcttaatgtttcagccttcactgacggtgacatgtcaatagttggtgttcgtcttcacaaaggaatctgtcaaaggaaggcgccttgtaaagtctttcttgtgctgttgtgtgatagttttgtgtgaagggtaactgaaagttgaatgggttttgtgctcgagtgatagtctattttcccctcttcttttgtttgttgatactaaatgagaaaagacaagtgatattggtttggtttgctaggagtattgtgatgtaatgcagaaacttgttcccctatatcagtacacccttttaatctaaaaaaaaaaaaatactgattgctgactactgttgatgtccgaagggatccggattacacaccgcacgtcttcggttgacacacgacattaaatacagcagggaacatagaggatggacaaaatcgatcgagaaactgatcaacccaaagttgactcgaacattttcaaggaagactagtcacggagaagcacatgagattgttgtaggagtggcaaaaccacttagaacaccatcaaatctcaccgaaagacatgaacactgagaaaggaacaaaaagatagtaggtgtattttgatcgatggatctcatatatagagcgaggatgaggggttatattatcccattaggaaactactttaaaacatgttgggcaagttattaattctaaaaccagcccggagggagagagatttgagtttgtagccaccctacctacaacaatagagcatgtagtctatcagttggtggccaaattgttggaggatattcgagtggttagtgagtatccgaaagtgtttctgaaggagttgccaggtatgtcacctgatcggaacatagagttcattatcgatatcttacctagagatgcccctatatatttccaagagaccttataggatgtcgattgaagaattaaaagaatttaagagacaataaaaggagttgatgtatatgtgatttatttgacctagttcctcaccctcggggtcacccgtcctattcatacagaaaaaggatggctactagaggatgtgcatggattatcgattgctcaatgaagtaactatcaaatataagtattctttacctcgtatagaagatttgttcaaccaaatgagagaagcgaaagtttttttctaagattgatctatgatccaattatcaccagatgaagatcatgccactagttatgaactatatgagtacataatgatgttctttgggttgacaaatgtaccagccaacttcatgtattgatgaacaaggtgttcatggaatatcttgatagattcatcgtagtatttattgacgatatcttgatttatttgaaggatgaggatgagcatgaggaacacctaagactagtactgtagaagttgagggagaatcaactccatgacaaatacagtaagtgcaagttttggttgaatgaagtatcattccttggacatgtcatcaccaatggaggcattgttgtagatccgagcaaggtctaggatgtgctgaattggaagccaccacaatcggttacaaagatctagagttctctcgaactggttggatattactaacgattcatcaaagaattgtctaaaatagtgaaacctctcacttctctactagaaaaggaaaggagt

SEQ ID NO: 4981 - DNA, 774 bp, Zea mays
gggggtttcctcaacttggtgttggccggaagtacctctgcccttcgttttggtatcattcttggccttgcactgttggctctgggaatctcaagtttgagatcacaaagagatggcggccgtcggcctcgtcttctggtgaaagggcaagctgcaatagccagtgtcatcttcttcagggagttttcagttcttctccagaatggctggtttccaaaaatcttcatggttctcctcagtggagtagtggcaggcttttacttctatcgcattgcagctggtagccccaaagagctgagcagcaacagtgattcagtgaactaatgcacttggatgaatcagatgatcatgggggaacgcagacccagaaggctatggcctgtttgctttcgatttccttcatcatccttcaattcaggcaaagctcggttgtaaggtgtccgcatgatgaccacatggattcagaagaattgcttgtttactcggccctcttcccgcactcctttgttcctttgctcatgtagtatagatgatagacttgaacaacatcaataaacgacattcaaaggccatgcagttagctcttcagtttgtctgctgtttgtttttcatggggacagcccgaaaggtcggtgaagcgttcaatgtttcgtgaagtgtccgaaaacagtcagtgttattactctgtagattccagctcgctcaaaactattcaaggccgatgacaagttgataacaattagtggccaaaaaaaaaaaaaaaaacccgcggcc

SEQ ID NO: 4982 - DNA, 1216 bp, Zea mays
aggttgagatgaacgtctctcgccaaaactccatctaaaatagcagcgacgagacgagcgagaatatctgccaattcaaaaccaaaaaggagaggaggggagccccggacggagaagagaacagaagaaaccccgcggccaccccttcctgcctatatttctctctctgtcttgcgcgacagggagagaccagcgccaacacctccggtttcttgattgggtggtgatcggtgaaggaaggagaaattaagatgagcctcttcgggcttgggagcaagaatcagaagacgttcaggcctaagaagaatgcaccgtctggcaacaagggtgtgcagctgaagaaacacatcgatgcaaccttaggaagcgggaatttgagggatgctgtccgattgccaccaggggaggatctcaatgaatggctagctgttaacactgttgatttcttcaaccaggtgaacatcctgtatggtactctaatggagttctgcacaccagctacatgcccaacaatgtcagctggaccaaagtttgagtatagatgggccgatggggtgcagatcaagaaaccaattgaggtttcagcaccaaagtatgttgagtacttgatggattggatcgaagctcagcttgatgacgaatccatcttccctcagaaactcggaaccccttttccacaaaatttcaaggaagttgtgaagacaatctttaagcgacttttccgtgtttatgctcatatttaccactcacattttcaaaagattgtcagccttaaggaggaagcacatcttaacacttgcttcaagcattttacattgttcacttgggaattcacgttgattgacaaggctgagcttgcaccacttattgatctaattgaatccattgtttcagtttgttgacatgacatcaatgattatttggatcattttcttatttttggagagcaaggagttacaactaagtgtccagtatgagggtgagactaagaatggtcaaaagtttttttttgttatcttttaggtgtctgtctctacaatgggacttgtgcatgtttgtcttatgaagtcctgaagaaactatttagggctcaatgagataatgttgtgtatccttctcttgaatgactccataagttctgtttgcaacaagcattaatttctcattcctaaaggagaactttattcatctattcatgttaaaaaaaaaaaaaaaa

SEQ ID NO: 4983 - DNA, 1594 bp, Zea mays
  misc_feature (693)..(693): n is a, c, g, or t
ttctggggtaggttcagttgaatgttgccggataccgtggtgtgtaatgaaccgatttcccaccttcggcactcttgggtggttgcaccgcgcccaactcttggagtgcactgcactgtcctccgatacgtcacgtctaagaagactagaagaggacggtcttctatgagaacattgggctggccacagtatgtatgtagctgcaaaaaaaaaaaaaaatgtcgaaatttaccgcaaaaaaaaagagagttcattttatggctgacaattcattgcatgtttgagttatagtaaaaaggttatgctcatatgactgagttatagatttatttagataaatttacaactaaattagttttactgagatttatcacaaattcaagtaaattaaatgaaaaagaagaaaaacatcacgtaaacagccaggaggtcacgtcggatcttgaaagataagtgaggagttatatctgattttatagttaagggaggaaatatgagttttgtgtgatcgagagagataaaatatacttttttccaattttacccgctgaccatctccctctgctgcaccgcccaccccatcccgatgaaactgtggaaatacagtttgcgtcagcaagagaaaatttctcgtgttaagaaagacaacaaaattccggttacaatacggcatatcgttgaaagtgcgccggnttcaaacgcgaagcaacggcataccgtcgtggtcctggactggacctggatggtccagctgttctgcgagcgcacctaccccagaaaccagtccgcgttcgttgccacgctcgatcggattgctttgcttctcgccaaatttagtggtcgtgtacctaccctaaaggcctaatccatctcattctcaccgatatatatacatccctctccgtctccctaccgctcccgtcccgtccgctgctggctctgcatatcccgcgcccgactcccgttgctgcgtgcggcggcccgactagtcgcgccgcgctgcgcttggcttgattgaaccggccgggatgggggtgttggaagacctcgtggcgagagcgggcgggtgcgcggtcatcgacggcggcttcgccacgcagctagaggcgctcggcgccgacatcaacgacccgctctggagcgccgcttgcctcatcaccaggccgcacctcgtcaaggaggttcatatgcagtatcttgaagctggtgcggacgtcatcatttcatcatcttaccaggcaacaatcccgggtttcatagctagaggaatgtctgtcgctgaggcagaagatttactgcgaacaagtgtaaaactggccaatgaagctcgagatgaattttggaagtcaacactgaggaagtccaaacctatttacaaccgtgctctggttgctgcatccattggtagctaataacagctctgggccaacgacccgccgggccggcatgttttacgctgtatgtttgcagttgcgatgcaatgcgtgcgacccccaacaggcgccatctgtttgctgtgtttctgttctccacgagtacccacgagaaataaactattgctgcgctagatgtgaatgtgatcctgcagatactg

SEQ ID NO: 4984 - DNA, 1355 bp, Zea mays
atacatccctctccggctcgtccccgaccgctcccgtcccgtccgctgctggctctgcatatcccgcgcccgactcccgttgctgcgtgcggcggcccgactagtcgcgccgcgctgcgctcggcttgattgaaccggccgggatgggggtgttggaggacctcgtggcgagagcgggcgggtgcgcggtcatcgacggcggcttcgccacgcagctagaggcgctcggcgccgacatcaacgacccgctctggagcgccgcttgcctcatcaccaggccgcacctcgtcaaggaggttcatatgcagtatcttgaagctggtgcggacgtcatcatttcatcatcttaccaggcaacaatcccgggtttcatagctagaggaatgtctgtcgctgaggcagaagatttactgcgaacaagtgtaaaactggccaatgaagctcgagatgaattttggaagtcaacactgaggaagtccaaacctatttacaaccgtgctctggttgctgcatccattggtagctacggagcctatcttgctgatggatcggagtacagtggatcatacggtgctgacatcacagccgagaagctgaaggacttccacaggcgccggctgcaggttcttgcaagtgccggtcctgacctgattgcgtttgaggccattcctaaccaaatggaggcacaggcattggttgagcttctggaggaagagaaagtccagatcccttcctggatctgcttcagctccgtggacggtaagaacctgtgctctggggagagttttgcggactgccttaagatcctcaacgcgagcgagaaggtggccgttgtaggcgtgaactgcacacctcctcagttcatcgagggcatcatatgtgaatttaggaagcaaaccaagaaggcgattgcagtttacccgaacagcggcgaagtttgggacgggagagcgaagaggtggctgccggttgagtgcttgggtcacaaaagcttcgacgctctcgcgaagagatggcaggaggcgggggccagcctcatcggagggtgctgccggacaacgccttcaactattagggctgtttccaagatcctcaaaggaaggacggggcattgatttgtttattataattgagctgttgttgcattatgtcactagccagaataacattcagaatatgtatcctgttgctcttccgttcccctttctaaaataaggtatcaatataattttgcagtgtaaaacgtaatactagtttgtagcgctgacccacagtattgcttagtctccaaaaaaaaaaaaaaaagttgggttcccaggttaggttgggttttaacaagactactaaattttctt

SEQ ID NO: 4985 - DNA, 2466 bp, Zea mays
actacacacgcgcacagccgtactcggttccagctacagagaattcgtccaggaaagtaaaaaaactcccccattcgcgagggacaggagggaggagtcaccgcgtgagctcaggaggaagagggagaaggagaggccgccggcggcggcgcggcagaccgggaaccgccgtgtagcactggggtggtggacccgcgcgcccatgcgtcggtgaggtggtggggcccgcttggcgctcgagttggaatggcggcggcagggaggtggtgggcggtggtccttgcggtcgcggtgctgctcgggccgggccgggtcgtcgccaacaccgagggcgatgctctatacagcctgcggcagagcttgatagatacgaacaatgtcttgcagagttgggattccactcttgttaatccatgtacatggtttcacgttacgtgtaacagcgataacagtgttatcagagttgaccttggaaatgcacaattatctggcgtcctagtgccacagcttggtcagctgaaaaatctccaatatttggagctttacagcaacaaaataagtggggcaataccccctgaactggggaacctgactaaccttgtcagtttggatctgtatatggacaacttctctggcaatatccctgacagcctagggaatctattgaagctgcgtttcctacgtcttaacaacaacagcttggttggtcccattcctgtagccttgaccaatatctccactctccaagtactggatctctcgagtaacaacctctcaggaccagtctcatccaatggctccttttcactcttcacccctataagttttaacaataatccaaatctttgtggccctgttactacgaagccctgccctggggatcctcccttttccccaccgcctccattcaatcctccgtctcccccaacccaatcaactggtgcttctggccctggagcaatcgctggaggtgttgctgctggtgctgcattggtttttgctgttccagcaattgcatttgcaatgtggcgccgtcgtaaacctgaagagcatttcttcgatgttcctgccgaggaggatccagaagttcatcttggtcagctcaaaaagttttcgttgcgggagcttcaagttgctactgatacttttagtaacaagcacattttaggaagaggtggttttggaaaagtgtacaagggaaggcttgctgatggctcattggtagcagtgaaaagactaaaagaggagcgcacacctggtggtgagcttcagtttcaaacagaggttgagatgattagcatggcagtgcacaggaaccttctccgacttcgtggtttctgcatgacacctactgaacggttgctggtctacccatacatggctaatggcagtgtggcatcacgtttacgagagcgccaggcatctgaaccacctcttaaatgggaaacaagaagacggattgcactgggatctgcaagaggtctttcttacttgcatgatcactgcgatcctaagatcatccatcgggatgtcaaagctgcaaatattcttttggatgaggagtttgaggcagtcgtaggtgatttcgggcttgccaagcttatggactacaaggatacccatgtcacaactgctgttcgtggaacaattggacacattgctcccgagtacctatccactggcaagtcctctgaaaagaccgatgtttttggatatgggatcatgcttctggagcttattactggacagagggcatttgatctagctcgtcttgcaaatgatgatgatgttatgcttcttgactgggtgaaaggactgctgaaggagaaaaaggtggagatgttggtggacccagatctacagaatgcctacgaggagatcgaggtggagaaccttatccaggtggcactcctctgcacgcagggctccccgttggagcgtccaaagatgtcggaggtggtgaggatgctggaaggtgacggcctggcagagcgttgggacgaatggcagaaagtagaggtggtgaggcaggaggccgactcggcaccgctccgcaatgactggatcgtcgattccacgtacaaccttcgtgccgtggagctgtccggtccaaggtagtagccactccatgactccgaagaaagaattcaacactgaattgcctagattcagtctaattgctgcttgtgtatatgaaaggtagcttttggaattgttagcgacagtcaatatgaagggatgttttttttataattcctcgctagcctcagaagttggggggtaggctgcagttgtgttaaggtgaaaattcgtatacccgagagtgaatttctgaagcattgttgtagtggttcggggaatgtagcagcgatcgtccaattgtactacgtgctatgaagaacagtgctaccttttggccatagttttgcgtttcgaaaataaaaaaaaaaaaaggcccctagggcc

SEQ ID NO: 4986 - DNA, 2924 bp, Zea mays
cgccttggcgccgtcgtaacctgaagagcatttcttcgatgttcctggtctgtatcatatggtgtactttgttttttgttaacccatattgcctgtttgttcatctgctggcccattttgcttcagccgaggaggatccagaagtccatcttggtcagctcaaaaagttttcattgcgggagcttcaagttgcaactgataatttcagtaacaagaacattttaggaagaggcggttttggaaaagtgtacaaaggaaggcttgctgatggctcattggtagcagtgaaaagactaaaagaggagcgtacacctggtggtgagcttcagttccaaacagaggttgagatgattagcatggcggtgcacaagaaccttctccgacttcgtggtttctgcatgacacctactgaaaggttgttagtctacccatacatggctaacgggagtgtggcatcacgtttacgaggtactttgttctttattctaaaaatactgattccatagccccaactaaacaagcagaatattagcttcctgttctcattaatatttctgattccatagagcggcagccatctgagccacctcttagctgggaaccaagaagacggattgcactgggatctgcaagaggactttcttacttgcatgatcactgcgatcccaaaatcatccatcgggatgtcaaagctgcaaatattcttttggatgaggacttcgaggcagttgtgggtgatttcgggcttgccaagcttatggactacaaggatacccatgtcacaacagctgttcgtggaacaattgggcacattgctcccgagtacctatctaccggcaagtcttctgagaagactgatgtttttggctatgggatcatgcttctggagcttattactggccagagggcatttgatctagctcgtcttgcaaatgatgacgatgttatgcttcttgactgggtaagtaaattttcttctcaatacaagtgtcacacacagtattaccgtgtgacagattatatttttttctttcatactttttgctgtctatgggctatattttattaattttctttcttaaagattggtgccaaagctaatcctgtaatcatgaagtgcccttgatccattttcttaattagagagcacgcactggcaagttacaagctgggtagttcaccctccaggggacatgcatcatgccttgaatatgctaatgcacaatcagtcgacctaccatgtgcctgctgcattataagaacatgttcaaccatcagaaccgtggaacgggtagattgctgatgagaaaaacaagctggcataaatgaataattcgcaattggcatcttgcaggtgaaaggactgttgaaggagaagaaggtggagatgctggtggacccagatctgcagaaagcctacgaggaggtcgaggtggagagccttattcaggtggcactcctctgcacgcagggctcccccctggaccgtccaaagatgtcggaggtggtgaggatgctcgaaggtgacgggctggcagagcgttgggacgaatggcagaaagtagaggtggtgaggcaggaggctgagtcggcaccgctccgcaatgactggatcgtcgattccacgtacaaccttcgtgccgtggagctgtccggcccaaggtagccactccacgactccgatgaaagaaaacactgaattggccaagattcagtctaattgctgcttgtgtatatgaaaggtagcttttggaattgttagcgacaatttgaaaggatcttcttttttttggattcctcgccagctcagatgttggttacgctgaggttgtgttaaggtgaaaaattcgtgtatctaagggtgaatttctaaagcattcttgcaatagtccagcgaatgtagcagcgattgtactacgtggtatgcagaaccgtgttacgttttgccatagcttagttctggttcagctttctaagccacggtcaaaagtttggaatcttacttagggctagcttagaaactcaaatctcctttccttctcaaccatctccaatcctagagagaatttggggatttgatatttcaaactagccctaaagtggtaatagcaggtggatagatttttaaaatctacatagtctagtgcaatataaaatcttttattacccattttttctaaaatactatttatatgtccccgcatatgagattgaattgttttattttctatttggaggtctttcacctgacttgtcgcattactcttacctgacgacacctctcaagagtggccaaggttgccatcatctaccagcgatatggctcaatagtccctaaaccatcgcatctattccccatcgaccatttagcgctgctcatcgactcatcatcaaacattcatgccgcctgtgttccatccgatgttgccctcttcaacatcttcctagctccacattgaggtttgacgatgatgcaacacctatgctttagctgctatcgccatgcggcactgctcatgtaggacgctatgcacgcgctagagtgactacagccacaatgcttgagcctaatgctgcagtcatagggcccttgtggcacgtcataccgtcccctcattagtgatgatctgctgtgttaggttgccacaccgttatactcttaaagaatctatagtagacgattgttttaaccagacaacttttacttttcctacatctgtcaattcataacacttactcatagcttacaattagaatcagtttttcaggaatctacggccgaaccaaacagatcattagtatgtgtttttttttgcatcttgaaaaatctatttacattttcattgcgtaaaattacaatagtacaatggatactcgttgaatcgacgatacataactaaatgtgaggctgatatgtaccaaaa

SEQ ID NO: 4987 - DNA, 2513 bp, Zea mays
  misc_feature (2464)..(2468): n is a, c, g, or t
  misc_feature (2491)..(2495): n is a, c, g, or t
attacacacgcgcacccgcccggccgccccaggtgtcgactttcgagctccagagaattcgtcccggaaaagaaaaaaaatcacccttccatccgcgagagagagagagaggagtgggaggaccggaggaggagttcaggagggagaggtcggcggcggcgcggcagatcgggttgcaccgtgcagctcgggccttaggcgcaccagcggtggggggatccgcgcgcccatgcgccggtgaggtggtggggcccgcttggcgctcgagttggaatggcggcgtcggcgtcggctgggaggtggtgggcggtggtccttgcggtcgcggtgctgctcgggccgggacgggtcgtcgccaacaccgagggtgatgccctgtacagcctgcgtcagagcttgaaagatgctaacaatgtcttgcagagttgggatcccactcttgttaatccatgtacatggttccatgttacgtgtaacaacgataacagtgttatcagagttgaccttggaaatgcacaattatctggcgttctagtgccacaacttggccagctgaaaaatctccaatatttggagctttacagcaacaacataagtgggacaataccccctgaactggggaacctgactaacctggtcagtttggatctgtatatgaacaacttctctggcaatatccctgacagcctggggaatctagtgaagctgcgtttcctacgtcttaacaacaatagcttggttggtccgattcccgtatccttgaccaatatctccactctccaagtactggatctctcgaacaacaacctctcaggacaagtcccatcgactggctccttttcactcttcacccctataagttttgccaacaatccaaatctttgtggccctggtacttcgaagccctgccctggggctcctcccttttccccacctcctccattcaatcctccatctcccccaactcaatctactggtgcttctagcactggagcaatagctggaggtgttgctgctggtgcagcattggtgtttgctgttcctgcaattgcatttgcaatgtggcgccgtcgtaaacctgaagagcatttcttcgatgttcctgccgaggaggatccagaagtccatcttggtcagctcaaaaagttttcattgcgggagcttcaagttgcaactgataatttcagtaacaagaacattttaggaagaggcggttttggaaaagtgtacaaaggaaggcttgctgatggctcattggtagcagtgaaaagactaaaagaggagcgtacacctggtggtgagcttcagttccaaacagaggttgagatgattagcatggcggtgcacaagaaccttctccgacttcgtggtttctgcatgacacctactgaaaggttgttagtctacccatacatggctaacgggagtgtggcatcacgtttacgagagcggcagccatctgagccacctcttagctgggaaccaagaagacggattgcactgggatctgcaagaggactttcttacttgcatgatcactgcgatcccaaaatcatccatcgggatgtcaaagctgcaaatattcttttggatgaggacttcgaggcagttgtgggtgatttcgggcttgccaagcttatggactacaaggatacccatgtcacaacagctgttcgtggaacaattgggcacattgctcccgagtacctatctaccggcaagtcttctgagaagactgatgtttttggctatgggatcatgcttctggagcttattactggccagagggcatttgatctagctcgtcttgcaaatgatgacgatgttatgcttcttgactgggtgaaaggactgttgaaggagaagaaggtggagatgctggtggacccagatctgcagaaagcctacgaggaggtcgaggtggagagccttattcaggtggcactcctctgcacgcagggctcccccctggaccgtccaaagatgtcggaggtggtgaggatgctcgaaggtgacgggctggcagagcgttgggacgaatggcagaaagtagaggtggtgaggcaggaggctgagtcggcaccgctccgcaatgactggatcgtcgattccacgtacaaccttcgtgccgtggagctgtccggcccaaggtagccactccacgactccgatgaaagaaaacactgaattggccaagattcagtctaattgctgcttgtgtatatgaaaggtagcttttggaattgttagcgacaatttgaaaggatcgatcttttttttttggattcctcgctagctcagatgttggttacgctgaggttgtgttaaggtgaaaattcgtatatctaagggtgaatttctaaagcattcttgcaatagtccggggaatgtagcagcgatcgtccaattgtactacgtgctatgaagaacagtgctaccttttggccatagttttgcgttttgnnnnntctatttaggttttctttgtgtnnnnntacaattgtcattgaatt

SEQ ID NO: 4988 - DNA, 1988 bp, Zea mays
  misc_feature (1346)..(1346): n is a, c, g, or t
  misc_feature (1352)..(1352): n is a, c, g, or t
  misc_feature (1361)..(1361): n is a, c, g, or t
  misc_feature (1377)..(1377): n is a, c, g, or t
  misc_feature (1393)..(1394): n is a, c, g, or t
  misc_feature (1401)..(1401): n is a, c, g, or t
  misc_feature (1403)..(1403): n is a, c, g, or t
  misc_feature (1407)..(1408): n is a, c, g, or t
  misc_feature (1411)..(1412): n is a, c, g, or t
  misc_feature (1420)..(1420): n is a, c, g, or t
  misc_feature (1468)..(1468): n is a, c, g, or t
  misc_feature (1474)..(1474): n is a, c, g, or t
  misc_feature (1477)..(1477): n is a, c, g, or t
  misc_feature (1496)..(1496): n is a, c, g, or t
  misc_feature (1504)..(1504): n is a, c, g, or t
  misc_feature (1510)..(1510): n is a, c, g, or t
  misc_feature (1513)..(1513): n is a, c, g, or t
  misc_feature (1517)..(1519): n is a, c, g, or t
  misc_feature (1531)..(1531): n is a, c, g, or t
  misc_feature (1536)..(1536): n is a, c, g, or t
  misc_feature (1548)..(1548): n is a, c, g, or t
ccacgtttactttcactccacacatcattctgtagcctgagagattaacagtttatgctgaacctgttcttggaacggactggccacacgtagaccaacacatggagaacgttggccttggaaacgtgaagaggttccagttcagggagctccaggccgcgacagacaagttcagcggcaagaacctgctagggaaaggtggctttgggttcgtttacagagggcagctccctgacgggactctcgtggctgtgaagcgactgaaggacggcaatgtcgcgggaggcgaggcgcagttccagactgaggttgagatgatcagcttggcgctgcacagaaaccttctcaggctctatgggttttgcacgaccgccaccgagaggctgctggtctacccatacatgtctaatggcagtgtggcatcacgtttacgaggttctttattctttattataatatataaaaaacctgattccatagtcccaactaaacaagcataacgctagcttcctgttctcattaaactttctgattccatagagcgccaggcatctgaaccaccttttaaatgggaaacaaaaagacggattgcactgggatctgcaagaggtctttcttacttgcatgatcactgtgatcctaaaatcatccatcgggatgtcaaagctgaaaatattcttttggatgaggagtttgaggcagccgtaggcgatttccggcttgccaagcttatggactacaaggatacccatgtcacaactgctgttcgtggaacaattgggcacattgctcccgagtacctatctaccggcaagtcttctgagaagactgatgtttttggctatgggatcatgcttctggagcttattactggccagagggcatttgatctagctcgtcttgcaaatgatgatgatgttatgcttcttgactgggtaagtaaattttcttctcaatacaagtgtcacacacagtattaccgtgtgacagattatatttttttctttcatactttttgctgtctatgggctatattttattaattttctttcttaaagattggtgccaaagctaatcctgtaatcatgaagtgcccttgatccattttcttaattagagagcacgcactggcaagttacaagctgggtagttcaccctccaggggacatgcatcatgccttgaatatgctaatgcacaatcagtcgacctaccatgtgcctgctgcattataagaacatgttcaaccatcagaacaatggaacgggtagattgctgatgagaaaaacaagctggcataaatgaataattcgcaattggcatcttgcaggtgaaaggactgttgaangagaanaaggtgganatgctggtggacccanatctcagaaagcctannaggaggncnaggnnganngccttatncaggtggcactcctctgcacgcagggctcccccctggaccgtccaaanatgtcngangtggtgaggatgctcgaangtgacggnctggcngancgtnnngacgaatggcanaaagnaaaggtggtgangcaagaggctggctccggcaccatccgcgggtgaatcgatcggcgccgcccgggcaggtacaaccttcgtgctgtggagctgtccggtccaaggtagtagccactccatgactccgatgaaagaattcaacactgaatctaggcaattcagtctaattgctgcttgtgtatatgaaaggtagcttttggaattgttagcgacagtcaatatgaagggatgtttttttcataattcctcgctagcctcagaagttggggggtaggctgcagttgtgttaaggtgaaaattcgtatacccgagggtgaatttctaaagcattgttgtagtggttcggggaatgtagcagcgatcgtccaattgtactacgtgctataaagaacagtgctacctattggccatagttttgcgttttgaaaaatctattgggaaaagaaaagag

SEQ ID NO: 4989 - DNA, 3522 bp, Zea mays
ccgtgctaattattgaggagtgccggagtacttctcttgttttaaatgtgaattagatgtacactgtttcaaaaacaaattatccatttataagttagttgatctaaaaaagtcttttccttacattttatgtgtaactctgcttattaattgttgcatacatttcattttgtaattctgtccttttagatacgagaatttatttatattcctttttttttgtaatagggagctttacagcaacaaaataagtggggcaataccccctgaactggggaacctgactaaccttgtcagtttggatctgtatatgaacaacttctctggcaatatccctgaccgcctagggaatctattgaagctgcgtttcctgtaagattcattttgtttaccagttactagcaccctcatatattgttttactagctgtttttaatgcttagacagttttcagtttttttttaaatttgtttgtttttttacttttgatatctatgtcaagaatggtctatgtactttgtaaccagaaaaataagaggaacttgtgatgctgcatttgttaatttctgtgacacgttggtatttgattaagtttgttgttttcctttttgatagatggagttgggtgtttgtttggcctcctttctcttactcttaccttgcttattctatatttttggcagttgtagtgttgaattgtaatttatcagcaaaactcatggtgtctgtggaaaaagaaaatcattgccatttttctttttattagtgtcttctgtgcccttatattttggtaaagtcacaaatatctatttgttctgtgcctatttgcaatgatagacgtcttaacaacaacagcttggttggtcccattcctgtagccttgaccaatatctccactctccaagtactgtaagtagcatgtgcactactactcttctcttgatgtttgttgtgtgttgaatgaatatataatataccagttaccatgaaaaatgcagggatctctcgagtaacaacctctcaggaccagtctcatccaatggctccttttcactcttcacccctataaggtcttttatctggaaaatccactgctccttagcctaaactgtatcttcagtgtgcatgataaatattacctgttttttttacagttttaacaataatccaaatctttgtggccctgttactacgaagccctgccctggggatcctcccttttccccaccgcctccattcaatcctccgtctcctccaacccaatcaactggtaggttttttaatctatttctattctcattactacactaaaactttagcattctggatgacacattgacactacttcctggattgtctactattaggtgcttctggccctggagcaatcgctggaggtgttgctgctggtgctgcattggtttttgctgttccagcaattgcatttgcaatgtggcgccgtcgtaaacctgaagagcatttcttcgatgttcctggtctgtatcatacggtgtaccttttttctgaacccatattgcctgtttgttcatccgctggcccattttgcttcagccgaggaggatccagaagttcatcttggtcagctcaaaaagttttcgttgcgggagcttcaagttgctactgatacttttagtaacaagcacattttaggaagaggtggttttggaaaagtgtacaagggaaggcttgctgagggctcattggtagcagtgaaaagactaaaagaggagcgcacacctggtggtgagcttcagtttcaaacagaggttgagatgattagcatggcagtgcacaggaaccttctccgacttcgtggtttctgcatgacacctactgaacggttgctggtctacccatacatggctaatggcagtgtggcatcacgtttacgaggttctttattctttattataatttataaaaaacctgattccatagtcccaactaaacaagcagaacgttagcttcctgttctcattaaactttctgattccatagagcgccaggcatctgaaccacctcttaaatgggaaacaagaagacgggattgcactgggatctgcaagaggtctttcttacttgcatgatcactgcgatcctaagatcatccatcgggatgtcaaagctgcaaatattcttttgggtgaggagtttgaggcagtcgtaggtgatttcgggcttgccaagcttatggactacaaggatacccatgtcacaactgctgttcgtggaacaattggacacattgctcccgagtacctatccactggcaagtcctctgaaaagaccgatgtttttggatatgggatcatgcttctggagcttattactggacagagggcatttgatctagctcgtcttgcaaatgatgatgatgttatgcttcttgactgggtaagtaaattttcttctcaatagtcatagtgccacagtattaccgcactacagatatacatttttctttcataccattttgctgtctatgggctatattttattagtttcttttcttaaagattggtgtcaaagctaaccctgtaatcatgaagtgccctcaatccattctcttaactaaagagcgagcactggcaagtgacaagctgggtagttcaccctccatgggacaatccatcatgcctggaatatgctaatgcacaatcagtggacctaccatatgcctgctgcattaaaataagaacatgtccaactatcagaacaatggaacgaaccgctgatgacaaaaacacgctggcgcaaatgacgatgtcgctatccgcctcgtccgggtgaaaggactgctgaaggagaagaaggtggagatgttggtggacccagacctacagaatgcctacgaggagatcgaggtggagaaccttatccaggtggcactcctctgcacgcagggctccccgttggagcgtccaaagatgtcggaggtggtgaggatgctggaaggtgacggcctggcagagcgttgggacgaatggcagaaagtagaggtggtgaggcaggaggctgagtcggcaccgctccgcaatgactggatcgtcgattccacgtacaaccttcgtgctgtggagctgtccggtccaaggtagtagccactccatgactccgatgaaagaattcaacactgaattgcctagattcagtctaattgctgcttgtgtatatgaaaggtagcttttggaattgttagcggcagtcaatatgaagggatggtttttttttttataattcctcgctagcctcagaagtcggggggtaggctgcagttgtgttaaggtgaaaattcgtatacccgagggtgaatttttaaagcattgttgtagtggttcggggaatgtagcagcgatcgtccaattgtactacgtgctatgaagaacagtgctaccttttggccatagttttgcgttttgaaaaatctatttaggttttctttgtgtaaaaatacaattgtcattgaattgacgatacacaactaaaaaaaaaaaaaaaaaa

SEQ ID NO: 4990 - DNA, 1233 bp, Zea mays
ccgacagagtcgtccgtcccaggctcccagtcccagccccggcgcccgtctcaaatcgggtacctccagcccggcccgcaaacccataaaaaatactgtattttccaaccaagccactcgcccgaccttcatccgcattccacgcgcactccgctgcctcactccgagactccgccgctgcttccaacttccgttgcgcacgagcgaaacatccggagctagcaagggaggaggaggaggaggcgatggcggggggcggggataaggtggactacgtcttcaaggtggtgctcatcggcgactccgctgtcggcaagtcgcagatccttgcgcgcttcgcccgcaacgagtttagcctcgactcgaaggccaccattggggtcgagttccagactcggacgctcgtcatcgaacacaagtccgtcaaggcgcagatctgggacaccgccgggcaggagaggtatagagctgtcacaagtgcctactacagaggtgctttgggagctctgctagtctatgatatcacaaaacgccagagcttcgaccacatacctcgctggctggaagagcttcggggccatgctgacaaaaacattgtgatcatgctggttggcaacaagagcgacctcgaagacgagcgtgccgtaagcaccgaggacgccaaggagtttgccgagaaggagaacctcttcttccttgagacctccgcgctgcaggcgaccaatgtagaaaatgccttccagaccgtcttgacagagatctttaagatccacagcaagaagaacatggcagcggacccaagggccaatggggccgcaccatcgctggcagggaagaaggtcatcgtcccaggcccagctcaggagatccctaagagcaagtgctgcagttccatgtgacatgttgcctgaattttatttgggtttgttcgtgtccgaggtattctcagcatctttgtggatgtatatctatactggaataggcttagatttgaattgctggttaacttgatgtgcggttttgaagggaccgatatcgtagtttagatttgtcacccgtcttcaagatgacgaggatagggagcgagaagaaaacatatgtttgcatagactttgttggattttacaaaaatagcagtgtaagcacattattttttccccgatgccttgaaacccttgtgtacaggagagatggatcctaaacatcttaattacaggataaatttaatatttg

SEQ ID NO: 4991 - DNA, 9332 bp, Zea mays
  misc_feature (4273)..(4273): n is a, c, g, or t
tttttggccggtccatttgactaacagttcttattgtctggactacaatgtaggatttaattgtggtgaagctgccaactttgcaactccacaatggttaaaatttgctaaagaggctgccgtacgaagggctgtgatgaattatcttccgatgctctctcatcagcagcttctgtacttgctagcagtttcttttataaccaggtaagcttttaggcaatagtacttgctaaaaaacagcaagttcttgacatggtgactgttgcagctagttgctaggactagatcattcgttatgtctggcttatatgccttgttttgtacatgttgaaggcatggggtgcttgaatgtagcttacaatctgcagcctttagtgaatcgcagcatgagctgctagtccctgtaatatgattcaatttaaagtattaatgagctccagcaaacgcgtgcgcgtacacacacactatataagatggcctgtgtaattgtgtattgaataagattagctcttacatttgttttggttcagaatgattcttttgggcatttatcagtcattgcctatgaataaatatttgggcttccattgtttgttaacatcaatagagaaaccaggattgaagatattatgtatgggaaaaaaagagaattaggaaacagtgaagccactgaaattgctagcttcctgggactagagtagaccgataagttggtattgctagagtccctagaaatctggctatgatgcttctacagaaatttaaaagatagattttgataatttgattggaattgttgactgtttatttctatatattttttggattcaagttcagttgctaaaaggctaaatttttaattgtaatttatattctggcaacaatcaaaatatcagatatcagtaacttaatgatgtttgaatatagcacatcagaagtgaaatagtgtgcttcaagattgcactcttctacgatgttattagaagatccataattagatttgctttatatatctgcaacttatatgttgctggatcatcagtctacttggcttacatttgcttatgctaggaattaaaatgaaaaaaataattcatgatgcaatagaaaaacaattccttagtagtggagtcctaatgccaatgattctgtgttgatgcaatttcaagagaaaatgtcttgaaagctagtgatataggggtgtttgggactgctctcggttccagcttcagtgtgcgctgtagtttataacataaatttaaatagttttaaaaatatttttaatctaaataataaacaaaatgacttatctaaatgccctctaaaggtccacaactctagcttcaggattttctgaagcacctaaggccatgtttagcatggctccaattccaaactctagactctggagttgagtttagccagccaaacaccccaactccacatttttttggagcagcccacctctatggagttggtggagctctagttcattttgaggctggagtttggagcacctcttttctagctccaaaccaatccaatatggatgtagacatagagttatatattatttacccatcaatgccatccattacacaggaaaaatgttgcgattgtttcctgagaaccctattcttcttactcctcttgcacgcaccccatctcctgcgtcctccgcccccagccgccggtctttgctgtgtgccctgccagggcgtgtgccgccctcactgttgtctgcccgcacgcaacacaccccatctgcacgctgcccctgccgccagtattcctgcatgcatcgcctaggcgtgcgtcagagccccgccgtctgtcttcgtcacgcctgggcttaggcgtgcaccagtccttgcgccctgcacccgaccgcacggctgcagcgacttggactgcgggctctctgccctctgcagtggtagcacatgacggctagccaaacacctccttccagtcagctccaactccacgtggagcctgctccgcctggagttgtggagtgcagcaggaacaggaatctgtggagttggagccatgccaaacagggcctaagacatgctccaccaatgcaagcccaggaaattctggcctagctatgttggacaaaagttagggttagaacttgactagtaatatggtgatacttctttgctgtctttgcatgtatgacttgatttttatccagcatttgctagttgctgctaaaacaacctttctttattaaaattcttaaattattaagaaacacctattattcatcttctacaaatttaacttgacaatcttgatatttgatctcttgatttatgcttacctagctttttagtgatcttgttacaacccattagagcaccataccaatgcttattgttttctgcactttgaatctggtagttcattttaatttcagaaccccaaatgtattgtctggaattcgttctcgcttgagagatcggaaaaaagaagaaagagaactgctggtgaagcaggaattcttgcaggacatgattagtgaaaacaagcttttgtgttctttcctggaaaagaaatcaattggtcatgttgtgctctgggagcctgacttgttaccatcttcgactgctctacattcctgttcttctgactcaaaagctcctgagaagaagtctgaggatggttgcagaattgaatctagtgaacgtggcaccaaagataacaactctgatggcagtgcacatatgattggcgtacaaactaaatttatgtccgggaatagcaaatcatctggaactgcatctgcttccatggatgaggtcaatgctgatactgatgatgaggatgacctaccttttgatttgagcattgattctgggtcattgacctgtgttgcttgtggaattcttggttatccattcatggcaattctgcagccttcaagagaagtattggaagggatttcccttgctcacacgagtagatacaagatgagttctgaaaaagataattgttcaaacacaattccatgctgtcccactgacagtaagtttggtatgcctttcctagcttccaatgttttatttcatatgtgcgtgcgcgcctgtgtgtgtgtgtgtgtttcatagaataacctattctatgatcactgagttaccatgattactatactaatttatgagattatggtaactctctgctaagtgatttactataacatattggtaaacactaaacgctagcatgagttatagtagcacatgtattgtagatatatattcactttatcttaaattagtcaagtattatatattcactttatctcagattagtcaagtattattgtaaatcaaagtgacaatataataagttattctgtggccaaccacatattagcctgcatacacacagacattggagctaaggtagacatttcattgatgcatgtcgttttatcatacaattgtgatggaaaatttgaaaggcaaatagcccctaaacagatcaccaggaactcacacacaaacaaacacaatgggtgtggtggttggaatgactaggccttggtggctggaatgacttagcattttcggattttccgtctggctttatgcattgctgagagttacatttgtggctgtgatagcctcctaactaatgcagaatgttacccaaataaatggtctatgttactactgttactccatgctgaaatttaactaaagttatgaatctagacactagcatgcacctagacaggattatttccaacaaattttatgaatggatgcattttttgtgtggagttgtacgaggttttctataaacctcacctttttccttcttaatataatgatacacaactttctacgtgtttggatttttttttcattgatggatgcattttttcttgcttcttttttgtttgacaaatagcaattttgtgactactttaagccccaaacttggattagctttttaatccatgaattacgaatttgccactgaaattggccctatcccttctgcttgccacttttggaaaccaagggcaaaatctatttcagaagttctgaagaaaaaatgattgcaacatggaaatgctattttgattttgaccacagcctgtatgtctgtctcttacctttattgaactctcccactatttgcaacccaagaaccctagatggctatatcctcaaatcccttcatcctttctccatcgcaacagagaaggtttgcagcaaggaagtgctgtggtggcttgggtccatccggtttncagtggcgccgctccgttgccggcttgccgcatcttgagcagggatgggtggagcactagggacagatgaatgtgtaagggtgtaggggatgtggttaacttgggctattttgttggttgggtggccacagcttgaacttgtgcatcacaatgaagcagtaggcagtagcaataggcggagggtgatgacaggtgttgtcattgcttttttgacttcaggaacctacagattatactgctgtcatgttagaaaaacatgtgctgttgttctgtgatattctttatgttttaggaaggaacagtgtgatgctgaacgcctgaacttaaaattaactgaatgtgaccaggggtgccaccattgcattttacgggaaaacctccagctgaaggtgggtagtccaaactatgttgggtccacagatttttaatggcaagtttgcaattgtacctttataatgtcagtttcacatagcccttcatattattggcaaatttgcaaatggcctttttgtctaatttagagaaaagctatggttgggagagagccttctgttttaggcagcctgaatctatttttttattgaacatgcatggtcatgatggctggttcattggccattatgaagtgcttgtggatgagagtttctggctgcaataaatgtatgctgaagagtgatgtgatctgcatgcatgttttttgaacaatcagaataggacattttcagaaatggtttattaccttgccatgcacattctaaatttttaacatgattttatacacaagagttgactatcttaaccttgctatttgattaaaactgaatattgttctggaaccttgacacatgcttttgcttatgtatcaggatgttcatttgttcccagtagaccttcttggcctgcggaacagcaatgtctggctactcctttggcgcaagctaacatcagtcatcagaatgtaaattcacataaagatgtttgtttaagggagaatgaacctaatgggcctgtgccacaatgtaacaatatttcacattcttgcagaagtgaaaatactcttcattcatgtagtgacaggggaaaatccgagaataagatttctgaggacagtcttggcccagaagtaggtgaacaaacaggcaaatatgtcatcaatgcgcaagctgcagaaagttctgatggtactattaactggaatacttattgtacatttgcacggccccggatcttttgcctgcagcatgcccttgagattgaaaagttgcttgagggcaaaggcggtgtccatggtctcattatttgccactcaggtagtttataaataaacttctatcttcatgctctatttgactgctggtggatgctcttatgaacctgcgtacttgatacaaaataagtaattagctggagccttttactcactggacatgttggtcatgtttatatgtaaacattttgtttttacaactaacacattctatctttggaacatacctttagatatcaataatatattacatttttaatggaaaactatactttatgcattaaactggattgtggaaactaatatgcccttttggctttgcggatgagccaacttatcttctttctagtgcaaatcagcaaaaaccaacagagggaattacaactaccttctttctagtgcaaatcagcaaaaaccaacagagggatttccacaacgatgggaccacataattttttgtcttaatctgtctcagtgtcgctaatgttaggcagctaaactccattcactgtattataatcggtagattacatattttcactgtcaaataattatagctctatcttatattcaagcctcaaaagaaatattgacctattagcttaccaatcactgggtttacactgttaagtgaaatatgttgcttgaaaagctaaaacaacatacaattcggggttgagggaatatcattgtagtttagaattgcatcagagcattaaggtaacctcatttaattcgtctttcagaaaaaggcctctttcacagatacatgttgataatccctaattgagcatactcctgaaattagcaactgaactcattgttctaaatcacaatgtaaatcaaatatgcttatcttctattttactttccatatcacttgagatttctactgatcttaaagcacttttatttgatttttttctgcagactttgtcaaactaaaagcacttgcaatatcagtagctgaggaaattgagtttcaatttgattgtacagacatttcacttgcaaaagcatcaaagtctgatttacatctgatcaatatttcaattgacgacgagggacatgaggaagatggaagagactggacgtcacagatgggtctaaacctgaaatattctgccaaactcaggaaagtgaaatcagaaaatcaagaacagtctcctttgccatttgggggactgctttcctgcccttcgcctgtttcggttgttcctaatcttaagtggctttgcaaaagagcgcggacaccatacacagttattggtactacgaggggttctagtgcaacagcaactgctgcggaacttaagcctggagtgaagacagaaatattcactaatggaaatgtttgcaaggatgacaatagacatcattcttttcgacaaactggcctcgagcaaccaggtggactacaagagtttgataagccttcatgttccgaggagaatggccatggaagacattgtcttgttaacattcctatcgctgttgctgaatatcctatgatgcatcaagtccgtgagggtccagtgagtgttagcacgtgcaatgactccatttgtttgtcaggttccctggatttacctccacacgcctctccagttgaagtaactagatacctaggatgtatacagtcaactgagctgagcagtttaccagccttttctgttcaacatttctttaatgatgaaagtacctctgtggaaggaagcatagactgtgtaagcaatggctgcttagaatctcaggatgatattttagggagcagagatgaacgtttgcaagttcaacaatatcaagagaagatggggcttcgcaataaccccaatatgaagtcagttgattcacacctgatagaaggtttggctgtatcagaaggaaagcatggggaaactgtggcagcattccttgaaaacaaggagcgttgtgctaagacatcctactgttctaacactgaaacaaaaactactaaatctgcaatagacaatcgattggagactcatcatctgggtactggtccagtgaaactaaattcaagctttaatgagatgcacagtgctgatagacaatgcagtttagtctttggctgccttgactcagctgatgttcctgcttcaactcaggctctgtcagtttcacctgttttgatgagtgacgagcagcaggtcgatgacgcccattctgctgtcaaggccattgagcacctgggcaataatctggctaacataaagcacaaatccctgcatatggatgtcctcatgttagaggacgcccaagttgcttccatggctgcagtccctgggcatgagggagaatctgtcgaggctggatcaaattcttttgatattttacttggagctctggctgaagagtccaaggcagcagatgctcctgagaaagatgaagttggcaaagcttccttgacattaataacactggctagcaatgagccctctgttacagaaggcagagttgtagacgtggtggaaacagacacaattttgggagcaggaaaagatgataaacaagttgatcagccacatgacttccatttgtcagatctggtgtctagatgcatcgggagctcaaatagatccgatatcatatgctatgtcagacgcaaacacaaaaggaagagggattactcgtgtttcgtccgctctccctgtgagagcttgaggccaaggtccaagcctgcagtagtcgaggagtcggaatggagcagaacagccgaggcttcttttgctaaaaggggtaagaagacacaagcagtggggatcatttcagtgtgatattgatctgtgtgactagggctgaacttaatgtccacaagcagatccatgttttcgcattgtctgggttctcatcgtgtgcatgtaattcctgtcttcgcattgtctgggttctcatttatatcctgtcgtactgttacagcagatccatgtttttttttagttcaacgagatgagtcttatatatgtcttagtgttcggctacgattcagggcagatcttatgagcactatcgaggtggctggacggtggaacgagatcctctgacgtggggagagggcactgccgcgtggcccccgcgtgcggcagggcccgtgcagtgaccctactgcctggacggtatgggaggaccggttggacggtgtcgagggttcgagactcggctgatccggtgctaatctgcccttgtgactatcaaggacaggaaaaaccattattattataaaacattaaaactgcatgacttgatgactagctagctcatcgacccagcagacctgagcacgccagagccgaaactacagctaccagtaaccaccaatgcaatgcagacagagtctaagacaggtcacctactaacaagaagtaacaagaactgagttcacccgtgtttgctgccgcccgtggcatcaagaacacatgcatgactactgggacgactcatcgttggctgaagctcccttggccttgatcaaagacccgagcttgggctctccgaacaaggtgatgccctggcgggtcctgagcatggcgtattcgctggcgccgcgggccttcctcttgatgctggcccactgcgtttgtgcccaccacgtcggctgatgggtcccctccggctccggtgcggtggccgccgccggcttcggcgcgccgtccttctccatcggtgatggaagggtggacttgctgcttgatctctgtacgtaggtcagagacgagacaagacgagacgctaagaaactggagctaagagaagatgttgcggacgcgtgcg

SEQ ID NO: 4992 - DNA, 1911 bp, Zea mays
tgtggcagcattccttgaaaacaaggagcgttgtgctaagacatcctactgttctaatactgaaacaaaaactactaaatctgcaatagacaatcgattggagactcatcatctgggtactggtccagtgaaactaaattcaagctttaatgagatgcacagtgctgatagacaatgcagtttagtctttggctgccttgactcagctgatgttcctgcttcaactcaggctctgtcagtttcacctgttttgatgagtgacgagcagcaggtcgatgacgcccattctgctgtcaaggccattgagcacctgggcaataatctggctaacataaagcacaaatccctgcatatggatgtcctcatgttagaggacgcccaagttgcttccatggctgcagtccctgggcatgagggagaatctgtcgaggctggatcaaattcttttgatattttacttggagctctggctgaagagtccaaggcagcagatgctcctgggaaagatgaagttggcaaagcttccttgacattaataacactggctagcaacgagccctctgttacagaaggcagagttgtagacgtggtggaaacagacacaatctgcggcgcaggccccccccccaaacaagttgatcaggcacatgatttccatttgtcagatctggtgtctagatgcatcgggagctcaaatagatccgatatcatatgctatgtcagacgcaaacacaaaaggaagagggattactcgtgtttcgtccgctctccctgtgagagcttgaggccaaggtccaagcctgcagtagtcgaggagtcggaatggagcagaacagccgaggcttcttttgctaaaaggggtaagaggacacaagcagtgggatcatttcagtgtgatattgatctgtgtggcatggcatttgagactagggccgaactcaatgcccacaagcgcaatatttgcactgacgagtcatgtggcaagcgtttcagctcacacaaatacttgaagcgacatcagtgtgtccacagcgagatgaggccatttaaatgcccctgggaaggttgtaaaatgaccttcaagtggttgtgggctcagactgaacatgtcagagtgcacactggagagcggccatacaagtgctcggctcctgactgcgggcagacattcagatatgtatcggattacagccgccacagaaagaaatttaaccattactgacagcttctagttttccgagttattggccgcagctcggggcaaatctccagctgcttgtgtcggtgggccttgtttgttgtagtagctcagctcacgtatttattaacaacctgacagctgataggcctagtgaatgttccccgttaacaatgggctagtaatttagtcggtgtaggagttagaaattgttggggggtgaagtgcaacccccttctgttggtgtaggtttgcataagctgatcaccccccactgacacgtggccattcattatttgtttctcagatcagtgatgatgtatttaatccctgatgacaaacttcatgaacactgaaaccatatgatgtcggatgtcaaaatgatcaggggttgccaccgtcctcatgtaattcctgtcttcgacacattgtccaggtcctcattattctgtcatactgtttcagcagattacttgtatgcctttgtctacgcgaaatctaatcatttttaaattcagcgagatgctgccatctatatgccactgtttcgcttagatttaacgcaagggtgtgtttggtatctctgctccattttggtgaagtggcagacagtctagattactttttttgtgaccggtggtattgacgtctaaatagctttaaattctatatctatgatgtattttagagattttggagcaacaaaatagttg

SEQ ID NO: 4993 - DNA, 2175 bp, Zea mays
cattgggtacctcgaggccggccgggggtaacttaaaagctagccagctcgtttgacaaaaagaaaagaaaaagggaaagacgtttcttttctttccttccacgtctctcctcctcctcctcctccccacgccggctccggagcttccgcttccgaatttcggatactcccccgcgcttccttcttctcctgagagtcctgttgctgtctatctcccccgctctatcctccgcctcgcgatagcaatccgcgcattggacgtcgcgcctcaccggacggagccggtcgaaatggaggaggcggctcccgcaggaactagtaataaggtgtactacgacgggtgccccggctgcgccatggaccggaggaaggagagccgcgccggcgtcccctacaaggagctgctgttcgtcgccgccgccaccttcgcatccgctctgccaatcacgtccctgttccccttcctctacttcatgataagggacctgcgcgtcgctgagagggaggaagacattggattctacgctggtttcctcggcgcagcatacatgatcggcagaggcgtcgcgtcggtcttctggggcgtggtggcggaccgcgttggccggaagcccgtcatcgcgttctccgtcctctcggtcgtggtgttcaacaccctgttcgggctgagcgccaagtactggatggctatcgctacgaggtttctcctgggcgccctcaacggcttccttgcgccagcgaaggcgtactccatcgaggtctgccggcctgagcagcaggctctgggtatatcggtcgtaagcacagcggtggggggatgggcgtcataatcggcccggccatcggaggctacctcgcgcagcctgccaaacagtatccgcacctgttccatgagaaatcagtgtttgggaaggttcccgtacctgttgccatgcctgtgcatctcgttcttcgccgccttggttgtcataagctgcgcatggctcccggagaccctacacaagcacagaggcctggagagagcagcagctgaagtggcagaaggcacgacagcagcagcagcagctcaagaaagcaccccggagccggagccggagccacctaagagcagcctgctcaggaaccggccactcatgtcctccatcgtctcgtactgcgtcttctccctccacgacaccgcgtacgtcgagatattttctctgtggaccgtgagtggcagagatcacggcggcctcagcttcgcgtccaaggacgtcggccaagtcctcaccgtcgctggcgccagtctcctggtgtaccaaatcttcgcctaccgttgggtcgacaagatcctcggcccggtcaactcaacccgagtttcgtcgcaacgcatgcaggcgctatccataccgataatcgccgcttaccccttcatgacgcgcttgtcgggaataaggcttggtgtgcctctctacgtcgcggcgatgctcaaaagcgtcctcgccatcaccagagtcaccggcacatcgctcctgcagaacaacgctgtgccacaggagcagaggggcgctgcgaacgggatagctacgacggcgatgtctctgtccaaggcgttcgctccggccgtggccggcatcttgttctcgtgggcacagaagcgccagcatgccgcgttctttccaggtgaccagatggtgtttctgctcctgaatctgacggaggtcatcgggctcgtgctcaccttcaagcctttcctcgcggttccccagcagtacaaacagtgaaagcggtgctgcgtgcgtgcgtgctctgcatggatactatagagaggtagctagctgctagccagtgtgtgcgcgagagcgagacgagggagatggacatggagactggagtagaagtatgccgtagcgcgtgtgttgccactcgccacgcatgctgtcactgcacatcagaacagatccaggtgtgcaacggaacggagcccaattaacgttttcaccccgtttgttgtctctagttggcacaaggaaaaaaacaaatagaagaagctactagcagagaatagagatgcatgctgttaacctggttatacggcacaatgcttcttttaggggaatgcagcaggggaaacctctactgtggcattaaaaatatataacactaaagctgtacaacaaactcatcgaagggtac

SEQ ID NO: 4994 - DNA, 1649 bp, Zea mays
gttgctctgaaatcatccgtgcattttctttctttttatttggcaagggactttccttctcttttctttctcctaatttatagtggtgaccaaacagataagggacctgcgcgtcgctgagagggaggaagacattggattctacgctggtttcctcggcgcagcatacatgatcggcagaggcgtcgcgtcggtcttctggggcgtggtggcggaccgcgttggccggaagcccgtcatcgcgttctccgtcctctcggtcgtggtgttcaacaccctgttcgggctgagcgccaagtactggatggctatcgctacgaggtttctcctgggcgccctcaacggcttccttgcgccagcgaaggcgtactccatcgaggtctgccggcctgagcagcaggctctgggtatatcggtcgtaagcacagcgtgggggatgggcgtcataatcggcccggccatcggtggctacctcgcgcagcctgccaaacagtatccgcacctgttccatgagaaatcagtgtttggaaggttcccgtacctgttgccatgcctgtgcatctcgttcttcgccgccttggttgtcataagctgcgcatggctcccggagaccctacacaagcacagaggcctggagagagcagcagctgaagtggcagaaggcacgacagcagcagcagcagctcaagaaagcaccccggagccggagccggagccacctaagagcagcctgctcaggaaccggccactcatgtcctccatcgtcacgtactgcgtcttctccctccacgacaccgcgtacgtcgagatattttctctgtggaccgtgagtggcagagatcacggcggcctcagcttcgcgtccaaggacgtcggccaagtcctcaccgtcgctggcgccagtctcctggtgtaccaaatcttcgcctaccgttgggtcaacaagatcctcggcccagtcaactcaacccgagtttcgtcggcgctatccataccgataatcgccgcttaccccttcatgacgcgcttgtcgggaataaggcttggtgtgcctctctacgtcgcggcgatgctcaaaagcgtcctcgccatcaccagagtcaccggcacatcgctcctgcagaacaacgctgtgccacaggagcagaggggcgctgcgaacgggatagctacgacggcgatgtctctgtccaaggcgttcgctccggccgtggccggcatcttgttctcgtgggcacagaagcgccagcatgccgcgttctttccaggtgaccagatggtgtttctgctcctgaatctgacggaggtcatcgggctcgtgctcaccttcaagcctttcctcgcggttccccagcagtacaaacagtgaaagcggtgctgcgtgcgtgcgtgctctgcatggatactatagagaggtagctagctgctagccagtgtgtgtgggcgagagcgagacgagggagatggacatgtcaagtagaagcagaggatatgatgtcattatacatatttactttgcgagatatgtagttcctcatgagtcttcgctgtgcggttttctaaaaaaaaattgagataaagttggtctctcaattatatggtgcattccggacatcattgttaaaaggaaagtgtacttcctctaactc

SEQ ID NO: 4995 - DNA, 1706 bp, Zea mays
attgggtacctcccctccggcccccccccccctttctctctctccagcctccgcccgcttccttcttctcctgagagtcctgttgctgtctatctcccccgcgcgctattcctccgcctcgcgatagcaatccgcgcattggacgtcgccgcctcaccggacggagccggtcgaaatggaggaggcggcgcccgcaggaactaataaggtgtactacgacgggtgccccggctgcgccatggaccggaggaaggagagccgcgccggcgtcccctacaaggagctgctgttcgtcgccgccgccaccttcgcctccgctctgccaatcacgtccctgttccccttcctctacttcatgataagggacctgcgcgtcgctgagagggaggaagacattggattctacgctggtttcctcggcgcagcatacatgatcggcagaggcgtcgcgtcggtcttctggggcgtggtggcggaccgcgttggccggaagcccgtcatcgcgttctccgtcctctcggtcgtggtgttcaacaccctgttcgggctgagcgccaagtactggatggctgtcgctacgaggtttctcctgggtgccctcaacggcttccttgcgccagcgaaggcgtactccatcgaggtctgccggcctgagcagcaggctctgggtatatcggtcgtaagcacagcgtgggggatgggcgtcataatcggcccggccatcggaggctacctcgcgcagcctgccaaacagtatccgcacctgttccatgagaaatcagtgtttggaaggttcccgtacctgttgccatgcctgtgcatctcgttcttcgccgccttggttgtcataagctgcgcatggctcccggagaccctacacaagcacagaggcctggagagagcagcagctgaaatggcagaaggcacgacagcagcagcagctcaagaaagcaccccggagccggagccggagccacctaagagcagcctgctcaggaaccggccgctcatgtcctccatcgtctcgccccgcgtccgccccctccacgtcgccccgcgccgccagatattttctctgtggaccgtgagtggcagagatcacggcggcctcagcttcgcgtccaaggacgtcggccaagtcctcaccgtcgctggcgccagtctcctggtgtaccaaatcttcgcctaccgttgggtcgacaatatcctcggcccggtcaactcaacccgagtttcgtcggcgctatccataccgataatcgccgcttaccccttcatgacgcgcttgtcgggaataaggcttggtgtgcctctctacgtcgcggcgatgctcaaaagcgtcctcgccatcaccagagtcaccggcacatcgctcctgcagaacaacgctgtgccacaggagcagaggggcgctgcgaacgggatagctacgacggcgatgtctctgtccaaggcgttcgctccggccgtggccggcatcttgttctcgtgggcacagaagcgccagcatgccgcgttctttccaggtaattaaacaacctatatatatacacacacgctgttactgcaataagagcatgtagaggatgcagatctgaatgggaggttagacactaaagggattgtgattaatctaacccgcattgatatgtgtgtgtatatatatatgcatgcatgtaggtgaccagatggtgtctctactcctg

SEQ ID NO: 4996 - DNA, 6228 bp, Zea mays
  misc_feature (6159)..(6160): n is a, c, g, or t
  misc_feature (6172)..(6173): n is a, c, g, or t
agcaagaatcaatgattgttaatcacggagacaggacggccgactttccttgtctctctttcaagcttcttttcttttctttggatgccaaacagaatcttgattaaggagacactgtcacctgggaacgagtacactacaagtcgagggcaatgacaaggcgtcaaggcgtcattcatctcctctccctgactatcgtggaaccggctacacagagtcagccaagggacgagaagacgtggctcagtttggcgccaacagaacacgccgtggtttctgaacctactggacctcatattattagggtattattttattatttttgttgttgcaatgaaggtctaaaatgagtgtagctctagagaagtccacatgtatatgtatttattacagataataaaaacgaatgtctcacttacaagccctgatcctgtgatccatccagatatgtctaggctgggccacggatggcaacaagaaattctccattaaaaaatagcttctcatcactgttttcacgataaaaaaaatttctccataaacgcttgtgaaaatgtttcttccacatccttgtttcttgtagggataaattcccgacaaggttctaaaaacccaacccagactttgagaagagtgaagctcgttcttataagccagtcacggccccctcccgctagcgagatggcactaaaccgggccacttgacggcgggcacctaatagacgctctactacctccgttatcggatatttatcgctcactaattcatttttaattaaatcatgataaataaaaaagaatggagagagtattatttttttgttgttgcaatgaaggtttataatgagtgtagctctagatgtccgtatgtatatgtatttattacagataataaaagcgaaggtcaattacttgccctgatccattcagcattcaggtatgtctcatagtctgggttgggccacggatggcaacaagaaattctccgtcagaaaatacctttttcatctccgttactgcgtctaaaaaatttcttcacgaccccttgtggagatgtttattccacatcctcatttcgcatgggataaattcctgatggatccccgtccaggtttagattataattaggatcatattaaattaatgtaaaatatttgtcatttataggcattgtcagatataaaaaaatattatttatgcatatcaaaacgaacatatttatataatgagtgatatattaataaaataattatttatttttattgttaactattataaaaaaagtgtcacgtataagtttattaacggattctcacgaagaatggagatgtagaatgcttctcttccgtttaactgtaggtgatgaaccgcgtgaccaagaaactttctcatccacataattccacacgaagaattgaagatgtggcccactgccatctctagcgtgttcactgtaggcagcattattgcgggccacagcaccaggtggccggtaccatgcatgatgtggcatcgttatcgttctcacttctctcggtctcgggcggcatcaaccagcatatgaatgagtgcgtgtgcatggtgccggatcgagcctggcctcgatggagatcgtgcaacgtagcgcgagcgctcattcatgcatgcggcgatgatggcgtctgggcaagagaaacgaagcgatcgagacctgcagtgcaggcgctagtagcggctcttgtggcatattccggcataatcccgattcgccggctgctcgtacgtacacgtcggccgcggggtatatacgtggctgatcgtggagccacagtaacggtcgtggcggcgtacgtgacgtgaccgcggctgcgctggattattggattagacaccgagaacggactttcggttttggggttcagtttggggttggattgcttttggttctggatttgaaataacgatgttagttccaaattcaactggtacattgtccgtactgatatggttttatacttgtataaaatataaaaccacggccgaaattcggttatttgccgagtgtttttttatcgggcacgttcgacaaagaattctttgccgagtgccgcattcggtaaagtcctgcactcggtaaaccatgacgtttgccgagagcagaactctcggcacaggaatacactcggcaaaggcttctttgccgagggccaaacactcggcgaattgcggctctcggcaaacgaccatcaaccgacatttaaagctgacggccattatctttgccgagagtcgtgtgtgctggcattcggcaaagaatatatttttttgtcaagtaccctccgttagacactcgacagagcaagctatgccgagtgtcatttctagacactcggtaaagtatatttttatattttttattttgccaaacacattttttgtggtatgttcctacactatgtagatctgtatgtactgttcgtcgagccctctttaccgagtaccacactcggcaaagactttgtcgagtgttttttagagtttaccgagtgcttcaggcactcgacaaagcacatgattccggtagtgaacataacaacatgtgcattaacttgtggtcgtggagaggttatttggctcctaattcggtacataatgcacacaattccgtcatgagttagctaccacagagctagacatgagatactttttttattttgtaaagttgaatactcaataaatatgtcacgacactcgattaaagtatgataaatttcacacatatcacttatatggtccattatattaacttttgaatacttgaaaaaaaacagtacatacaaaaatcatcgcaagtgtaataatagagacatttttcaacaaaatctcaattttgtgaagctagagcagggttttacaagtcaaacacatcaaaaaaaaaagtaaactgtggagtagagttgctcgtctatgatatttggtgaagcagggctgaaattgatgaaacctttactttcataatcttaaactcaactagaaacggaaagaaatttttctatcttcgtcctatgcggcctgcctgatcggataagaattccgttgcggtgtgcatgcggcgacgtggaccggccagatcagactcccgtcgccatcgcagtcgcgttcgccgtccgggctgctagttacaaattacaatagtgaattgctagtcagcatgtgcatgtctaccttctctctaggcaaggaggatggcgccacaagcgaggactcttgacccttaacacccgctctgatccaaattacaaatcatttttttctaaaaaaatatctagatttatataatactagttagatatatgtgcattgctacgtcttttatatatcacatgggaagattttattttaataaaatataaaaatgtgtattctattggtatggatgggtgtggatttagtatccaacaaccaagagttaaatacccacttatgtataattttaccttattttgtataaaatggaaaggatgacatacggcgactatgataccgtgtaaactagaaaaaactagtactttatatagtagagatataataatattgttagtttctttattaattatttttttatagtatacttattgggtattataaatggttttatatttttacaattttatttttagaaaattagaaccaagattataactagacgtaaaattaaatcttaatcccttagtggactataactagaacatgtcattcataatctaaaacttctgtattgtctggaactacaattctatgtccaaacaatagatttaaattataactcatttttaatattagttatatagatattagatatcgacgtccaagcacgtctttcttcccttcaactattttgcactgtagaatatagataggacttagagataaatcataaaatagataaatttgcactgtagaatatagataggacttagagataaatcataaaatagataaattcctggatacagatttacggccgtacatcagtgcgcgcacggatccaaatctacaatcaaaacatagagagtagggttgggccggtttcttcccacagcccactccttgaactgggccggaaaggcggaaatcctgttcgtcattacagtcgtaccgcaccctacctactgactgggcctgcggattcatatcaggtcgtgatgaattgatcactcaatcaataaacgtacagtttccatttaaaaaaaacgtacagttacaacttacaaacacgcttcattacgtctccaagactatcaaatattccgtctattgtaattaccaatttattttaattttgtgctataccaaatttcattagctttgatgcaatgcaatttatagaggaatacataagcatctaattgattcatttttccataaaatataatatctttggactgtgcttatatttgaactaatactctccctgccccaccccaaaacatctaaaaaaagttgtcgctgattaattacatttacccatatttataaaagaaaaggtgataatatttgtatctttaattttattacaaaaaacataaaaatatattccgtaatttatgtaccaaattatgcatcttaaatattaacattttctttatatatagattcagttaaaaattgaaaatgtttaacttcgacgaaaggtaagaatgacgttttccgcagaaaacaatttggtccactcgtaggctttctttccttgaatgactcatgtgtgtcaaagacaaggccacgcaaactagcaaccggtgccacgcaaactgccaactgccatcttcttccccagccgctgtgcccgtccccctgccaccaaggtccaaggtctccggagcgcgacctggctgcaacgcaggcaatggagtcgccgttccgcgcggacctgctgagggggaaggcggcgctggtcacgggcgggggctccggcatcggcttcgagatcgccgcgcagctcgcgcgccacggcgcgcacgtcgcactcatgggccgccgccgcgaggtcctcgacaaggccgtcgccgcgctccggtccgagggcctcagggctgttggttttgacggggatgtccgaaagcaagaggatgctgccagagtgatcgcagcaacggttgagcattttggcaaactggacattcttgtcaatggtgctgccggcaacttccttgcctccccggaggatttgaagcccaagggattccggactgttcttgacattgacactgtgggtacatacacaatgtgttatgaagccctcaagtatctcaaaaagggtggaccagggagaggtccttcctctggtggcctcatcattaacataagcgcaacgctgcaatacactgccgcttggtaccaaattcatgtctctgctgccaaggtacttggaccttctctgaaccgctctgcaagagaaaatcgatgaagtgtgtagatttctgctgattgatcggcttctataggctggcgttgacggtatcacaagatcattggctctggaatggggaacagattacgacattagagtaaatggaattgcacctggaccaattcaagacactccaggaatgaggaaacttgcacctgaagaaatgggcaataaggggaaacgagaaacgatgccattatttaagcttggggagaaatgggacatagcaatggccgcactctatctagcttctgatgcaggaaaatatgtaaatggggctataattattgttgacggaggtctttggttgagtcgccctcgccatattcccaaggaggaagtgaaggcactctctaaagttgtcgagaagaaggttagggcatctggtgttggggtgccatccagcaaattgtgatgacatctttgactacgtagctcttcgatgtgttctgtacaacatatgtctatattgttgtcccactaatgttgtcagtttggctatgccaccagtccatgcagatgacttgttagggcttgttcgcttatttttaatccatatggattggaggggattgatatggattgggggagattttcacttactagggattaaaaccctctcaatccatatggattggggtagaaccgaacatggccttaagcggctgagcagtccatttagttgaagaaattcaaatatttaaaaaaannaaaaaaaaaaannaaaaaaaaaaaaaaaaaaaaaaaaaaaaaaaaaaaaaaaaaaaaaaaaaaaaaaa

SEQ ID NO: 4997 - DNA, 1412 bp, Zea mays
gtacaatccggtctttcgggttatcccctgccctccccggccgccccccggcggcccatcccacccgtcagcgtcggcgtaggcccccgccggctccttcctctcgccgtcgcgagaccgagcagccagtagcagcaggagtgggtgctccgtgccccgccatccaacaccaaaagtggaacccctcacacccacgcgaggtggtcgacactcgacggagagccgcaaaggaggaggagctggcggtggcgggatccagcaggccgcccatgtcgagcggcgcggacggatcggatccgatcacgggccttggcccgtcgacgatcccagagccgccggaccgtgagccgcctcatctacagtctccgtcgccggcggcgcagcaggaggtggcggcgtcgcaagccgagacgccggtgccagcggtgaccatcgtgatctcgcggccaggggaggaggttcagacgcctgatgcaatgggtggctccccggcgtgctccacgcaggccggtgacggcaaggctacagccacctcggtttcgttgaccgcttcggcggctgccaaggaggccgagttggcaaggtccgacagcttcgacgactacgagcaatgcagagtttgtcaacagaagacagaagaacctctggtcgaccttggatgtagatgtcgtggtgatcttgcaaaagcacatcgcacatgcattgatgtttggtttcgtactagaggttcaaacaagtgtgagatatgccagcaggttgctgccaatatcccccctccagagacgcaagcaagtggatggtttagcccactttgggttgcatttgcaatcctgattggtggtctcttattggatgtgctgatatctgtttctcttggtgtttccgcacttcctgtcaatataataattggcgttcttatagttctcggattgggcaccgcccttcgtcttgctctcgagtgctgccaggaatggggctcaaggaggaacgtaggcaatatgccgaggctggagaacataccgccgactgggtaccaccctgcagtagtataatcattatgggacttgtaaatagcggtaggaacatctaaccttgtgctggctcttggattgtattagctttagctcacacgttgctcgtgaatgtcgagctcaaattcaaagcttgttgattacgatcgggtccatactccactagtccaatgcaatgtaaatgcagagttactgatactcggtcttcatggactagtgctgatgccgaattgccagcatcttaattggttgtctggctaatcgttcagcaagacagcgcttggtttcttcttccttgtacggtttgctctcacaaatcacctgttgtgtttcatcttatctgtggcttgttggtataggcatttgtgaaggccatttgag

SEQ ID NO: 4998 - DNA, 2056 bp, Zea mays
  misc_feature (19)..(19): n is a, c, g, or t
  misc_feature (1989)..(1990): n is a, c, g, or t
  misc_feature (1994)..(1995): n is a, c, g, or t
  misc_feature (1998)..(1998): n is a, c, g, or t
  misc_feature (2008)..(2008): n is a, c, g, or t
  misc_feature (2010)..(2010): n is a, c, g, or t
  misc_feature (2036)..(2036): n is a, c, g, or t
gaaatgaatattataacgncactttcctactcgttcgactacgacctgcttccattgacatatgggtcctgcagtgttaaagtcccacggatcagccaaaccagcattcccctcaaagccgtcgtccttatccccaatccacaccgtcggcggcccatccaacccgtccccatctgatctccccgtcggcggcggcccccaccgcttccttcccctcgccgtcgcgatactgagcagacactagcagaaggagtaggtgctccgtaacccgccccccaacaccaaagtggcactcatcacgcccacgcgaggtggtcgacgaagagccgcagaggagggggaggtgctgggtgggatccggcggaccgctcatgtcgagcggcgcggacggatcggatccctgcacgggccttgacccggggacgatcccagagctgccggcccatgagcctcctctgctgcaggctccgtcgccggcgccgcagcaggaggtggtggtggcgtcgcagaccgaggcgccgttgccagcggtcaccatcgtgatctcgcggccaggcgaggatgttcagatgcccgatgcaatgggtggctccccggcatgctccccgcaggtcggtgacggcaagcctatggccacctcggtttcgttgaccgcttcggcggccgcgaaggaagccgggctggcaaggtccgactccgacagcttggacgactacgagcaatgcaggtatccagtcggtgtgggttttcctgtgcaagctcaggccattttagtgaactgcgagttgggacggggacgagggtgtgttctgttttggagcgttccgattttgtatgggcacctcgttacgtttagcagttgcgcgttttatccatccatggattacctgcgatggcttcgggcgatgctcatgcagtgaagtgactgtagctgtatgaacgaacttccttttatgatgtagtgtttcatttcttggagtcgccctagcacatggatcatgtcaactggactgattaccccagcggcctttttccctccgtcattacaccaatggattttttgcctgcagttgggtgagttgttgtttatcacatataacatgcgagcaacaagtttgtgaacatgttcattgtcagtttgtctgcatcttctttagtattgactttgtcagtgtttgtggtatgtgcttatttacagcccatatgttagtgtagttaggctttcatgaagtgcaaataggactacaaagtggtaattatgatatattagggtctccaaggtatttaggcggtcatgagaaggtaggttatgtttccaatgcagttgggttgaccttgaatgtagaagcaaaggatattcggaatggtttgaacttacagcaacttcgtgctcaagtttgctgatagtaagatcttttatgtgtagaattattataaataggacttcatatattcgacaattcgatgaatatatatgatatttacttcttggctatgaaaggctaactggcagctaggaggctgcgggtgaaaacaatatgaggaagcatggtggaaattgataatcaacttccaactgagcttttcttgtaccacatatgtgctgtgagccgcaccattgcttttccatgtattgatgttcttgcgttgatcttttgatttactggatgcaagtaataacacatccaatctgttttctcatggctctttgacatttctaaatatagaagggagcattgtgttacttatgatctactaatcagaacaattatctttagaagctgaattttcccaatacagtacctggaattaaatattggtcttttgttttacaggagcaacacttgtactcttaataagcccaggttccagttaaggtacctgtggaccaagtggctgtccttgttttggaaggaacaatgtagaatgcattggccttgatggtaccgatttaagttattaagggcctgttgtttggggaatataaanntggnnagnttatataatntnacttattttaaactaacacttagttnaaaataagtgagattatata

SEQ ID NO: 4999 - DNA, 1683 bp, Zea mays
acggaggatgaagaagaataacagaggatccacgtaagcaccggagtctgggtcgaagcacaccgacggcgacagtgcacggctatgccatcggcaacaactggcgaaagaaagaaatgaagaacaacccgagtcaacaacgggagaaggtgctaatggatttgaagtcaagctactaacgagaaatctcacgcgaaacggaggcagaggcacgaaggggaaccaaaagttgttaatggcgatcagcaaaagctgttgccatatctttaaagagctcggttcggttataataccacgaatgcaattatgtgcttcgtgttgctatttctacgatgccgcatccataccggatgccaaattgccaacaggaaatattgtaattgtaacgtcaaactttccatgctcgttcgactacaacgtgctgcggttgacataagggtcccacgtgttgaagccccaccgatcagccgcaccagcttccccgcacagccgtcgtcgttatccccagtccccgccggccgcgccgcagcggcccatcccacccgtcagcgtcggcgtaggcccccgccggctccttcctctcgccgtcgcgagaccgagcagccagtagcagcaggagtgggtgctccgtgccccgccatccaacaccaaaagtggaacccctcacacccacgcgaggtggtcgacactcgacggagagccgcaaaggaggaggagctggcggtggcgggatccagcaggccgcccatgtcgagcggcgcggacggatcggatccgatcacgggccttggcccgtcgacgatcccagagccgccggaccgtgagccgcctcatctacagtctccgtcgccggcggcgcagcaggaggtggcggcgtcgcaagccgagacgccggtgccagcggtgaccatcgtgatctcgcggccaggggaggaggttcagacgcctgatgcaatgggtggctccccggcgtgctccacgcaggccggtgacggcaaggctacagccacctcggtttcgttgaccgcttcggcggctgccaaggaggccgagttggcaaggtccgacgacagcttcgacgactacgagcaatgcaggtattcagtcggtgtgggattccctgcgcgcaagctcagggtattttagtgaattgcgagttggaaaggggacgagggtgtgttctgcttgggagtgttccaattttgtatgggtaccttgttaggtttagtagttgcgcgttttatccatctatgaatcacctgctatggctttgggtgctccctatcttgggggcgttgcttcctcatgcggtgtagtgattgtaggtgtatcaacaaatttccatttatgatgtactgattcatttcttgaagtcaccctagaacatggatcatgtcaactggactgtttactttagctgcccttttctgtctgtaactacaccaatagatttttgcctgcagttgggtggaattgttgttcatcacatataacatgcgagcaataagtttgtgaacacgttcattgtcagtttatctgcatcttcattagtattgactttgcccgtgcttgtgacatgtgcttatttagagccctatattagtgcaattaggctgtcacagagtgcaaatgggactacatagcattcctgttagctatgatattttaagggtctcgagggta

SEQ ID NO: 5000 - DNA, 1543 bp, Zea mays
actgatcagccaaaccagcattcccctcaaagccgtcgtccttatccccaatccacaccgtcggcggcccatccaacccgtccccatctgatctccccgtcggcggcggcccccaccgcttccttcccctcgccggcccctcacgcgccggctagcagaaggagtaggtgctccgtaacccgccccccaacaccaaagtggcactcatcacgcccacgcgaggtggtcgacgaagagccgcagaggagggggaggtgctgggtgggatccggcggaccgctcatgtcgagcggcgcggacggatcggatccctgcacgggccttgacccggggacgatcccagagctgccggcccatgagcctcctctgctgcaggctccgtcgccggcgccgcagcaggaggtggtggtggcgtcgcagaccgaggcgccgttgccagcggtcaccatcgtgatctcgcggccaggcgaggatgttcagatgcccgatgcaatgggtggctccccggcatgctccccgcaggtcggtgacggcaagcctatggccacctcggtttcgttgaccgcttcggcggccgcgaaggaagccgggctggcaaggtccgactccgacagcttggacgactacgagcaatgcagagtttgtcaacagaagacagaagaacctctggtcgaccttggatgcagatgtcgtggtgatcttgcaaaagcacatcgcacatgcattgatttttggtttcgtactagaggttcaaacaagtgtgagatatgccagcaggttgctgtcaatatcgcccctccagaaacgcaatcaagtggatggttcagcccactttgggttgcatttgcaattctgattggtggtctcttattggatgtgctgatatctgtttctcttggtgtttccgcacttcctgtcaatataataattggtgttcttatagttctcggattgggcaccgcccttcatctagctcttgagtgctgtcacgaatggggctcaaggaggaacgtggccaatattccgaggctggagaacatagcgccgactgggtaccaccctgcagtagtataatcgttatgggacttgtaaatagcgtaggaacatctaagctcgtgctggcttttggattattatgttctcgcaactagctttagctcacacgtgttgctcgttaatgtcgagctcaaattcaaagctcgttgattacaatccagttcatactcccactagtccaatccaatgtaaatgcagagttactgatactcggtcatcacgggctagtgctcatgccaaactgccagcaccttaattggatggtctggctacccattcagcatgacagggctaggttccttcttccctccttgtacggtttactctgacaagtcacttgttgtgtttcatctttatctgtggcttgtcggtataggcatttgtgaaggccatttgagagttgtggatataacatttttatatgaattaatctgctgatacgtttcgtgactacgtaaaaaaaaaaaaaaaaaaaactcgagcccgg

SEQ ID NO: 5001 - DNA, 565 bp, Zea mays
aaccaacgcggcgtaatcatggcgagtagaaagcctttttgacctgtaaagcatccgtttccaggatgaggttgtcaatgcccccccggcctgctgacctcgtggatctcgacatctcaggatgcccatgatcaaactacgaacacgagctttggcctaaaaggcaagaacatctctgagcgtgagtggtcgccggcgaagtgcgcgaagccggagagagacctcgtcggctcctggtatagggcggcggcgggaggtagcccaggccagccgtagacagggaagcccacgcacgcgagggagagtaggtggtggtgggccgctgagccggactggacgggattgggctgccaggccgaagataacgacgctcgctccccgctcttggtgcgtcatggtcgttttcgtcagtgcggggtgcggggtgcctcgccgtcacatgtctcgcggggacgggtggtgggagttcgggttacccgaaaatttcgggtcgggtaattcgggtatttaaaatttcgggttttaagaattgatatctgaaattacaacgggttttacaataccc

SEQ ID NO: 5002 - DNA, 1110 bp, Zea mays
gggcaatctgtatacgatgattggggtcgcctggtgttccgggctggtcttacctcgcttcctgttatatcactcggagtttttgagcaagatgtttcgtccgaaatctgcttacagttcccagcattataccagcaagggccaaagaaccttttctttgattggtaccggatccttggatggatggggaacggcctcttctcctctctagctatattcttcctcaatctctgcatattctacgaccaggcaatccgtgctggagggcagactgcggacatggctgcggtgggaactaccatgttcacctgcatcatctgggctgtcaacatacagattgccctaacaatgagccatttcacatggattcaacatctctttgtatggggcagcataacaacttggtatatcttcatcctcgcctacgggatgacattgaggtccggcgacaactaccagatcctgttagaagtccttgggccagctcccatatactgggcagggacgcttctggtgactgctgcttgcaacatcccctacctgatacacatatcctaccagagatcgtgcaatccacttgatcaccatgtgattcaagagatcaagtatctaaagaaagatgtcgaagaccagacaatgtggaagagggagcggtccaaggccaggcagagaacaaagattggtttcactgcgcgggttgatgcaaagatcaagcagattaagggaaaattgcataagaaaggcccatctttaacaatccaaacggtatcttaggaatctcggtggcctgacaggctcgtcaacagtagttgccactttgttgtttgcttctgcaaggcagtggttttagcttctcagggcaatatagcaaaattcttttcttttttttccttatttctttattccccccgggagtcttttttttatcttcatttgtgtaagaaatgttggggtgtaatcggtggtgttcatcctagtagaagcttcatagccagccgtgtaaaaaatatagctcatttcagttggaaaaacaagctattgatatagctgacaacatatgtatatctgcaattttgattgttccctatcgatatttacggcggtgttggt

SEQ ID NO: 5003 - DNA, 749 bp, Zea mays
ctctacccgcaccgcgctcttcttcggatctttccctagccgcgcgtacgcgagactagccctagccgcgcgtacgcgagacaccaaccaccggcgccgctatgccgatctcctccacgctcgccacacgcctccgcaccggtcattcttccgcacccaaacccgcacggcggagcccctacaccagacccaagcccagcggcggcgccaaggcctcccgcccttccccccgccttgatccagcgaccacgagacctctcgaaccctctcagaaggcggtgcgatccggtttgggtcgccgtgccgagcccgatgtgcccgacgcgcgcgcggctgagtcgaagccgaaactggcgcatggagacgataggccgccccttgaggagaagcgccgctgcagcggtgagggcggattcgtcttcctctgcgcccttgctggacacaccgaggctatcggtgggatttctctgccgtctggttcgaacaagctctactccggcagcgtcgacggatctgttcgcatctgggactgcaattccggcaaggtagcttggttctcggcttccgacgatgtatctgattatgcacgggttaccaacaatatctctgatatgcacgggctaccaacaatatctctgactatggacgagtaacgggctgcttcaccggggttccaggaggaaggtgtcattgtcgggggtggtcatgtgctgattagcaagtgtgcaccctatggaccaacctaccga

SEQ ID NO: 5004 - DNA, 1378 bp, Zea mays
aattccgcgcggccggccgcggagccatccggtcccaaaagtagaaaagggcaagcgacgagcacagcacagcacagcacaagcacgccttccgttttgggaaggcgaggagaggggaaccccggcccagggagagttgtggggaggggatcggcggcggaggagatggaggagcgggagaagctcgtgtgcctggccaagcttgccgagcaggcggagcggtacgacgatatggtggaattcatgaagaatcttgctaggatggacgtggatatgagtgctgaagaaaggcatttgttctcagttggtttcaagaacactattggagcaaagagggcatcatggagaatcatttgttcacatgagcaaaaggtcgcagctgatcgtcagactggtgtgatgatagatgcctataagaagaaagtagaagaggaactaaggaaggtttgcaatgaagtattgtcagtcattgctattcactgccttcccttggccagtacgggtgaaaatatcgtattcttttataagatgaaaggtgactactaccgttacttggctgaatttagcactggaactgaaaagaaagctgcctctgatcagtcacttatggcctatcagcatgccatggttgtcgcctccagtgagctctcacctgctcaccaaatccggcttggccttgccctcaatttgtcggtcttcttttatgagataatgaactctcatgagagagcttgccaagtggcaaaacaagcatttgatgaggctcttactgagataaattctggtgagggagtttacaaggatagcacacttatgatgcagcttctgaaggacaacttagcattgtggacatcagaactaactggaggtgaagcatccaagggtaacgacgatgtcgacatggagggttgatacattctccatgttttaaggaaacacagaaagcacgcaaaaatatccaggctgtgatgctagcgaacctgggtcctcaagttttttctgcatcggaactcagaggagccttgtgtatttttctgaagtttctgtccgtctcgggtttttttttttgaggtctgtttgttcctctcttttggccatcgtttggtcctggagtcagtcactcactaccaagtgtttcagaggtctgaactggtgagcatctagatctgttgttgctttttttttcttcttctgtgcttcagaggcatctttgtacaccgatggaaaactgtttctcttatcaacgcatagactgtcagtgctgttactaatcatgttcggtgactgaagcagtctctgtaatgttgagatcgatcataaacaactccaccagattatgtaaaaaaaaactggtctgaagatgcttcgtcaatgacat

SEQ ID NO: 5005 - DNA, 1118 bp, Zea mays
atgagaatgatatgatgatagatcaacttattcaattttacaaatcaaacaaaagtgagtaagaaggccgtttttttttttttttttgaaaccaaacgcgctattaacttctacgaacgtgtagaacagcataatgcacatggcaatatcagagtagcacaaaataaaccaatgttggaactaatcaacccttggatcagtacccaaaaggccaaaactcaaaattcgattcagtacattattacaagagtgcgacaattagagcacctattgatcattacaaggaaacagcaaaaagaaccagcaggtcatgcatttggaaacgctgcactatgcggaccacccaccctgaggaatggcaaggcttccgaaccctttcgtagaagctcagaccatggatctcaaattctgaatcgaggtctgtcgctgttccgtatcatggttcctcccccttcccaagttttttgtagaagcagatgagatcactcatgtcgcttccatgccagagagcagaagcacccccttccgctccctgtatcccaaaaccatataaccagattcttcagcctctatccgacctttagtttagctgcagagcttgacagtgcatgcaacagcttgagcccaatacttcaacctcgccttcacttcttctggatcgtcacccgggccagagatcctccaattggggagcggcggcgacgcaggctccaattcctcctcctgccccggcgccttctgctcgtcgaggaacctccgggtcatggagtagcagagttcgagcgcgggcagcgtcccgcagagctcgggtatctcgctgtacgcgaatccgaagccgaggtcgaggcagcccttgagctcctccaggtcgtcctccgtgaggctcttcgtcctggccaccccgccgtcgctgccgctggcagaggacgcctccaccatcacgaagctgctgctccgccgtggctgccgcatcaacctacttttgctggcggcagggtcggcggtggagatcggcagctgcggctgcggggagaagtaggaggaggcggttgaggtggaggagacggccgccatttctcaggtactcaggttcgagttgggcgtctaccctattatat

SEQ ID NO: 5006 - DNA, 2333 bp, Zea mays
  misc_feature (1362)..(1362): n is a, c, g, or t
agatgagcataattcagtggagcctagtcttgctttgctttgtcgtgaagatgccttggagaagactgtaagcactcactgagaaaagtgacatcactgagaaatgcatgctatgtctggtcgcttctatacggggacataaccaataatgcgagtatcacctttgttcctccactgtgaatcaaaatgatgaaagttctctttgttttcgtttgctatcgaattcagaatttcagatagcaccaaaaccatagaattgacaataccccaaaaggtaggtagaatcctgcagtgtctatcatcgatgtccttctatgaaatagagtagcagaagaaatttttattctctatgtcaaacctcctataaagtactcctaaaacttaaaaggcagcaaagcccatcaaaaacaaaaggaatgaatcagtatggattagtataagacggatttgatgtctgaacttgacagaccgagcccttatgactgactaacgagtttttgacttcgtgtttctaagagagacagtaatgtaaacatcttgaattctttcataactaaattttgtcacaaagttttcttaataaaaaagatcgcactgaaaattattagtcaacaggcactcatcaacttactcaaaacgagaaaaaaatgatgcactaatgaatcgagcaaattgttatactagcagctcaaagagcacctacttcatcagttatccaaccatacaccagttcagcaatctaacaggaaaaacatgatagatcttcgctatttaaaaaaaaagatacgcgactgctcttcatgaccttcagtttttttctgatggactcaacccgttcctccaccatcagcagagatgcataacatttgaaacaagttactcagaaataaaacatgctttgatttattggtgcagtgtatttacacgcatatgaagtatacattgtcagaaacttctcaatttggcaccaaaagtttgtgactcccccaaaacagaaaaccaccaggccttcaacgttaaagctattatttcacatcatcccaatgacccaattcccaagtgaatgaaaaaagaaatgttaccaatttcgaaaactgagaagggaaaagtgatttttacccgggccagagatcctccaattggggagcggcggcgacgcaggctccaactcctcatcctgccccggcgccttctgctcgtcgaggaacctccgggtcatggagtagcagagttcgagcgcgggcagcgtcccgcagagctcgggtatctcgctgtacgcgaatccgaagccgaggtcgaggcagcccttgagctcctccaggtcgtcctccgtgaggctcttcgtcctggccaccccgccgntcgtgcgctggcagaggacgcctccaccatcacgaagctgctgctccgccgtggctgccgcatcaacctacttttgctggcggcagggtcggcggtggagatcggcagctgcggctgcggggagaagtaggaggaggcggttgaggtggaggagacggccgccatttctcaggtactcaggttcgagttgggcgtctaccctattatataaccgaagcgagtgcgtcttggcttaaaatggtttttgggtaggatcagcgagtgcgtcttggcttaaaatggtttttgggtaggatcttttagagtgttttataatttaggaataaaaacggtcggaaacagtatttatttggtaattaaattttttattgtaaataaataggatatagaatatacaatataaatttgtattcttgtttttaatattcagcttgttaagattcataaaaggtaaacctcaaattcatactatgttttttcaaataatatatataaactttgatatggattcggaaacaaattcgataattttttcaacttttgtgttgtaaggagcaaataatacataaaacaacttatataatattttattcatatttatactaatgtgcttgataacataaaaaaagatcaacgtcaaatttaatacatatctattttaaaatattaaatttgttctaacagttcggattaccactttcattctacttttattaggcaatttgaatttaggtgttcttgcgctagaattttaggagatataagtattaaggcactggtccacatatctaaaattaacacttagagcctatttggtccaatagtgataaagtttaacaacaaaatttagcgtttagcctatttgttccaatagcttgataagatgttaaattttagcacttgggctttactagagcacgccatcgattgtaggggagagagggatattcaatgcaaaatatggtggggac

SEQ ID NO: 5007 - DNA, 4853 bp, Zea mays
  misc_feature (3383)..(3383): n is a, c, g, or t
  misc_feature (3723)..(3723): n is a, c, g, or t
  misc_feature (3736)..(3736): n is a, c, g, or t
  misc_feature (4425)..(4425): n is a, c, g, or t
atttctgctggcgcgcggccaccgccgtcaccgcggaggaggtcgctgactttcctgaggatagagatgacaaaatggagaccggccagacaatggctgcaattccagaactaccccttggccgtatctgcacgcagctccattgaggcactcgaagggtcgaagggtgatgccggtattggacatgagtctggtgtggctgcgccgaactggtaggttactagtgccgtagtacgaggcttgggcgaccgtagtggagtcaagggctccacatggaagcttcagaatcgtcgggagccgtgctgccggcacgtgtgctgcccgggcacaagtggtggtcctcactgttcacccaccgacactgacagcgattttttcccctcctctatacactatcgactatccagcggcaaagcgcagcagagcaaaatgcaaatgcgtcatcgcgtgagattatttttatgtgatctgtcccaaggaactatgcaggttaaagattataagcaggtttatcatgtaaacataagtgttacataacagttcagtggagtttcttctttgccgagtttcagtcagtttccagctaagctgagaatatatgtacgcatcttctacacacgattgaagcttgccaagcaagctgacactttgctgcaaatctgcagaacgtacatcgatcgcaatacctagagagtggcacaaaatagatcaaaaattggagctaatcaacccttggattagtagccaaaactcgaaacttccattcagtgcgtcattaattattacaggactacgacagttagaacacctagtgatcatcatcattattattattaacaacgaaacagcaggtcctgcattttgcaaaggcttgcggcgtagaaccctcaaaccatggatctcaatcggggtctgtcgctgtcccggatcatgatccctcctccgccctcccaagttcttgcagaagcagccagagaagaaacctatgaagagagttcttcgctcccccgaatcccaaaacacatacaaccagactgttcaacctccaacaggccctcggttcggcccgtcgcagcatacgctaacagaacagacagcagttaaaaccagcctctggttcagctgcagagcttgacagtgcatgctactgcttgagcccaatacttcaacctggccttcacttcctccggatcgtcacctgccagaaccgatgctgatcagcacagaaattaacacaggtgtttcatagtaaagaatcaattgcagggacaacagaatctcaggactgaagtctgaagggggtaacggccaagctaggtttaattagaagtgtttctatttagaacatctccaacaatacattaaattgaaatatatagctctacgtaggaaaaactacgccaacttattttataagatgtaattaaaaaaattatataacaccctcttaagtgtcttaaatatactacactatagtgggttgtcctatagtctacatttagagttttactgttggtgccctaaattctataaaatatgtttattttaaaattataagatatttttataggccatgttgttagagatggtcttgcagtttccaaacaatggaccttcggtagagctagaataatcctctttttttggtgaggaaacgtgactgcgctgaaaaggagatagcataaaccagtggagcctagtctcagctttgctttgtcgtgaagattgtcttgtcctggagacgactgtgagcactcactgagagaagtgacatcaccgagaaaaaatcatgctatgccggctcgcttctgtatggtgacgttgtgtgaatcaaaatgatgaaagattttctttgttttcgtctgctatcgaattcagatagcaccaaaaccacagaatgggacaatgcaccaaagccacagaatcctggagctagcatccgtcgtccctgttccttctatgaaatagaaggagtagaagaagaggttcttattctttatgccaattgccaaaacctcctataaagtactcctgaaaaggtagcacatcccgtcaaaaacagatggctcctagcttgagttctgaatccggcagtccgagcactcatgactgaactcacgagttttcgaatcagtgtttctaagagatgcagtaaactactctgggacatcttggattctttcataactaaattttgtcacacagccttcttaaggggaaaaaaagatctcactgaaaattatcaggacctgtttgtttccttccaggttatataatccagtttatggattatacaagcatctaatgacttacttatgaattatcataatctatatatttaggttatataatcacctaataatctgtgttgttcgttttgtatcttaacttatttaagctatattacataatgtagagggtaaataaacatgacactcatcaacttactgaaaacgaaaaaaaatgatgcaccattacaccagttcagcaatctaccaaaactgatgcacaacgtttgaaacaaaatactcagaaataacgtatgatttacacgcatggtgaagtatacttggtcagaaacttactgcattttagaccaccaccctaaaaaaaacctcacccctttaccgtgaggctattaattcacaccatccagattgaatggaaggaaaaaagaggaaatttcaccgagttcgcgaattagatcgagaaatgtggttcacttcctccggatcgtcacccggtgcaaagatcctccaatttgggagcggcggcgacgcaggctcctcctcctcctcatcctgtcccggcgccctctgctcgtcgaggaacctccgggtcatggagtagcagagctcgagcgcgggcagcgtcccgcagagctcgggtatctcgctgtacgcgaagccgaagccgaggtcgacgcagcccttgagctcctccaggtcgtcctccgtgaggctcttcgtcctggccaccccgccgtcgccgccgccgctggcataggacgcctcctccaccatcacgaagctgttgttccgccgtggccgccgcgccagcctgctgatggcggcggcattggcggtagggtgggcggtggaggtcggcagctccggctgcgaggaggcggtggcggtggaggagacggccgccatctctctgatcggttttgtttgcatgatgccgcgtcaggttctcaggttcgaggtgggcgtatggcgctgcgtatttataaacgaagcgagggtctgttggtttaagatgggttttgttgggtagttatatttcctccactattggatccagctgcatacctttccgtggcttgtaggtacgtacgtgtcggtattgttgttaacgactccaactgccgtgaccctgtntttctgtctcggcgcgccacgatctaactaaccaaaccgcttcgtccgcttaccgcgctcgctccgtcgcgcaacgtctgcctgtaaatattacatttgagatgttttgttgtcttgttgatcgaatcacctaaagtgcatgtatgttgcatgtttcaacttataatttgcctagattagagtatctccaagagattagttaaatgtcttgtcaaactaaattttggctagtcaacaataaaatagctctcaaacagactttagacatcccaagatatgcaactctctaaaatgactccctcattaactaaatttaactagccactctgaatagtcaaantatatagatagtntgttagagtgaaatgctaaatataaaatgtaatctttatggaaagataaatagagaatcaaacagagagagaaaatgaatagccccttagagacgctcttatataatctagcttaaataatctaaataggaaataaacaacttatttggtaaaaaaaactcatccctcgttaggtcatgtttggaacctctagaactaaccgttatataataaaaaatagttgttgtgtttcaaacaccctcaactaataatgcagctaattgttagctactctatggttctaatttataattcgtttgacttttttaccccaaatttgaccaactcgtcttattcaaaaaattcacaattattttaattttttactgcagtattgtttatcatataatatactttagttttggttttgaatttttcagtcaaacttggtccaaaaaaagtcaaatagacgagccagtcaaacttggtccaaacaagtcaaacaaattataaattaggacagaaggagtacctcacaaataacacttagttcattatgtgtcttaacctagctaatgatttattagctagttaactattagctatagaggtttctagacatggccttgctatggataataaattacttaatattgtcattcattagggcatgcacaataaatgacttgagctgtgtattcaggtgtgtntaaggcgtaaatgtaaaaaaaaattcagacacgtctcttgacaaagacaatatgttttggctctatgctcgagacggaggctagctaattggtcaatttaatttataataatctgattagtgtaatgaatatagtaagatacaagttttacatatacccattgtattacattgtgttttaactgtgtcttatacatgagtatcatgcatgtcagagttgtacgtacccttacgcattaaaaacgtttcatctattttgccttgcccccgccatgcaacgccattgaacacattgactaaaatcaatgatcaactatccaataagatgggttgccaaacagttacaacaaaaatatttaccgtagattatataattcctcatatataatctataagctgaatcaaacataccttttacaactatgatgt

SEQ ID NO: 5008 - DNA, 4446 bp, Zea mays
tatataataagcgtactctcaactcttgagaaccgcctctacccgcaccgcgctcttcttcggatctttccctagccgcgcgtacgcgagactagccctagccgcgcgtacgcgagacaccaaccaccggcgccgctatgccgatctcctccacgctcgccacacgcctccgcaccggtcattcttccgcacccaaacccgcacggcggagcccctacaccagacccaagcccagcggcggcgccaaggcctcccgcccttccccccgccttgatccagcgaccacgagacctctcgaaccctctcagaaggcggtgcgatccggtttgggtcgccgtgccgagcccgatgtgcccgacgcgcgcgcggctgagtcgaagccgaaactggcgcatggagacgataggccgccccttgaggagaagcgccgctgcagcggtgagggcggattcgtcttcctctgcgcccttgctggacacaccgaggtgcgcgcttcccccatctctctgaaaattctctatctcgacgcgatcgccaatttctgtggtggtgtcttacagtaatcataaaatctgataggctatcggtgggatttctctgccgtctggttcgaacaagctctactccggcagcgtcgacggatctgttcgcatctgggactgcaattccggcaaggtagcttggttctcggctcccgacgatgtatctgattatgcacgggttaccaacaatatctctgatatgcacgggctaccaacaatctctctgactatggacgagtaacgggctgcttccacggaggttccagtgaggaggttgtcattgttcgtggtggttcatgtgctgattagcaatgtgtgcaccctatggaaccaaccataaccgaatggtgactcctgattttttttctgattggttgtgcctaaatcaccaatcgtcagcggatctcttatgattagttgggtgatcctgtgctcctggtttggattggatgctatctgtcaggctagccttgttgctatatattggaggctcttcgcctgcttcggttacccgtttgcctgggatcagtttgtggcgctatctggttggttgtcacttggttgatacatatggttgcatgatctgcaagtgaatcttcagagattacagctatctcattagtggatagtcatgcatttatgtaaaaatatagcaatgagaaaaaggaacaaagtaaagaaaaagagaaaatatagatggagatatgtgggagtatatccaagaggatggaaaaaaaatataatctgttatcatattacaatttttgttcttaatgtttctgcaatagtgtgttgatgtcatcaagatgggaggcaaggttagctgcatgatcacccatggcccatgggtactcattggaattccaaagtttgtggaggtgacattctgattctagtgagagtacacctttattttgtattatgtatggtgacattgaggggtgactttgcttggtacaaggcattgaacacaaagacagggatgaaactaagatttcaagggccttctagtctagtttgttccatggctatcacgaatgagatgttgtttgctggtactggagatggtcgcatcatggcctggagatttcctgctaaggatagtaacactgaaccagtgttgatcctcagtggccatcaacggccagtgatttcactgtctatctcggcaagaagactttactctggctcactggacaagtccatcaaagtatggatttttcttcaagatattgctcaattggcagtcagaagttatgctcattctgacacattcttcaattctctgtatttaccaggcatgggaccttacaactcggcagtgtgtccaaacactctctgagcataaagcttctgtaacatctgtgctttgttgggatgagaagttattatcttgctcccttgacaagactgtaaaactctggactctgtcagagtctggaaaccttcaagtcaaatatgcccatgccgaggagaatgtaagaactgcactcctgccgatcatgcgttatttttgttttgttggatgctgcaggcaggctttaccggaatagtttatggcaacatcatttttattggtgtagtaactaagttttaccattaaggttcagagttaagagcaacagttaccttttcttcttgtagtccttggatttttttattgtattttgatgaatattggcaacagcatttgtgccttttgttgtcctcctaggttcattgatcaattctgttttttgtgtgctactccattgatcagcttaagtctattgtatattcttaactgacgatacaatttattgcgtataggaataacctgcccgatacagaaatccgtttcaatggctctgtatgcctatgtaccgaatacttctaaaaatcaagcaaatctgttcacaagagttttttttgttgctgcaattagttttcctctgtacttctgcacgtctcatggtgttaattgttggcactctgtttgcttttagccaagaaatatgattcataaatgcagtctctgaagtagatgttggcataggcatgctggaacctctcaacatcgggtcttcttgcttgcatataagagatggcctgtctggttggtcttggtcgactagagtttatctgatgaacctggaaaattctagcgattggagtttctatatactgatataagccttattggatgagaactttagattgtctgctcagttcatctgtttgtctcgaagacttgaagagcaattgagtactaagtatcttagaattacgaaaacaacatctagggcattatgtttgaactgattgcctatcataaacataaaaacttcattcggcaggaagaactaatggaatttcttggccattgttcttctagcccagcagcacttttttcttttactttctactcttacctgtatttcaaaatattcccctgactgtattattctcttcagtacttttgacttggaacaagttcaaaaaataattttaatctttttcatgagatggccttagaaaaaaatgctgccttggtgtgcttgatcacagaacctacacaagagtataattatgcaactgcgatgagtgtgttgtgtttcccctttctttttacattggtttcctcacaacagctctaggctgttcccctaccgcttaagctttccgattatgttgcagggtttgcgcacactcttcggcatgcaccgagttgggaagacgccagttctcttgtgctccctccacaacagcaatcgcgtccgcttgctcgacttgccatcgtgagtgcataatttttttttatcagtttcatcatcagatagacaaaccgctcgctcagtggttccttactgaaaggagctctgcatttgcctggttaccatctttcaggttcgacgggattggaacactgttgtccacgaaggaagttaggaccatcgagcttgcggctggtgggctgctcttcaccggagactgctccggcgagctgaaagtgtggaggtgggcgcccaaggactaggaggcagtagctgatgtgcatcaaatagtgtagctgtagcctcattgaagaataatagccactgacgtgctccatcattgtattcgtttccatgtaaattatggctgctccccctgatgatgtagcacatacggccaattttgtgaggatgcaaccctggtatcatgttcccatgcgtctccctttaactgccctgacttgagatgcgtgccgtgtccgtgtccatgcccatccagaagaccacgtgcgtatggccgtgtggagtgaatgcagacagatgaccaagcgtgtaaggtttgcacgagtcctcatcgagtcaccgtgcgccaagaaacaaacacgtccaccgattccgcccacggctttacaaatggagtgaagttcccatgttttgattgtccgtgttaggaatacatgttacgtacgtagtacgaactgcctccgtcccaaaaataatgtcattctagatttgaacaaggagtcgtagaaaatattatcttctctaaacagatttattataaaaatatatttcataatttatatattatttattatacgttgtaaacattagtaataatttcttgtatatgtactctatctattttaaaatagtcggtgtttttatttttttttaaaactaactattttaaacttcgatcaaatatgtacaagaaaatatttatattcatattacatgattagtatcgttatatcattaaatagatcattgaaattatttttatagtaagtttatttgaggatataaatgtgactaacattttctaaaaagctagtctactctaacaaactttgatggacataaataccatcgcgacaactattttaaaacaggaggagtaaatacacatatatacattcatacgtacc

SEQ ID NO: 5009 - DNA, 1664 bp, Zea mays
aaaacccaacgtcgccgcctgcgaaaggggaaaacccatccgatttcgattcgatttgccggcggtgcccgcggcggagaggatggcgagctccttctccttcccgctgatgaatccggcggacattgcggaggcgctgcacagctactgcatcgcgcccagccccggcctccgcgccgagcacatcgtcaccccgcagcccggcctcgtcgccgaggtcctcgccctcttcctcgccaacttcgtcggcgacgacgagcccgacgagcagctagagtttcaggcgctgcaggcgatcgacaacccggagcaccacatgcgcgccatagcgctctcgcgcctctaccggagggccaacgccttcctccactccatcctcttccgggacctcacgctccgcgaccttctccgcgccgacggccgccgtgtcgtctacatcctcagcgccataatcaacttcctccactacaggcaggataagctcagctttcttgagcccatcgtccaagagtacagcccccttcaggaacggcacacggagctcagggctaagatcgccgagcttcggaacgcaaaagaagaccatctacttaaggagcagatggaggcgcccgtggtccagcaactcgagaaggaggtcaatgccctcaaacagaggcttcgtgaatacaacaaagagcagctgtcgctgcgcgttgcaacaaaagccatagacgaaaagaaacaggagttactcggcaagatgaaccaagctgatttcgagttggtgaaagttatgcaagaaaaggaaaggctatcagccaaaattgttcattcccctgaaaagctcctgaggacccttgaggagaagaaagcagtccgtgatgagctaaggaactcagagaaggtggcaatgcaaaaagttcaagagaaaaccaatactcttgagacgtatactaaggtttctgagaaactagtgaagcatctctctaaaatttctgctgtacatgaaaaaggcactgttgctaaagcttctgagaaggatgttaaggcacacaaagagaagattggtgatcaaaatttggagataaaggcacttcgcaataaagctgctgagtggcaattgaaagtactcgagaacgagggcattctgaacgcaaaggagaaagaaagggatcaaagagttgcagagaacaatctgaagatgaacgcgttgaaatctgaagtcgaatcggagcacaagtgccatgcggagaaagaaataaaaataaaggaaaagcttgaaaaggttgctgaattatgctctcaagctgattcggttgctgaagctggaaataagaaaatacaggaaatctgtgggaagtataatcaagtttgcgaggctgcaaacatgtacatggatggcatcgatcgttcctttgaagagatcgatgaagctgcagtgagtttgaaagctataggccagagtggtgcttgatgcgtgaagtgaccatcgacgggcaatggatcgtggacagcatagtaaattgtgctagtgttaagctctgtatatatacctccaccgcgtctgtatatgccttcttcccactattttaatttaattagcactaattgccagtgaaaatggatatgtctaccgatcttgattaattatatttcaattcaaaacaaaaaaaaaaaaaaaa

SEQ ID NO: 5010 - DNA, 837 bp, Zea mays
aattcctgggtcgaggagctactagtcggcggccgccacggggcgcggcgatcccgcagtgcccgcctcgcgtcccagtcccacagccaaggtcaccgagggcggcaccggtaggccggcctctcggctcctctccacgaggtcactcccgagcctcttcgcggagtccgcgatgacgacgagccccgccgcctccgcgcccgagctgctgtccagggccccgccgggcctggcgggcgtgctggtggcggaggaggccgacgagcgggggtccttgttgaggaacgggcgcagggtgctccgcggggcgcggctccgggtgcagctgccgccgccgccgccgatcgagttcggcgtgaagaacagggaggcccagctggcgctgctctcccccgtgcagcggtcgccggcgcggctggcaaggcggaggagcgaggtggaggaggagctggccggcgaggactacacctgcgtcatcgcccgcgggcccaaccccaagatgacgcacatattcgaggaccgcgtcgtcgagagctcgagctcgagctcgacctcgacctcttgcgatgggtgcaacaaggatgctgctctcttgctgctgctggaaagaggcgagagcgagttctgcatcgaccaacggaaggcgctgtttggcggcgaacgggctggcggcgagcgggcggtgacaaactgaactctccgtcctgaatcttggcacacccgcgctatatgtgaagcgacgaaccattccgttcttcatctcgtttgaagaaattttgatccgtgctgggcccaaaaaaaaaaaaaacaaaaaaaaaaaaaaaactcgagccgaat

SEQ ID NO: 5011 - DNA, 2597 bp, Zea mays
tttaacacgccaagaccaccatattcttttggtgtacaaataatactccatttggtcagtctatatttctttttgtgaccttcgccttcccagaagaatctagatctataatagtctagcttcttgagaaccgtacgtgggacctcaaaaaaagacaacatgaagattgaaagactgctcaagatggagtttatcagcacgagccttcctccaatcgaaagcatttttacctttccacgcacttagttttctctgaaatctttcttctacctctttccagtccgtattttttaattttctatggagcatcggaatgcctaaatatcagaaggggaatattcccatgtcacatccaaagatctgagaatattccctctctgattcttgagcttcaccatagcaaaaaagttcagttttatggaaattaatttttaagccagaaagttgctcaaatgcattcaacactagcttcatgttctttgcctcttcaatgtcattttccataaaaatgattgtgtcgtcagcatactggagaatagataatcctccatcaaccagatgaggaacaactcctctaaattgtcctaaatctttagcacgagtgattaacacggccaacatatctacaacaatgttaaaaagtataggtgacaaaagatctccttgtctaacccctttttttgattgaaagtagtgactgatgtcatcgttaacatttaccgctacactccccttggttaccacttgttgtatgcaggagcaccaggtagaagaaaaacctttcaaccttagaacttgttgcataaaaggccatttaaccttgtcatatgctttttcaaagtctaatttaaggattattccattcttctttttcctatgcacatctaggtcattaaacttgtaaagttatatcgtctcggtctctaaaatctgaacatgcacatttatacagccttattacaactccataaactgctatagaaaaaaatctgtttagaatcatagaacaattttaagcaacctcagtgctagcatttgattgtcagtggcttataaaaatctacctagccaatatctccaaggattgacagacatttatgatttcttgttgtgattccagcagactccaaaacctgagccgatgtgattgatgtactaccctggcgctctgttctagtgacatgacatcggagcacggtgtctagtggagcagatgtgccggccgtcgtcagtgcgcaagagatggaaaacggatgtttacgacacaacacaaaacgtctcgcaaagtcgccgtccagtcacgtcacgacacgacccaaagcgcgcgctggtgaatgacggggcggagcgggcaggtggtggtggactggtggtggagcgagtgggtaggtgcacggacaagatgggacgaggacgtgaggcgggatgagatggcaacgtcccaacttctcccggcccgcgccgcgcagaaaggtcgtgcagcatgattgtggtggcatgtcactggcacgcacgcacccgctggcccagaaagctactagcgtgcccacacaagttcatgcatgtccgtggcagcaagcaggagtatagacatgtagcgttgcacttgcactgccctcccagctggtttggtttggtttcgttttggttttggttgggttttcacaggcaccgcgcgcgcgccggcgatcgagatggccgactggggccccgtggtggtggcggtggtgctgttcgtgctgctgtcgccgggcctgctgctgcagctgccggccaagggcgggcgcttcgtggagttcggcaacttccagaccagcggcgcctccatcttcgtccacgccatcatcttcttcgccctcgccgccgtcttcctcatcgccatcggggtgcacatcaccacggactagccgtctagccccatagccgggaccgggatctttcttcgttacagtctgcctgtatatacatatatacatacatgctcagtacgtacgctttaccactctgtcagtgagtatctctttgtatcagcacccctgctgtgtgcgtacctagcaagtgtttatatgggctctggtctgggctgttatcattcagcggcgcagcaagaaacccgatcgtttgcttccaaaaccagacaaaaaaaggggcccgtggccatccatcgtcgatccatctcactaatttacacaactccacagttcagctcgatatccttcgatttcatctctcacacgaccggtgggtgccccccttctctcttgcaattgggtcgcaagtctccacctcacacccatatttccacgcaacaaggtcgccctgaaacagtttttatttcttctgaagaatatagataagtaggttcttatggattttctctctctctctcaatcttcaacgtaggtagaatctcaaaacttgaaatcgaagaatccatccccctctggatctgtatccaagttatcaacctacagcgggaccgcgaggatagggctagacgaaatgatcgtggcttgtcagctcgctcgattcgtggttaacccgactcgtttgaattttttcacgaagttaagaatgacatcctagctcggttcata

SEQ ID NO: 5012 - DNA, 894 bp, Zea mays
cccacgcgtccgtccacctccgcccgcgtcgagcgagggacacaccgcctccggccgcgcggcacgatctccgttccccaacatgagcacgacagaggatgagaggtccggcgccgccgcagaagcgggaggaggggaggaggagagacgggagaggagcgtcggcctgatggccggcctcgtggacagggccaagggcttcgtggtggagaaggtggcgcagattcccaagcccgaggcggcgctggatcgagtctccttccagagcataagccgcgagggcgtcgagctgcacagccacgtcgacgttagcaacccctactcgcaccgcatccccatctgcgagatcacctacaccttcaagagcgccggcaaggtgatagcgtcgggcatgatgcccgaccccgggtggattgcggcgagcggcagcaccaagctggagctaccggtgaaggtgccgtacgacttcatcctgacgctgatgaaggatctgggaggggactgggacatcgactacctgctggaggtagggctcaccatcgacctccccgtcatcggcgccttcactatcccgctcaccaccgagggcgagatcaagctccccaccttccgagacttactgttctaggcaatcggcaaatgaaatgatttattatccatatcaaaatcagtgctctatcaaagcaatgatggtcgattagcaatatttgggtttctatataactgttcagggatttaaaacaatctcacaccggtgtgaaaatagatgacttgacagtcaaaaaaataataatgccatgaggcacatgcatggccgtgtgtgggtgattggaatttggaatgatataataccagatccatggaagtggcatgtgtgcctaaaaaagggcggcc

SEQ ID NO: 5013 - DNA, 980 bp, Zea mays
caggcgcacggctcacgttgtccgcctcacgtaaaggtcggtgccatcctctcctatctctcctcgcgcagttccacttcccattttccgccttcgtccgagggacacactgcctgcgatccgcatgcggcaagatctttccttattctccaaacatgagaggagcagggggggagagatctggcaccgccactgatgcggcaggagaggaggagaaacatgagaggagcgtcggcctgatggccggcctcatggacaaggccaagggctttgtggcggagaaggtgatgcaaatccccaagcccgaggctgccctggatcacgtctccttccggagcatcagccgcgagggcgtcgagctgcatagccacgtcgacatcagcaacccctactctcaccgcatccccatctgcgagatcacctacacgttcaagagcgccggcaaggtgatagcgtctggcacaatgcccgaccccgggtggatcgcggcgagcggcagcaccaagctagacctgccggtgaaggtgccgtacgacttcatcgtgtcgctgatgaaggatctcggaggggactgggacatcgactacatgatggaggtggggctcactgtcgacctccccgccattggcgcctttactatcccgctcaccaccgagggcgagatcaagctccccaccttccgggacctattgttctaagcaattcagatatttggcgtatgaatcgatttgttttcacaccataatcagtgctgatgtggatctgcaatatttgtggatttctttatgtggcccgggactttcaagctaacactattctccccccaatgtgaaatagaggagtttaagcctcccgccacaaaaaatccaacccgatggagcaaaaaaaaaaacaaaaggggcgggccccgcgctccacctttggtccccccccgcacgccaattcccccttgtcctcaactcgccccccccgcctccccc

SEQ ID NO: 5014 - DNA, 5635 bp, Zea mays
aagtgcataacaaactacacatgtagaaaagccaaaatgtctttgtttggaatggagggagtaacatgcagtgcttccgcactatagctaggggtggtaatgggctctaaattgtacactataaaatttaaggatcaaatcagattaggatcgggctctattcctattcatttttgaacttaaatttattaagggccctaacttattgtgaagaaacatttggatcgcggtccattaccacccctaactatagctgcagtagtatgaattcatcaagggcaagggtgcagatgtcattccagcatttgtccaaagacaaacctttctttctttaaccatcaatttctagaaattcgtagtttattatcgtacgatttaagttcctagattaaccatgagaaatactttcatagcatataatttgcatgttgttaagctgtatgaacttgtaggaattgttggtcaaagatgtaaatgtttgaataaggacaatgccaaaatgacaattaaattgaaacaagagtatattataagcttaaacctatgtggccatcatggttcttaaagcggtaaggcgacgtcttatctatctaagaaccagcaagactaacatggagaggaagaaaaagaaaaaagaaaaagaaaaaaaggggtagcaggcccagcccaccatctagcccacatatcctccctgttgccctcctcctgccgatggggccgcccctgccctcgaagcagccgtcagcaccctagatttggcgttgccgacctcgattcgggctgccgccgccccgattcgagccaccgttgagctgatttggtcgtcgacgccccgattcaacgtgccccatctcctccctcttgctggttcttcgctgggcgatggggacacctagccactttggggcgcctggacgcctaggcgacacctttaaaaccatggtggccatagaagatccctcttagtgttgtatgcaaggaactaaggaaggtcctcatcaagttgcaaaagctgtacatatccaatttgtgcataggaaaagcaacttgtgtgaagataaaaaagcagtgaaacacttatctctctatctggttcatagatgccagtctggcagtctttatctcccatcgttctctcatgtattagccttttctctccctctgccaataggactcttctaaacatgtcaggagtgaatcagcactgtgatatatatgaatttgtttcctaaatgctccttcaatcattgagcatcatcttctacaataactagaaggataccctaatcattgcatgttaatcaatatttcaatacaatgctgataatttatctagttgaaagcatgcgggttagtattattatacttaactcgctaatttgttgccttctgttgtacatcagctttaattttcgcaatccatctatgttttcaggcagttaaacagctcattaaatgggatgaagataatccagacagtcaccgttgtttggtaagtttgaaaactatacctaccattaagttttttgttttcttgaattatgcaacatgtcaaaataaattctcttcttacagtacactaatgacctaacagatattgagattccagagtcatgttttttctgagttcatgaatttatggttctggtaattctgccttgagcccaggatatcttcgataagggcaaactgaaggctattcttcagtgtaccttggttttgagcttgtttttggtcaatgtatagtaggattgctgcataccacaccacacatcgggtgaatttgaaatctgatagtttttttcttttgtttgggtaaagtcagtgaggagaagtctatagcatggtttaaaaggcggctaggcggaactaggcgcccagccactgcctgaccgcctaggcgacttaggcgggcgcctaggcgacgccttagtagctgttacaaacagctgttagcctataacaaaataccaagcaactaaagtaccaaacagatgttacagctcataaactagaaatcatcacaaattcacaatagcacaatagtggatctgaaatagccacaaagtagtttctaaaggaacaatagcaagtctcaaacttcacaacaccacatgtccaaatctgaaatagccacatagatagtttgtaatggcataattaatagtaactagctgcagttagtaatgcagcaaatatgctaatgcaatctagcaatagctactctccccctctcccgtcgctcaaaaatcatcatcaaactctcctgggatattgggtgcctccccttcttcaccatcattgccaccattagattcatcttcacaatctgtgatttctgcatcatcatgtggaacatcttcttcatcttcatcttcctcttcagcctctgacatattttgtgcagcaacagaatttcttcttgaatacacattatgggcccttcttggtaagtttcggccacggagtgcttgtgatgctccaatggcattatccacaaggtcccatgtaaggtcacactcacacccacgcccaccttcagggactacatgcaaagaatcagcccactcattgtcccagttgaagtcctcatgaaccaatggatcaaagtttttccccttcttctggcgtagtttttggaacctagccttcatctttctgttgtaggaaatgaagacaatagaattcaacctcttatgtaacaatcgattttttttctttgtatggatctacaaaataagaaaagagaaaacacttggtcatttaatcctgaaatattggatacaaaagtagccaagtaggtggatgaggacttgaggaggcacacataataacttacaaattcaaaggtactccaattgcgttcacaacctgatgaagacgcacaaagactcaccaaacgtctagcaaatctctgtaactcaatagcacgaccaccatacgaacgcctccactcaactgcaataacatcacaacaatttagcaagctactagcaacaactagtaagtagtaaactagtaacagccacaaacacttacgtggggtcatagtttgtaggttatctttggccatcttatttgaaaaagctgctcctctaagaaactcgtaatccattgcttgagaattgatcttgtctctagtttcctcatcatctaccattcttgcaagcacatcaaggaagcaacctcttagctgaccaacagtagcatcatcatcatttcttatgagaggatgcagctttcctgggttcaaatacattgcagccccatacaatgggtgatccatttgtttctcccaacgccgttcaattatagttatgattttcttgagtaaactcttcttgctttggacagcaaagctttgattgatcttttcctttgcacatttcatcaatgcttggacctctggcatagctggcctctcatctccatctaccaccctaagtacaataagtagtggccctgaagctctaaggcaatcttctactgaattccaaaactgtgtggagaagacaatgttatacacatccaatccagcactagtctttgacaatctgttatcagtccaagctgtgcttgcaaataaagccttcaaagcatccttgtgcttgtacaagctcttcaatgtgagaaaggaagtagcaaaacgagtggctgcaggcctcacaagatcagccccaccagttttctctctcatggcagcaagaattctcccgtgtcggtatatgaaagttgtcacacgccttgcacgtgcaattggtttcttgaattccttcaagtttcctatgtcctccaacattaggtccaagcaatgtgcagcacatggactccaaaataatgtaggaatcctctccattagaagcttgcctgcagctttgtaattggcaccattatcagtaacaacttgtacaaccttgtctctcccaatctcatcaacttttttctcaagcaaatcagcaagcatgtatgcatcatgtacttcactagatgcatcaacggactctaaaaagtaagtgccctctgggctgttcactaagaagttaatgagatggcgtcccctcctatcagaccatccatcagacatgagtgtgcaaccatagtgtttccatgcacgctcatgttcctccctcattgtagttgttgacttcacagcctcttgtagcaatggctcgcctagttggtacggtgttggaggcttataccctgaaccaaactgtgctgtggcctcaattgcaatctgaaactgcctagctgccgcggcattgaaaggtacaccgcactcatagaagaacaaagcccactgcatgtccacatagtgtttgtcctccttgctttttgcactagccaagattgtgggctgataagagcctgaaagtctctcatccaccacctcctctggtgttctccgcaacatctcaactacggacttggctgtctttggctgtgctttactgtttgccttaaattgcaaggtcgattgtctttttttggctgctgtaccagaactgggctgcaccttggatgcttgagactccacagcagatgtatcattcgccccatctgctgctgccacctccaccacttcatcatcttcttcatcttcatctagaaacattggtctttttctcttgtttgcctccaaataacttgtcatctccttccttattccactgctagccttgggacataactttgcatctccatatgcccctgccaaatgttgctttaacctcttttttcctccactaacaacctgaccacatagggtgcattccaccttatctttattttgaagatccggccaaaatccatacttccaccctggatcagtagacttccgtggcttccgggtaggatcgctcttcgggtcgtactcaccagccacagaagatggagcttcatttcgagaagacattaggttgtcggttgtcgctggtcgctactcgctgcagtcttgagtcttgacacttgacacaaactattcgctggctcgctgcacggtctgcaaaccaggggatgagcagcagcagcgcgcccagaccctagagcacagagcagcagcagcgcgcccagagagcagagcagcagcaggagcagcgcgcccagagaccgcgcccagagcagagagagcagcagccgagcgcccgcgcgtagggagtagccgcgcccgcgcgtagggagcaccggagcagagagcgcgcgcagggagagggagcaaaagagtttgccgcgcgcagggaagagtttgccgcgcgcagggaagaggtgcgcgcagggaagagccgccaaatttgcggcgccagggagagccgcgcgcgcacagaaagcccaaaacgcgaggcccagtacaaaccctagcccaatacaaaccctagctgctaaggcgtcgcccagggaggctaaggcgtcgcccggacgcctactacgccaaggcggacgcctacctcgccaaggcggacgccatacacattttcacctgggcggcgccgacgcctagctccactcgccgcctggacgcctaggcgacgccttttgaacagtggtctatagttctctatttgtccactcaggaattaatgttgagtaaattgttgcattacaagttaatgttttgttgagtctatgaactcagggc

SEQ ID NO: 5015 - DNA, 903 bp, Zea mays
gcgcacggctcacgttgtccgcctcacgtaaaggtcggtgccttcgtctcctatctctcctcgcgcagttccacttcccatttcctccttcgtccgcatcagggacacactgcctccgcatgcggcaagatcctccctcattccccaaacatgagaggagcagaggaggagagatctggcgccgccactgatgcgggaggagaggaggagaaacgggagaggagcgtcggcctgatggccggcctcatggacaaggccaagggcttcgtggtggagaaggtgacgcaaatccccaagcccgaggctgcgctggatcacgtctccttccggagcatcagccgcgagggcgtcgagctgcatagccacgtcgacatcagcaacccctactcgcaccgcatccccatctgcgagatcacctacacgttcaagagcgccggcaaggtgatagcgtcgggcacgatgcccgaccccgggtggatcgcggcgagcggcagcaccaagctagacctgccggtgaaggtgccgtacgacttcatcgtgtcgctgatgaaggatctcggaggggactgggacatcgactacatgatggaggtggggctcactgtcgacctccccgccattggcgcctttactatcccgctcaccaccgagggcgagatcaagctccccaccttccgggacctattgttctaagcaattcagatatttggtgtatgaatcgatttgttttcacaccataatcagtgctgatgtggatttgcaaaaaaaaaaaaaaaaaaccggccgtcagggacggccaagttaaaactatctcacaccaatgtgaaatagaggagtttaagcctcccgtcacaaaaaaatctaacccgatgtagcaaaaaaaaaaaaaaaaaaggggcggcc

SEQ ID NO: 5016 - DNA, 1831 bp, Zea mays
ccccactcatgtatgtaaggtggttaaaaatctgagtgctgcaaccattattactatgctcggtgatggagccaatacccttttttggaaggacagatggttggatgggagatgtattaaggacatagctcatgcaatgtttgatatggtgcccttgcgtcttgccaacaaacggttggtcaaagatgctctccctaatttccattggatctccgatgtgaatggggcaatttcagtcagagtcattgctgaattcctggaactttgtgaagtgcttgatgcagttgtgcttcagcctggaataagggatcgacatatatggaaattcagtgcttcaggggattatacaactagttctgcttataaagctctcttccttggttcagttcaattcgaaccagcagagcgtgtgtggaaatcttgggctcctgggaagtgcaagttctttatctggcttgtggaacataataggtgctggactgctgacagcatggtttaaaaggcggctaggcggaactaggcgcccagccaccgcctgaccgcctaggcgacttaggcgggcgcctaggcgacgccttagtagatgttacaaacagctgtgagctgttacaaaataccaagcaaccaaacagctgttacagctcataaactagaaatcatcacaaattcacaatagcataataatggatatgaaatagccacaaagtagtttctaaaggaacaacaacaagtcacaaattttaaaacaacacaataccaaatgtccaaatctgaaatagccacatagatagtttgtaatggcataattaatagtaactagctgcagttagtaatgcagcaaatatgctaaattgctaatgcaatctagcaatagctactctccctgtctctcgtcgctcaaaaatcatcatcaaactctcctgggatattgggtgcctccccttcttcaccatcattgccaccattagattcatcttcacaatctgtgatttctgcatcgtcatgtggaacatcttcatcttcatcttcatcttcctcttcagcctctgacatgttttgtgcagcaacagaatttcttcttgaatacacattatgggcccttcttggtaagtttcggccacgaagtgcttgcgatgctccaatggcattatccacaaggtcccatgtaaggtcacactcacacccacgcccaccttcagggactacatgcaaagaatcagcccactcattgtcccagttgaagtcctcatgaaccaatggatcaaagtttttccccttcttctggcgtagtttttggaacctagctttcatctttctgttgtaggaaatgaagacaatagaattcaacctcttatgcaacaatcggtttcttttctttgtatggatctacaaaataagaaaagagaaaacacttggtcatttaatcctgaaatattggatacaaaagtagccaagtaggtggatgaggacttgaggaggcacacataataacttacaaattcaaaggtactccatatgcccctgccaaatgttgctttaacctctttatccctccactaacaacctgaccacatagggtgcattccaccttatctttattttgaagatctggccaaaatccatacttccaccctggatcagtagacttccgtggcttccgggtaggatcgctcttcgggtcgtactcaccagccacagaagatggagcctcatttcgagaagacattatgttgtcggcttgtcgctagtcgatgcagtcgctgcacagtctaaaaacagggggagcaggggatgagaaaacaggggaagcaggggaggaggggatgagaaa

SEQ ID NO: 5017 - DNA, 1486 bp, Zea mays
atgaatcagctaacaattcatccaaacaaaaaaatcaacaaccttatgtaagtatctgagcttctagatgcacggcacattaattgtctcgtcctactgctagcaccagaccgctgtcttcttgagcacattgaggtcttcggatttctccgggggtggccgcgcgcagcaccggcaatgtcgtcatgcaagcggtacttgccgtgcttgatattgttgttgctgcacggaggacgaggtgcggtggccgggaaggtgtcggcaatcgtcgtgttcggcgactcttccgtggacacggggaacaacaatttcatcccgaccatcgcgcggagcaacttctggccgtacggccgcgactacgacgatggcctccccacgggccggttctccaatgggcgcctcgccaccgacttcatctccgaggccttcggcctgccgccgtccatccccgcctacctggacaacaactgcaccatcgaccagctcgccacaggagtctccttcgcctccgctgcgacaggcctcgataacgcgacggccggcgtcttgtccgtgatcacgctggacgagcagctcgcttacttcaaggagtacacggaccgcctcaagatcgccaagggcgaggcggcggcggaggagatcatcagcgaagcgctctacatctggagcatcggcaccaatgacttcatcgagaactactacaacttgccggagcggcggatgcagtatactgtgggcgagtacgaggcctacctgctgggactcgccgaggccgccatacgccgcgtgcacaccctcggcggccgcaaaatggacttcaccgggctcacgcccatgggctgcctccccgccgagcggatcggcaaccgcgacaaccccggggagtgcaacgagcagtacaacgctgttgccaggaccttcaacgccaagctgcaggagctcgtcctcaagcttaacaaggaactgctgggactgcagctcgtcttcgccgacacgtaccagctcctcgccaacgtcgtaaacaggccggccgactacggatttgacaatgctgtgcaaggttgttgtgggacggggcttttcgaggcaggttacttttgtagcttcagcacatcaatgctatgcgaaaatgccaacaagtatgtattctttgatgcgatccatcccacggagaagatgtacaaattgctcgccaataccgtcatcaacaccaccttgcatgtattcatgtgaaattatttgatcttcctaatagaaatgcggcatggacaggtctatacggccatgcctgtgtacaatctataatgcacatagacacacctaccgctcctccacatacaactttgattgttgaaaccatatcatatacaattataaattatagcacgtgtactataaattttatcttatagatcaaaaaaaaaaaaaaaaacaaaagtttataaaaaaaaaaaaaaagggcggcagcttgcgatctagaactagt

SEQ ID NO: 5018 - DNA, 6900 bp, Zea mays
gcacggataatatgtactacacacctcgttagcatcatggctagcttctaggtttgttgtggagtgtgcatgttgatcctgtccaccaattcatcccgtcaatgtattgtttgccaatcattattgtgccacatttgaatactaaccttgaataagtgtgccattcaaagagttatcaccctaatacacatgctatgcgactagtagtgtatcgctcacttattgggccccccaaaaccttactaaatatgtagtaaaagactaaaagcaaatgtaaataagtagtaaccatacaataggagaagatgagaaaagtgcgcagacaggccctcaaaaccggcggctacagcagcgacactgacactgacaccagggagcggtgagcacacctggagatggtgacgggaatccgcccctgtatactgcctccctccactcggctatcacgcttcccagcctgcaaaccccgtgcccacagctcacctttttctcctctgcagcccacgcctcccgataaattcgcaacccagtcccccccgtcgctctcattcctctcggccacaacactgcgcgctccgcagacgcccaccaagcttccgctattcgccaaaaggtccccttctgccctccgccctatctatccatggaaaggcggcacggcttcttcgcggcgctgcgggaggaggtggcgcgcgggctgtcgccggcgcgggcgcgccgcaagccggacgccacggacctggccgccgcgctcagcttcaccggagtggcaggcgccggcgagatgctggcgccgctcatggaggggcccgatccggagcccagcgacgacggggacggcagcggccgccgaggtgccgcgcgcgggaggaaggaaggctggggccactgggtgcgcgtgcagttcgcgcgggccccgtcctcggcggtcgcgctgcgcagcgacatcaggatgctcctcggcgttatggctgcgccgctcgcgccggtccgcgtctgcgccgccgagccactcccgcacctcagcgtcaaggacactcccatcgtaagcgcttctctcgtctcgtcacgctgctgctgctgtgtttttcttcctttccccccctgcccacttgtttgctccacgttcctttgcaatcaactgttcgacgaaatgccggtgccaaggttttcatgggtgtatgtatccgagtttccttgaattcgtgggccctgtagactgtaaaaagttcgttactagtgttacagtgcggtaaaagagttcgttactagtgactacaatgtctgcatgtctggtcaccaggatctttgactgctctttaggactggtatatatgactgattgtttttttcaccgctgttgcctggtagtatgtgttaattcactgtttgctgttatatgccagatttttaataaatttatgattttttttttgggtgtgatgtgcttgtccacaggaaacctcgtccgcgcagtacatcctgcagcagtacctcgcggcttccggagggcacaagctcctggcctccctgcgcagcacctacgccatgggcaaggtacgcatggtggccaccgagttcgagaccgccggccgtctcactaagaaccgcagcgctggacgcggcggcgagcctggccgcttcgtgctgtggcagatggcccctgagatgtggtacatcgagctggctgtccgcgggagcaaggtgcacgcgggatgcaacggcaagctcgtgtggcggcacacaccatggctcggtgcccattctgccaagggccctgttcgtccgcttcgccgtgcccttcaggtatggctgttgctgtccatgtccctgttttgttggttttcagtgctaattcagccacagtcccatagaacatggttgttcagatttactcagctatatatatcctgagtgatgttcttttgcagggcctggatccgctgacggcggcaagcatgtttgctcgtgcgcggtgcatcggcgagaggaaggtgaacggggaggattgcttcatcctgaagctgagcacggatcctgagatcctcaaggcacgcagcgagggccatgcagagattatcaggcacgtcacgttcgggtacttcagccagaggactggtcttcttgtccacattgaggattcacatctgacccgaattcagtcggccgccggaggggacgcggtctactgggagaccaccatcagctcgtccatggaggactaccgcccagtggacggtatagtggtggcgcattctgggcgctcggccgtgaccctgttccggtttggtgaggttgccatgagccacaccaagacccggatggaggaggtgtggagcattgaagaggtagcattcaacgttcctgggctgtccatggactgtttcatcccgcccaccgacatcaagtctggatctgttggcgaggccatggagcttgctcatggcgagagaagccgggccggtcctcctccccctcccccaggctgccgcgctaaagttcccgcgctggggaaggcagaagaaggtaaagtggcatggggcggtggaaccgtactcgagaatcaaaactgatccgcagactgtccataaacttggttctcacagccgcgcggctgctgaccctgtttggagtctagtgtaggagagaaacaaacgagtgaaggctgagagaggatttggaagtttggtaaatccaaatgcctcctctgtataggaagaagcatgggggcattcacatggtcttgcatatgattgaagcggatctgtgtgaaacatcctctctctctctctctctctctctgatcccatccagagagacatggtatggtagtaggtaggtagccttgtttcctgcttcaggcttttctttcttctttgtctgttcctagtgaaaggaaacttagggcatgtttctgcactccagccgcatgagaagaaggtcgttgtggttggttctcttttagcttatatatcctaatcatgggcgctgccacctgcggggatgaagggtttcctcaccagcaaggcaggtgttttggccgtcatggctgggcatccgattggcggcgttcagtgtgtttggcttgctgacggattgagccgaagctaacctctcagtgaagagatagagatagagagagagagagagagagagagagagagagagagagagagagagtagaacatctgaatggtttttacttgtgttttagtactgggtagaacctgttagatgtttgttagtaattagcagtgtttttatttagcaagttgttttttttgttcctgaacctcctttgcatctctctatattttaatcatgagatgaaggatgtactgttattaaacagatggtggatgtaatctaatccaagacatcttttttgagcgtcatggattgaactgtgcttgtgctcgtgcttggtaaggtagaaccgaagaaatgcaatgattcgggctttttccagagcgtcgatgttctgcagacagagacagcagcatggcgccagcaccatcaatgtgtttctctccggccagctcgcgttttgctgttgtatgctctccaggcctgctcgtgtactactgtgatatgattagagatggcagttcggtcgattttagctagacacccgatttagccagctctgaacgacggttaaaccgaatgtggcagaacactcttacatgtcgaacgcaaggtgagcggcaggccagaattcagaacggaccatacgcacgtacggctggttccacggacgggaactcggatcaatgagctggatgtcctagataagtaccgcggctgaggtggtttgagacagagcaaaattaaaggctaacaggaagcaaaaaagctgcaaaggggttggtggtatgcattaagacgatatctactttattagcatcgcccctcaagcaagccctagtaatagtcgccactggccatgcgcccatgtccatcattgctcagcacggttctctcaacccggacctactacagttccagaactgttagggctagtatggcgactccaatttctccgaggattcttcttttcttaggggttagggctagtttaaaaacactgttttctcaattgatttcaattttatcaagagaaaataaactaatttttcttaggaaaatagaaatatattgaaaaaaatgaggttactaaactagtccttaaagaaaaataattttttttttggaaaaatgaaaatcccttgaaaaaatggattcacaaactagctcttagtagggagagaaaagcaattaaaagctgttataagactatctaatacagtttatccattcaaatacctatatttaaactctaacatgggtgcaaaagcagaagcagcagtgtccgtgatgtcctacagtactcgtgtgtcgccgaaatggacgcagctctagcccatgatggttaatcctgcaggtcacgtcgtacgtgtcagaccatgtcggagccaggccaattaataatcagcgtacttttccatttccagaagctggcttggcttggctttgctggccggtggttgcgtaagtgcgagcgaaactgatgaaaatcagaaaatgctctggagagacgaagcacattgacggacgctgcaggctggaacgtgtggaactgaaacccctatgctggcaggcggcagcacgcacgcacgtacaagtacatatacaaatacaacacaaaaaggttggagtccaagcgaagcagctctcgagaaggaagggaggattggaggaagcagcagaagccagccttggccatgtgtgagtgtgtctgtactctgtactatgcagctgcaactgcaagaggcaagagggaaacagtagacttgtttttacaggattcagatggaccgttggtttccagtcagggccgtacgtactgacagtgctgtcgtctgccgctccagacaggcaggcacttcgtcgcacgcacagccgaggaagcgtgacgcccacagttgcagttgcagccgcagatgcggcaggcagcacaacgtagaagtgagtaatgaaagagacggccggactgagttgcgacatgtatgtaatcaagaacttgaaggagcgtcagactattacaacaagggattcatttagacctactgttttgtgtaataatgaagaccacgagttgactgcccccattctctctctctctctctttcaggggtcactcgccttacatccttttaataactatagtgcaaactgataagggttgtaatggggtcacagtgagagaaaaaaacatgtctagacagttgtgaagtaagtggtaaagaagccgtcatcacatttttataaaaaaaaaactgcaataatagctctcgctcttactattaaagcacatcagacatgaacatggcggtgttggtaaaaaatagtatgtcacaactcacaatgtgtaaagattatacagacattatttagctcgaagagagccgacaaagatgacctggccgaacttctaaagttcatagcctgatacctcatgttccttcactcatcttatcgtcaccagattattgcagcaaactgttataaaaatgtatgtacaaaaaggcctatattaagtggatttatatctgcgaaactcgctatcaacttttctattgttaggctgtttccagcggcttactcattatatctctaatttcatcttttattttaaactttactacatgaacagtgcagtgttttgtatgactatatacacgatctgctagatacagctaatcacaagccacatacataaacgtcaaagagaaaatccagtgagacctggaaattccaaactccaatattaataccatattagcagctattgtacttttctataaccaagacatgtcaacactggacataagaaaatgaaattgagactatcctccataaaaaatgcaaatgcactcttaagctatatatgtgaagtgaatctgaatatgagttagttatatgtctgaaaaataataataaatcaagatccattcaaaaccgtactatttggggagtaaatataacaagatttataagggtttagacttctgacgaggcacccaggtttaaacataactctgcaaaggtgagaaatatgaatgtatagagaacaaatggtgcatcctcattccttgaagaataggagaaacagcaagctgccagtccgcatcaacctccctcctttaagcacatccgttgtgtgaacatgaagctgcaaacactgatacagtatcttttgttgcctccactgccagacccactgccaacagtagctttgtttctatgttccaggatgctatgtaaggccatgaagaaatcattagtagcagaatgcatatgggaaatcaggaagtgagacaccctaatattgaactgggctaccaaagcagttctcaggatcattttgtggaacaatgtagcacagtagttttttttcagtgagataagggctcagttaaatggtgctgaaaaggcacctgggtgctcaattttaagaaaagttacagcagactgaaaacaaatccatcttcattacctatgtgcagtctgtcaaacttttttgttcacgaacaaaaaataaagaacggttcctctagaaaagacatattcatggacttatggttagacagttcgagaaaatttccatgatatataaaatgcacacaaaatgttcctattattttatttgaaaatcacagatgttactccccggacgcgcgcgcatgtaacaatataaacagatgggcatgtacctaagttggggcatacagaacaagattagtagtggaaaatatgacaggaattccaaatatcttcatataataaatcagtgcacggaccagtaaaattaacacttgcagaaaattacgagctaat

SEQ ID NO: 5019 - DNA, 1550 bp, Zea mays
acagatcccggaataccttcctctcatgttaacaagatgtttctctttgatagttgatttaccataaactgaatggcttggtcgccaggggcgatcttcggagtcttcgccaccgctgtccacatcataactttcactgtcaccagtatcttcagacagtccctccagaatttccttggtaatcttttctgtgttggacttcgacatggctataagaaaccctaggttcttctcttcatcaagactcagcttcatctcagcagcagccttcttagcagcttcagacatcttcggaagcgctaaaaaactgtttttaaaaagccgaagcttcaaagctaaaaaacttagcagtgcacaagagctaaaaaatgaatgagcaggagtggttggccggaaagcgtgcgaaataagtttgcggcatggccgtatttatacgcttgatgcgttgaaagttgaaagaccccacttgtcattgaatgttgctattctagcaaagggaaggtgttttttcggaccttcggctcaaggccttcgtccatatcgcaatctgaatttattatttacaaattaatattgcgaggggctactgttgggggccttcgtcctccgaaggtcctcaaaaacatgatttgacaatgttttccgagtggattatgtgaacaggtattttcggatccagaattatgaatatggagcacggccaggacgaagcctgaaccagacgaaggtcgagtgtagccgaagctgtgcgcagggaagcttcggcgcgatggcagaagggggaaccgacttaaagatgaaaagacttcgggggcctcgacagatttccataaaccgttaacaaatgtaatggacatggatgtaattttacgtgggctgcgtcccgcgtctataaatagatgaacagtactcccgtactggtcacacgctgacttggcatttgcttttggcatcacgcttgtactttacaccttctctcaggaccgaaggtacatttgcaatttggaatcatttctgtttttccatgttaataaaatagaaatgattctatggtgatgtttatatcatatttcatgctttatatgagtccttcgtcattacttgttatgtttacgaaggtatgtctctcatgaccttcgtccgagactcattatttcccgaaggaacataatgcttcgaaggacgaaggattttaacacttaacactttatgttgccttgttcttaactcttagcacttgagaacaagtccccaacaatcatgttccagcaggtctgatgacagtgaagaaggagttcctggcactcaagcaagggtctatgttcgttagtgagtacggagacaggtttctgtagctgtcccgctatgcacctgaagatgtcaatacagacgccaagaggcagtatcgtttcttgagaggcttggttgatcctctgcattatcagctgatgaatcataccttccccacattttggcacctgattgacagagcaatcatgacagagaggaagcgcaaagagatggaggatcgcaagcgcaagatcaatggg

SEQ ID NO: 5020 - DNA, 1668 bp, Zea mays
ttttttttttttttttgcaagcgtagggaaaaatgtagattcttatcatgatgacgtagctcgaacagccggacgacacaaaccaattattcatgaatccaagctaaacctgattgattccatgcaaaccaacagactcccgatagcaacccgatctggaacacacggcactggaacatgctgaagagtgaagacaccaccttcgtgatccgcattccaacagctagaccacatcttgcttgcaattgatcataaattgaagtttgtgaaaaaggcaacataaccgtccacacccttaacacatgatacttgcttatcttgatgttccagtcaagttcttgttctctccggattggaggaatggcaaggcaacgacctcacgctcccagtatgcccaaacaagagaccaatgcatttcctgtttcctaaactccatactatgactgttcgatcacccaatgcagcaagtaattgagatcccttctacattagtaacacataagttgaaactctgtcagaaaggaacacttgctgagatttttaacatgtggatccgctctttcgttggactgttacaatcagtgcataaagtcctgaattccttgattcccttcttgagtagaaccaagcgaatactccatgcttgcctaacaaacaggtagacaacaaattcgaaagaggtagctgaaaaaattagcagggcacttaagcacttactcgcatcatcctctagaacgaatcgtacccaattaatcccagaccctaagacttagaatagagcacatgtaaacatccctttgcttctccacgacaaacctcaagccagataatgacatcgagggcatggcccgaaacgagattattgaacctgggaatcccaccgctaatctgcgatggtctaaccaagcgattgattagcttccagcagcagcccagagcgtggaacaacatggttggtggcccatcagttggtatcccctgtggacgtcggggcggctgaatagatggcaggggcttggatccctgcatcagtggtatttggggggagcggggcggcagtcgtggatccgaggacaagcacggtgagcggaggacaggaaggcggtgtctccagagcgagcgtggtggagtcctcgttcctcggagttgaggtgggcaaccagacccgcggcggcagagtctggtgaggaggaggggagcgcgctggccccggaggacaggcacggagggcggggcgtgcatgacgcgtgggtagtccgccatggtcgtcgatggaagggcgcggtgggggaggatttcggcgcggcgcagcagcgacgaagatgcgaggaggatgcgcggcgcttcggtagcgacctcgtcgttggaagggcgcggttagggtgacgaccggtgaagatgcagggaggatgcgcggcttcgctagcgccccgtcattggaagggtgcggttagggcgacgaagaccaaggcgtgtgcggcgtggtggcggtcgatgaggttttcggcgcgacgcggtagaggatttcagggcgggcgagtctggggcgctgatggcggctacagaggcgcccggccgcggccgcgatggaggtttttggtgcgggcgaggtttttggcgcgacgcggtggaggaggaattgggggcaggcgagccgggggcgctgat

SEQ ID NO: 5021 - DNA, 1217 bp, Zea mays
atgataaaaatagatattttccgagtattctgatatattttttattgaaatttaagtatatttagtctattaaaagattaaaacccaccaaatttattaatctgcaccggcttctgcttacacatcggcgcgaaaactcttagtcaaaatctgttgatttctcggcggatttctgttgggggccttcgtcctccgaaggtcctcaaaaacatgatttgacaatgttttccaagtgaattatatgaacaggtattttcggattcagaattatggatatgaagcacgatcaggacgaaggctgagccagacgaaggtcgagggcagccgaagctgtacgcagggaagcttcggcgcgatggcacaagggggaaccgacttaaagatgaaaagacttcgggggcctcaatagatttccataaaccgttaacaaatgtaatggacatggatgtaattttacgtgggctgcgtcccgcgtctataaatagatgaacagtactcccgtactgttcacgcggacttgtcattttgcttttggagtcacgcttgtactctccaccttctctcaggaccgaaggtacatttgtaatttgggatcatttctgtttttccatgttaataaaatagaaatgattctttggtgatgcttatatcatatttcatgctttatgcgagtccttcgtcattacttgccatgtttacgaaggtatgtccctcatgaccttcgtccgagactcattatttcccgaggggatataatgcttcgaaggacaaaggaccctaacatttaacactttttatgttgccttgttcttaactcttagaatttgagaacaagtctccaacattggcgcccacctccggtgaactcacttccacttcaagtcttcgtgaacaccttcggaagctatagaccttcgctatggcgccgaagaaagcttcagcggctggggctgcagcattacaaccgctggaccacaaccaggagaccgtctctcttcgggaggccagaagccagaagagaaaagctgttagcccgacgcttgaggaacaagagctggaccaagaaatcagagagatggagatgctacatcaacaagtgcagaggaagaaggagaagatggcccgcctagctgagttgcaaaggcaaattgacgaagcttctgaggaagttcgccatctcactcacgatgaacagaacagaaggcctcagcagaaag

SEQ ID NO: 5022 - DNA, 2220 bp, Zea mays
  misc_feature (19)..(30): n is a, c, g, or t
  misc_feature (2213)..(2214): n is a, c, g, or t
ggccggccgggaaaaaaannnnnnnnnnnnaagaccgagagagaaaggaaaaaaaaaaacgcggcgcagaagccagaagaaccagcgagccaactcccaacctctcgcccgatctcgatctcgatctcacgggcgccgccgccgccagcgacgatggatccagagatgctgcggctggcgcaggagcagatgcgccgcatgtccccggacgacatcgcccggatgcagcagcagctgatgtctaaccctaacctaatgaggatggcgtctgagagtatgaagaacatgaagcctgaggacttaaggcgagctgcagagcaactgaatcaaacaagaccggaggatatgcgtgatatgaccgagaaaatcgccaacactactccggaggagtttgctgctatgaaggcgcaagcagatgctcaaatgtcctatgcgatgtctggtgctaagatgttaaagaagcagggaaacggacttcataaccagggaaagtattcagatgctgctagtaaatataagcttgctaaggataacttaaaaagcataccatcgtctacggcgcatactctgcagttgcaatgtacacttaatttaatggcttgttacttgaagacaggccagtttgatgaatgcataagtgaaggtacagaggttctaagttatgattcaaacaatgtcaaagcatattatcggaggggtcaggcatataaaggactcgggaagttggaggcggctgttgctgatttgagtaaagcccatgaaatttgcccagaggacgaaactattgctgaggttctaagagatgctgaagaaaaacttgcacgggaagggggaggagtgagcacgcggaaaggtgttgttattgaagaagttgttggagatggcgcttcacagccatcaagcgagtgaaagaaattcttctgggtatactgtttcacaacctacctgaaggagcaggaaatattgggctgtcagggtctttagaaaggccaagggatgatcctacttctatcaggtcatcccaaaattatgtgtccaagagcgatcctgagggcgggtcaaacttcggaattgaaggaatgtcgcctgaacttgtcaaaactgccactgatatgattggctcaatgaaaccagaggagcttcagaaaatgttcgaagttgcttcttcattgaatagcactagctccgctggtccaaatctgggacccaatatgccagaaatgtctcctgatatgcttaagatggcatctgacatgattgctagtatgcctcctgatgacgtacagaaaatgatgagttttgcttctcagatgggtgggcctggtggtgcccccaggagttcagagaatattaactttggaccttcagtgagagctacaacgagtaattctgcccgtggatcatcatctcaacctgttttggagaaccctgatgaactatcagatgaccaaaggatgagccagtcatcctctagtcttccaccttctacagctgatatgcaagaaaccatgaggaattctatgaaagaccctgcaatgcggcagatgcttacatccatgatgaagaacatgagccccgagatgatggcaaatatgagcgagcagtttggaatgaaactgtcaaaggaggatgccgcaaaagctcaacaagccatgtcgtcattatctccagaggatttggatagaatgatgagatggatggagcgagcacagaaaggggtagaagtcgcgaagaagacaaagaactggctcttgggccggcaaggcttgatccttgctattgtcatgctgatcctagctttcatccttcatcagtttgggtttatcggcagatgatgggggtgacttgggtggctgcatcagcatggaaatagattattcgatggcgatgcagagttccctcttgctaacaactgcttaaaagcgctttgggggaaggccggattacgagaattctttgtatccgtatcttatgaaagtgtaactctgtccataaagctatttcatcctatttttaccagcaaaggtagtagaaaggaatcgagccgaaactgttgtgataacaagacgacatgtaatatgataatatccttgtggtgctttcagttttaagtagcagttttgtttaataaagcatatgcaaaggtgaagtggaacaaagtacatgcgcacacagaaactaactggaagatagcatcttcaattcttaaaaannaaaaat

SEQ ID NO: 5023 - DNA, 1673 bp, Zea mays
gggtacctcgaggccggccgccgccccagctacgacgcctggccgtacctgtatttctcatcccgcggtacaggccccagccaagacgcttgtaccgtccccaagcagtcggtcccagactgcaagtgccaaatgctttctcgtctcctcccgcgcctccatcaccgccgcctcctccaaaccctgtccagggccgccgtcgccgccccagatgttgacctccaccagaggctgtgctcttcgtctgcagcgtcgagcccgagcctgtcgatatggcggcggaagaaggagatgggcaaggagggcctcatggcggtggcgcagctcaagcggctcgcggctctgcccccggcggggggtcacccgcgcctggagcagttcatgcgttcgcacgtgtcgcggctcctccgcaccgacctcctcgccgtcctcgccgagctcctccgccaggaccatgtcagcctctcaatgaagatatatggtgttgtgcggaaagaaatctggtaccgccctgacatgtacttctaccgtgacatgctatacatgctagcgaggaacaagaaaattaatgaaacaaggcaggtatgggcggatctcaagtctgaagacgtgctatttgatcagcacacttatggcgacattgtgagggccttctgtgatgctgatttgattgaccttgcaatggaaatctatgatgacatgaggagctcccccgaccctcctctatcattgccgttccgtgttatcctgaaagggttggttccataccctgaactgagggagaagataaagcaggattttctggagcttttcccagatatgattgtgtatgatccaccagataccttatctgatatagatgaagaattcaagttttgatgaatgtacgccttcatccggattcagtgcttctgagttacattccctgcactgcaggcaaacctccatttctcgttcttttggtgggctagatcaattgtaaatgtagctgtctcgatctgcccagtagctgtggtaccaccaattttaacctcttgatgaaccatttttgttaatctatgctttggagaattgtctgcttccgtctgtgtctcgtcctactttgaatcaccctgttctgaagtttggtactgctgctgtgcactgagatttgtgttccgttgatccctgctatataatcatttgtacacttcaaagagaatcgtaccttttcagcctggccatttgtaggtcttatgtagcctttaaggtcacataaaactgatccagggaaattgatccctcgatattaaatcatttctgcacttgaacgagaatttcccgtcgacaattatatattttccagtcttttacaggttttattcaatcttgaaggttgtatatatggtcaatgtaattgtatacaaatgtttcttcaagctttggtgtacaatatttgaaatggtgttggcttcagcgtccaactcaatgtcataaattgcacttgtaataatttgttaaatcaaaaaaaaatattcttgaggtaggatttttcaagtaccaaaagggatgtaagaaattttgaaacatacgctatgacctgtcgctagcagcatgtcacgaattgttgacacccaccatgtttatcctgatacatgaattaggatagaattcccaaactctcaggaactgca

SEQ ID NO: 5024 - DNA, 1779 bp, Zea mays
  misc_feature (1759)..(1773): n is a, c, g, or t
acccggtaaaacaactgcggcaaaactcaccaagcccccaaactgttaacaggtgataaagcttttctctctcttggccggccagtgacatcagacatcaccaactcgtcgacggtagagagagcaagctcttcggcgatttgagaagaatcgaggagcgagcgagcgagcgagcgagagaggaggaggaggagctggggcttgagcctgcgcccgggggccccgggtcacggaatcctaccattaccaaccctagccttcgttgatcgccgtctcaggtcatggcagggccggcgccggatcgggccgccctgactgtggggccgggcatggacatgccaatcatgcacgacagcgaccggtacgagctcgtgcgcgatatcggctccggcaacttcggcgttgcccgcctcatgcgcgaccgccgcaccagcgaactcgtcgccgtcaagtacatcgagcgcggcgagaagatagatgagaatgtccagcgtgagataattaaccatagatcattgaagcaccctaacattattaggtttaaagaggttattttaacaccgacccatcttgctattgtcatggaatatgcctctggcggtgagctttttgagaggatatgtaagaacgtgcgattcagtgaagatgaggctcgctacttcttccagcagcttatttcaggagtaagctactgccattcaatgcaagtatgccaccgtgatttgaagttggagaacacacttctagatgggagtgacgctcctcgcttgaagatttgcgatttcggttattccaagtcatctgttcttcattcccagccgaagtccactgttggaacacctgcttatattgcacctgaagttttgttgaaaaaagaatatgatggcaagattgctgacgtttggtcatgtggtgtaaccctctatgtaatggttgttggcgcatatccttttgaagatccagaagagcctaagaacttccgcaagacaattcagcgtatcttgaatgttcagtacgcaattccagacaacgtgaacatatctccagagtgcaggcatctaatttcgaggatttttgttggcgatcctgctacgcgaataacaatccctgaaatccggaatcatagttggttcctgaagaaccttcctgctgatctgatggatgatgatagcatgagcaaccaatatgaggagcctgaccagccaatgcagaccatggatcagatcatgcagattttaacagaggccaccataccacctgcctgttctcgcagtataaatgtcctagctgatggactggacatggacgacgacatggatgatcttgattccgactcagatcttgatgttgacagcagcggtgagattgtgtacgcaatgtgagtaacatctcagcagccatctcagcagtcaaccaaggaaccaatcaggcatgggatgccctgttgtatactctggcaaagggcatgcttccttttgtgaaaaacatccatgtagttttctcaaggaatcgcaatgtgttctgtggaacacatatgttgtagtcaaactcgggttactcagcttgtaaaactagcctcctcttgcttcctggttactgggctttggatactctcaggcttcgacttgtgtgttgctgttaaatatgtataagaaacttctactcaggttgatctgtgaatctggattcgggtagtggttttgctcaaaaaaaaaaaaaaaaaaaaaaggcccaaactcgagggggggcccggtacccnnnnnnnnnnnnnnnaaaaaa

SEQ ID NO: 5025 - DNA, 1656 bp, Zea mays
  misc_feature (9)..(9): n is a, c, g, or t
ggaaaaacngggccacggacagtattcaggagaactcacgtttctcttggtcagccagtgacatcaccaacttgttgacggtagggagagcaagttcttcggcgatttgagaagaaacgaggagcgagagagcgtgggtgcgtggggggtgggggctgcgcccggggcccccggatcacggaatcctacccttaccaaccctagcctccattggtcgccgtctcgggccatggcagggccggcgccggatcgggccgccctgactgtgggtccgggcatggacatgccgatcatgcacgacagcgaccggtacgagctcgtgcgcgacatcggctccggcaacttcggcgttgcccgcctcatgcgcgaccgccgcaccaccgaactcgtcgccgtcaagtacatcgagcgtggcgagaagatagatgagaatgtccagcgcgaaataattaaccatagatcattgaaacaccctaacattattaggtttaaagaggttattttaacaccgacccatcttgctattgtcatggaatatgcctctggcggtgagctttttgagagaatatgtaagaacgtgcgattcagtgaagatgaggctcgctacttcttccaacaactcatttcaggagtaagctactgccattcaatgcaagtatgccaccgtgatttgaagctggagaacacacttctagatgggagtgatgctcctcgcttgaagatatgtgacttcggttattccaagtcatctgttcttcattcccaaccgaagtcaactgttggaacacctgcttatattgcacctgaagttctgttgaaaaaagaatatgatggcaagattgctgatgtttggtcatgtggtgtaaccctctatgtaatggctgttggtgcatatccttttgaagacccagaagagcctaagaacttccgcaagacaattcagcgcatcttgaacgttcagtacgccattccagactacgtgaacatatctccagagtgcaggcatctaatttcgaggatttttgttggtgatcctgctatgcgaataacaatcactgaaatccggaatcatagttggttcctgaagaaccttcctgctgatcttatggatgatgatagcatgagcaaccaatatgaggagcctgatcagccaatgcagaccatggatcagatcatgcagattttaacagaggccaccataccacctgcctgttctcgcagtataaatgttctagctgatggactggacatggacgacgacatggatgatcttgactccgattcggatcttgatgttgacagcagcggtgagattgtatacgcaatgtgagtaacatctcagtaaccatctcagtatctcaccagtcaaccaaagaaccaatcaggcatgggacaccctgatgttgtacactctgccaaagacctagcatccttttgtaaaatatctccctgtagttttctcaaagaagcgcaagcccaacctgttctggggaacacggatgctgtagtcaaactggggttattcagattgtaaaactggcctcttgcttcctgcttactctcaggcttcgacttgtgtgttgctgttgaatatgtacttacaagaaacttctacggagtactcatgttgatctgttcgaagcaaaaatcggacac

SEQ ID NO: 5026 - DNA, 1562 bp, Zea mays
gcacgaggctgcttttcaaatctacggcgtgccctttgctctccaaaagttgatgttccatcatgttttattgggctggtattggagaattgccaacttccacatccaaaccatggccatgttatcttggccaatccttcgccaatactattttacccaattagcagcacagaggtgcgctgtttggttgatgtcccaggtcagaaggtgccttccatagctagcggtgaaatggcaaattatctcaaaaccgtcgttgcaccccagattcctccagaaatctatgactctttcatagcggccattgataagggaagcataagaacaatgccaaacaggagcatgccagcggctccacttcctacccctggcgcacttctgatgggggatgccttcaatatgagacaccctttaactggtggaggaatgactgttgcattatccgacatcgttgtcctacgtaatcttctcaagcctctccgcaatctccacgacgcatcttccctgtgcaagtacctcgaatcgttctatacgctgcggaagccggttgcctccaccataaacacgttggccggtgctctgtacaaggtcttcagcgcctcgcctgatcaagctaggaacgagatgcgccaggcctgttttgattacttgagcctcggaggcgtcttctcgaatgggcctattgccttactctcgggtcttaatcctcggccactgagtttagttgcacacttcttcgctgtcgctatctacggtgttggtcgcttgatgctccctcttccttcgcctaaacggatgtggattggagccaggctgatttctggtgcatgcggcatcatcctcccgatcatcaaagctgaaggcgtgagacagatgttcttccctgccactgtgcccgcatattaccgggctgcgcctacgggagaataagtaaagcgagaaccgattccgggctgctgcagtgctgctgatcccaccatgatctgatggcaactgatgtgtcatggatggcatttttttcctgtgttagtggttgttaggtggtttgttgtgctgctgtcattggaatgaggaacctgtatagtgtgcccctgggtactggtcaaagttgggaaatatgttgggtcctaccgtagccatgtcgattactgccaagctgtatatgattctgtcgaactagtgaaacctctccccatctttaacgcgtatcaatcttgtttgctccaaaaaaaaaaaaaagcacgttgcagtttttttgcgtaatcgtacatacgtacgggcgtatgaccggtgaggcggagagctatttcctgcttgcaagcggggggactcacgattggtaaggctggtaccaagcggcggatttgattcggattcggcgtgcatatattcggaaaatctgacgagcatgcaaaaagcagcccaaatccccagatagataatgcatcgcattattcttcctccgcgagctggctgctgcaccccgcccgttctgcgtccggtggttattttcgtggggacaggacggcgccgtgagcaattcaatccgaaaaacacacaca

SEQ ID NO: 5027 - DNA, 2051 bp, Zea mays
gtaccctcgggttcggccgggttgggtgcccccgggcccgccgggagacgcatcaaaccgccctcctctgtccctccctctcccgtctgccccctcgcatccccaaattaagccccgcgcgcaaggcagcaaacgcgccgcgcaccggaaggccccggggagctgcacgaggtggccccattgcggcatggctgctacggccgccgccgctggcgtcgagttcccgctcattggcgttgccgtggccacgctcatcgtgacggtccttgtcgcggccgtgatgcgccgccgccgccgtccctggcaccaggcgcctctggtggaggggaaacccgcaccagaggcaggctgcgcggtcagcgatggcgggacggacgtcatcatcgtcggcgccggggtagctggatctgcgctggcatacacgctcggaaaggatggccgtcgggtgcatgtcatcgagagggatctgacagaacctgacagaattgtgggcgagctgttgcaacctgggggttacttgaaattaattgagctgggcctccaagattgtgtggaagaaattgatgcccaacgcgtgcttggttacgcattattcaaagatggaaggaacacaaagcttgcttatcccctggagaagttccattctgatgttgctggtaggagctttcacaatgggaggtttatacagaggatgcgtcaaaaagctgcgtctttgcccaatgtccaattagagcaaggaactgttacctcacttcttgaagaaaatggtactgttaaaggtgttcaatacaaaaccaagtcaggtgaagaactaaaggcttatgcgcccttgacgattgtatgtgatggctgcttttcgaatctacgacgcgccctttgctctccaaaggttgatgtcccatcatgttttgttgggctggtattggagaactgccaacttccacatccaaaccatggccatgttatcttggccaatccttctccaatcttattttacccaattagcagcacagaggtgcgctgtttggttgatgtccctggtcagaaggtgccttccatagctaccggtgaaatggcaaactatctcaaaactgttgttgcaccccagattcctccagaaatctatgactctttcatagcagccattgataagggaagcatacggacaatgccaaacaggagcatgccagcggctccacatccgacccctggtgcacttctgatgggggatgcgttcaatatgagacaccctttaactggtggaggaatgactgttgcattatctgacatcgttgtcctgcgtaatctgctcaagcctctccgcaatcttcatgacgcatcttccctgtgcaagtaccttgaatcgttctatacactgcggaagccggttgcttccacaataaacacattggccggtgctctgtacaaggtcttcagtgcctcgcctgatcaagctaggaatgagatgcgccaggcttgttttgattacttgagcctcggaggcgtcttctcgaacgggcctatcgctttactctctggccttaaccctcggccactgagtttagttgcgcacttctttgctgttgctatctacggtgtcggccgcttgatgctccctcttccttcacctaaacgaatgtggattggagctagactgatttctggtgcatgcggcatcatcctccctatcatcaaagctgaaggcgtgagacagatgttcttccctgctacagtacccgcatattaccgggccgcacctacgggagaaaaggcatgaacagagaaccgattccgtgctgctggtccgaccatgaatgatctcatggcaactgatgtttcacggatgacatttttcctttgctagtggttagttattggttattgttagaccgtcgatggaatgaggaacctgtatagtgtttgtcctgggtactggtaaagttggaaaatgtgttgggtttgttctaaaaaaaaaaaaaaagctcccacgttgtgcacgtagccacgtatgattctgttagctagtgaaaaaaaaaaaaaaaaaagcggcc

SEQ ID NO: 5028 - DNA, 2473 bp, Zea mays
ccccgcggccccccccgggctcgtcccatcgttcctctctctctgccccgcctacgcctcgccccagacgcatcaaaccgctctcctctccctccctgcccccctcgcaaccctgaagaagcccccacacgcaaggccgcaaacgcgccgcgcaccgcaaggtcccagggagcgacacgaggcggcctcattgcagcatggctgctatggccgccgctggcggcgtcgggctccacctcattggcgctgccacggccacgctcatcgtggcggtccttgttgcggccgtgctggggcgccgccgccgggcccgggcccgggcccaggcgcctccggtggaagggaaacccgcgccggaggcaggctgcgcggtcggtgacggcgcgggtcccgacgtcgggacggacgtcatcatcgtcggcgccggagtggctggatctgcgctggcgtacacgctcggaaaggatggccgccgggtgcatgtcatcgagagggatctgacagaacctgacagaattgtgggcgagctgttgcaacctggaggttacttgaaattaattgagttaggcctccaagattgtgtggaagaaattgatgcccaacgggtgcttggttacgcattattcaaagatggaagaaacacaaagcttgcttatcccttagagaagttccattctgatgttgctggtaggagctttcacaatgggaggtttatacagaggatgcgtcagaaagctgcgtctttgcccaatgttcaattagaacaaggaactgttacatcacttcttgaagaaaatggtactgttaaaggtgttcaatacaaaaccaagtcaggtgaagaactaaaagcttatgcgcccttgacgattgtatgtgatggctgcttttcaaatctacggcgtgccctttgctctccaaaagttgatgttccatcatgttttgttgggctggtattggagaattgccaacttccacatccaaaccatggccatgttatcttggccaatccttcgccaatactattttacccaattagcagcacagaggtgcgctgtttggttgatgtccctggtcagaaggtgccttccatagctagcggtgaaatggcaaattatctcaaaaccgtcgttgcaccccagattcctccagaaatctatgactctttcatagcggccattgataagggaagcataagaacaatgccaaacaggagcatgccagcggctccacttcctacccctggcgcacttctgatgggggatgccttcaatatgagacaccctttaactggtggaggaatgactgttgcattatccgacatcgttgtcctacgtaatcttctcaagcctctccgcaatctccacgacgcatcttccctgtgcaagtacctcgaatcgttctatacgctgcggaagccggttgcctccaccataaacacgttggccggtgctctgtacaaggtcttcagcgcctcgcctgatcaagctaggaacgagatgcgccaggcctgttttgattacttgagcctcggaggcgtcttctcgaatgggcctattgccttactctcgggtcttaatcctcggccactgagtttagttgcacacttcttcgctgtcgctatctacggtgtcggtcgcttgatgctccctcttccttcacctaaacggatgtggattggagccaggctgatttctggtgcatgcggcatcatcctcccgatcatcaaagctgaaggcgtgagacagatgttcttccctgccactgtgcccgcatattaccgggctgcgcctacgggagaataagtagagcgcgcgagaaccgattcctggctgctgctgatcccaccatgatctgatggcaaactgatgtgtcatggatggcatttttttttcctgtgttagtggttgttaggtggttggttgtgctgctgtcattggaatgaggaacctgtatagtgtgcccctgggacctgggtactggtcgaagttggaaaatatgttgggtcctacccatgtcgattactgccaagtgccaagttgtatatgattctgttgaactagtgaaaccttcccaatctttaacgcgcatcaatcttggttgccccctccctgcccccgagtacagcacgctgcattttgttgcgtaatcgtacagacgtacgtatgatcggcgagctctttcctgcttgcgagcggcggactcacgattggtaaggctggtaccaagcggcggatttgattcggattcggcgtgcatatattcggaaaatctgacgagcaggcaaaaagcagcccaaatccccagatagataatgcatcgcattattcttcctccgcgagctgctggctgctgcacgccgcccgttctgcgtccgctggttattctcgtggtgacaggacggtgcggtgagcagttcaatcggagaaacacacacatccagttcaatcgatggagcaataagcgagagcctgca

SEQ ID NO: 5029 - DNA, 2125 bp, Zea mays
  misc_feature (2107)..(2107): n is a, c, g, or t
ctcgaggccggccggggtcccatcgttccgcacgagaccattacctagaacatcctaatcgaaaaatcaaaccgctctcctctccttccctgcccccccctcgcaaccccgaagaagcccccacacgcaaggccgcaaacgcgccgcgcaccgcaaggtcccagggagcgacacgaggcggcctcattgcagcatggctgctatggccgccgccgccgccgccgccgctggcggcgtcgggctccatctcattggcgctgccacggccacgctcatcgcggcggtccttgttgcggccgtgctggggcgccgccgccgggcccgggcccgggcccaggcgcctccggtggaagggaaacccgcgccggaggcaggctgcgcggtcggtgacggcgcgggtcccgacggcgggacggacgtcatcatcgtcggcgccggagtggctggatctgcgctggcgttacacgctcggaaaggatggccgccgggtgcatgtcatcgagagggatctgacagaacctgacagaattgtgggcgagctgttgcaacctggaggttacttgaaattaattgagttaggcctccaagattgtgtggaagaaattgatgcccaacgggtgcttggttacgcattattcaaagatggaagaaacacaaagcttgcttatcccttagagaagttccattctgatgttgctggtaggagctttcacaatgggaggtttatacagaggatgcgtcagaaagctgcgtctttgcccaatgttcaattagaacaaggaactgttacatcacttcttgaagaaaatggtactgttaaaggtgttcaatacaaaaccaagtcaggtgaagaactaaaagcttatgcgcccttgacgattgtatgtgatggctgcttttcaaatctacggcgtgccctttgctctccaaaagttgatgttccatcatgttttgttgggctggtattggagaattgccaacttccacatccaaaccatggccatgttatcttggccaatccttcgccaatactattttacccaattagcagcacagaggtgcgctgtttggttgatgtccctggtcagaaggtgccttccatagctagcggtgaaatggcaaattatctcaaaaccgtcgttgcaccccagattcctccagaaatctatgactctttcatagcggccattgataagggaagcataagaacaatgccaaacaggagcatgccagcggctccacttcctacccctggcgcacttctgatgggggatgctttcaatatgagacaccctttaactggtggaggaatgaccgttgcattatccgacatcgttgtcctacgcaatcttctcaagcctctccgcaatctccacgacgcatcttccctgtgcaagtacctcgaatcgttctatacgctgcggaagccggttgcctccaccataaacacgttggccggtgctctgtacaaggtcttcagcgcctcgcctgatcaagctaggaacgagatgcgccaggcctgttttgattacttgagcctcggaggcgtcttctcgaatgggcctattgccttactctcgggtcttaatcctcggccactgagtttagttgcacacttcttcgctgtcgctatctacggtgtcggtcgcttgatgctccctcttccttcgcctaaacggatgtggattggagccaggctgatttctggtgcatgcggcatcatcctcccgatcatcaaagctgaaggcgtgagacagatgttcttccctgccactgtacccgcatattaccgggctgcgcctacgggagaataagtaaagcgcgcgagaaccgattccggggctgctgctcatcccaccatgatctgatggcaactgatgtgtcatggatggcaatttttttccctgtgttagtggttgttaggtggttggttgtgcttctgtcattggaatgaggaacctgtatagtgtgcccctggatagtggtcaaagttgggtcctacccatgtcgattactgccaagttgtatatgattctgttgaactagtgaaacctccccatctttaacgcgtatcaatcttggttgctcccctgccccccgagcacanacaaaaaaaaaaaaaaaa

SEQ ID NO: 5030 - DNA, 820 bp, Zea mays
gtgcggcgctcaggcggcgggtgcgaaccagagtaccagagagcgaaagagttttccatcccttcacatttcccattccctccctcgtcatcccgcattcgtctatggcggctgcactgggcgccgtgctccggcggctgcatacggcggcggcgcagccccctcgcctgacgaaattcgcgctgcacccgcccaaattcgttgaaatcgaattcgctgatggtagctcatttcacctgtcagcagaatttctcagagtatacagcccagcagttgatagcaaaatccgatcagtgggcggtgaaaaggttatatttggacgacgacatgttgggataatgtcagctgaatcagtaggaaactacggagtccggatactctttgatgacttgcacaagacagggatcttcacatgggattacttgcaccatctcggttcaaacaaattcagtctgatgagaaattacatcagaactttgagaaagcatggtcttagtcgcgatccccagagaaggaaatgatggagcaacagtctctagacagcctcgcttcttggcgcatggatcgctccatcaggcttgcctgccatgtaacaaagagatgctcaattgaatatttgagatgtgaacgcataacgcaaggatatccattaactagtgatcaacagtgactgtgatgggaaagactgaataaaagtactaaaacgttcatttacagaaaaaaaaaaaccgcccgggcccctctggacaagacaccctcaattctcatatgtacgtatgcagttttcttgcaaaaaaaaaaaaaaaaaggccctagggcc

SEQ ID NO: 5031 - DNA, 707 bp, Zea mays
aattgcgacacttgaaaaacgtgaagaaagatacaaggcggtgtttgcagagaggatctcggtcttccggaaagcctgctgctcccttttcggttacaagatagtgatgaatgatcagcagcagtcaaatgggattcccgtaacacgctttattctgcagtcagtgtatgcccaaagcgatgatgaaaagcttgagtttgactatgaatcaggaagcactaatatcgtggtcaacgattacacatcccaacaagaaattgctcggcaggtcgacatctacataaggaggacgaactccataccagccttcactgccaacctgacaatggagtctttcaacaaaagaagtatatgctgaagacatgaaactagtgtcagggcacattgcttgatttctgtatgttatcattgacgaagagtatgtatatgagcactcacattggtgggtgaaaactgctcctgctaattgaagttgaggctggagctttgattctattcccaacggattctttttttccctttaactagcaaggcgtacatgagtattactgggcatggcgacgtaatgttgaagcttccggcttgtctagagttgagtgtagctaccaggtaactaggaatacttgattcgccaatcatgactgacgttattcctctgagagaacgagagttttgctgccaaaaaaaagggagggcccgctcccatc

SEQ ID NO: 5032 - DNA, 648 bp, Zea mays
gcattgcgaccagggcggcggcggcggcatacttcccgtccgcggccgtgcccgacccgtcggaccacgtctgggcgcaccacttcaacatgctcaactccgctgctgcggcggccggcacgtcagctgcgatgggcggcggggccccgtcgtcctacgacccgtcgcgcgccaccacgtcgtccagggacgaggcctccgtgtccctcagcaacgtgagcgacctggaagccacggagtggatcgaggaggacgagccgggcgtgtgcctcaccatccgcgagctcggcgacggcacccgcgagctccgccgcatccggttcagccgggagatattcggcgaggatagggccaaggtgtggtgggagcagaacagggagagaatacaggcggaatatctgtagcaagcgatcagacactgagctgatgcaattttcaggcctgatgggataatcaaatatgtttgtgagaggatagattagggagatgataccgctatatacatggtgaaaacaacgtgaagggggaaactgtgaaagtgaaagaaatggtacctgtccttagttgcctaaactaataataagtttgtacatcgttggtacaatggtaccggtgtctggtttaaaaaaaaaaaaaaaaaactactgt

SEQ ID NO: 5033 - DNA, 1428 bp, Zea mays
agtgaaacttgtcattattattccaacgacacgttttgtgtaaacgagatcggacacgtcgttgctgggcaccgctgaggcaaaggcaacacatccgttcaagctgatcaagactgggacacttttttttttttttttgagcaaaagtcatccctttcatcaacaacatcctgtttaccaactaatgtgacaatggcgtagtaatgattgagttttagcaattctaaaagccactcatatcatacacttgcactcttgggaaattgagagccccaaaaaaagttttttccttgagtgtgggcgagggtggttcatttgtctactctgtggctatcagaaacggaagtccccagccacctcttctagagaagtaatcactgtccaaggaaatcgcgagagcaagagccactgccctttcaggcaaagtcagctggcgaacaacatgcagttcttcgacatcttctgcgggagcaaacttgtggctttgcccctcatcaccaaaccggatagcatactggccagcatccgtgaagagctcaaagccgaggcccctccaattacgatcaatctgagccaacattttatcatcttcatccaccaggttaaaggtccagttccagaatcctggattctcaacaactgcaaattgcatattccctaagtacaagtcataaattctccgccaaaggtgccaacgcctgtggactacacctatctccttatcattcacttctacataaattgagctgttgatccaccaaaatggccggcgaaccttaaatatctcgttacccatagcatcagttatttctgcaacaaatggccgtcttgttctgagtagctgtctaaagatgatgttgcttttctctcgaataaaacctactggagattgtggaaagagtgggtccattatgatatacctgctctcctgctcaaaagcaaacatgatgtttgcccactcaatatccctggcaatgacgaggttagctcttgcaagaagcggagccagtttggcctccacggggttagagccgctgtattcgtactgatagctccttgacggtgcctcctcggtcgctcctgcaacctctaatgatgagccgacgccccatctcctcgcggcttccttctgcttcttcagctcgtctacccacagcttccgcaaccactcccgaggcacctccggtgacccatccctgccgccactagcgaacccgtgggatcctcccttgacgagactagtgttggacctcgccgccgcggaggccctcctggcggcgacggcttgagagagcagcctcgatagccaccgcatcgccgtacggccgcagcgcagagacgccgggagccgggggaagggagaaacgcgagggctgatttggtgaattctgccgctccggccgagcccggggccccagacccggccgg

SEQ ID NO: 5034 - DNA, 1950 bp, Zea mays
gggccccccccccttttattgtttggcccaattttttcctcccggcccttggggtcccctccttttttctttttttttggagaagaaatatatctttcctatttacactatataaatatatttttcctattcacaattatgccaaagctcctgccgcttcggttaaataaaatggcatgatcataatttacaggttacaatgtccagcaagatatagcacaattccaattttgttttgctacacaagacacatgtaatcgatggaattgccacaccaatcacagtccaataccagtttccatacaaaaacggggaactatctcacctatcgacacagcactatacatcatacaatttcaatttacaaggagtgcatatgcatctgcccatccgtccatcaattgtctggatcatgtctgcaagcaacagcatcctcactcagcattgcatgatgctgcggacctcaggcgccggcaggaacatctgtgccagccactgcagcggcttcaccagctccgcatgcttctttcgccagtaccagatagcagcattgtagaactcgttgcggatcgtcttggacgctgcccgccagtcgcacttctccatctcggatctggccgtccgccccatgttttctctaaactccctgttcgtcagcagctgctggaccttgccgaggcagtcgtccaggtcaccaggggtgaacaggaagctcgtcctgccctcctggtcctccgggattatgtcggggatcccgcctgcacgggccgcgacgacgggcacccccgacgacatggactctaggaccacttggccgagcgtttctgactccgatggcatgatgaaaacatcgccgctggcgtacgcctgcgagagctcttcaccctgcatcattcctgtgaacactgctggcattccttcaaacatcttctctagttcacccctatatggtccatctccaataaatgcaattcttactccaggcaacctttccattaccatcttcaaaaaatccaaacttttctcacgcccaaaacgtccgacatgaattaccagtggtttttcaggctcaccgtcacttagcctgactcgcatctcatgactgcggaatctaggatggaagcttgcagaatcaacacctttgttccaaaggcgtattctattagctgatatgacctgagcagtttcaaaatctttgctgatagcagcagatggtactaaagttaaatcagcagctctatgaaggaatcttatgacttgccacattggctctacaagccagctaaatgtatatctcggtatgtatactggaacatgggtgtgataggacatgactaggggcacaccgagtagcttggcaatagctagagctccaaaaaccataattccaggagaagacgcatgaataatgtcaggtttgaacttcgcaacctccgaaatgatcctaggactgagtgccagcgaaagaggtacttttccatacatggggcatgggaagctccatgaacctataaccttggcgccatggaactcttggggaactccctcatgattggtcacaacaatgacctcgtcccccatttctcgcaaatgtttgatgaagttctggaaccggttcttatacccagaaatgtatgcgaacggagacggctcgacgaagagcgcgacgcggcgcggccgcatggcctcgtccaggaccggcggcggcgcctcctccaggtcatccttgacctccttcccgccaatcgccattgcccctgcggccaccggaggagacagagcagagcggcaatccttgggcttgcgcaagcgtgcacggcgcttgtgttctacctgcgtgtgatgatttgtaggagcaaggaagagggcgaggtcgccgttgcgtatataagcgggagaaggactgaagacgatttttcgattaggatgttctaggtaatggtctcgtgc

SEQ ID NO: 5035 - DNA, 935 bp, Zea mays
gaccctcgggctggccgggcaagcaagctaaaaagaagggggctaagcaagagcttaatgcatcacagccaccagaagaaattacccataacatccacttctggaggaacggcttcacagtaaacgatggtccacttagaagttttgatgagccagcaaatgcaccctttttaaagagcatcaaggattctgactgcccaactgagcttgtgccggctgatgagaaatctatagtgaatgtgaatcttgtccggacggaagaagaatttactgagccagtcaagcgtgctgctccttttgaaggggaacgaagaaacctcatggaaccttctgataataatacttccaatgctgctgctgcttccagtagtgcaactgcttctcggacaatcacagtggacgattctttgccatcaacctccctccaaatcaggttcgcagacggcagtcgcttggttgcccgtttcaacacaagccacaggattagtgacgtgcgggcatttatcgacgcgacaaggccaggagccagtgattacacgctgcaggccgggttccccccaaagccgcttgaagacacggccaagaccatcgaggaagccggcgtggccaactcggtaatcattcagtcagtctagcttggcagaacaggtgccgcaaccctattccatcgaacacgctaggcatctgaagctaccaccttccttgatcttccttcattttgtttctcaaacctggcttttaaccttttatcttcatccagtagctacttctggtattgcgagtgtaaaacagtgaggtctgggtgtcctacatcttattcatctatagcatatatagtactacttgttgcatacagtactacttttgcttgtctccttcagcgtttggtcggttaaaaaagaaaaaaaaaaactcgagggggggccgggtaccca

SEQ ID NO: 5036 - DNA, 1710 bp, Zea mays
accaatgaaaaggaaaaggaaaaaccagacggccaaggcagcccccaaccccggccccagccggcagaccatctcgatacgcggccgccgcagacgagatggccgccggggacgcaggccgcgcgccgacggcagcggccgcgcaatcgctggtggagtccttctgcggcgtgacctccgcgaccccccaggaggcggccttctatctcgagagccacaactgggccctcgaatccgccgttcgctcctactacgactccgtggacggtgaagccgacgccgtcgcggccgatccagtgcccccaccaccagctgcaccagccggaggcggggaggataccgaggatgaggattgcgtggtcggcggtggcggtggcggcgacgacgacgaggatgatgaggactacgtcgatggcgacggcagcgatgatgaggacgctgcgctcgcggctgaggccgcggaggaagaggagaggaggaggcctttcaagaggctgaagagaacccacgacgcgcggggtgggagcggtagcagtgccaaggcgcgggggaatgtgaggacgctcgccgatctcgatagtggcaagggaaccgcgggttccgacgagaactccgaagacgatgatgaatggacaccaccgcccgagtacgagacgagagatcgatcaagacgtaaaaacaacacagatgagatcttcaagcaagctaaaaagaagggggctaagcaaggtccgtttgaggctcgtccgcgatctagttcgaggaactttactgggactggtagacttctgacaggtgaaactgtagagcgtaatgcatcacagccaccagaagaaattacccataacatccacttctggaggaatggcttcacagtaaacgatggtccacttagaagttttgatgatccagcaaatgcaccctttttaaagagcatcaaggattctgactgcccaactgagcttgtgccggctgatgagaaatctatagtgaatgtgaatcttgtccggacggaagaagaatttactgagccagtcaagcgtgctgctccttttgaaggggaacgaagaaacctcatggaaccttctgataataatacttccaatgctgctgctgctgctgctgcttccagtagtgcaactgcttctcggacaatcacagtggacgattctttgccatcaacctccctccaaatcaggttcgcagacggcagtcgcttggttgcccgtttcaacacaagccacaggattagtgacgtgcgggcatttatcgacgcgacaaggccaggagccagtgattacacgctgcaggccgggttccccccaaagccgcttgaagacacggccaagaccatcgaggaagccggcgtggccaactcggtaatcattcagtcagtctagcttggcagaacaggtgccgcaaccctattccatcgaacacgctaggcatctgaagctaccaccttccttgatcttccttcattttgtttctcaaacctggcttttaaccttttatcttcatccagtagctacttctggtattgcgagtgtaaaacagtgaggtctgggtgtcctacatcttattcatctatagcatatatagtactacttgttgcatacagtactacaaaagcatgtcaccggcgccgctcgcgcggtctaggtccccccttgttctttgtcgcaaaaaaaaaaaaaaaaaaggccccta

SEQ ID NO: 5037 - DNA, 1051 bp, Zea mays
  misc_feature (814)..(814): n is a, c, g, or t
tcattcgcccacctcatctccctctcccgccccgccttagaaaaagaacacgaggagcgcgcgtgctccccggccccgcggcaggcagacacgcatcgatgggcaactgccaggcggcggagacggcgacggtgctgatccagcacccgggcggcggccgcacggagcgcgcctactgggcgctctcggcgggggccgtcatggcggccaacccgggccactacgtcgcggccgtcatcaccgtcccgcagccgggcggcgcgggagacggagctgcctctgccgccgcgcccgtgaagcacctcaagctgctccgccccgacgacacgctccagctcggccgcgtctaccgcctcgtcagcttcgaagaggtgcttcgggagttcgcgtcgaagcggcacgtgaagctgagccgcgtgacggtccgggccaaggacgaaggcgaggacgtgaagccggcgcccaagcatcgccgccgtcgcgccagcggcggcggagagcgcaaggaatccgagcggtcactcgccaaggtcatggggcagacggaggagcagttggtgccggaggcaggcccggcctcgggccccgcccccagctcctccaagcaaggggacgccgacacgccggccggcctcgacgccgacctggaggcgctcctgcagccgcacggggcgttgctcggccgccgagccggccggcagtggaggcccgcgctgcagagcatcgccgaaggcgaagggtaaaggggggcggggcggcgggcgccaccagctcgaccgttcggtccgcggtcggtgagcagccgagctccgtngtctccgtctccgtgcaaggtcaactgcaacttgcgaggctgacagcgtattgtaaaataagttcattgttagcgcgcccgactggtgtccagatgtgtagcggcagcagttggctaagcataccactagactagtatagtagtatccatgcatggatttgatggtgtgtttgtaataaggtaagtagtatacggtatcgcataaaatctttatcctgttctttgtgagctcaatcc

SEQ ID NO: 5038 - DNA, 1321 bp, Zea mays
aattcggcacgaggggctaagctccgcacctgggggaaatggagctgctcagtggcgcagtggcgcagcgggagcttggggaagcggaagcttgcgagcagccagagcactagccattacccagcgctaccatacactgacatatctatcgatctgatcgggctgctgctgagtgcagtgtttgtacaaaaggccctgaaggcggtaagaccgagctgcacctgcactagaggtgaaggggtgtgagggagaagaaaagcgagtagcccgtgagctgctgcggtgcgagggagcccagggtttcgtctcgtctggccctcttctcttggcgcggccatggacgcctacgaggccaccaaggtggtgttctcccggatccaagccctagacccggaccacgccgccaagatcatgggcctcctcctcatccaggaccatggcgagaaggagatgatccgcctcgccttcggccccgagtctctgctccacgctgtcatggccaaggcgcgcaaggacctcggcctgctcctcccggcctcgccgacctccgttgcggccgccggccacgcgccgttcctgcagctcccacgccagaactccgggcgcgcgggcgcgccgtcgccgctctcggtgtcctcgccgtcgtcatggagccacgcgcccgtgttctccaggagcaacagcacgagtaatggcaccgcggaggaggcggcgggggctggggaggagctgcccagtcccgtgaacggcggcgcggcgccgttctttcctcgtcaggccggcgacgcgctcctggacgacttgcagctgcaggagcagctcgcgttcctcaacgagggcggcgggaacccggcccaccagctcctggggttcgacggcggggagtgccggagccccggtcccggtgatgccgatgggatgttcgcgttcggcctcgggtggcacaacgggggcccagcgcaccgtaggagttcgtcagtcaacgagctctgccttggcggcggcggcggcggcggcgatggtttcggttggaagccctgcctctactacgcgcgcgggttctgcaagaacggcggcagctgcaggttcgtccacggcggcctctccgacgacgctgctgcgctcgctggcgccaagatggaggcagccgccgatcagcagcagcagtgccaggacttcctcatccgctccaagggccagcgcctcggccccgccgccttcccctactcccccaccggctccctcccaggctcgccctccgccgctagcaagtgcctcagcttcctgctgcagcaacagcagcagcagcacgacagagccg

SEQ ID NO: 5039 - DNA, 1620 bp, Zea mays
ccgaaacgtcgacaatattaatatggcatatctaatgatactaatttattgtcaccaaatttcacttaggtctagtttgagagccacaaaactggaagagattagaagggattagagggaattgaataagaaggagattctagcccttctaattttttttggttttgttgctctcaaactagtgagatggaaaaaacttgcagaagtatttttttttatcggtacatcagttgtctttgcatctttcactatgccagccgagaagaagttgctagtaccttccaggattcttggctgtgcggctaagccacgcctgctgggtcctcgtctaagcctctaaaggcaccgacatggccatccatggcagcgtacgaactcgggcttccttgcgttgtactgagcggttcttcgtgtcccagatcgcacggcccacgaatgttccttgcttcctagctagaactgctttctgcctgcactggaacaagcgatagatatttcaggcgaaagactgcaggcaggcagcaccgcagcaggcagcagccaccatggcatcccgggcacccaatggcgacgcggaggcgccactgcttgcggccaccggtgacgcgccgacgacgaccgccatcggcaaggcccttaacagcaccgccgacctcgccaagcacctcccgacgggcgccgtgctcgccttcgaaatgctgtcgccgtccttcaccgcgtacggcacctgcaacgccgcgaaccgcgcgctcacgggctgcctcatcggcgcctgcgcgctctgctgcttcgtcctctgcttcaccgacagctaccgcgacaccgccacgggcgcgctgcggtacggcttcatcacacccagcggccgcctgctccccatcgagggtggcggctccagctccggccccggccccggcgcgccgccgccgcgggacgacaggtacaggctgaccgtgcgcgacgtcatgcacgggctgctgtcgttcgcggtgttcctggccgtggccatggtggaccgcaacgtggtggcgtgcttctaccccgtggagtccgcgtccaccaggcagctgctggcggccgtgcccgtggcggccggcgccgcggggagcttcctattcgccatgttcccgtccacgcgggcgcggggatcggcttccccgcggccgtccgcggcggcgtcctgagtcctgacgaatgaattacgtcgtcgggtcagccggtccaggtggtcagctgctggcggcgcgcgggctttttgtttgtttggatgattgcccacttcaatggcagcctaaggctagctgctaaatcacataaacaaccgtcatgcttgcgcatttccattgcattcccccacactttacaatttcgtcgaatgaacttacgggtgtgatactacctctattcttaaatattacgctgcatagtttatttttgaactaaaaaacttcaaataaaaaaggtgcatgggcgtattatctattacttcactttctttgatgggaacgtattagggtttactattttgctatttcgttttacagtcatttcttggtgattagcgaaatcgagaaaccaagcgaatttcatcgaatttcactattcccggagtggtttgtg

SEQ ID NO: 5040 - DNA, 945 bp, Zea mays
accatctccactattgctagtagatagtaagtagatcacgcagcgcagtagctctggattaattaatccttctcccccgtgcctgggtcctgagccgccatggctgcccatgtggacccgctggttgtggggagggtgatcggcgacgtggtggacttgttcgtgccgacggtggccgtgtcggcgcgcttcggcgccaaggacctcaccaacggctgcgagatcaagccatccgtcgccgcggccgctcccgccgtcctcatcgccggcagggccaacgacctcttcaccctggttatgactgacccagatgctccgagccctagcgagccaacgatgagggagttgctccactggctggtggttaacataccaggtggagcagatgcttctcaaggcggtgagacggtggtgccgtacgtgggcccgcgcccgccggtgggtatccaccgctacgtgctggtggtgtaccagcagaaggcccgcgtcacggctccgccgtcgctggcgccggcgacggaggcgacgcgcgcacggttcagcaaccgcgccttcgccgaccgccatgacctaggcctccctgtcgccgccatgttcttcaacgcgcagaaggagacagctagtcgccgccgccactactgagacaggctgatcgtcgtccaacggcaattacgtacccagcaaagcttaagccagccgctgcagtcactcatctcatcgagaagaagacaatcttcctagtcgctgttcttgccaagtactagtaccttgttaattattatgtaagctaaacccgtgtgcctgtgattatattgggacgtgtctcgctttaatacaaccgctcaacttgtggcgtttaattattttatttattagacaaaaaaaaaaaaaaaaaagtcacttgccttaaaagaaaaaaaaaaaaaagggggggcccggtaccca

SEQ ID NO: 5041 - DNA, 751 bp, Zea mays
  misc_feature (747)..(747): n is a, c, g, or t
tttttttttttttttttattagcggtaggaatccaatccaatatggttttaggctacttactacaagcggtgaaatatacatttcacaaaaataaaaaatatgtctctcactacatcacaaatcaaaatagaacagaggcagggacagagccagaaaaaagtttaggagggactgaactaaattgctgcagtataaaagctcattctacattatattgtatacattttagattagaggagactgtagtagggcttcatgggatccgaaacggtagggaaatcgagccccgcccaccccaccgctagatccgtccctgacagggggagcactggtcctttttcagattgttcaagaagatagtaggtagtaacactgaagagttccaattttcatctttccaatattgcatgatgaggagcaaacaagtctctggtcaagctcgaaaagggtttcatatagaccatagaaaatttgagtgttcccatctgagctctcatcagttagagaagcttcaacatcgtttgaactgggaatcacaacataaaacctccccattatgactccttcgtttgttgaggctatcaattacatcaaaagaaatggaaggagaggctcactgcaaaaaaaacggccgggaagggaatgaccgctcttgtggtataatactaaaggacccaaaccactggtcctggctgagaaaacctctgaaccttggcccacatcactaacggcccgagtacaactgnccac

SEQ ID NO: 5042 - DNA, 1951 bp, Zea mays
ttttttttccgggctcgagttttttttttttttttttatacgaaaccagagacaaatcctttccgcttctttaggcaattgccgagccatggacggacgctgtagaaacacggagcacagacctcgaacagcgccggccgctcgctcgctcctacggtcctaccgcggcgccaaaccaaaccactagtatcatcagctagcaggaagcagacacaccaaacaccttcttacatattactacagtgcaaaaccccggcccaaccccacctgcagaagaagctgcatcgggcaccctgatcacgagaaggtttcaggcagaggctggccctgcaggaacgccctgaagagaacgagcgagcgcccgggctgcgagaagggcgcctcgtgggaggcgcccctgatggtggcgaaggacagcgcgccgcctccgtacacctgcgtccatcctccgacctgctgcccttcgaaccacacccggtacggggtggtggtcttgaggcccatgtcgcgcgccaggttctgcaccagcgtccggctgcccgtcagagggatcaccgagtcctggtcgccgctgtaaactagcactcggatgccggatttcacgagcgatccgacgacgctgatggtcgggatctgcaggttgagcagctcgtactcgagaacgctgctgcagaccgcccacttgtcgacgccgacgagcctcgcgtgcagcgccgcctgcacgtcccggcggttgaggtacctcaccgtctcgtcctccacgcacacgtcgatccgctgcccgacctgctcgtgcggcgagaggatcttggactgggagagcaccgacgagaggcagacgtcgagcgtgacgtcgtacttgtcgacgaagcggctggtctcgcgcgtcacctggttcatcacccgggcgcacagcggcgacagcgagccgccgtagtactcggtgacgtaccgggagtagttgcaggcggaggtgaacacgcggtaggtggcgtcggagatgaggccgtgcgaccagaagtactcggcgcgggcgttgaagtccgtcgcgaactccagcaccgggttgcccagggcgacgcctctgaggttgaagatcctgtccttcttgttgaactccaccatggcctccgcgagctgcgggatgtagtgccctgcgtagctctctccagcgatgtagaggtctctgcccctgtactgtgggaacttttggagccacctttgcaggaacaccatgttgtccatggctgtcatcttgtcatccacgccctggtagtaagcagcatcagcagagtaggagtagccaacaccagccggcgtctccaggtatatcacattggcctctttgttccagctgtattcgttcttgaccagcacctggccactaggcctgaacggcccgttctctgagaaggcgcctaccgcccagggacgagcacccaggcccgtccgttgagccagagcacgagaggcttggaggcggggtccacgacgtcggcctccacgaagtagtagaacagggcgcgcttgccgccgccgccgccgctgtccacggcgacgtagcccgagttctgggcgaagctcacctccggctcccccgggagccgcctgatcctgtccgcggcggcggcggctccgtcgtcgcaagcacccggtcggcacagcgcggccgcggcgacgagcaccagcgccagcgccagcggcctgctgccgttggagcgcgctggagctagcaatggaatggccatgcctccagtccagtccagcccaatggacggagtggcagagagctagagagatgtgtgtgactggagcttgagtgagagagtgagtgagagaggcgagcaagagtcaagtgtgctcttttgccttgagagcacaaagctattttcaaaagatgaatgattcagtgggaggatgagggagggagggaggcctcgtgccgaattca

SEQ ID NO: 5043 - DNA, 1851 bp, Zea mays
acgaaacgagggacaaatcctttccgcttctttaggcaattgccgagccatggacggacgctgtagaaacacggagcacagacctcgaacagcgccggccgctcgctcgctcctactcctaccgcggcgccaaaccaaaccactagtatcatcagctagcaggagccaggaggcagacacaccaaacacctccttacagattactacagtgcaaaaccccccaccccacctgcagaaggagctgcatcgagcaccctgatcacgagaaggtttcaggcagaggctggccctgcaggaacgccctgaagagaacgagcgagcgcccgggctgcgagaagggcgcctcgtgggaggcgcccctgatggtggcgaaggacagcgcgccgcctccgtacacctgcgtccatcctccgacctgctgcccttcgaaccacacccggtacggggtggtggtcttgaggcccatgtcgcgcgccaggttctgcaccagcgtccggctgcccgtcagagggatcaccgagtcctggtcgccgctgtaaacgagcactcggatgcccgatttcacgagcgatccgacgacgttgatggtcgggatctgcaggttgagcagctcgtactcgagaacgctgctgcagaccgcccacttgtcgacgccgacgagcctcgcgtgcagcgccgcctgcacgtcccggcggttgaggtacctcaccgtctcgtcctccacgcacacgtcgatccgctgcccgacctgctcgtgcggcgagaggatcttggactgagagagcaccgacgagaggcagacgtcgagcgtgacgtcgtacttgtcgacgaagcggctggtctcgcgcgtcacctggttcatcacccgggcgcacagcggcgacagcgagccgccgtagtactcggtgacgtagcgggagtagttgcaggcggaggtgaacacgcggtaggtggcgtcggagatgaggccgtgcgaccagaagtactcggcgcgggcgttgaagtccgtcgcgaactccagcaccgggttgcccagggcgacgcctctgaggttgaagatcctgtccttcttgttgaactccaccatggcctccgcgagctgcgggatgtagtgccctgcgtagctctctccagcgatgtagaggtctctgcccttgtactgtgggaacttttggagccacctttgcaggaacaccatgttgtccatggctgtcatcttgtcatccacgccctggtagtaagcagcatcagcagagtaggagtagccaacaccagccggcgtctccaggtatatcacattggcctctttgttccagctgtattcgttcttgaccagcacctggccactaggcctgaacggcccgttctctgagaaggcgcctacgcccagggacgagcacccaggcccgccgttgagccagaggacgagaggcttggaggcggggtccacgacgtcggcctccacgaagtagtagaacagggcgcgcttgccgccgccgctgtccacggcgacgtagcccgagtactgggcgaagctcacctccggctcccccgggagccgcctgatcctgtccgcggcggcggcggctccgtcgtcgcaagcacccggacggcacagcgcggccgcggcgacgagcaccagcgccagcgccagcggcctgctgccgttggagcgcgctggagctagcaatggaatggccatgcctccagtccagtccagcccaatggacggagtggcagagagctagagagagtgtgtgactggagcttgagtgagagagtgagtgagagaggcgagcaagagtcaagtgtgctcttttgccttgagagcacaaaactattttcaaaagt

SEQ ID NO: 5044 - DNA, 1576 bp, Zea mays
ggcctagtggccaggtgctggtcaagaacgaatacagctggaacaaagaggccaatgtgatatacctggagacgccggctggtgttggctactcctactctgctgatgctgcttactaccagggcgtggatgacaagatgacagccatggacaacatggtgttcctgcaaaggtggctccaaaagttcccacagtacaagggcagagacctctacatcgctggagagagctacgcagggcactacatcccgcagctcgcggaggccatggtggagttcaacaagaaggacaggatcttcaacctcagaggcgtcgccctgggcaacccggtgctggagttcgcgacggacttcaacgcccgcgccgagtacttctggtcgcacggcctcatctccgacgccacctaccgcgtgttcacctccgcctgcaactactcccgctacgtcaccgagtactacggcggctcgctgtcgccgctgtgcgcccgggtgatgaaccaggtgacgcgcgagaccagccgcttcgtcgacaagtacgacgtcacgctcgacgtctgcctctcgtcggtgctctcccagtccaagatcctctcgccgcacgagcaggtcgggcagcggatcgacgtgtgcgtggaggacgagacggtgaggtacctcaaccgccgggacgtgcaggcggcgctgcacgcgaggctcgtcggcgtcgacaagtgggcggtctgcagcagcgttctcgagtacgagctgctcaacctgcagatcccgaccatcagcgtcgtcggatcgctcgtgaaatccggcatccgagtgctagtttacagcggcgaccaggactcggtgatccctctgacgggcagccggacgctggtgcagaacctggcgcgcgacatgggcctcaagaccaccaccccgtaccgggtgtggttcgaagggcagcaggtcggaggatggacgcaggtgtacggaggcggcgcgctgtccttcgccaccatcaggggcgcctcccacgaggcgcccttctcgcagcccggacgctcgctcgttctcttcagggcgttcctgcagggccagcctctgcctgaaaccttctcgtgatcagggtgcccgatgcagcttcttctgcaggtggggttgggccggggttttgcactgtagtaatatgtaagaaggtgtttggtgtgtctgcctcctgctagctgatgatactagtggtttggtttggcgccgcggtaggaccgtaggagcgagcgagcggccggcgctgttcgaggtctgtgctccgtgtttctacagcgtccgtccatggctcggcaattgcctaaagaagcggaaaggatttgtctctggtttcgtaaaaaaaaaaaaaaaaaaaaaccacgcgtggggggggttttgcaaaacaccttcttacatattactacagtgcaaaaccccggcccaaccccacctgcagaagaagctgcatcgggcaccctgatcacgagaaggtttcaggcagaggctggccctgcaggaacgccctgaagagaacgagcgagcgcccgggctgcgagaagggcgcctcgtgggaggcgccc

SEQ ID NO: 5045 - DNA, 1528 bp, Zea mays
tgttctactacttcgtggaggccgatgcccccgaccctgcctccaagcctctcgtcctctggctcaacggcgggcctgggtgctcgtcgctgggcgtaggggccttctcagagaacgggccgttccggcctagtgggcaggtgctggtgaagaacgaatacagctggaacaaagaggccaatgtgatatacctggagacgccggctggcgttggctactcatactctgccgacgctgcctactaccagggcgtggatgacaagatgacagccatggacaacatggtgttcctgcaaaggtggctccaaaagttcccacagtacaggggcagggacctgtacatcgccggagaaagctacgcagggcactacatcccgcagctcgccgaggccatggtggagttcaacaacaaggaggagaggatcttcaacctcaaaggcgtcgccctgggcaacccggtgctggagttcgcgacggacttcaactcccgcgccgagtacttctggtcgcacggcctcatctccgacgccacgttccgcgccttcacctccgcctgcaactactcccgctacgtcgccgagtactacggcggcgcgctgtcgccgctgtgcgccagggtgatgaaccgggtgacgcgcgagaccagccgcttcgtcgacaagtacgacgtcacgctcgacgtcttcctctcgtccgtgctctcccagtccaagaccctctcgccgcacgagcaggtcgggcagcgggtcgacgtgtgcgtggaggacgagacggtgaggtacctcaaccggcgggacgtgcaggcggcgctgcacgcgaggctcgtcggcgtcgacaagtgggcggtctgcagcagcgttctccagtacgagctgctcaacctgcagatcccgaccatcaacgtcgtcggatcgctcgtgagatccgggatccgagtgctggtttacagcggcgaccaggactcggtgatccctctcacggggagccggaccctggtacagagcttggcgcgtggcatggggctcaagaccaccaccccctacagagtctggttcgaagggcagcaggttggaggatggacacaggtgtacggaggcggcgcgctgtccttcgccaccgtcagaggcgcctcccacgaggcgcccttctcgcagcccggccggtcgctcgtgctcttccgagcgttcctgcagggccagcctctgcccgaaaccttctcgtgatgagcaatggctggctggctggctgctggtgcggctcttgatctgaaggcaagtcactggtttcctggacgcagcagctcttctgcgcgtgcgagggggtgggttttgcactctagtaaactgtaagaaggtgttccggtgtgttcgctgtttcttcagcatccaaggctcggcaattgtctagagaagtggaaagaattcgtctctcgtctgcgtgtgttcgtttttgtctgtaaatgttctgctagtgctgcaagaacattgcatattcttggaaaaaaaaaaaaaaaaaaaaaactcgagag

SEQ ID NO: 5046 - DNA, 1635 bp, Zea mays
aaggccaagcacaggccctccctccctgcatccgccactcccactctctccctccccacctcctcctcgtcccgttgaatcattcagcttttgaaactatttttttgtgctctcaaggcaaaagagcacacttaactcttccacgcctgcctctctctctctccctctccagtcacacacacactgtacctctgtccatcagcggcatggccacgccattgctagctccagcgagctccttcattaccagcccactggcgctggcgctggtgctcgtcgcggccgcgctctgccgtccggcttcctgcgccgccgccgccgcggacaggatcacgcggctccccgggcagccggaggtgagcttcggccagtactccggctacgtcggcgtggacggcgacggcggcggcaagcgggccctgttctactacttcgtggaggccgatgcccccgaccctgcctccaagcctctcgtcctctggctcaacggcgggcctgggtgctcgtcgctgggcgtaggggccttctcagagaacgggccgttccggcctagtgggcaggtgctggtgaagaacgaatacagctggaacaaagaggccaatgtgatatacctggagacgccggctggcgttggctactcatactctgccgacgctgcctactaccagggcgtggatgacaagatgacagccatggacaacatggtgttccttcaaaggtggctccaaaagttcccacagtacaggggcagggacctgtacatcgccggagaaagctacgcagggcactacatcccgcagctcgccgaggccatggtggagttcaacaacaaggcggagaggatcttcaacctcaaaggcgtcgccctgggcaaccccggtgctggagttcgcgacggacttcaactcccgcgccgagtacttctggtcgcacggcctcatctccgacgccacgttccgcgccttcacctccgcctgcaactactcccgctacgtcgccgagtactacggcggcgcgctgtcgccgctgtgcgccagggtgatgaaccgggtgacgcgcgagaccagccgcttcgtcgacaagtacgacgtcacgctcgacgtctgcctctcgtccgtgctctcccagtccaagacactctcgccgcacgagcaggtcgggcagcgggtcgacgtgtgcgtggaggacgagacggtgaggtacctcaaccggcgtgacgtgcaggcggcgctgcacgcgaggctcgtcggcgtcgacaagtgggcggtctgcagcaggtatcctatccattcggctcgacacagctgcacagcctgcaagtgcgaccggttcggttccgtctgaaggacatggggctaacgttccgcttctgctgcagcgttctccagtacgagctgctcaatctgcagatcccgaccatcaacgtcgtcggatcgctcgtgagatccgggatccgagtgctggtttacagcaggcccgtgcacaagggagtgcgagctgttggacggaacagggcctccatttttttggggccccaaaatttattgtactagtccattagtactactaatttaatattaggagcctagaaagtgaaaaggaaatcgtttcgcatgacaaaagaaagaaaaaaga

SEQ ID NO: 5047 - DNA, 1529 bp, Zea mays
cgccgtggacagcggcggcggcaagcgcgccctgttctactacttcgtggaggccgacgtcgtggaccccgcctccaagcctctcgtcctctggctcaacggcgggcctgggtgctcgtccctgggcgtaggcgccttctcagagaacgggccgttcaggcctagtggccaggtgctggtcaagaacgaatacagctggaacaaagaggccaatgtgatatacctggagacgccggctggtgttggctactcctactctgctgatgctgcttactaccagggcgtggatgacaagatgacagccatggacaacatggtgttcctgcaaaggtggctccaaaagttcccacagtacaagggcagagacctctacatcgctggagagagctacgcagggcactacatcccgcagctcgcggaggccatggtggagttcaacaagaaggacaggatcttcaacctcagaggcgtcgctctgggcaacccggtgctggagttcgcgacggacttcaacgcccgcgccgagtacttctggtcgcacggcctcatctccgacgccacctaccgcgtgttcacctccgcctgcaactactcccgctacgtcaccgagtactacggcggctcgctgtcgccgctgtgcgcccgggtgatgaaccaggtgacgcgcgagaccagccgcttcgtcgacaagtacgacgtcacgctcgacgtctgcctctcgtcggtgctctctcagtccaagatcctctcgccgcacgagcaggtcgggcagcggatcgacgtgtgcgtggaggacgagacggtgaggtacctcaaccgccgggacgtgcaggcggcgctgcacgcgaggctcgtcggcgtcgacaagtgggcggtctgcagcagcgttctcgagtacgagctgctcaacctgcagatcccgaccatcaacgtcgtcggatcgctcgtgaaatcgggcatccgagtgctcgtttacagcggcgaccaggactcggtgatccctctgacgggcagccggacgctggtgcagaacctggcgcgcgacatgggcctcaagaccaccaccccgtaccgggtgtggttcgaagggcagcaggtcggaggatggacgcaggtgtacggaggcggcgcgctgtccttcgccaccatcaggggcgcctcccacgaggcgcccttctcgcagcccgggcgctcgctcgttctcttcagggcgttcctgcagggccagcctctgcctgaaaccttctcgtgatcagggtgcccgatgcagctccttctgcaggtggggtggggggttttgcactgtagtaatctgtaaggaggtgtttggtgtgtctgcctcctggctcctgctagctgatgatactagtggtttggtttggcgccgcggtaggagtaggagcgagcgagcggccggcgctgttcgaggtctgtgctccgtgtttctacagcgtccgtccatggctcggcaattgcctaaagaagcggaaaggatttgtccctcgtttcgtacaaaaaaaaaaaaaaaa

SEQ ID NO: 5048 - DNA, 917 bp, Zea mays
  misc_feature (860)..(888): n is a, c, g, or t
ggatcttaacctcaaagcgtcgccctgggcaacccggtgctggagttcgcgacggacttcaactcccgcgccgagtacttctggtcgcacggcctcatctccgacgccacgttccgcgccttcacctccgcctgcaactactctcgccgcacgagcaggtcgggcagcgggtcgacgtgtgcgtggaggacgagacggtgaggtacctcaaccggcgggacgtgcaggcggcgctgcacgcgaggctcgtcggcgtcgacaagtgggcggtctgcagcagcgttctccagtacgagctgctcaacctgcagatcccgaccatcaacgtcgtcggatcgctcgtgagatccgggatccgagtgctggtttacagcggcgaccaggactcggtgatccctctcacggggagccggatcctggtacagagcttggcgcgtggcatggggctcaagaccaccaccccctacagagtctggttcgaagggcagcaggttggaggatggacacaggtgtacgggggcggcgcgctgtccttcgccaccgtcagaggcgcctcccacgaggcgcccttctcgcagcccggccggtcgctcgtgctcttccgagcgttcctgcagggccagcctctgcccgaaaccttctcgtgatgagcaatggctggctggctgggctggtgcggctcttgatctgaaggcaagtcactggtttcctggacgcagcagctcttctgcgcgtgcgagggggtgggttttgcactctagtctctagtaaactgtaagaaggtgttcggtgtgttcgctgtttcttcagcatccaaggctcggcaattgtctagagaagtggaaagaattcgtctctcnnnnnnnnnnnnnnnnnnnnnnnnnnnnntgttctgctagtgctgcaagaacattgca

SEQ ID NO: 5049 - DNA, 4252 bp, Zea mays
  misc_feature (3819)..(3819): n is a, c, g, or t
tagttaatgtgtttctaggacttgaaaataaaattgaactcttaagtgtttgcatgtccaagctatcttgtgggaatgttcctagggttccatagagcatatctaactaggtgaatctaggtacattatatttaagtgtaagaatctccattaagtgttttctaggtgatgaaacaattaaatcttggtctgtgatgattcttatgtttcaacttatcaaaggaatgaagaagatgcaacaaagctccttagtgtgtgagtggagctcaactcgccgttatctctccttgggctttatccttcttaaaatcacatgctcgtcttctccttgctagagggagggagctcttctcccttctccctgtagcaagctcttgcgtgaagcaatatgccactgatgtgtggggagagaacttaggccccctttggtaggctccttcgagtgcttcttcagcaacttcttaaaaaaaatctaccaaatgagagactcttcctagaaaaaagggaggagctcatccaaaaaaccagcacgagtagggagccagaaaaaggaggtcctaccagctcccctcccatgtttttcttttcgacgacgctacatcataaaagaagctgtaggaggagctatattttaacgtcaaccaaacatggtgctatttataaagttctcctgataataataaggagggagctgttttcttagagaagtcacggcaagagctaaagctgtgccagagaaagagccctaccaaacggggctttagtgttaatcgttgaccttacaaagagtggcaaaaaagttaaataaaattaaattctttttgtggcaagtgtttaataacaaattcatttttttgtgattgaccagaaactgctgagcgtattctgtttaaatgtcacctttccaattttctttgttgcatgatcaaagaaataccgagtgaattaaggaggcgtgccacgctaaaacacgcaaggtacatgcatgcattgtattacgagaggtactacagcagctagctagctagtgcggactgcggaatagaaactaataagcaaataaacaaacatgttgatctgcttaattattcgacgacgacgacgatatgatagcggccggatcggatgtaagtacactgtagcagcagcgatcatgcagctgctgcaagaataaggtcctcgtctccgtctccgtctccggcggtggtgtcaatgacaaggtcgtctttggtagcgctactagcgccgaagctggcgcggacgaagcagttgttgcgcactgggcccggatcggcccccctgagcctgctgagcttgagcatggattccacgaagcgcttgaagaattcgtcctggctggaggcgcagcggtcgacgagccacctggtgcggccgtccctgtagagcgcctggtcggaggtgagcacccctctgccgttctgcagctccacgaagtagctgttgtcgaagttgaagggcgtacggtccagcgcgtgcttcttctccttgtctccgttgcagtagccggtgagcccccactcgaagttatccttgccggtcttcttgtcgatacggtcctggaacgaggagcaacgcgccacgcccacggtgtgcgcgccggagagcaccacgacgtcggagccatcgaggcccctgttaccgaagttgccgaggagctcggagacgccatcggtggggggcgggagcctgttgacggcccatcctggagcggggcccctgctgtcgctgcggcccagctccatagggatgaaggggccgccggcctggttgacggcgtggctggtggcgagcgccaggatgtcggcgcaggagacggaggcgccgcagcgggagtgcaccctgccgcggatcctctcgacgaggtccagcgccgcctgctgcaggcccgtgttctggggtgcgtcctgctcgctgccgccctggttcctgcccagcaggatcgacgcgtcgcagccctgcgggaagcagtcgtggaagaagatgcggaggaggcccgccgtgacctgggcgtcccaccgccgcgcctcctcaacggcggagcgcacgatgccgtccaggtccgggcacgacgccgcgtggaagtccacggacaggcccgccgccctggcagcagcaccaatgtcgtcgtcgctgccgttcaacgccgcagctgctacagccggtgtcgtcgtcgatgccgcggagaacacaaggccgatggccagcaggaggaggacattattacctgagcttgctctcgtcctccttgttgcagccatacccatatatatctactacagtagtagctactatagctaagtctaagtgtgtgtgccttcttcctcgtgccgcaagcagctggtacttataggcagccaacgctatcctactcgactcaaattaggaatatttacttatttagcatgaaattactctaacatcctagaatatagttttgaagttcagttgttaaatctaaactttctcttttacagaacatctatgcttatttgtatgtttaacactattcttaataatataaaaatagtactcatatatttgtatgtatttatgttgtttttatggcctcaatagataaaataaataatgctgggaaatgataggggcaatttagtccattttcttatgagccgagaaataaaaaaatgaaaagatatagatgaagtgttgttttctgaattcaattgatgaaactgatgttgttctttgaattgcttgaaaacgagtaccatttccggaacactgtctcaaagtagtgctgatttgtggattccgtcgatgggcaagtgggctgccaaattgaagccatgcaccgaaaatcgatgggtccttccttcttctcccgaggcaattgtaagagcatcttcaagagactagttaaatggcttctcaagctaaattttggctgctcaacagcaaaataattctccaacagattagctatctgatttgttaagctatctgactctccaaattgactctctcattagccaaatttgtctagtcacctgactaacaaaattagatagatagtctgttgaagtgaaatgctacatatatagtgtaatctttatgaaaaagctaaatatagaattaatttaaatagagagccaaaaataaatagtatcttaagatgctctaagggatcaccgacgcttcgctcgctatttgcactgtgcgcgtagttgctaaaataagccccaccacatatttcctccacgtgcatgcatgcggtcaatgcatagatctcaatattctgatggttaaaatagtctaactagcgggaaagacaaagtatgagcccaagttttctaatgatctactattcatatggttctaacttagtatcaaactacggtctcctctagtaggctacgcacacttgtgtggagcttataacaaggattagtaaggtcattttcagtgaaagttttattgcacggttttcaaaagtgacacatcagcttttgtctatgaaactgtataatattcgagttttatctggttgaaatcatctctcctctcatgaaactctctcaatctctttcatcataaatattgtatcatgtcatcaaatatagtaatgtgtcatctcatttaatgagaacgaaactataatgaaacttccacttagaatggcctaagaagctacactgataccacagtaaaagtatcggcgcattaacaagagttcgcttttctatctcattaaagtctcgtatttatattgttatctttggttgtatactttaccttatcagcttagttataagctacggatatgtccgaaacttaggntgcaaaattccttttatggtagagatagtaacacttagataaaactttagttgcacaaatcaacgcttggttatccgtatacattttgtttaagagataaaatagaggcctaaaatagagtgaaaatagttctcctaatccactcccccaagacaactttagtcgcacaaatcaatgcttggttattcgtatacggttttgtttaaaagaaaaatagttctcttaattcactctccctcttatgcgtccatgttcttttcaatgtccatgccctatctaattctccttgactctttagtcttttctaagtctattttagttagctcctaggttcctaatcaacaaaacatgtacttcaccaatagtaaggttaaaaatgactaacaccttgcaatgcatctaaagaagtgatgtcctcattaacttagataca

SEQ ID NO: 5050 - DNA, 981 bp, Zea mays
tgatcttgggaatgggccagctccaactcaagctcacatgccccctgcgggaccaccaggagtattagcaggcccagctccccaaaccttaattagcaactctagttttggtgttcctccacagcagcctcaccagctctatcaatcagccgcacatccaagccatttcatgatgcagcaagttccgaacagcatgcccatgcccgagcaacaacctaatagcatgcttgtaacgcaacaaggtttgggatacctccagccaaacaccccaccttcatacggctccgttgggggtagtaatccattcgggtaaaagaagtgtgggaatacctgctctttcatctctagactaagggtctgcagcactcagcgggacagacatccatcgaagcccccgagagaatgtgtttcatacaaccaggtggtgtattctgtcgggtgtgatatgttgtacaacttgtttccaagggcttcatcatcgaatgtaactctgttttagagggcctaagctgctttcagcctcattccttgtatattgtgtctggcattctgcttgaattgcatagtatgtatattttgtgttcctttgttgtcttggacagtatcagctcagttttagtacgagtcagcttctagttcagttgactattcattttaacgtggatggtaagtactttataatagaccagatgtatgatcgtgatcaaccaattttgtggtttcttttacttgcgattttaatatcacttattggccccgtggtcttctttaagaattctttttcatgtgtaactcatcacaggtatacctggccaatgggccaggccgggccagcacggcccaaacctgtcatgggctcgcacgtgggcctgaacaccagcccaagcatagcactgctggctttaactggtctcgtagggttggattggactttagtgctggcaggtatgattgtatagtacccagcggtactgcaggcat

SEQ ID NO: 5051 - DNA, 2653 bp, Zea mays
gcacgagaccattacctagaacatcctaatcaaaaaacaaaagagacgagccttttcgctcgccgctaccaccacctcgttgtctcgcctcagcacgcgcgcgggatctcgcgctcgttcgcgcaccgaggagcgcgcacccacctgcagggttcggggcggggtgatccggcggcgatggcgagccgggtcaaggaggacgagaggcacgagaagatcatccgcggcctgctgaagctgcccgccaacaagcgctgcatcaactgcaacaatttgggaccacaatatgtctgcacaaatttctggacctttgtttgtaccaattgcagtggatcacatcgggagtttacacatcgagtaaaatctgtttccatggccaaatttaccgcacaagaagttgctgcccttcaagaaggggggaatgagcgtgctagagaagtatttttcaaggaatgggatcctcaacgaaatggataccctgacagcagtaacgctgacaaattgagaaatttcattaagcatgtgtatgtggaacggagatacacaggagaaaggagtactgataggccaccaagggcaaaggatgacaaggatgagtatagtgaaaatagaagatctgatggaaattggggtggttcgagaagtccgccaaatggaagttactctgatcgtcagagttatagcggacggagtgatgacagaaattccagatattcctatggggaccgtagtcctggctatgaccaaaatgactataagagaagtcctcgctactttgaggttggtgataatagatctggaaaaacaactccaattcaagggtttgaagacaggaggttttcagagcccagaaagcgagatagtgggtctccagacttccagaaagaagctgatggttctagtcctgttgtacggccagtgagggatatattgggtgacaacgctcctcaacttcgggtcggtgaaccttcaaagccagctactgagcctgcaaagccaactgtagtcagaccaattgatcctccaaagccaagtgtagtcagaccaattgatcctccgaagccaaatggaaccagggcaattgatcctccaccactgacaaagacaatatctagtgccagcagcattggttctgcagaagggacatcggaacagacaaaggtggcaagtgcagtgagtttgattgatttcagtgcagatcctgaacctgagtccacagcaccaccacagccgacccctatgacacaacagcctccagttaatgcagtagcaccacagcctgttcttgaacaaaggaaaagtgctccttctgtcagtggtggtgattgggcatcttttgatgcttttggccaacaacaaacacctcaaacaagcagcagtgtaaatccccttgagtctgcacttgcacagctgtcattctctgaagcaccctctgcaccaaatgtgtcagcttatcctgtttctctggatcccactttgaaagcaaatgatggaggatattcatctgtgctagatcagtcacattccttgtttgatgcaccctttggaatctcaggcaaccaggcctcaacagtaatgtctggccaagaaacatcggttcaacaatcttctatagctgcccctacggctggacttccatctcaagctactgcaaatcaacaaggaaccagtggtattcaaggagcagcttcttctactgacagtaaattcagtggcaggaaagaacttccagcggatatctttactgcactatatccaccatcaactccaatgatgcctggttggcagagagccccccattttggaatgggatacgccgtgcaatatccacctggagtgttccagggaatgcaagcatatcctcagcctacatatcagcaacctgtatattcgcaacatgcatattcccacccccaacctgtgaaagcttcaaacccttttgatcttgggaatgggccagctccaactcaagctcacatgcccccatctggaccaccaggagtattagcaggcccagctccccaaaccttaattagcaactctagttttggtgttcctccacagcagcctcaccagctctatcaatcagccgcacatccaagccatttcataatgcagcaagttccgaacagcatgcccatgcccgagcaacaacctaatagcatgcttgtaacgcaacaaggtttgggatacctccagccaaacaccccaccttcatacggctccgttgggggtagtaatccattcgggtaaaagaagtgtgggaatacctgctctttcatctctagactaagggtctgcagcactcagcgggacagacatgcatcgaagccctcgagagaatgtgtttcatacaaccaggtggtgtattctgtcggctgtgatatgttgtacaacttgtttccaagggcttcatcatcgaatgtaactctgttttagagggcctaagctgctttcagcctcactccttgtatattgtgtctgcttgaattgcatagtatgtatattttgtgttcctttgttgtcttggacagtatcagctccagttttagtacgagtcagcttctagtgcagttgactattcattttaacgtggatggtaagtgctttataatagaccagatgcatgatcgtgatcaaccggcggtacccc

SEQ ID NO: 5052 - DNA, 2090 bp, Zea mays
  misc_feature (10)..(10): n is a, c, g, or t
  misc_feature (208)..(208): n is a, c, g, or t
  misc_feature (220)..(221): n is a, c, g, or t
  misc_feature (236)..(236): n is a, c, g, or t
cagaaatcantatttttggggaccgtagtcctggctatgggggggaaggacgtataaaaaaagtcctcgctactttgaggttgtcgatgacagatctgggaaaaacaactccagttcaaaggtttgaagaccgttggtcttcggagcccagaaaaccagatagtggatctccagatttccagaaagaaggtggggggggggaggctgngttacgtccagnnagggatatattgggngacaatactcctcaacttcgggttggggaactgtcaaagccagctactgaacctccaaagccaagcgtagtcagaccaattgatcctccaaagccgagtgtagtcagaccaattggtcctccaaagccaaatggaaccagggcaattgatcctccaccccgcacgaggacaatatctagtgccagcagcattggttcttcagaaggcacatcagaacagacaaaggtggcaagtgctgtaagtttaattgattttagtgcagatcctgaacctgcgtccacagcaccaccacaacccacccctatgccacaacaacctccatttaacgcagcagcaccacagcctattcttgaacaagggaaaagtgttccttctgtcagtggtggtgactgggcatcttttgattcttttggccaacaacaaacactacaaacaagcagcagtgtaaatcctcttgagtctgcacttgcacagctgtcattctctgaagcaccctctgcaccaaatgtgtcagcttatcctgtttctcttgatcccactttgaaagcaaatgatggaggacattcatctgtgctagaccagtcacattccttgtttgatgcgccctttggaatctcaggcaaccaggcctcaacagtaatgtccggccaaggatcatcagttcaacaatctcctctagctgccccaacagctggacctccatctcaagctactgcaaatccacaaggaaccagtggtattcaaggagcagcctcttctactgacagtaaattcagtagcaggaaagaacttccagcggatatctttactgcactatatccaccatcaactcaaatgatgcctggctggcagagagctccccattttggaatgggatacgccatgcaatatccacctggagtgggattgcaatcgtatcttcacggagcatttcctcagcctacatatcagcaacctgtatattcacaacatgcatattcccacccccaacctgtgaaagcttcaaacccttttgatcttgggaatgagtcagctcatattcaagctcacatgcccccatctgggccacctggagcatcagcaggttcagctccccaaaccttaattcgtaactctagttttggtgttcctccacagcagcctcaccagctctatcagtcagaagcgcatctaagccattttatgatgcagcaagttccgaacagcatgcccatgcctgaacaacaacctaatagcatgcttgcaacgcaacaaggtttgggttccttcaacatgggttttgatcagcaagctcctctcggatacccccaggcaaacacctcaccttcctacggctccgttggtggtggtagtaatccatttggctgaaagaagtgtggaaatacctgatcgttcatcactagacgaagggtctgcagcactcagggggacagacatgcatcgaagccctggagagattgtgtttcatacaacaaggtggtgtatcttgtcggccgtagtctgttgtacaacttgtttccaaaggcttaatgatcgaatataactctgttttggagggcctaagctgatttcagcctcattccatgtacattgtgtctggcgttctgcttggattgcatagtatgtatattgtgtttcttcgttgttgtcatggacagtgtcagctcctgttttagtacaagttgtttctagtgcacttgattattcgatttaatgtggatgattagtacactatagatcagatgtagaatcgtgatcgatcaattttgtggtttctttttacttgctatcttagtaccacttagggcggacgcgcgcgttcgtgagcgttttttcttgtggaactcattcttg

SEQ ID NO: 5053 - DNA, 1021 bp, Zea mays
aactacttagatgcgcttctgactgatagagctggtgaggctgctgtggaggaacaccaaaactagagttaccaattaaggtttggggagctgagcctgcctgaacaacaacctaatagcatgcttgcaacgcaacaaggttcgggttccttcaacatgggttttgatcagcaagctcctctcggatacccccaggcaaacaccccaccttcctacggctccgttggtggtggtagtaatccatttggctgaaagaagtgtggaaatacctgatcgttcatcactcagacgaagggtctgcagcactcagggggacagacatgcatcgaagccctggagagatcgtgtttcatacaacaaggtggtgtatcttgtcggccgtagtctgttgtacaacttgtttccaaaggcttaatgatcgaatataactctgttttggagggcctaagctgatttcagcctcattccatgtaacattgtgtctggcgttctgcttggattgcatagtatgtatattgtgtttcttcgttgttgtcatggacagtgtcagctcctgttttagtacaacgttgtttctagtgcaattgattattcgatttaatgtggatgattagtcccctatagatcagatgtagaatcgtgatcgatcaattttgtggtttctttttacttgctatcttagtaccacttaattttgtggtgatcttttgtaagggttattttcttgtggagctcattacttgttatctacattttgtaatgcaattcaaggtatgttcaacttaactaatttctccctcagtttacttctccaatttcgaagaggatttgagtttctaaactacccggtatacagtttggcctagagtagagttggcctttgcatagcgtcctgtcggctgtcgcggagctatacaccccataggaaactgttagattattgtattctgtttgtatctctactatctctactactattatgattctaccgtagtcgtccacacccggtggacggtgtacg

SEQ ID NO: 5054 - DNA, 1087 bp, Zea mays
  misc_feature (1060)..(1060): n is a, c, g, or t
ggggtaccctccgggtcccgccgggaaaaagttgctttttttctcgggtaaacacgcgcatcgaagcaagccagcagcaacaaaagagacgagccttttcgctcgccgctaccaccacctcgttgtctcgcctccgcctcggcctcagcacgcgcgcgggatctcgcgctcgctcgcgcaccgaggagcgcgcacccacccgcagggttcggggcggggtgatccagcggcgatggcgagccgggtcaaggaggacgagaggcacgagaagatcatccgcggcctgctgaagctgcccgccaacaagcgctgcatcaactgcaacaatttgggaccacaatatgtctgcacaaatttctggacctttgtttgtaccaattgcagtggatcacatcgggagtttacgcatcgagtaaaatctgtttccatggccaaatttaccgcacaagaagttgctgcccttcaagaaggggggaatgagcgtgctagagaagtatttttcaaggaatgggatcctcaacgaaatggataccctgacagcagtaacgctgacaaattgagaaatttcattaagcatgtgtatgtggaacggagatacacaggagaaaggagtactgataggccaccaagggcaaaggatgacaaggatgagtatagtgaaaatagaagatctgatggaaattggggtggttcgagaagtccgccaaatggaagttactctgatcgtcagagttatagcggacggagtgatgacagaaattccagatattcctatggggaccgtagtcctggctatgaccaaaatgactataagagaagtcctcgctactttgaggttggtgataatagatctggaaaaacactccaattcaagggtttgaagacaggaggttttcagagcccagaaagcgagatagtgggtctccagacttccagaaagaagctgatggttctagtcctgttgtacggccagtgagggaataatattgggtgacaacgctcctcaaactttcggggtcggtgaaccctttcaaagccagctactgggagcctgcaaagnccaactgtagtccagaaccaattgatc

SEQ ID NO: 5055 - DNA, 875 bp, Zea mays
atactgtctcatatactccactccagtccccgcgctgcatccttccgcttcctctcgctccctctgctctctcgcggtcgcagtctcgcagatcccgatcgcgcaaggagccagcgtagagggtgatcgacgatggcgggcagcacgcgcgcagcgcacaaggcgttcctgctctgcaactacacgctgctgggtgcagcatcggcgtgcatcttcctcacgctctcgctccgcctcgccccgtccgcgtgcggcctgctcctcgtcttcctccacgcgctcaccgctgtcttcgccgccgcgggctgctcgggctccttcaccgacggcggcgccggggccggccgcgcgcacgccgcgcacacagcgggggccgtgctcaccgccatcttccagggcgccgccgcgctgctcgccttcacccggaccgccgacttcctagccgagctgcggtcctacgtccgggaggaggacggcgaggtcattctcaagctcatcggcgggctcggcaccgccatcttcgtgctcgagtgggccgcgctagcgctcgcattcgcgctccggcttgacgatgatggcaacgaggagattgacggtgagcactgcaagagctgggcgtcagcgtaccatgtctgattctgctctgttcagacaccggagacgcgagagatacaggcacacaaaccagaaattgggggggggggggattttctcttctattatttacagctgtggatctattccgctgttgttacttgttactgtggtcatgaaccgaagtgcaaaggcaaatgttttgctttgcaatgtattcaattcatctcttagaaattgcaataaagtacattcagtgagccgtaaaaaaaaaaaaaaaa

SEQ ID NO: 5056 - DNA, 2173 bp, Zea mays
gactattccgtcccaattccccgtgtacctgtctcacgaatttatgttaatctaaattactccattgacttgttaaaagtataataaaaactcaatacatagtctattataaaatagcaaactaaactctaatgtagatgtaccttataattttaaattttgtttgttaaatttatattgatttgatatagatatgttaaatttcgtctttagatattgcacttcctagcgatgatggattcttcactgggataaattccccgatggggacggggataggaaaaaaagctctcttgtgagcgttcgtggggatggagatggagaattttctcctcacacggatggggagtcattcccctacgtggaattttcagttgccattcctagccatacccatacccacttgagaaaaaacacctaactacccatactccactatctatcatgggtgcaaaattaccacatatccaaacccaccacgggtacatagaggatagccatcgggtaccaatacccaccagcattctaatagacatgttcttttttaatcacaaaagtaggcaccaaatacaaaatattgaagtcacatatggccatatctcaataataacaaaaaagtactaaaatagaatattatctttgtgtcccgtatgacaaatttattgaactcaatatatttttatcacaaatttaataacatttaacattaaatgacagcatcttagggcgtggcttgggataggataaacccgagaattcacgtagtcgttgtctatccggggcaggacgtaacaactgcctctagcttgtttggtttcctatctaaggtgtcacagtctgtctaatcttaatagcttcaaagaactaagtttagataaaaaaagttagacacctggagtcgctttagacaccaaatcaaacaggcactcgacggagcctgctttgttcaacgtgtgtgcgctcgcccaaacaactccttcctaccaacactacttttgttttattaatcgtcgtccgattagtgggcacgagaccattacctagaacatcctaatcgaaaaacggacaccatcatttgactgctccgatgtctgccactctgccaactttctcgaaaatctacctcccctttccgcgctatatatgctttgttgttttacttgttggattggacgagttcatcgaatggacgggctgcagaggtcggcgcagacattcaggaggtcgggctcgtcggggctggtctgggacgagcgcttcatcaccgagggcgccggcgcggcggcgccacgccagcagccggagctgcggcactcgaggagcgtcggcagcgtcgccatgctgctgctcggcggcgaggcagatcgcgacgacaagaggaagctgacgctggccaagccgaacctgaagggccaccacaagaagcaggaggagctggtgcctggcaggaaggcgtttcggaccagggacgtagccccggccgccgagccaccgtcgccgagggtgctcgccatctgctgcgcgccctgctccatcttccgggatgccggcgccggtggctcgtcgtctctggcgcggcgggccaagaagcggtaggataggaaaatcaatatgtttattttttcgggttcatggtatgcttgagacgaagtgtaaccgtacggggggatcgtgaccaagtggctcgcgcgtacgtacgatttgaggctcataaaatctctctgattctgaataaatttgtactacatgatggataatctgttcaaccaagcgcctatcgagggaagtaggtaacgatcaacgattgctcttcatgtctacgatacttttgaaccacgcttaagataatcgacttctctctctctcgtggatttgcttcgaagtttaagattcatggcctaccatcatatagatactctctaatcctcttattactaaaccagtcttagcactgtttggaaactcaaactgctatataccctttgttgttctcgttagattctttgatgcctaggatcgattcctaagccccatgaataccaatatgtatctaggaaattctcgatgacgaataaatttattcaactgagaaaaatagggtaacataccttcgttgttgaagtgttgacgcgtcctatctagatggtagtggagcgtggtcggctggtcgctg

SEQ ID NO: 5057 - DNA, 2168 bp, Zea mays
tgtctgtctgtcactttgtccacctcagcagtcaccacgcgtcccaactgccagtgccaacccagtctccaaggccacaaccacggctcccggctggctccaggctctagttccaacctccacctgcgccgcccgatagcaaaacgcagcgacctcgccccccctgccccgctcctccccttttcccggtagcagagacggagcaccgcagcccgccagaaaggaagacgaaacgcgccgcggcgcaacgcaccgcgtgctagtgaaagggcgcagcggaaggccgccgccgcgctgctatttagacaggaagcggggcgatcgaatcgcgtctctcaaccaatcgataaatctgccggtaggtcgatcaaggagagcgcggtccacgtctccgttccgttccgttgcggggaaggaaggaaggagagagaggagcgatggcgtccgggtaccgcgcggaggaggagtacgactacctgttcaaggtggtgctgatcggggacagcggcgtggggaagtcgaacctgctgtcgcggttcgccagggacgagttcagcctcgagaccaggtccaccatcggcgtcgagttcgccaccaagaccgtccaggtcgacgacaagctcgtcaaggcacagatctgggacaccgccgggcaggagaggtacgcccttcttcgctgttgtacgctatgcaggttgcagatgcagctctaggatctgtgcaccatttttcagggcttcctggttagtagtaaggatttagttaatggttgctaatacggaaacttaagcgtaaccgacggtttccaacatacacctgtgcttctgattcgcatttcaaaaatgaaaccaaaccactggcctgttcatgactatgttttacggctgaatacgagattgatgtccatactactacagttgggagttcatgccgtaatgaatccatcaattaacatagcatcgcgatcgcgatcactaaaaagcgcgcgcgcttttcagattgttgcttgcgtatcacattttattcaactccagctaactttacgtgcgtttcgctagcgtgccattcagtgtcctcgaccctttcggcgatcgcagctgattgcttgtgtgccggcctcaggtaccgcgccatcacgagcgcatactaccgcggcgcggtgggcgcgctggtggtgtacgacgtgagccgccgcaccaccttcgacaacgcggagcgctggctgcgggagctgcgggaccacacggacgccaacatcgtggtcatgctggtgggcaacaaggccgacctgcgccacctccgcgccgtctcgcccgaggacgcggcggccttcgccgagcggcacggcaccttctccatggagacgtcggcgctggacgccaccaacgtggagcgcgccttcgccgaggtgctccgccagatctaccacgtcgtcagccggaacgcgctcgacatcggggacgaccccgccgcgccgcccaggggcaagaccatcgacgtcagcgccgccaaggacgaggtctcccctgtgaacgcgggcgggtgctgctcgtcggcttagccctggtcaaacatacgctttgctgattaaggaagacataacgtgatgacaatctttgttgacttcgtcaagcggttgggggtggttggcgctcgtgatgtgtttgcagactagcaatcgctgtcctcgattgtatttttcgggctattttttgattgatgcacttgggtgacgcacacatttacaagtggcaggttatggaccatatggggagcgatttacactgatttggatgaaaaaaaaaaaaaaaatgacatgttttgacaacttcgagcaaaaaaacatggataaattgccattttgatgccgtcatcttcaaaaaaaaatgtacagcaggatccatgttctattaattccatcaaagtaaataaatatatacagtgctgcctacgcctacctagagatgccatttgtctccctggttcgccacttcgccttatcatacatactggagggcgaacatttaatacattctacatttcaagaaaaagaatacggtggtgcatatttcatattctcatctacagagtcaacacatgcatactaaacatcattcaagctaccactctaactaagatccatgcctacacaagcagcaaggggcgcg

SEQ ID NO: 5058 - DNA, 1496 bp, Zea mays
aagacatcagcctctgttatcctggcccacacatcagcctccctggagtaagcgtggtagttgccactgccgtcccctccagaagtgcgaaacgggatacagttcggattcagatcgcggccggtgcgaacccacgaaggcacgaacggtagaacccgaccgagcgcggcagcgcaaacctccgatccctgctgcgagcaagggatggcggcggcatgggcagtgctggcggcggtcctcgtcgcggcgcaggtggcgtctgcggcgccggtcacggcgccagcgttcctctgggcgcctaagaactacggattccgctctgatgatgctaaggaggtagtccattatcaaacaatctcaccaaagaacttagctaaatctgttcttgaggaaggtggctggtcaacctttatgtgttcaagggaggatactgagaagcatgttgatgttgccattgtttttattggctcaaagctacaatcatcagacatatcgaaagataagcaagttgatccagctttagcagatacattgaagctctccttcacagaatcagagttttctatggcattcccctacgtttccacatcagacgatgagaaactggaggagtcattgctatcaggcttcactgagaactgtaaaagtggttttggaagaaaccgtatcacctacacagacacgtgcgccgtgagtggccaagatctgaagacgtatcacaacatggatgctatcaatgacttggtagtgtcaggaagaaccaacccgagtggacagactgatgtaatcgtcttctgcagcggcgggttcgagaagttaggcaccacggaatcggaaggggagctgctttcccagcttgtcgacttgctgaagctgtctggggctagacacacgattctctacgcttcccagccatctggttatctactggagaacccttccggctcgccagtggctaggcaccttgcggagaggactaacggtacaaaaactggcctactgagcaaatgtgacggagagtgcctagtcaaatcaactcttcttgaaggaacctttgtcggaatagtgctccttatcatcttgatatcagggctcatgtgtatgatgggaatcgatactccctccaagtttgaagctccccaggagtcttgatctcccttcgaagcagaacccttgttttgttggtctgcactgtggatagatattattcagtttccccctttgaaagcgcctttcgtataattattattatttttttactgagccatctgttatttacgatgtgctcaaacttttgacaccaaacgaatgcatgtgtgtgaggcttgtgctgtgaccagacatagcattgcctccaggtgttttctgtgaataacctggaatttcaggtgggtactgtgcatcaaataaaaaagatgaaatcttgctgttgcaaaaaaaaaaaaaaaaaaaaaaaaaaaagcgcgggggggctcgaggggggggcccgggtaccc

SEQ ID NO: 5059 - DNA, 1581 bp, Zea mays
gaagtaagcgtggatgttgcccacgtggcccccggctcctccagaagtagccatacggattcagatcgcggccgcggcgactccccgagcagaagaacccgatcgaacgcggccgcggcggcgactccccgatctcagatccctgctgcgagcgaagggttccattcgagcagagatggcggcggcatgggaggtgctggctgtgttgctcgtcgcggcgcaggtggcgtcggcggcgcaggtcacggcgccagcgttcctgtgggcgcccaaaaactacggattcagctctgatgatgctaaggaggtagtccattaccaaacaatctcaccaaagagcttagctaaatctgttctcgaggaaggtggctggtcaaacttcatgtgctcaagggaggatactcagaataatgttgatgttgccattgtttttattggctcaaagctgcaatcgtcagacatatctaaagataagcaagttgatccagctttagcagacacactgaagctctccttcacacgctcagagttttccatggcattcccctacgtttccacgacagtcgacgagagactagaggactcgttgctatccagctttgccgagaactgcaacaatggtttcggaagaaaccgcgtcacctacacagacacgtgtaccggtcaagatctgaagaaataccacaacatggatgccatcaatgacctggtagtgtcaggggtagcgtcaaggagagtcaaccacccaagtggacagaccgatgtaatcgtcttctgtagcggcgggttcgagaatccaggcactgcgaaatcagaaggagagctgctttcccagcttgtggactcgctggacttgtcgggagccaaatacacggtcctctatgcgtcccaaccgtctggtttgctggagagcccttcgggcctgccgctgggtaggcatctcgcggagaagaagactaacggcacgaaagctgtccagggcgaaaaatgcgatggcgagtgcctcgtcaaatcgagtctcctcgaaggaactttcgttgggatagtgcttctcatcatcctgatatcaggactcatgtgcatgatgggcatcgatactccctcgaggtttgaagctccccaggagtcttgatctctcccttggactgcagaatccgcgggggggttgtgacgagggcacgcggcggcgttgaggggggccggtgttctgttggtgtgcactgtggatatatattgtttagcttcccatttggaagggagtacgccttgtgtattttttttaccgagccaactgtcactcacgatgtgctagaattttttggtgtaatatttgcgtttcgcgcctatggacaactaataagctgaggcattgcagcagataaattcatgtgctgcgtgaggcaggcttgtgttgtgtaccagacgcacagcattgttgcctccagctagtgctttctgtgtgaaataaacctgaaacccagtcccaggccaccgcaccaataaagatgggtactatgcatcaatcaaaaaaaaaaaaaaaaagcactaaaaaaaaaaaaaaaaataaaaaaaaaaaaaaaa

SEQ ID NO: 5060 - DNA, 2001 bp, Zea mays
ttatgattttaccccagattttttaactatatgattttacccattcgtttgaaaaacgaagggttaccataccctggtgtcgttacgtgtagttaactctattaaatctgatgcgaaaagacaaaagtatccatgcaatttattgtgcttttactttttgttatattatgcatttgtaattttgctcttgttggggttgcgccttaaaaaataggagggtggttggacctttcacccttttcttttcttttcttttctcatttttttatttttaatcactaattctgatttttcaataacagagttgagatggaggtgcaaaagtaacttcgttcaaaacggaggaataaaatcacaaaattgaaaaccagagggtataatcataattacaaggccagtgaaagtaatataatcacagttatcccaaacaataacacgagccgggttggacacgtaagacatcagcctctgttatcctggcccacacatcagcctccctggagtaagcgtggtagttgccactgccgtcccctccagaagtgcgatacagttcggattcagatcgcggccggtgcgaacccacgaaggcacgaacggtagaacccgaccgagcgcggcagcgcaaacctccgatccctgctgcgagcaaggggtaaggtttttccaagatcgccccatgctcggatacctaatatcgatttccgccagcggttttcctcatttttttctctccctctcttgcccggtgatcggtcgggatcgattcgagcagatggcggcggcatgggcagtgctggcggcggtcctcgtcgcggcgcaggtggcgtctgcggcgccggtcacggcgccagcgttcctctgggcgcctaagaactacggattccgctctgatgatgctaaggaggtagtccattatcaaacaatctcaccaaagaacttagctaaatctgttcttgaggaaggtggctggtcaacctttatgtgttcaagggaggatactgagaagcatgttgatgttgccattgtttttattggctcaaagctacaatcatcagacatatcgaaagataagcacgttgatccagctttagcagatacattgaagctctccttcacagaatcagagttttctatggcattcccctacgtttccacatcagacgatgagaaactggaggagtcattgctatcaggcttcactgagaactgtaaaagtggttttggaagaaaccgtatcacctacacagacacgtgcgccgtgagtggccaagatctgaagacgtatcacaacatggatgctatcaatgacttggtagtgtcaggaagaaccaacccgagtggacagactgatgtaatcgtcttctgcagcggcgggttcgagaagttaggcaccacggaatcggaaggggagctgctttcccagcttgtcgacttgctgaagctgtctggggctagacacacgattctctacgcttcccagccatctggttatctactggagaacccttccggctcgccagtggctaggcaccttgcggagaggactaacggtacaaaaactggcctactgagcaaatgtgacggagagtgcctagtcaaatcaactcttcttgaaggaacctttgtcggaatagtgctccttatcatcttgatatcagggctcatgtgtatgatgggaatcgatactccctccaagtttgaagctccccaggagtcttgatctcccttcgaagcagaacccttgttttgttggtctgcactgtggatagatattattcagtttccccctttgaaagcgcctttcgtataattattattatttttttactgagccatctgttatttacgatgtgctcaaacttttgacaccaaacgaatgcatgtgtgtgaggcttgtgctgtgaccagacatagcattgcctccaggtgttttctgtgaataacctggaatttcaggtgggtactgtgcatcaaataaaaaagatgaaatcttgctgttgc

SEQ ID NO: 5061 - DNA, 2893 bp, Zea mays
aagatctccgtgctcgatagctcacatcgattcccgccagcgggttccctcaaaattttcggtctctcttcttcccacgggaccagcagtgttcgattcgagcagagatggcggcggcatgggcggtgctggcgcggctccccgtacgcagaagaacccaggtggcggcacgcggcgccggtcacggcgccagcgttcctgtgggcgcccaaaaactacggattcagctctgatgatgctaaggaggtagtccattaccaaacaatctcaccaaagagcttagctaaatctgttctcgaggaaggtggctggtcaaacttcatgtgctcaagggaggatactcagaataatgttgatgttgccattgtttttattggctcaaagctgcaatcgtcagacatatctaaagataagcaagttgatccagctttagcagacacactgaagctctccttcacacgctcagagttttccatggcattcccctacgtttccaccacagtcgacgagagactagaggactcgttgctatccagctttgccgagaactgcaacaatggtttcggaagaaaccgcgtcacctacacagacacgtgtaccggtcaagatctgaagaaataccacaacatggatgccatcaatgacctggtagtgtcaggggtagcgtcaaggagagtcaaccacccaagtggacagaccgatgtaatcgtcttctgtagcggcgggttcgagaatccaggcactgcgaaatcagaaggagagctgctttcccagcttgtggacttgctggacttgtcgggagccaaatatacggtcctctatgcgtcccaaccgtctggtttgctggagagcccttcgggcctgccgctgggtaggcatctcgcggagaagaagactaacggcacgaaagctgtccagggcgaaaaatgcgatggcgagtgcctcgtcaaatctagtctcctcgaaggaactttcgttgggatagtgcttctcatcatcctgatatcaggactcatgtgcatgatggggatcgatactccctcgaggtttgaagctccccaggagtcttgatctctcccttggactgcagaatccgcgggggggttgtgacgagggcacgcggcggcgttgaggggggccggtgttctgttggtctgcactgtggatatatatcgtttagcttcccatttggaagggagtacgccttgtgtatttttttgtaccgagccaactgtcactcacgatgtgctagaattttttggtgtaatatttgcgtttcgcgtctacggacaactaataagctgaggcctgaggcattgcagataaatccgtgtgctgcgtcaggcaggcttgtgtggtgtaccagacgcacagcattgttgcctccagctagtgctttcctttctgtgtgaaataaacctgaaacccaggcccaggccaccgcaccaataaagatgggtactatgcaatatgcatcaatcaattagaatgagatcttgcttttgtttgatgagaatcagataagatattgctgtgttgatgatatgtgtgggcccgagctaatggatcagcaggcgctatagttccagttgactccaactacaaatatgttcccacatactcccaatgcttgcggcctctccgacaatttgagacgaatacgtactaagcaaagttgttggagactactcgtactaggcaatgtatacgtatgtatggtcggtgccgacgacgacgatgacatgcatgctgtggccatacgcaggctgccagatcagcgcgctcgtgttagcctctctgactcaggaaccgcgtgcagtgtggccgggtatactcacatccatagcagtttgtttcagcttacagattatataatctgaattacaatctaaattatataatttaaattataatttaaatagattataatctatatatagctttttagtagtctagattatataaatatagattatttatagagacaacagtatcttttttttttttgaggtggggaaagaaggatgacatatattgtaatttctatttacataaccattggtagtgcgtgttttgccaaaaataatctcaaataagttactctcaaggagattatgagattatcgtaatatagactttagattatataatataaacccataatctagatgtttgtttacttgctagattatttgcgctggattatataatctgaagagattataatccaaaacaaacagggccttagactatttccggcagctcactcatcctcatcctcgtattagaactttactctgcaaacagtgcagtctgcagtgtaaaatggtgcaaaacaatgttttaggtgaccatacgggtaaattgttgaacacggtcttatccatcatatctcatatcatatttctaaattcaaacttcaatctacaaacaatacaatctacagtgaaaaccgtattgtgcatgacaatatgtatgatctgtgggagacagcctcagtggcattagagttattctcggtgacaccatttcaacaaaagttttcctttaaaattgacattattttttgtggcccggccctaggccaaccactgaaaataatttggacacgacttttttttgcggctgctaatggatgctgccaataagccaacttattttcgacggcgtgttctagccgccaaaaataagttggtatatttttggcgcatattagcggccaccgaaaatagatcattttcaggatctagaatattattactgtatgcatgttttttttcacacgccgtatggtttacgaattgaaacttcatatttcttatacgaaaacaatcctaatgcatgcacggcgccggcgcatctgggctacgcatgatgcatgcatccactgcag

SEQ ID NO: 5062 - DNA, 1455 bp, Zea mays
gaagtaagcgtggatgttgcccacgtggcccccggctcctccagaagtagccatacggattcagatcgcggccgcggcgactccccgagcagaagaacccgatcgaacgcggccgcggcggcgactccccgatctcagatccctgctgcgagcgaagcagtgttcgattcgagcagagatggcggcggcatgggcggtgctggctttgttcctcgtcgcggcgcaggtggcggcggcggcgccggtcacggcgccagcgttcctgtgggcgcccaaaaactacggattcagctctgatgatgctaaggaggtagtccattaccaaacaatctcaccaaagagcttagctaaatctgttctcgaggaaggtggctggtcaaacttcatgtgctcaagggaggatactcagaataatgttgatgttgccattgtttttattggctcaaagctgcaatcgtcagacatatctaaagataagcaagttgatccagctttagcagacacactgaagctctccttcacacgctcagagttttccatggcattcccctacgtttccaccacagtcgacgagagactagaggactcgttgctatccagctttgccgagaactgcaacaatggtttcggaagaaaccgcgtcacctacacagacacgtgtaccggtcaagatctgaagaaataccacaacatggatgccatcaatgacctggtagtgtcaggggtagcgtcaaggagagtcaaccacccaagtggacagaccgatgtaatcgtcttctgtagcggcgggttcgagaatccaggcactgcgaaatcagaaggagagctgctttcccagcttgtggacttgctggacttgtcgggagccaaatatacggtcctctatgcgtcccaaccgtctggtttgctggagagcccttcgggcctgccgctgggtaggcatctcgcggagaagaagactaacggcacgaaagctgtccagggcgaaaaatgcgatggcgagtgcctcgtcaaatctagtctcctcgaaggaactttcgttgggatagtgcttctcatcatcctgatatcaggactcatgtgcatgatggggatcgatactccctcgaggtttgaagctccccaggagtcttgatctctcccttggactgcagaatccgcgggggggttgtgacgagggcacgcggcggcgttgaggggggccggtgttctgttggtctgcactgtggatatatatcgtttagcttcccatttggaagggagtacgccttgtgtatttttttttaccgagccaactgtcactcacaatgtgctagaattttttggtgtaatatttggctatttgcgtttcgcgtctacggacaactaataagctgaggcctgaggcattgcagataaaaaaaaaaaaaaaaaataaaaaaaaaaaaaaaagtaccagacgcacagcattgttgc

SEQ ID NO: 5063 - DNA, 2130 bp, Zea mays
caaccaattatatgattatgttgattttgaatgttttttacccaaataaattttatagaagctggctgaaaagttgagtgtttggcagtccgcagcagcttttggtggccagaaactgtgaaaaaccgaaacaaacagaggctatatagtgccaccaaacacgaaaacctggcatccgtaatttctttattccttctagtctagacaaagcataagggcaatactagtagtctacttttccaagagccaatggatactctcatcgctcctggacaaattaattttaagggttgttttaggttaaatttctaaatgtttgactggccttaataaaagagcattatgtcatagattactgtcattaaatacaccataaactataattttctaataatcttatttgctgtcataatttctaaatgttttttacaaacctgattaaatatagaaaatgatctgaagacagctctagaaattgacggaggaagcgtgtggcatgcagcacgagatgaacaaaaaaaaaggttacaaggatgatgccgggtgcgcgtagctaggcacgaccctgtggcctcctgtctgtcgtgagcacgcttcgcttagcagcatatgccagtaaatattcggaaaaccgccacggccgacctcgccttctgcctctccgatccgcatctccgatccgcatctccgcttagtatatacatggggattggtagcgagcgattgattacactgggtgaccatcatcatcagtaactaataattactttagattagaagcaaagggaagcgaagcaagaatcgatcgagtcgagaagatggtgcagttcggcaagtggctgaggaggcagatcgagcggagcctcccggagtggcaggaccagttcctgcgctacaaggagctgaagcggtgcgtcaaggcccgctccggcggctgcccgccgttgcccgcggaggaggccgagttcgtggccgagatcgacgcggagaccgagaagatcaacgccttcttcctcgaccaggaggaggagttcatcatccgccaccgggagctgcagaaccacatcgagcgcgcgctgggccgcggcaggccggcgccggcgccggcgctgcacgaggccgaggtcgccgccatccgcagggagatcgtcaacttccacggcgtcatggtgctgctcctcaactacagcagcatcaactacataggtaggacttaggagctctagctctagctagctagctgtacggagttgaattgaaagcctgcaggtctgtccttttgcccatgcatgtctcctctccatgcatgatgattctaaccaatcccgttccatcctccatgtctggctgctggctgctggctgcttgcaggcctggccaagatcctcaagaagtacgacaagcgcaccggcgcgatgctgcggcttgccgtgatggagtcggtgctgcagcagcccttcttcaagacggagacggtgtcgcatctggtgcgggagtgcgagtccttgatggaggccgtgttcccggaggcgcgcgatcggggccaggccgccgccgcggcgctcgccgtcgcggaggcggagcagggcatcttccgcaacaccgtggccgcgctcctcaccatgcaggacgtccgcgcggggagctccaccagaggaagccactcgctgccgccgctcaacctgccggactccgactggctacggtccttcgacccgccgtttccgatcccgacccgatgacacttgttgctcgccgctcctagttggcttgcgccagcctcctcgatctcccttccttttcgtctagcttcttggcccgcccggtcccggcccggtacatgctgtgcactgtgcttgccttggttttccattttcccgctttctaagttctaattaactaatgtatgtagagtgcagtagtgagactacagtaaataaatgtaatttactggaatgacagccgagagaacgtacaagctcatactcaatttggttccaattttgtggaaaaaaaaaaaaaaaacctactgttaacggtgaaaatcgctgtgcagcggctcctgatgggtcaaaaggtcaaaaatccaccagacaacctttacttctatagttgtagttgactgcaggc

SEQ ID NO: 5064 - DNA, 1243 bp, Zea mays
ggaaaaccgccacggccgacctcgccttctgcctctccgatccgcatctccgatccgcatctccgcttagtatatacacggggggtgcctccgggccggccgggacactgggtgaccatcatcatcagtaactaataattactttagattagaagcaaagggaagcgaagcaagaatcgatcgagtcgagaagatggtgcagttcggcaagtggctgaggaggcagatcgagcggagcctcccggagtggcaggaccagttcctgcgctacaaggagctgaagcggtgcgtcaaggcccgctccggcggctgcccgccgttgcccgcggaggaggccgagttcgtggccgagatcgacgcggagaccgagaagatcaacgccttcttcctcgaccaggaggaggagttcatcatccgccaccgggagctgcagaaccacatcgagcgcgcgctgggccgcggcaggccggcgccggcgccggcgctgcacgaggccgaggtcgccgccatccgcagggagatcgtcaacttccacggcgtcatggtgctgctcctcaactacagcagcatcaactacataggcctggccaagatcctcaagaagtacgacaagcgcaccggcgcgatgctgcggcttgccgtgatggagtcggtgctgcagcagcccttcttcaagacggagacggtgtcgcatctggtgcgggagtgcgagtccttgatggaggccgtgttcccggaggcgcgcgatcggggccaggccgccgccgcggcgctcgccgtcgcggaggcggagcagggcatcttccgcaacaccgtggccgcgctcctcaccatgcaggacgtccgcgcggggagctccaccagaggaagccactcgctgccgccgctcaacctgccggactccgactggctccggtccttcgacccgccgtttccgatcccgacccgatgacacttgttgctcgccgctcctagttggcttgcgccagcctcctcgatctcccttccttttcgtctagcttcttggcccgcccggtcccggcccggtacatgctgtgcactgtgcttgccttggttttccattttcccgctttctaagttctaattaactaatgtatgtagagtgcagtagtgagactacagtaaataaatgtaatttactggaatgacagccgagagaacgtacaagctcatactcaatttggttcccattttgtggaaaaaaaacctactgttaactgtg

SEQ ID NO: 5065 - DNA, 1139 bp, Zea mays
aaaaacactgggtggccatcatcatcagtaactaataattactttagattagaaagcaagaatcgagtcgagaagatggtgcagttcggcaagtggctgaggaggcagatcgagcggagcctcccggagtggcaggaccagttcctgcgctacaaggagctgaagcggtgcgtcaaggcccgctccggcggctgcccgccgttgcccgcggaggaggccgagttcgtggccgagatcgacgcggagaccgagaagatcaacgccttcttcctcgaccaggaggaggagttcatcatccgccaccgggagctgcagaaccacatcgagcgcgcgctgggccgcggcaggcccaggccggcgccggcgctgcacgaggccgaggtcgccgccatccgcagggagatcgtcaacttccacggcgtcatggtgctgctcctcaactacagcagcatcaactacataggctgctggctgcttgcaggcctggccaagatcctcaagaagtacgacaagcgcaccggcgcgatgctgcggcttgccgtgatggagtcggtgctgcagcagcccttcttcaagacggagacggtgtcgcatctggtgcgggagtgcgagtccttgatggaggccgtgttcccggaggcgcgcgatcggggccaggccgccgccgcggcgctcgccgtcgcggaggcggagcagggcatcttccgcaacaccgtggccgcgctcctcaccatgcaggacgtccgcgcggggagctccaccagaggaagccactcgctgccgccgctcaacctgccggactccgactggctccggtccttcgacccgccgtttccgatcccgacccgatgacacatgttggcttgttgctcgctcctagttggcttgcgccagcctcctcgatctcccttccttttcgtcttcttggcccggtacatgctgtgcttgccttggttttccatttttcccgctttctaagctctaattaactaatgtatgtagagtgcagtagtgagactacagtaaataaatgtaatttactggaatgacagccgagagaacgtacaagctcatactcaatttggttccaattttgtggaaaaaaaacctactgttaactgtcaaaaaaaaaaaaaaaa

SEQ ID NO: 5066 - DNA, 1235 bp, Zea mays
  misc_feature (25)..(25): n is a, c, g, or t
ccggccgggagcatatgccagtaanatattcggaaaaccgccacggccgacctcgccttctgcctctccgatccgcatctccgatccgcatctccgcttagtatatacatggggattggtagccggcgccggccgggcactgggtgaccatcatcatcagtaactaataattactttagattagaaagcaagaatcgagtcgagaagatggtgcagttcggcaagtggctgaggaggcagatcgagcggagcctcccggagtggcaggaccagttcctgcgctacaaggagctgaagcggtgcgtcaaggcccgctccggcggctgcccgccgttgcccgcggaggaggccgagttcgtggccgagatcgacgcggagaccgagaagatcaacgccttcttcctcgaccaggaggaggagttcatcatccgccaccgggagctgcagaaccacatcgagcgcgcgctgggccgcggcaggcccaggccggcgccggcgctgcacgaggccgaggtcgccgccatccgcagggagatcgtcaacttccacggcgtcatggtgctgctcctcaactacagcagcatcaactacataggcctggccaagatcctcaagaagtacgacaagcgcaccggcgcgatgctgcggcttgccgtgatggagtcggtgctgcagcagcccttcttcaagacggagacggtgtcgcatctggtgcgggagtgcgagtccttgatggaggccgtgttcccggaggcgcgcgatcggggccaggccgccgccgcggcgctcgccgtcgcggaggcggagcagggcatcttccgcaacaccgtggccgcgctcctcaccatgcaggacgtccgcgcggggagctccaccagaggaagccactcgctgccgccgctcaacctgccggactccgactggctccggtccttcgacccgccgtttccgatcccgacccgatgacacatgttggcttgttgctcgctcctagttggcttgcgccagcctcctcgatctcccttccttttcgtcttcttggcccggtacatgctgtgcttgccttggttttccatttttcccgctttctaagctctaattaactaatgtatgtagagtgcagtagtgagactacagtaaataaatgtaatttactggaatgacagccgagagaacgtacaagctcatactcaatttggttccaattttgtggaaaaaaaaacctactgttaacg

SEQ ID NO: 5067 - DNA, 1179 bp, Zea mays
tccgccattgcagtagtacgccatctgcgtgcggtcgtgtggaactgtagtgctggacatcctcgccttccagccttctcgaaaatcgaaaccctagaccgcgcgccccctcgccctccggccttccacgtccgatccgatccaaaatgcataagctaggcagaggaagccgggacaaggtgcaacagttcatggcaattaccggcgcaagtgagaaagctgcccttcaggctcttaaagctagtgattggcacttggaaggagcttttgatgttttctacagccagccacaaattgctgttgctaatactcgacatctggaagagctctacaacagatataaagaaccagatgctgatatgataatggtggaaggcatatcacagatctgcaatgatttacaggtggatcctcaggatattgttatgcttgtcatatcgtggcatatgaaagcttccactatgtgtgaattcactcgccaggagttcattggtggactgcagtcaataggagtggattcaatagagaagcttcaggcgaagttaccttcattgcgagctgagcttaaagatgatcagaagttccatgaaatatacaactttgcatttgcctgggcaagggagaagggccagaaatctctcgcattggagactgctattggcatgtggcagttgctatttgctgaaaggagctggcctctcattgactactggtgccaatttctacaggtaaggcataataaagcaatctccagggatacatgggcacagttattggagtttgttaagacaattgatcctcagctaaccaactatgacgaagaaggtgcttggccctacctaattgatgaatttgtggactacttgaaagagaacggtcttgcctagcatagaaggtgtacggaattgggctgtaggggggagaatttgtcacccacaaggccaccatcattgtataacttaatggtcggatgcttgtattcattgcactaccaatagctaatgcggctcgtgcgtctggggatggagtttatcctctatatagacaaaacttgttgaatgatgtgggtgtaaaacgaaggctagaatggaagtcaagccctggttattgccattttgaattcccccccacctgcctcgcctacgtcattgtgactttgcaaaaaaaaaataaaagggc

SEQ ID NO: 5068 - DNA, 1491 bp, Zea mays
atttatggcggcccgcgccagcggcttctggttcctcacctcctggtcagaccaagcggcacgcacaagcgcagagccacggtgagcagagaagaaacgcatccacagaagggacaaacgtccggagcggattccacattccagtctcggtctcggtccatgggcgcgggaaagggaggagacggcggcgaggcggcgcccgaggccgcgcaggcgcagcccgtcgtgctgaagatgaacctgcattgcgccggctgcgcgcacaaggtcaagaaggccatcaagcgcgtccccggtgtggactccatcgtcacagacgtcgcggcgaacaaggtcgttgtggcggggacggccgacgcgggcgcgctcaaggcgcggctcgaggccaagaccaacaagcccgtggagatcgtctccgccggcggcgcccccaggaagcctcccgccgcggagcccaagcaggacgccggcgacggcgagaagcagggggtcaaaggcgcgagccccaacgaggaggagaaagagaaagagaaggggaagaagcaacaggcggaggagaaagagaaagagaaggggaagaagcagcaggtggagtcggtgctgctcaagatccgcctgcactgcgacggctgcgcctaccgcatcaggcaacgcatcggcaagatcaaaggcgtcaaggatgtggtgctggaggccaatgccaaggacgaggtggaggtcacgggcaccatggacataccgaacatggtctcctacctcaaggagaagctcaaccgcgacgtggaggccgtggtgctgcccgtcaggaaagacggcggcggcggcggcgagggcgagggcgagggcaaggacgacaagaagcacagcggcggcggcggcggcaaggacaaggtcgcggccggggcagccggcgacgacaggatgaacaagggcaaagggatcgaggcgtcggcggccggtccgtcaacggcggccgccgcggcgtacatgtctgcgccggcgggggcgagcacgtaccacgtggctccgccgcacgggtacgtggcgtatgagcaggccccgcctcctgccagctactatccctacccgtactacggctacggcagtggcgatggcatgggccacgccaacccctcctactaccagcagcagccgcagccgcagcccgacgggaaccagcagccgcaggtggcgtacccgccatacccgtaccaattcgacatggcgccggcgccgcagctcttcagcgacgagaaccccaacgcttgctccgtgatgtgacgccgccgccggtgcgtgtccttgttgcgttccgtcggcgagctcactgatccgccgtcagctttaaccttagccatccgggcatccggccgagaaagaactcgacctgtacatatcgtcaatgaggaatcagccttagtccagagccctaggattatattttcctgatgaaattttgcttcatttgtttaaccaaaaaaaaaaaaaaaa

SEQ ID NO: 5069 - DNA, 1799 bp, Zea mays
  misc_feature (1452)..(1452): n is a, c, g, or t
cattttcactgtgcttgctgtaaagattttccattattctgctttgtcatacaagcatccatcccacatttgttttttgccataatctttgctgattatagttagatttttcttttatctttccagaccgatggtataaagaaaataacaagtatccaatttatttgacagagaaaacgaaattctaccaaggattccgttgccctgtacgcggtgcaatgctataagtgctacaaatggagtacggttccaaaagaagaatttgagacgcttcgtgaaaacttcactaaggatccatggttctgcagcagacgaccagacagctcttgtgaagacgatgctgacattgagtacgacagcagccgcatttgggttttggacaagcccaacataccaaagcctccaccagagacggagaggctagtggttatgaggggcgactacagcaaaatggacacatattatgtcatgcccaatgggaagcgtgcaaggtgtgctggtgatgtggataagtttctggaggcaaatccggagtacaaagaccgcatatctgcttcggatttcagctttgcgccacccaaggttgttgaggagactgtttctcacaaccctgcctggcaagctgccaaggccaagaagcaggagaaggcagaggcacaaaagtgaatgatactcccaacggtgcttgtgttatgtttagatgatagtccgctcaagatcatgccccatcctatctagtgtgtacttgtctatctcgactgaagtcgatgtttaggtctttttagctgatttggctctgcatgcttcgttgcaacggagcccctgcgtgtcaattcctggggaataaatgagatgttgaataagtgctgtagagtgtagacctgctcttttataattaggcctcaagtcatgcttccttaatttctgcttcagttatccacttgcttggggctatcctatcctaatttgcttgggcctagttgttattgtatccagtatggtgttctggttagctggtgtaacacccctgatgttcaaaccaaattagatcccaaaatcagaaaattagcaagattataataaaacttgacaccttttatgaaaacattttctttaaatggcaaccatcacgtttaaaatgtaaaacatattttgaaataaaataatagaaaattcaatatatacatatatatacatacgtacggatataaaaaataaaataaatatacaaataatagtatttttaaaaaaatttaaaacttcaataaaatatctattttttaaaataataataataaatttagttgctctttgctaaagtttagtctatgtcatatcaaatgtttaaatgataattatatatattaaatatagtctaattacaaaattaatttcacagatgaaaattaaaagacgagacaaatttattaaatttaattaagtctatatttnatactcctaattgatattcaaatgtttgatgtgacccgaactaaactttgtatatgttgttcgtatgattggttgctggcctcctcggcgcttggctcaggcgggtctgcaccgtttgaaacacgctcgtcttacatccccacacacgcaggccaacggatgtaaaaagctacacctacatctgcgcgttcaagctcgggcactacggtccagtgaaccaatcacacgcgtaagaacagtcaatgaatgcaatgagtctagacatgggcagccgaacaaccaatcacgcgatatgtgattaggtgatagtctgcgcaagatcatgccccatcctatcaagggcatgt

SEQ ID NO: 5070 - DNA, 1031 bp, Zea mays
ccggccgggagttgacgaccaggccctccgcagtccgccccgcacaaacagatacagcccgtccattccccaatccccgtgtcgcctgtgcccctctgccacctcgccgtcggcatgacaacagggtcgaccccgggttcggccccctctcagagaaaacgaaattctaccaaggattccgttgccctgtacgcggtgcaatgctataagtgctacaaatggagtacggttccaaaagaagaatttgagacgcttcgtgaaaacttcactaaggatccatggttctgcagcagacgaccagacagctcttgtgaagacgatgctgacattgagtacgacagcagccgcatttgggttttggacaagcccaacataccaaagcctccaccagagacggagaggctagtggttatgaggggcgactacagcaaaatggacacatattatgtcatgcccaatgggaagcgtgcaaggtgtgctggtgatgtggataagtttctggaggcaaatccggagtacaaagaccgcatatctgcttcggatttcagctttgcgccacccaaggttgttgaggagactgtttctcacaaccctgcctggcaagctgccaaggccaagaagcaggagaaggcagaggcacaaaagtgaatgatactcccaacggtgcttgtgttatgtttagatgatagtccgctcaagatcatgccccatcctatctagtgtgtacttgtctatctcgactgaagtcgatgtttaggtctttttagctgatttggctctgcatgcttcgttgcaacggagcccctgcgtgtcaattcctggggaataaatgagatgttgaataagtgctgtagagtgtagacctgcttttttataattaggcctcaagtcatgcttccttaaaaaaaaaaaaaaaaaaaaagacagtaaaaaaaaaaaaaaaaaaaaaaaaaaaaaaaaaaaaaaaaaaaaaaaaaaaaaggaaaaaaaaaaaaaaaaaaaaaaaaaaaaaaaggggcgggcggttttaa

SEQ ID NO: 5071 - DNA, 879 bp, Zea mays
aacaaacagatacagcccgtccattccccaatccccgtgtcgcctctgtcgcctgtgcccctctgccacctcgccgtcggcatgacaacagggtcgaccccgggttcggccccctctcagagaaaacgaaattctaccaaggattctgttgccttgtacgcggtgcaatgctataaatgctacaaatggagtacggttccaaaagaagaatttgagacgcttcgtgaaaacttcactaaggatccatggttctgcagcagacgaccagacagctcttgtgaagacgatgctgacattgagtacgacagcagccgcatctgggttttggacaagcccaacataccaaagcctccaccagagacggagaggctagtggttatgaggggcgactacagcaaaatggacacatattatgtcatgcccaatgggaagcgtgcaaggtgtgctggtgatgtggataagtttctggaggcaaatccggagtacaaagaccgcatatctgcttcggatttcagctttgcgccacccaaggttgttgaggagactgtttctcacaaccctgcctggcaagctgccaaggccaagaagcaggagaaggcagaggcacaaaagtgaatgatactcccaacggtgcttgtgtcatgtttaggtgatagtccgctcaagatcatgccccatcctatctagtgtacttgtctatctcgactgaaggccatgtttaggtctttttagctgatttggctctgcatgctttgttgcaacggagcccccctgcgtgtcaattcctggggaattaatgagatgttgaataagtgctgtagagtgtagacctgctcttttatattttaggctcagtcaagcttcctttaaattctgctc

SEQ ID NO: 5072 - DNA, 1737 bp, Zea mays
cgctttcacttctcgccgttacccgacgcgtattctactacctggtgcattcatagacgccgatcgatacagtacattcaccgcagtttcttcaaaccgagtagcttgaggaatacaccggcgacctttccacatgggcagccactatatatattaatggcgtcgcgagccaacaacgcacgagacaaagggcctcacgctttccacatcgacacaaaaaccaaccgccgccacctccctccgctcgcgctagctgtgtgcgttccttgcctgccacaactccagcacttggagtcttcgacgacgacgacgacgacgacggcaggggaggagaaagagaaacaggcgggcgggtcatccatggagacggaggaggagacgacgcccaaggcgaagaagcggtcgcagtcgctgctcgggagcctgcgggaggcgatcaccaaggtccggttcctgctctcctccagcgcgacgcggtggatgctgctcaggtccctggcccgcggcggcggcggcggcggcgccccggcgcggcgcctcagcttcgacgcgcggccgggcctgctcgacaccatcgccgcgtcgccggactcctcctgcagctccaggacctccaggtcggccagcctgggcacggcgaccacccggaccctgtcgcgggccagcagcgccgcgtcgccggaggccctgacgagggcctcgtcgtcgtccggcggccgctccccggcgtcgtcggccggggacgacgacgtcgaccagcgcgccgagctcttcatcgccaacttctacaggcagctgcggatggagcgccaggtctcgctgcagctgcggtacgtcagggggaacagctgggacaggacccctggcgcaactccttctcctgcttcttccaggggatgatccgtagattgcgtagcgaaataagaatttgcaaggtagagatcctttcctttcagagcgcgcggtgacgcgatttagatgggtatcctctttttttttcctccatcgtttctgcacattcttttttttttgggtgctgaatagtactgtacagtttatgatttgcttggactcatgatcgagagtgtaataaatacaaaaaaaaagagagagagattgggattacagtctgtaaacaggtgaaaaattgggcggtcgttatgtgaaccaagaggaaaaggggaagcacattctgatgctcatttgggagtgtttgtgttcgattggtttggttgatatgttgaggaaaggccgagagcatcgctacaatttctgttcgaatagagcattgttcgtcattgttgtctgcaattaggacattttggtaggtaatatttatagagatgcagaaagcaagccttctcgtttcatttcatcctcctgtcctgacttgggaaacctgcacgcagaccttacaagtgtatgcatgcgtctgcatcctcctgattatcacaaactaaagctggctctagtagtatagccctatagagcattgcgccagcaggttgcaagcgccatccatgaggtaatgcattttttgatttgcttctccatccctccccttggttctcttcaatggatctgtcacaattggatcttcaaccggggctcgaatttgaagcaaatgtctgtaagaaatttggttcatcgatgtctccgccgccgagtgctcataaaagcatgttcgcttgactttaattcgtatcagtctctactgtttctacggtatttttgtat

SEQ ID NO: 5073 - DNA, 1295 bp, Zea mays
aaatcgaatccactggcccattcgtcttcaggactttctcgtgtagcatcatttccgctacccaaatctctccatccacggcgacgcccgacgccatccgtcagccagccccatctccaccacccctccccgtccccgacgtagcagcactgcagcagagcggagaggcggccaagccaactcctcaccggtagctcctccgcgctcccgggctccgtctcgccgcactcggatgccccctgcgctggcgcctagagcggcggcggtctagcgggcgccgggagcggtgaaatccacccatggccgacgctctcctccttccgtgccgcttcctcgcgccgttgtcagtcgcatccggcgcctcttcatcagcctcttcgtccccgccgtgtcgttgggtgctctcgtcgcccggctcgccgtggcggccgcgcttggctgccgggcaacggcaaccccgacctcgccggttcactcggcacaagatttgtgcagcagagcgtggtgagcaaccgaaatggtgggagaaaaatgctgggccaaacatgattgacatccactccacagtggagttcttggatgcactaagagatgctggagacaggcttgttattgttgagttctacggaacctggtgtggttcatgcagggctctctttccaaggctctgccggacagctttggagacccctgatgtattgtttctaaaagtgaattttgatgaaaacaaacccatgtgcaaacgactgaatgtcaaagtccttcctttcttccatttttatcgtggagctgatgggctactggaggctttctcctgttccttagctaagtttcagaagctgaaggatgccattgcaatgcacaacactgctcgttgcagcattggtccacctgttggagttggcgatgttgacttgctggatagcgcgagccctcaagagaaacctgcagaagctagcccacgttagattaatgataaggggctcctccccatccacgtctacatcctgctcattgttttcttcactatagaccttaatgtaatcagttcaggagaaccaaagtaccctcaattcatgaatcagatgtatggattatcgtacgcattcttgaaagggaaaaaagtgtataatagtgataactatacgttttttggacagaagaaccatgtacttgtacgtcattttaggtgaagacgtcatgagcatttaagcgcccttgtgggccgttttatcagtaaaaaaaaaaaaaaaaaaaaaaaaaaaaaaaaaaaaaaaagggcggctgctcgcgat

SEQ ID NO: 5074 - DNA, 1087 bp, Zea mays
gtgacagtctcatgggctttctcgtgtagcatcatccccgctacccaaatctctccgtccacggcgacgccagacggcatccgtcagccagcaacatctccaccacaccctccccgtccccgacgaagaagcacagcggagaggcggccgaagccgacgcctcaccaagtcaccagtagcttctccgcgctcgtgcgcgccttcccgcacttggatgctccctgcgccggcgcctagagcggcggccgtctagcgggcgcccggagggtgaacccaccgatggccgacgctctccttccacgccgcttcctcgcgccgttgtcagtcgtatccggagcctcttcatcagcctcttcgtccccgccgtgtctttgggtgctctcgtcgcccggctccccgcgccggccgcgcctggcggccggtcacccgcaaccccggcctcgccggttcactcggcacaagctctgccggacagctttggagaaccctgatatattgtttctaaaagtgaattttgatgaaaacaaacctatgtgcaaacgactgaatgtcaaagtccttcctttcttccatttttatcgtggagctgacgggctacttgaggctttctcctgttccttagctaagtttcagaagctgaaggatgccattgcaatgcacaacactgctcgttgcagcattggtccacctgttggagttggcgatgttgacttgctggataacgcgagccctcaagagaaacctgcagaagctagcccacggtagattcatgagaatgagctccacctcatccacttctacgtcctgctcattgttttcttcactatagatctcaatgtaatcagttgtggagaacataagtagcctcggttcatgaatcagatgtatggattattgtaacgcattcttgaaagggaaaaacatgtattatagcgtgataactgtaccttttgtgtttgttgtacagaaccatagaattgtacttcattttaggtgaagacgcctttgaacatttaagctcccttgtgggccgttttatagagtcagtcagtccaaaaaaaaaaaaaaaagaaaaaaaaaaaaaaaa

SEQ ID NO: 5075 - DNA, 1434 bp, Zea mays
ctgcaagtctgcaacattaataaggtagcccctttatttcccccttggtcattctactttaaattgttatctcgaaacactgaaaattctggtttaattaatgacactgggagcactacatttgtaacattgtacacgtgcaccggggcgtctggtcaccgtctcgcaccgacaagtcgcaaaaggcgtccccgccacagcggcgacgcgtccctcggtcggtcggtccacactgactccacagtccacaccaccaccacacccaggcttccacttgccgccgcgcccgcgttttcttttattcccctccactgctttgcgcttgcgcctacgcatcgccgccccgcctctagttctctctgtcctcgtcttcctactgtaaaccacctcgtccctatccgcggcaaccgttcaccgcgccgcgaggcctgctgatccgaccgacctccaccgtcatggctcccctgcgccgcgcgtctcgcctccttcgatcagccgtctgccggctgaggtctccagcgccggctcgggccttctccagcgccgcggcgaccgagacgggtgccgtgatcgccgctgctgccgtggcggtggccagctccgggctcgggctgtggctgaaaccgccgtcgcttgccgactccggcgaggcgcccggcgaccagatctcggtcgcctgcgccggcgccacggaggcgcgggaggagaaggggtggttcctgttcgcaggcgcgcgtcgcccctttccccgtttgcttctcctcttgcgctatctctgtctccgtgtttgctgttcgcaggtgagcgtcctccctttcccggtttgttcctacctctctgtctccgtgtttgctgaggggtttggtggtcaccgccgccgctgttgtttagtgtggcttggcttattgttttgcgtttgtatttaagctttgctctgtaaagctacaagaggtgctgggtcatcttaccgaagggtgtcacctctactgattttgaccgcctgcttgcttcaattgcgacctgtacggtgctcccctggctgtaccgatcctgttgtagataggagtacgtgataagccacgtttgctttcccccggctgtaccgatcctattatatataggaatatgcgataagccaattggccactagattccaaactatacatggcacgggagcaccattcagtgaagtctgttacgatgtctgctttttgatcaacatcaacactaaatatgcactgcttgatgagtgtagtgttgcttaattgtctgagagcattgtatttatcttcttcaagctttgcaaatttgagcagtgtgtttatattttttttagataatggaacagaaataaggtcccagcctctacaccatccaagacagcgtacacagcgtatcgatacatccaacaagcgcttaggctcacaaacagac

SEQ ID NO: 5076 - DNA, 1374 bp, Zea mays
agtattctctgtcttttgtcttgagattaagaagtacagaaagcagtccttcgttgttcgtcaggaaaaagaacaatgcagcacgtaatcctttgcctgcaaatctctctgctactctccagcttctcctatttgatgcaagcccagtacacctcgatctttagcttcggcgactcctacaccgacaccggcaacaaggtcatcctctacggcccggcggcggcggatctgtggatcaacaagccgccgttcgggatgaccttcttcggccatccggccgggcgcctctccgacggcagactggtcatagatttcatcgcccaggcactagggctacctctccttccgccctcgctggcgaaggaccagagcttcaagcaaggcgcgaacttcgccgtggctggcgccacggcgctgaagacgagcactacaagcccagcgctctacccgcagctggccgtcgccggcgatgccgtgcctcctccgaacaacatctccctcgctgacgagctgggctggttcgacgccatgaaacccgcgctctgcggctcaccccaagcatgcaaggactacttcgcgaaggcgctgttcgtcgtgggcgagctgggctggaacgactacggggtcatggtggtcggcggcaaaagcgtcgccgaagcgcaatcctacgtgcctcagatcgtcgcaacaatcgtcgctgccacggagaagctgatcaacgacggcgccacgacggtcgtggtgtcggggatctcgccgatgggctgcgcgccggggaatctggtgctgctggcgagccaggacccggccgactatgagcccgacacggggtgcctcaagggaatgaacgagctatccagggaccacaacgcgcagctgagccaggcgctgacgacgctgggcggcaggtaccccggcgcgcgcgtcacctacgccgacctgtacggccccgtcatcgccttcgcggccgcgccggcgcgcttcggcttcgactccgcgctgagggactgctgcggcagtggcggcggcaagtacaacttcaacctgagcgccgcgtgcgggatgcccggcgtggccgcctgcccgaacccgtcggtgtacgtcaactgggacggcgtccacctcaccgaggcggcgtaccaccgcgtcgccgatggctggctcaggggaccctacgccaacccgcccattctcgccacggcgtagcgaactaggcgacgtggatgcgtgtattaattcaatttcttgcggccgggaatcacgtaaataatttgctgagttttctgtctgatcgtctgattcatgaaccacgtacaatttctctatataatacgtataattatattctgtgttcgtgcaaaaaaaaaaaaaaaa

SEQ ID NO: 5077 - DNA, 1521 bp, Zea mays
ttcttattttaagatttcattgattttgctgctctagtaaaatctaaagatattgtaggtggttgtgaattggcataggaattagattgttctgaaatatatgtttgttgattctttgggtacacagaacttagatcagaaaattggtgtgagatagtatgagtcatccgcgcattaagcctctaagagggtctagcccaagccacgcaccattccatctcatttttctcttccgaactcccctttcttcacacaatgtcgggttggtccccagatttgaacaccttcacggatctcttgcagtccgatgggtcacctacaacccttccgttagatgagtcttcttcactacatcgtcgctccgatgtttcagcctcactctcccgtgcactattttaattattatgtactttgtaatttttaattcaataaaaaatattatgttgtgtgttttctgagcgttgaaataaatccgcgtgaattacttaattctgaaatagaaaagctgacgtggctatagcctgaggttgtagcctgctgcagcctgtgcactggagcagcaggggcgagattgaaggcgagagctgacgtggcaggggcgagagggagtagggatgaaaacggtacgggaaaatcccgtaccgtcccattccgattaccgtttctttcggatcgttttcgtatacttcggttatttttcggtttcggtacgaaaacgggtagattgtcttcggtaacggtatcgaaaacgagcagactgttttttcgttcgtttttgcggttaccgttttgggtcgggaaaatcccgtttttcataccgtttaggctattcggtttgggcctttcagttctccaatgtcagcacagcccgagcccaaggcggcaaggcccaccagtggaaaccctatcccgattcccgtcatcccgtggccgccgcctgccagacgccacgccagccttgcccttgcccgtggccgccgcccgccagcgccagccgccttcgccgttcgccctgtcggctgacggctgtcgcccagcgccggagcgccccaagtccccaaccggccaacccatacgcggagacgccaagcccagtcactccctctcgcggtcgcgggtcgcgtcacgcggtcggcagtcgtctcctggctgcaggctgctcgctcgctcgtgtggactgctggctcatcgttgatcaacaaagcaagttgcaagcggtgaaagcgactgcgccggtgtctctgtccggctagctcaagctcctcgctcctgcggctacaagtaggaccatgacagggagagatgaaagctccgaccgtagttcggcgtgcttgttgttgggaacaccggctctactagctgctcttagaactgctgctcacttctggataaattatcagttaattagtatgtttgtatgtgacatgagtgtagatataatttctcactcaaataatgtcactatgtaattatgttgatgctataaacttaatatatattaatgtttgaattaaggcattc

SEQ ID NO: 5078 - DNA, 2262 bp, Zea mays
ccgctgtggcgcccctccgcggggcgcgctctttaacagtggatcccccgggctgcagggagagagctcactagtcccccccccccccccgtttatctccacccatgcgtccctgctctcctctagttgagctcaatcccaagtgctcgcttaagctgtgtggccaggttccctttcctggtcgccgtcgatggaagccctgccatcgatatcgcatgatattggttgttttcttcgaccacgtcaatgcctcacaggatttggacaccttgtcgacactcgaccatgtgttcgctcgttaccacgccatcttcagcatcatggttctataaaactctgcgcactcgtcggcacccgtctgtcaatctccaccacgcagcgctgcatcggacttaccctgtatgatgttcgacgacaagcccgaaccagtatttatcagcattctcgcgagtagtgagtcacgtttgatgctggtacgataattactcgcgtgatgcggaagacgacccaagtcgaccccaagcgcgggctaatccgcaggataaagcggatgaactaatctgaagacggatagatgaaacaagtatcacaacaaggataatcatcaagtggacgtcgtctaacaacactaacctagtgttactcaggttctaactttgtgctgttgttgatggtgttaagtgccggtgggctcggccttcttataagtctaactttaccgatcacgtgcctcttccccttcttgtatttcatggtaagggacttccgcgtcgctgaaacagaggaagacatcggattctatgctggttttcttgctgcgtcgtacatggtgggcagaggcttctcttccatcttctggggcgtcatcgccgaccgcgttggacggaagcctgtcatcacgttttcgatactgtccgtggtcgtattcagcgcgctgtttggtctgagcacgacgtactggatggcgatcgccacgaggctcgtgctgggcgctctcaacggcctgctcgccccgataaaggcgtactgcgttgaagtttgccagacccagcaccaggcgcttggactctcgcttgtgaacacggcatgggctctgggtctcattgttggtccagctcttggaggctacctttcgcagccagctgagaaatatcctcacgtgttttccaaagactctgtatttggcagatttccataccttttgccctgtctaagtgtatcagcgtttgctacacttgtcctgataagctgtgagtggcttccggagactatacacaagcataaggttcccgaaatggacaccaaagcattcaaagccctgtcgtcaaaagagggctattgcgatccacctcgcaagaagaagagcttgctccagaacaggccttggatatcaaccctgctaccttactgctttttcagtcttcatgacacagcatatagtgagatactttccttatgggctgtgagcgaccggaagtatggcggccttagcttctcgactgaagatactggtcaggttcttgctatggcaggcgctagtcttctagtgtaccagcttgtcatttatcgctgggtccatagaattcttgggacagtcaactcagcacgaattgcatctgctgtgtccatacttgttcttgcaacttatccctttatgacatacctatcgggagtgaaactttccttggctctttgttccgcagccatgatgagaagtgctcttgcgatcactgtcaccacaggaatttcacttctacagaataatgctgtgtgccaagaacaaagaggcaccgcaaatggtatatcgacaactgcaatgtcattcttcaagtcaattgctccagtaggtgcaggggctctattctcatgggcacaaaaacgtcaagatgttgctttcctgccaggtgatcaagtggtgttcatggtgctgaatttggtgcagcttctcgggctgatatccacctttgagccctttctagtgttacctgcactaccagagtagtagtgtttaaggctagaagacattatgaaaataaatgtaccttggcacatagttacagttgatcgagtgcaagacagaaggaacatgattgtagccacttgttacactactaaagatgtctgattagcccaagattcaaaaagaagaatgttttattaattagcaaacttgatctattgtaatatcactgttccccaaaacccatatttctaaaaaaaaaaaaaaaaaaaaaaaaaaaaaacctcgggggggggcccggt

SEQ ID NO: 5079 - DNA, 3800 bp, Zea mays
  misc_feature (3688)..(3688): n is a, c, g, or t
gacgcgcagcaaccataattagggtcactaatatataccggcccaaggctaccgaggatgggcctccgctccgctcgccaacatggcctccatacgcagaatttggatcacaaactcaacaattcgtctcaagacccctaaggatatgtggtcctgtcgccattgtcgtggcgatactatgtgcaatgggctgcacgggaggaactgatctagaaaggagaaacacaaaatgaagttttcataaaaatcattttaatacctaaataataaatttaatgttcaaatctgcaaatacaaatctgaacattgtagcaattttttatatcaaaatatctgtaacgtgttttattagatttttataatattaaatcagattttaaacctattctagtttgttttttaatatttcttcatattttttataaagtataattgatctccatagattttatcaagaaagtatagtttgccctttcataactgacctgacaccacataggatggctgcgcgtgacgttatatctcctgaaaactagtagtttcaaaatcccttaggcctagtttggcagtccagttctcggcaaggaacccgatcatttccctgcggtggtgacccacgtgacaagcttccacgggcacagctccagcttgtttggaagacacctccatcggatgattctaatggttggagtctacaatactggatgtgaaatccacttgagttaggcctgcaaaggcccatcacggcccggtgaacgaactgaattttgtcctcatcacgaagctcaataacataaccgttgctagttgctactatgaattacaacagccgcagcgtgtgctctccatctcgctgcggcaagcaaatgcaagtgccgcaagcgccgatggagaggaattggctgatcctcggccgcgtcatccgcgttgagcaaccggaggcgcaggcgcagggggatcacgcggcggtcggggaagccgagatcgccgcgcaggctgagaacgccgcggtcggggaagccgagatcgccgcgcaggcgcagctggaggagagcgtcatgggcgtgaacacggttccggcggcagcggcggcggcgggagaagccggcttctccatcgcgatcgcgccaccgccgcgagtcacctttctcaccgcgcgccagaattccaaccccattgccgaccgtggcgacacttgcccctacatcatcgcctccgggccctcgtgcctcctcgcccacttcgccgtggcgccctaccgcggcacggacttcacacgcgagctctcagggccgaggatgtgccaccatctcgttgtggcgcgccacttccgcaggaagggtggcctggttgtggcgagcagagagcgcatacccgcccgcgactaccccttcgtccccgctctcaggaatatcatgtgcgtcggcttcttctgcgaccacaactacaactgcaggatcgccgagctcatggtcgaggcgagaaaccccttgctccggctcgtggtcttcagagcggagtggtacacgataactctgaggtcccccttggtttattgggacagcgagaggaggtgggtaccccacggcgcagtcgccattgacagcacggtcctatggttcgacctctcgtgggggatcctcagctgcgacatcgaagcggaaatggaagacatggaaatctactttgcccgcctcccacgtggtcgtggtctcccgaggggcggggccacggagggcatggacagcaggcgctgcgtcgcggtgagcaggaacatgctgcggtacgtggagatcatcgtccccaaccccaaccccaatggcgatccccctgcaccgatggtgtccatgtggtctctcccagtggcggcgggtgacgtatgatagacgggaatggatcacgaactacagggtaagctttgaggacatttggaacagcgacagctacgctgtgaccgggctgcagcgggacatcccagtactcgcgggcgtgtgcccggcgaaccccagcgtggtctacttcgacctgcaccagcgcctcttcggcgtcgatgtccccgagcgcagggtcgtggactacgaggccaagcagcatgagctggtgaacgcgcaaggggacgacggggagaagggctccagccgctacctcatcatttgggacctaatgcgccaaggtttttttaattaattttgaccggatcgtgttactcaaattttttagaaaaaaaaaataaaaataataaaagtcatacttaaagtctattatataataaaagatattacagtaaaaataataattataattttttgataagacgagccgaccaaacttggaataattataatgcgccggtatcagtttctagtacaatatgatcacgactggacttaaacaaatataatataagattatctgttatccgtcacgttacaattatacgaaccaaacaacactaaattccactcaccgttatcatttttttttctctctcagcaggaatggacattgggcatgtgtcaccggacctgcagctgcaggaggaacatgatttctgcgacgagaagcagcaagccgttggaaaggcccggcagcggaaatcaacgtcgaccagcagcaggccgttgaagcgcgccaaatgaaatgagttgcaatgagttttaatttgacttgcaaacctcagcaatactgctccgtgttttgtttgttggcggacatgaacggaacttcgtcaaccaatgggaaacagactgccccgttttttgcttgttgtatttgacaacgtctcatacccctcgggaactagggtgccatagttttccaaattttcgagagaaagtggaaaaagcactcacgagcatgtaggatatttcttagcacaactgaaagaattgatcgataggaaagcttttcattttttttagataatggaacagaaataaggtctcagcctctacaccatccaagacagcgtacacagcgtatcgatacatccaacaagcgcttaggctcacaaatacagactcaaaaaaccaagtttacccaagacagctagacgactaggccgcaattctatttgagaacttccacccaaacgtagcgaacacctccataacgaccgactccaataagcggcatgccctgttcagatcggtcctcgcgtcctcgtctctaagcagcagcgaccaagaacgtgcccaatatgtcgccctgaaaataacctgcatgaaagtgttagccttgggcgcaattgaacaccatatcatttctattcaaccatatagcccaacaaatagcagataaacctacacaaatctgatttctaaatgctggccgaaaaccagcaagccaagaaccaaacaagtcgtgggtgctagagggaggttgaattccaaaggcgatatgtattgtattccaaataaagcgggcgaagtgacattggatgaaaagatgttcgatagtctctagagaactacacgaacaacattttagatttcctttccaatcccgctttgcaaggttatccttagtgagagtaactccatttttgatgtaccacaggaaaattttaattttaagtggtatcttaatcttccagattggggacttaagtggaacaataccatcacaaatcaataccctatagaaagagcgtgttgagaataccccacttttgtgtaaattccaaatnaaaatgtccctatcacctgtaaggctagtgctgaggacacatgccaccaatttgtaccacgactccaagttaacgcccgttaacgcccttcgaaaggtcacatttagcagtg

SEQ ID NO: 5080 - DNA, 1779 bp, Zea mays
gcacgagaccattacctagaacatcccatagagatagagatagacagctagcttcatcagtaggatgggcagcgacgaggaagcggcgctgctggtgccggcggtggaggagggttgccccgggtgcgtgatggagcggcggaaggcgagcagcaacggcaggatcccctacagggagctgttcttcgtcgccgccacctccctcgcctcagctttaccgatcacgtgcctcttccccttcttgtatttcatggtaagggacttccgcgtcgctgaaacagaggaagacatcggattctatgctggttttcttgctgcgtcgtacatggtgggcagaggcttctcttccatcttctggggcgtcatcgcagaccgcgttggacggaagcctgtcatcacgttttcgatactgtccgtggtcgtattcagcgcgctgtttggtctgagcacgacgtactggatggcgatcgccacgaggctcgtgctgggcgctctcaacggcctgctcgccccgataaaggcgtactgcgttgaagtttgccagacccagcaccaggcgcttggactctcgcttgtgaacacggcatgggctctgggtctcattgttggtccagctcttggaggctacctttcgcagccagctgagaaatatcctcacgtgttttccaaagactctgtatttggcagatttccataccttttgccctgtctaagtgtatcagcgtttgctacacttgtcctgataagctgtgagtggcttccggagactatacacaagcataaggttcccgaaatggacaccaaagcattcaaagccctgtcgtcaaaagagggctattgcgatccacctcgcaagaagaagagcttgctccagaacaggccttggatatcaaccctgctaccttactgctttttcagtcttcatgacacagcatatagtgagatactttccttatgggctgtgagcgaccggaagtatggcggccttagcttctcgactgaagatactggtcaggttcttgctatggcaggcgctagtcttctagtgtaccagcttgtcatttatcgctgggtccataggattcttgggacagtcaactcagcacgtattgcatctgctgtgtccatacttgttcttgcaacttatccctttatgacatacctgtcgggagtgaaactttccttggctctttgttctgcagccatgatgagaagtgctcttgcgatcactgtcaccacaggaatttcacttctacagaataatgctgtgtgccaagaacaaagaggcaccgcaaatggtatatcgacaactgcaatgtcattcttcaagtcaattgctccagtaggtgcaggggctctattctcatgggcacaaaaacgtcaagatgttgctttcctgccaggtgatcaagtggtgttcatggtgctgaatttggtgcagcttctcgggctgatatccacctttgagccctttctagtgttacctgcactaccagagtagtagtagtgttaaggctacaggacattatgaaaataaatgtaccttggcacatagttacagttgatcgagtgcaagacagaaggaacatgattgtagccacttgttacactactaatgatgtctgattagcccaagattaaaaaagaagaatgttttattaattagcaaacttgatctattgtaatatcactgtgacacaaaacccatatttctaatcatatggtcgtggatgctcaaaatgtgcaataaagttgtgatattcaaaaaaaaaaaaaaaa

SEQ ID NO: 5081 - DNA, 1727 bp, Zea mays
gtgacgagacgggccctaggcacaccacgcaatcagccgccccgcgcccccgcccgcggttggcgatgttgccgtgacgtcttccagggaggagaagccaacatcacaaactccacgccgcgtggccggcagtagaagccgagaaggtaggcccgctcgttccaacatcacaaactccacacggctctcctgtctccgctgcccgctccacctccctccatgccgtcggcttccctccgcctcgccgtcgtcggcgcgggcgcggcgggcctggttgccgcccgcgagctacgccgcgagggccatgcgcccgtcgtcttcgagcgcgccgccgccgttgggggcacttggctctacacgcctcccgccacgtcctccgacccgctcggcgccgcggcgacgcattccagcctctacgcatcgctccgcaccaacctgccacgcgagaccatgggcttcctcgacttccccttcgccgctggcgccgcgggctcccgagacccccgccggtttcccgggcacgaggaggtgctccgctacctggaggcgttcgcgcgccggttcgacctgctccggctcgtccgcttcgagacggaggtgctcagtgtgaggagggaagacggagggaggtgggctgtgacgtcgaggaagctcggggataaggggagcggcgaggaggagttctatgatgccgtcgtggtctgcaatggtcactacacggagccacgcctcgccgtcattcccggggtagatgcttggccagggaagcagatgcatagccacaattaccgtgtgccggagccattccttgatcaagtagtgatcataattggggcctcggcaagtgcagttgacatttcgagagacatcgcaagcatggcggaagaggtacatattgctgatagatcagcaccggcttccacctgtaacaagcagcctggctatgataatctgtggcttcattccatgattgaccatgcgcaggaggatggcactgtggtgttccaggatggcagctcaatcaaagctgatgttatcatgcactgcactggctacctgtatgactttccattccttggagatgacagcactatcaccgtggacgacaaccgtgtcgatccactatacaagcatatttttccacccgaagtggcacctcatttgtccttcatcggattgccttggaaagttatccccttcccactgtttgaactccaaagtaagtgggttgctagagttctatcaggacggattaatcttccatccgaagacaggatgatggaagatgtgaaggctttctatttgaaactagaagcacatggatggcctaagagatacacacataattttgcaaattaccagtttgagtatgatgattggctcgctgagcaatgtggccatccaccagtcgaagaatggaggaagcagatgtatgctgtaacttcaatgaacaaggcagctcgtcctgagagttaccgtgatgaatgggatgacgagcatctggtggccgaagcaaatgaatacttcaagaaattcttgtaaattctttcttactattctcatcccatattctttcggcatacccgaggctgatctcaactgcaatatgcaaatatgaataaccatttaactattttatgtgatgtggattggatatacttctgggttagcatttcatcgatgtatatatatgagactgttctggtagtaaaaaaaaaaaaaaaaaa

SEQ ID NO: 5082 - DNA, 1207 bp, Zea mays
tcggccgggagctgttgacacggtgtggtatatgtgttagctttcgtcttcgcctcggtttgggagccacatggatcggggcacagagattccgtgtgatcggggcacagagattccgtcgtaaaaaaatcggtatggcgttggtattcgttctctcgccactagccgctagtgaaagaaggggatatatattcgtgtcctccgaattagtccttcctgcagtgtcctcgccgacagggaaagccgtgttgcaagaaggggaattccgctgcgagatccgtgaacggttcagagatggcacagacggtgttcaccccctctttggaagcgatgaagcatgtcaaggcagagaacggagtcattctcaccaagcccttccttgatgtctgcaagcaaatattgcctgtcctcgataaatttggaggtgctatggcaattgtaaagagtgatatcggcggcaatatcacaagactggaaaacaagtatacttcagaaccatcaaagtatgaacacttgtacagcatggttcaggaagaagttcaaaacaagaccgcaaaaggttcctcaagctgcacaaatgggcttctgtggctgacgagggccatggacttccttgttgagttgtttcgtaacctgcttgagcatccagactggaccatgggtcaatcttgcactgattcatacaccaagactttgaagaaatttcatggatggcttgccagttctagttttacggtggcaatgaagcttgctcctaatagagagaaatttatggaggtcattagtggaaccggtgacatcaatgcagatattgagaaattttgcacgaccttctctcctttcctcaaagaaaaccacaactttctggcgagcgtcggtcttgatgatctgaaggcttcatagatcaatctccatgctgattacaacaaaataagcatgtcttacgaaactcaaagtgttgccgagggtatacctgtttcccgtagccatctcccccttgaaaaactttaggagatggtaataatttgtcagcatgattgaccatggctacttacgcagagaattgacaccactcaacaatttagtaccgaactctcgatcctgtgttacagcaaatcctatggttatgtggaactctggtgctgtaattctcttgtatgctacccagtatgccgcaggaaatcataattcggtgttccattgcagc

SEQ ID NO: 5083 - DNA, 1234 bp, Zea mays
aggaaggagcgagtttctacaacttctcacgttcctactgttgttgggagggttcggagtccagatcagagatctgcgacaactacgttgtcaacactcagcaccgtttggaaggcttcaaggctggagccagagggaccgtgccaaacgggcctctgctccagctaaccgcctgcctgccttttcttctctcgtccaccctaggtctcagtctctgctcgcgctcttgtggagctactaggtgaccgtcgcggccgccctacgccacgtgctcgatccagcctcgtcggcttcttcgcacccgtcaccggcggtcagcacccaccaggttcatagatggcagagacggtgttcaccccctctttggaagggatgaagcatgtgaaggcagagaacggagtcattctcaccaagcccttccttgatgtctgcaagcaaatcttgcctgtcctggataaatttggagctgctatggcaattgtaaagaatgatatcagcggcaatatcacaaggctggaaaacaagtattcttcagatccatcaaagtatggacacttgtacagcatggttcaggaagaagttcaaaacaagaccgcgaaaggttcctcaagctgcacaaatggtcttctgtggctcacgagggccatggatttccttgttgagttgttccgtaacctgcttgagcatccagactggaccatgactcaagcttgcactgattcatacaccaagaccctgaagaaatttcatggctggcttgccagttctagttttacggtggccatgaagctctctcctaatagagataaattcatggaggtcattagtggaactggtgatatcaatgcagatatggagaaattttgcacaaccttctctccttttctcaaagaaaatcacgagtttctggcgagcgttggtcttgatgatatgaaggcttcgtagagcgatctccaaggtggtgattacaacaaaataagcgtgtcttatcaaactcaagtgttgcagaggatatacctgttttctgtagccatctccccattgaaaattatacagggtgataataatttttccgcatgattaaccatggctacttacacagtgacttgacagtactctacaaatttactttccaaagttagtccctttttttcccagataatctacatatgatatgaaattctagtgcaattaataaataaattcctgcaaaaaacagaaccgttaccggcga

SEQ ID NO: 5084 - DNA, 1904 bp, Zea mays
gctgcctgcagtgtcctcgccgacagggaaagccgtgttgcaagaaggggaattccgctgcgagatccgtgaacggtcagttcgcaatcactcttgactgtgtgtatgatttcagatcatgacgcgagcttagcgcgtacatatgtcgtgagcttagtggagttctgaatccggccacgctggttcagtggttctgtgtttagtccgtcgagctctgatccatggatttcgtggttacatccaaatattcagtgagagatcagaagttgtatgtttagtttgaatctggtgcatgttggggcaggccgtctgggtgattgagatttagacgtgtatcatgtgtgggcaacttgctggattctttcgttttgatgaggctgctcataaatggagactatttgagcttgaaaacctgttgacttttgggttgtaatgatctggttcctgcgtgaacgttaaatccggaaactaggaagatgtattgtgaccttttgggaggttaaaccgcgcttgctgttgctgacgcatgttttttttctgattggtaaacttgaatcgggtattcaggtcaatacctgatttatctgttcatctgcagtagttcacccttttgtctaggtttagtgtctgcgatgtatctgttcatctgcagcgttctcttttgctgttctgaatgttacttctaagacttaactgtatttctgttatgcaaataatagaaatgggggtatccttcctctcagcgagcataatctatttgctgtgatgatgtatatactttcttgcaggttcagagatggcacagacggtgttcaccccctctttggaagcgatgaagcatgtcaaggcagagaacggagtcattctcaccaagcccttccttgatgtctgcaagcaaatattgcctgtcctcgataaatttggagctgctatggcaattgtaaagagtgatatcggcggcaatatcacaagactggaaaacaagtatacttcagaaccatcaaagtatgaacacttgtacagcatggttcaggaagaagttcaaaacaagaccgcaaaaggttcctcaagctgcacaaatgggcttctgtggctgacgagggccatggacttccttgttgagttgtttcgtaacctgcttgagcatccagactgggccatgagtcaatcttgcactgattcatacaccaagactttgaagaaatttcatggctggcttgccagttctagttttacggtggcaatgaagcttgctcctaatagagagaaatttatggaggtcattagtggaaccggtgacatcaatgcagatattgagaaattttgcacgaccttctctcctttcctcaaagaaaaccacaactttctggcgagcgtcggtcttgatgatctgaaggcttcatagatcaatctccatgctgattacaacaaaataagcatgtcttacgaaactcaaagtgttgccgagggtatacctgtttcccgtagccatctcccccttgaaaaactttaggagatggtaataatttgtcagcatgattgaccatggctacttacgcagagaattgacaccactcaacaaatttagttaccgaactctcgatcctgtgttacagcaaatcctatggttatgtggaactctggtgctgtaattctcttgtatgctacccagtatgccgcaggaaatcataattcggtgttccattgcagcaaaaaaaaaaaaaaaaaagcggccgccccatattgactttgtggctcagccagccgcccacttccaacacagttgagcgagaacatctagatgacataatcatttaattggtgccaatatgtatttagagaccaaatttagcagggagactgctgactattagcaagtaacatgcattaactgattccaacct

SEQ ID NO: 5085 - DNA, 1215 bp, Zea mays
  misc_feature (458)..(458): n is a, c, g, or t
cggcatcagcgtcttcccctccctcgtctcgtcaatcccctcgcgccctctcctccggtcctccgcacacggcacaccgtccggtgaccctgcgtgcgtgcctccctctctccttccgcctccggtaccggccccagcggctgcgctgcgcgccgcgcgcgggctgctggcagcgggagcgagcagctgctgctccacaaggcggtcgcgccgctttgggagcgcctgtgctccaaagcgaagctttacccgtctgcttagcgctgatgcgtgcgcttagtgccacttttttggaaccctgggttgagcatggagcatttacctgattttgttaccaatttctgctagtaatagttattttggacacagaatggaagggcgccgctcaaatgaagtatcatctgccgaagctgtcttggtgggagcattgtcgtctggtgtcaatgctcccacgtggntttgtgctcaagattacgtttttgctccttgcattgtgttttacggctatgcttgctctagcattttcgtcgaagaactttgtaatcgttgcacatgttcttctgctggtgactattggaaccgtgctatttgtgctgcttaacaggtttctggctgaagttgggctcgtgcctgttgaacagcagattaaggagatgggcatccacaaaacagaagccacagatgaagacaagagaaattaatcagtgacaccttttttttttttgatatggaaagcagtttaacattcaatggacagagtgacattatctctcatgatagaatcagcactcacttcagagacatgaagttcagacaccacaattttgcacagatgaccatacatctttgtacgtacttccaaatggaaacccaggtcgaaatctgtagtgaaaagggatgtagctgcaagcagagcacatcaagcctgctttccctcttccttgggcttgctcttttttttttacttggtgtagcagaagcatgagcaccagggaaactgaaacaagaactccattgccagagaaatcaccaatacttttgtttggagaagtgtgcccaagggatttgcatgcaatgtaacccttacatatacgacatggatgccgtttatcagtggacattaggatttatggtctttgtgcaatatatatggtcgtgtcagactatcgttccttccatttattctttattaaccctcataaaaaaaaaaaaaaa

SEQ ID NO: 5086 - DNA, 10237 bp, Zea mays
  misc_feature (482)..(482): n is a, c, g, or t
ccctttacttggaagaagctaatgaccttcttatgcaaattccaattatcatcaacgaagtgtgcagtcactgtaatatagtagtcttgttgttgagaagtccaacaatcagtggtaaggcaaaccctttcacatttctgttttcaaaagtgcatcaactttgctttttcctgaaagtaaatgcgaatgatgtccctagtgcaagtccatcgggatggaggctcaaaacgagggcaagcaatggacataaactttctaaagcctgccttctcaccaaacgcaaaaggaagttcatcttgtatgaccatttcattaaaagcttgtctaagcaactcaggatcataccttcatgcgctaacaccttgtccatcagtagcttgcaaagtaccttgcttattgtccttgttcagtttatggggattgcgcttacatgtattaaagtgctttcgcattctagatgtaccattggttgttgtatcagnccaaatattatggctgcaatacttgcactgtcccttctttaccatgttgtttgcatcctttattttgatgaaatgctaccacatttcggaacggggagccatcactttcctttcacttcctttgttttctccatcactaacttgaacaacctcaacagaaccacctgtatctcccacatttgaagcacaagcaccatcaacaacaggtttcagtgcagatgacatctacaaaagaataaaatgggcaacacatgatacacatcaacaatcatgtacatagaaccgaatccgaatttattatttcggttttctggattcattacctgtacctgatacccgtttttttggttctttcggtttcagtctcggttttttcggtatttggatctcggtttttatgcccagtcctaatagcagctagttaatatgtgagattaatacagtgttgcgtccacatattcttgcctttttgccattctaatattttttagctatcctagttctgcatggttgtcattgcttatttccacaatgctaccttgacataaaaaacgtggtcgggagggaatgaccgccctcccggtataatactaagaagagagcaaaacattagtcccgactaagaaaatctccaaagtctggcctcccatcactaacggcccgacgtcaaccgtccactgtgcaacggtccaaccggagggtggcgcataggacatcgtaaccagagagcggatgaggcataacgaggggattttttttaaccaagccggaaaattcgccgtgagggaatcgaacccggttcttggatgtttgatgaatttaagagtttttgtaacctagatatcctcacacataccattaccttttggttcttttgcagcccggagtctgttagatggcctaccgtcgggaaatacaaagtagacgtagcatccttggaatcattagcagtacctgagctgcaggtaagcagttggtggtgggttatgaaagagctacgaaatgtcaatgatcatggggtgtgtgcttgttaggttaagcatgggtgcatgataacgttttaaagtttgttctcgattgataacggcggagaaggaaatatacttcatatttcatgttggatcaggttaaggaagaaacagatctcttcatcattgacgaagtgggtaaaatggagctgttcagttcagcatttttccctgcggtaatgagagttattgaatccaatataccagtgttggccaccatacccattcctaggcagggccgggacattccaggaggtaccatgctatcctattctgcaactttacagaggttgctgattaataattctgctgttccgttcaaaaatcatgtatagaaatatacaataccatttccacggttgctctttaacagccaattcattcgtatgtatttgagaacctgctttcactacatgtttaaagcttgttgtattccattagctatgcttgctgcatccaataaatgaaacaatgtctcttgtaccgaaacaagacttatattacactgttccacactcctcttgaaatgtagccgccacatgtttaaagattatgaccgcggcttgtcactagtgttctaattaaacggttccactgtaaaatgcagttgcgaggttgcggaatcatcctggagcagctgttttcaccttagacactggtaacagagatacgatgagagatactatctgcagtcagctaaggagtttgttgcagaggtgatctgctaacctccctgtgtctatgtagccactgctttttttgacataagataacaagcaaacgatcaagagtagaagttttctctcagaacctcgagtatctgttttcaagtttagctctgaatggatgataagcatgtcgttcagtttgttcttagttccgtatgtggttattcaatcatgtatttgcattcggtgggggcaaggttttattgccacaataactctcgcttgtatggatgcggttagcatgtagtgactctacaacaggtatcacatgatttgcacaactaatttgctaataggccattattgcctgaatcctacgggcccatgatgagtccagcttggtctggcaggtccattttaagttagtaattgctactctcttttgcctgtgaaagatggccgagtagactagtggttgaaatggcagtcaagtgagagaaaaaaaaaactcacatccatcgcctgcaagcccacacaaacaagaaaaaaatgtgatgaatgttaggggctgtaaaggagtgggttggcatcctggatgcatataattttttcccaatcaagttggatggtaataatgcgcatcattttactgtcacttgataatagaggcttcaggcaaatatttaaccaacacttgtgagctgtggcctctcctttttacaaaggtctatgatcactattgttaaacatccaatcgaaccgtcgtcacttgtgacaggctgtttaatggagaagacatcatgcagtgttatgggtcacagtctgctgaatcgtccggcaggtacgcacaatgatgaaacctatataaaaaaaaaagaagatcgcgtaaatagattaggcctacagtgaacaaaagaggcagtcgatttggtgggagggtacgttcttatcaattccgtttctgaaattcttccagcgtcgagttggaccactgctgtgctgcctgctaagacacctggctcgtagtggggtaagcatatcctagaagcaaccagcaagctcacatgacacatgttccttcgggttcggggggacgctttgctacgtcgatcgatctgaatgaccggggaatttccatccggagttccgattgaggtgggcactgaattaaagcagcggctgtactgatcatggcaccccccaccctttacagcccactgagctcccagttccccctttctctgagccctagcggaaaggcgccattaaacgccaacgctgcgagctttgtttcgatgaaggcggaaagcgcaagggcaaatctcacaggagatacgctcgctactccgttctttgtctaagtatacaacaaatgagtgcttaggcgtgcaaaatatatataaatgatcctatgtgtgtaattacttgtaacttgtaagatgggggagctggaagagaagaagacctttcaagtagatgaaaaaggttcctgtggtggtggtggtggaattgattcgacgggcagcccccaccatgtgatgtcttgatggggttagattagatgccgccggtgaatgcagcgcaagcttgcttgattaactagtttagcgccgaggaatgatgacggccgtgcacgcacgcacgcccgccgcccggccatttgatggcactttgcttcgccggatttaattaagaagagaagggaaagaggctccatcgatcgttctagctagcgaaagcctttatggctgtgcgtatgcagagatattacatgtccggtccatgtcctggagagttccgacatcaggcgtgcggtgcggattgctccgtcccagccgtgctggtctgacgccctgtgctgcttcatccatgaaccatgatgcactccatagctcggtttcttcttccacgcacagctgctcatcagctacacgctgcgcagaaactccaacccaagtaagtacatgtttgtagccaaggccacgccaacctcttcagctcatgttttgcatcgtcgccctgtcatctcgtatcgacggcaaccaacctcttccagtcttcgcagccagccagtcagcagcacgatcgacagacagacacgaataaaaaaaaaaaaacaaaagaaacgaactatcaagcggcagcaggcaggcaggtagcagtggttggttggccgggtcaaggcgcgcatgtcatgtgcgcgtgggagcatccgtgcggtgcaggaggacgaggaggacatcgacatgcgcccaagggatcagatcacgcgtcaccgctccggcggcagcggcagtgtaccccgggcgacattgatgtgccgccgccgccgccgccctgggcctgggcgagggcgagtggacggcgagcaccagcagggcagcgccggtccagcagcccgtttggcctgggggggtgttccacctggaaccatcacgcacgcttgtcgcgccaccatcactaataataatacccctatataaaagggcttcgattcatctattgtaaggatatgtttaaaaaaatatatttatgcataattaatgagaggaggacatggcagcatctcgtccggattccccagcacatgatggaggccaacacaaaacacagcacaggtcgagactgcgatccgttccacgaaacggacagtttatcgcaacgccgccaaatggatccttcccctgcctctgcctgtgtctcgtgttcgtgtgtgcagaaggggagggagagaaatcagcgaaagcgtgtggtgctgcactgcaccaactggtgtcctcgcataaccgagctgtccccccggcctaaacctaaactactgtctcaggaattcagatcagatgccggccctccgctcctcatttgtctagtagtactaaccgatggctaagtaaaccatgcctcgccagctagctaatccatggcagagtcagtttaaccactgcgcgcagctcaccctgcatcttcttcccgctttcaccacctacccctaacagagcgacgcgaaggtccgtctctcttctcttctcttctcttctcttctctcgccgttcgcgctgtgctctggttctgctgtctggtcggtcctgctgtcgaggctgcattgcatatttgcatgcacaggagcggctgcagggaaggagtgagaggagcaggatgggtaggtgggcgggtgagggcaaaaggaagacttcgcttttcgctttcccggctgttgctgttgctttccttccccttctaatcatcccttctcctcctccctagttattatcgtcgtgccaccataagcgcggcctcgcgccaacaagaacctcggcctcgggaggcagcagtagcaccgccgggggaggcgcagcgcagcgcaacggccggcgccgggacgagagatcctcgaatgtacatgtatgtatggcgctcgtcttggcctctcagctgtccgcgcgcagattggtctcggcttttcaatctgcttgtcttcttcctccagttctcctcctggtttacgaaaggaaacgcgggttcttccttccttcctttcttcgtttccgttccgatctgttttgcacgtgggtggggttcattcagcttcccgctccgctgacggggttgcgacttggcatttctggacggatcacctgcttgcttcgatggctctttctgtctcaaaaatgaatttcaataaagcttagcccccgaacgatctcgactaagttctgttcatgtccatggtttgtttcggccttcccggccatcagaaacgcgcctcccttctcttctcttctattctcttctcgcaatgcatcttgcgcgcgagtgtaccgggttcggtttggttaccacgaaatggatttgcagaactgacgagccatcacatgggctttctttctgcaggacaaggaaacttttccgtccagctgacccctctctgatctcgccaccgaagcgcacgctggacacccgtggttggtggcaccatgctgcagtacctggacttctcgcacgccagcacctcaaggaagtgggcgcacaggagacagggcgacggtatggcgatcatcagtccaaatgtccaatcctctctatccaccatccttctcagatgaactaggcctgcaatcctgcattcctcgctggacgctacagtttatagcatggtcataggaatgtaggattacatttttttattaatcaagatatcctttttttccccttgatttgtcgatatgatatctttatctgctcttttggtatgccataatcatcttccaggacttgaagctccaaggaacagcatggagttcgctttggaggcttcccacagctatggcgtgtttcaggaagatgttccggtgagtcttccgtatataccaaccagtactctgcccctgcctctgtcagagtaattcccccccatcttctgcctgtcgccaatcgccatagcatagcaggcaggcacgctgctgttctgttttcagacaatgaaggaccccctgttgtcactaacaaatacggcaccatacagttcgttcgttttgaccttaagtgagacttgaggcacctactcttgctctttgcatgtctcggtaactttgctgctagctacttgctatagtatagtccctcctggctgtacttgaaactggttatagttacatgagaggccacatcaataatgatgttaagcagtacagtagcacatactgttgctgaatctactgactacgtcaacagaaccacaaaaaaaaagatgtgcttttgtactgtgcaagagctaacaagcactgtttgctatgatctgattaagttccttgtgatttttttagcactatccctgcaatatgaggcagtacccaaaatcagggctcaaccacagctttaacccagtcaagaagctgatccaggaggacatctcgttccgaacgaatgaagtccagaagaggcccggcggcgtcatcgccagactgatgggcatggaatcgcctccactgaacgcagctactgaatccatcagtcgttcggagatcaccccgagaccaacaatgccaagaagagatcctcctgaaagggagacctcagccaagcatgtctccttcgtgcagcacggcaacagggactccaccaagcaggcgtcaaagcaggagatccgagcctatggcgaggagagggacgtgtttgggcagcagaacaagaggggcaacgagtggagtaagccgcagccgcgggagcacccgcaggaggaggagctgcagaagttcaagaaggagttcgaggcgtggcaggcgagcagggcgtgggagcactcgagaagcttcgagctggagagtagcaccctcggcgacgacgatgacgacggcaggtgcacggacatcgtgccgtacaggtaccagcaccaccaccaccaccaccacaaggggaaagatgccagccatggcggcaagcacatgcgctcctccaacgaggacgtgcattgttggagaagaagcagcaaggagagcggcacgtccatctccgggagccgtacgttctctctgacgaccagcgcagacgccgccgcctgctccacgaggctgccgctctccaggttctaccacgaggaggagaggtcgctgtcgccgacgaggatcgtgatcctcaagccctgccccgagctgagcgcggacgacgtcgaggagtcctcgctcgggtcgccggagctggtgaagaaggagaacaacatggaggccttcctggaggaggtcaagaagaggctcaagatcgagctcgagggcggggtggcctccgacgacaaggcggaccgccgttggtccgccgccgcagccgccgccgacgttattccggccgacccgaagcagatcgcgcggagcatcgccaaccagatcagggagaacgtcacgagggacatgcacccggcgctgctgcggtcggagtccacgcgctcgtaccgcagcgacgtgccgttcgacgggcagggacagatggattacatcggccgagacgcgaggaggcagctctccgacaggctgaagaatgtgctgaggagggacccgccggacgccgagacgcccttctcgttctcccaccggagaagggccacctcgacgtcgttcgacgaggagccaacgaggcccaagccgacgaggcacgaggtgccgccgccgtcgtcgaggaaggggaaggtcaggagcaaggaggaggagaggaagtgcgcggtggagtccgacgtccggtcgttcagatacggaccgagcaacaccccgacgacgacccagctggactccgagcccgtgtcgccgcgaaacctcatgaggtcgttctcggcgccggtgtccgggacgaccttcgtgaagctcctctcggaggagccgcgggtgctgaccggagcgaggctgcagcgcaagcaggaaggccacgggagcagcaggccagcgtcgtcggatgagaggaaagggaggaaggacgcgttcagcatcagaggcaaggtgtccaacctgaggcagaactttgggctcagagccaagctgttcggcaagatagttccacgcctccgacgatgccgttccccgacgacctcccgcccatcggcaccctcgtcaccgcaccatcggtcctcatacaccccggcgtcctgcaggtgaggcgtgcagctccaccgagctcgatgttttttctctctctttctttcattcagagccattgtcgttgcaatctaaaagcatgggagggagtgacggatgcttgtcttgttgcaggagaactccaccgaggtaccaccgagcccggcgtcatggtgcagcagcccgcctgacgagatgagcaggggaggctacccaagccctgtctcgccattggaggcatcctttaagcgaagcaccggtctcccatgaggacggaagccaaagacatggcttcagcggcttctggtaagtacacagtgccaaaaacattgtgcaggagcagtttatgccttgccacgaccatgagttctgatcagagaacctctcgcagaaccaggagaacaagcccatgctgaagaggggcgcgccgagacaagtcctgtcctggacgagcaggacgacggcgacatggacgatacagatcaccccctgaagtccttcgtcagagctgttctcgtcgtcgccggcatgtacgggcggaggcacaaccctggcaacgccaccatgtcagagtgcgaggtcaagcctatccccaagtgggtgctggaggaagtcgtgtccccgtcctcagccccggcgggctgcggcgcggcagccgtcatggaccaccggctcctcttcgacctcgtcaacgaggcgctgccgggagccgtccgggcctccacgacgctgtgcgcgttcgacaagtgccacgccatggcgccaaggagagcctccggtggcaaggcgctgctagaggcgctgtggaagtccatgcaggtgtggatagagccgccgagcgaccgcaggacggcgagctctgcctccgtggacgtgctgatcggccgtgacctgagcgtgtcggcgtggcacggcgcgttccgcgaggacgcggacgcgctggctggggacgtggaggcggagctgctggacgagctgctcgaagagacggtgtgggacgtgctcctcaatgtgggggactcatgatcggatcgtatgcctcttctgacgagtatacttgtacattttggggtgcctttttttctgcctcttttgggtgcttgccgggtttgtgaacggtgttgcattggcgagtgagatatgtaactatgcttgcgtgtggaagaatgctgaatttaccctgagaaatgcttaaagaagagagagaaaaagatgaataataaaaggaacagctgtcgtcatgtcattcgtgacagtaaataccagcaacgtagtaacagatagtttataacattaaaatatagtcgttaaaaatgcacaaaacatgtccaatgcagtcatcaaatggacaaagacaactatcataggtgttgtttggttcacatgtttgtaatgtaatagggggtcgagtgatcactcggtggacatccctaagaagtggcacc

SEQ ID NO: 5087 - DNA, 1084 bp, Zea mays
gtcatgtttgcaaaattctcggtgcggtggtgggaatgaaggtctgaaaaaaatcacagaactcactcgaacgacggtgccgccgcttgcctcgccggaccatggccgctgtgccgtcggggttcctcctcatcactggcccgccgggcgtggggaagacgacgctggtcatgcgggtgtttgaaaccctcagaggctcccacccgaacctcaacattcgcggattctatacccgagaggtgagagagggcggagaaaggatagggttcgaggttgtcacgctcgacggtagaactggaccactttcctcatgcaaggtttccagcccggagtctgttagatggcctaccgtcgggaaatacaaagtagacgtagcatccttggaatcattagcagtacctgagctgcaggttaaggaagaaacagatctcttcatcattgacgaagtgggtaaaatggagctgttcagttcagcatttttccctgcggtaatgagagttattgaatccaatataccagtgttggccaccataccgattcctaggcagggccgggacattccaggagttgcgaggttgcggaatcatcctggagcagctgttttcaccttagacactggtaacagagatacgatgagagatactatctgcagtcagttaaggagtttgttgcagaagaggtgatctgctagcctcccttcgtctctgcggccgctgctttgtctgacataacacacatacgataaagagtagaagttttctctcagcatgatctcatattctgcaacagaacatgcggtcgagtcttctggtgcagtacctgaaatacctgttttaaagcttaccgagcagtgaatggcaggcagattactatgttgctgtgctcagatggttagctctggatgaacaataagcatgtcgtccagtttgttctgagttacgtatgtgtggctattcagtcatgtatttgcattcggtgggggcaaggttttattgccacaataactctcgcttgtatggatgcggttagcatgtagtgactctacaacaggtatcacatgatttgcacaaaaaaaaaaaaaaaa

SEQ ID NO: 5088 - DNA, 2455 bp, Zea mays
cactcctatatttttattaacgtatctaaaaaataataaaatctatagatacaaatattaatatttatgacactaaataaataatataaaaatatttttaaataaaaatctaataatcattataaattttcctggttaaactaaattttaactaattaatatcaaaatatctggctctataaattggttctttcactctcgggctagccaaaataactcgcatgtatttatagagaggtaaatagggagttaaataaagagttaaaaaattgatgctcttaaatactttaaccagaaattgttatagcattgttattttgtgaagctgcatgtgaggtattgcgtcaagtctgacatgcaggtagaagttgacagccttgcagtggcagtgcccccatgccaccatgtcaccgcatctgtacattatttgtggtccaaaggcagaaacaaacaactggacgtgaagttggcagcctctggttttacagatagagtgtttaactgagagttcataggtcaatgaacataagacatgcatctactccatatatttgattactgcccacgagattagcaggctggcttgcgcatccaacctaccgcttgatttaatcaaagtagcaagacagctcttgcagcagtcttgctgctcctcaaaaaaggctcagaccaatacaagctgcagcaacagccatggcttcagcgaagcagagcaagaagatgcgcatacttctgatcccattcttcgccaccagccacatcgggccctacatcgacttcgccgtccgtctcgcggcagccaggccaggagccgtcgagcccaccgtcgccgtgaccccggccaatgttgcggtggtccggtcggcgctcgagcgccacggccccgcggcgagcggcacggtcaggatcgtcacgtacccgttcccgcgcgtggatggcctcgctccgggcgtggagaacctctccaccgccggagacgacgcgtggcgcatcgacgccgccgccatcgacgaggccctctcgcggccggcgcaggaggcgctcctcagggagcggtcccccgacgccgtcgtgtcggactaccacttcttctggaccagcagcatcgccgccgagctgggcctgccgtgcgtcgttttcagtgtcatcgcccccttctcgggtctcgtcatgcgcatcctcgccggcgccgtcgtctctgggtcgcgtgacgttaccgttcccgggttgccagggccggagatacggatccccgtcagcgagctgccggagttcctgagacgcccggcgaaggaccaaggcacgttcagcccctgcaacgcggcgcaggccaggtgtttgggcgtcgcctacaacacgttcgcaggcatggagcaggagtaccgcgaggcgaacgtgcgcgccaaatccttgaagcgctgctacttcgtcggccccgtctcactgccgctgccggcggcagcggcaggcaccagcgagtctccatgcatcaggtggctcgactccaggccaaactgctcggtggtgtacgtgtgcttcggcacctacgccgccatctcggaggaccagctccgggagctggcgctcggcctggaggcctcaggggagccgttcctgtgggtggtgagggccgacgggtggacgccgccggagggctgggagcagcgcgtcggggagagggggatgctggtgagagggtgggctccgcagacggcggtgctggcccatccagcggtgggcgcgttcctgacgcactgcgggtcgagctcgttgctggaggcggcggcggccggcgtgccgatgctgacgtggccgctggtgttcgaccagttcatcgaggagaggctggtgacggacgtgctcgggatcggggagcgggtctggagtggggcgcggagcacgaggtacgaggagagggagctcgtgccggcggaggcggtggctcgggcggtggcgaggttcttggagccaggcgggccgggggaggcggcgaggggcagggcgcgggatctcgcagtgaaggcccacgctgccgtagcggagggcggctcgtcgtcccgtgatctgcatcgcctcatcgacgacctggtcgaagccagagcggcaacgagcagctgcaacgctgacagcgagtaagagatggaattgctggagatgtctcgatctggcgagcaactggaagaaggtctcgaacagccttcacggacaagtacgccatctgcaacgtacgtacgttctcggagtcgaagaaaacacttatggaaataatatggtactgcaccacctcgatttctgtcaaaaaaaaaaaaaaagacactcgtgcttgctttgcttcccaagatattgtgccagcaggagctgtcgccatctccgatccaccgcaaaccaaaccgcttggtagttggcaggtgtcgccatctccgactccgatccaccgcaactactcctaccgtcc

SEQ ID NO: 5089 - DNA, 2722 bp, Zea mays
tctccttatatctgtattttctattatattttactacatcactctaaaagatactctccacacaccttacatttccaaccatccactctatctagctcacctatatactataatttagttattttatattttctcatctgtttttaaagtttaaaaaaaccatatactgtttgtactaccacaatatatattattatcgggttacattacttaaaaaccgttaatataaacagaaaaattaagtaataagggctggtttggccattttcgtaagtgatttccattttcctaagagatgatttggtgaccataaaaatgaaggggtctatggggaggaatctccttcctattcaaaattgaacagaaagaaaatttctctcccatggatcccctccatttccctggtcaacaaaccagtcttaaaggctagtttcgaggattggaggggctagaaacccccttcttattcgaaattgaataacaaggagattctaattcctccaatattctccggttttgtgactcccaaactaaccctatggaaaaataaactttttcttagaaaaatgaaaaaaccttagaaaaaaagttttcagactagccattaaagtggggggggggagattagaactctctccagggccgggtagtttcttccgcacatagggtgtgccggtgtagtgtcggggaagctcttacagcgccttccccgtggccggccgcgacacggtagcataggtggagggggtgtgaggtgtgtgtggttggagtgggcctaacaattgagcctgccgcgcacaatcaatggccgcgctcgagtccaacaagaagctgcgcctccttctcgtgcccttcttcgccactagtcacataggcccgttcaccgacctcgccgtccgtctagccacagccaacccggacgccgtcgagctcactctcgccgtcaccccagcgaacgtccacgtggttcgctcggccctcgggcggtacggcgccgaggcgggcggcgtgatcaagattgccacctacccgttccccgcgtggacggcctcgctccgggcgtggagaacctctcggccgccggggacgacgggtggcgcattgatgccgtcgccgtcgacgaggcctcgacgcgaccggcgcaggaggcgctcatcagggaacagtcccctgacgccgtcatcaccgacgtccacttcatctggaacaacgccgtggccggcgagctcggcgtgccgtgcgttacgttcagcgtcgttggcatcttctcgacgctcgtcatgtaccacctcggccgtgacgtcgtcatcagagatggccaggaggtgaccgtccctgggttgccggggccggagatacggatccccgtatccgagttgccggagttcctgagacgccggcaggagcacgacggggtcaggcggtgccatgtggagatgggcaggtgcttcggcgtcaccctcaactcgttcgtggatctggagcagccataccgggacatgtgcgtgcgcagcggatacctgaagcgcgcctacttcgtcgggcccctctcgctgccgttaccaccggccggagcaagcaccagagattcgccgtgcctcgcgtggctcggcaccaagccgaggttttcagtggtgtacgtatgcttcggcaccttcgctgccatctcggaggaccagctccgggaactggcgcttgggctagaagcttcagagaagccattcctgtgggtagtgagggcggacggatggacgccgccggaggggtgggaggagcgcgtcggagagagggggatgctagtgagagggtgggcgccgcagacggcgatactgtcccatccagcggttggcgcgttcctgacgcactgcgggtcgagctcgctgctggaggcggcggcggccggcgtgccgatgctgacgtggccgctggtgttcgaccagttcatcgaggagagactggtgacggaggtcctcaagatcggggagagggtgtggagcgggacacggagcacgagatacgaggagcaaaaggtcgtggcatggcagcagaggtagtggcgcgagcggtggcaaggttcttggagccgggtggcaccggcgaggcggcgaggagcaaggcgggggtgctcgctgcgaaggcgcgctcggctgtggcggagggtggctcgtcattctgtgatctgcgccgtctcgtcaatgacctgatcgaagcaagaacggctgccggaaccaacgcctgagttacaaaaatcacgagtacgtgttgaattgctcgatgtgttttcctttttttttccaggtggtttgtcctttcttgggaaaatgtcgaaggattttcactcctgttattttgcatacttcgctattctgcacactgaatctttttatgcttcaatggcagcaaggctctccactcgctttcctgcagagcatcagggcgaaatgtcagtggcagagtcaatatgcagaggatccactccggttcaaatgggatttttttctcataaataaatgtaagtaaagttaatcgacaaaaatcgctggaattctaaagtgagacttcgacaaaaaccgctatgcactcaagattctcgatgtaatcgatgtacaataaaattattaatcgatgtaggactaaatattacccttgtgttgtaaccagagcaacaaaaaatatttgttatttttgtacccaagtttaaattaaggccatgatcagtggc

SEQ ID NO: 5090 - DNA, 1800 bp, Zea mays
  misc_feature (1800)..(1800): n is a, c, g, or t
agggccgggtagtttcttccgcacatagggtgtgccggtgtagtgtcggggaagctcttagagctccatttccttatagtgatagtacacggtagcataggtggagggggtgtgaggtgtgtgtggttggagtgggcctaacaattgagcctgccgcgcacaatcaatggccgcgctcgagtccaacaagaagctgcgcctccttctcgtgcccttcttcgccaccagtcacataggcccgttcaccgacctcgccgtccgtctagccacagccaacccggacgccgtcgagctcactctcgccgtcaccccggcgaacgtccacgtggttcgctcggccctcgggcggtacggcgccgaggcgggcggcgtggtcaagattgccacctacccgttcccgcgcgtggacggcctcgctccgggcgtggagaacctctcggccgccggggacgacgggtggcgcattgatgccgtcgccgtcgacgaggcctcgacgcgaccggcgcaggaggcgctcatcagggaacagtcccctgacgccgtcatcaccgacgtccacttcatctggaacaacgccgtggccggcgagctcggcgtgccgtgcgttacgttcagcgtcgttggcatcttctcgacgctcgtcatgtaccacctcggccgtgacgtcgtcatcagagatggccaggaggtgaccgtccctgggttgccggggccggagatacggatccccgtatccgagttgccggagttcctgagacgccggcaggagcacgacggggtcaggcggtgccatgtggagatgggcaggtgcttcggcgtcaccctcaactcgttcgtggatctggagcagccataccgggacatgtgcgtgcgcagcggatacctgaagcgcgcctacttcgtcgggcccctctcgctgccgttaccaccggccggagcaagcaccagagattcgccgtgcctcgcgtggctcggcaccaagccgaggttttcagtggtgtacgtatgcttcggcaccttcgctgccatctcggaggaccagctccgggaactggcgcttgggctagaagcttcagagaagccattcctgtgggtagtgagggcggacggatggacgccgccggagggctgggaggagcgcgtcggagagagggggatgctagtgagagggtgggcgccgcagacggcgatactgtcccatccagcagttggcgcgttcctgacgcactgcgggtcgagctcgctgctggaggcggcggcggccggcgtgccgatgctgacgtggccgctggtgttcgaccagttcatcgaggagaggctggtgaccgaggtcctcaagatcggggagagggtgtggagcgggacacggagcacgagatacgaggagcaaaaggtcgtggcagcagaggtggtggcgcgagcggtggcaaggttcctggagccgggtggcaccggcgaggcggcgaggagcaaggcgggggtgctcgctgcgaaggcgcgctcggctgtggcggagggtggctcgtcattctgtgatctgcgccgtctcgtcaatgacctgatcgaagcaagaacggctgccggaaccaacgcctgagttacaaaaatcacgagtacgtgttgaattgctctatgtgttttcctttttttccagctgtttgtcgtttctttgggcagcagtttgtgtataggagggtaccaaatatttttaagagaaagaggtatttgtatttccttgtgaatagtagagaaacagacatttttggctagcagccaaatctgcgaaaaaaaaaaaaaaan

SEQ ID NO: 5091 - DNA, 948 bp, Zea mays
cccatgttctagttagtgacaaaaagaaagtgtgtctgggtcccttactacgtgcctcggtgcctgcatcatagtcattcgtactcgtacatatcctcctctgctgtccccctctggcgtttgcgggcccggtgctttctcttccttccggccgcggcaatggcgtcggggaacaacaacaagcagaggagcgaggaggagtggcgcgtcgtactctcccctgagcagttccgcatcctccgcctcaagggcaccgagttacccgggacaggagagtacaacaaattctacggcgacggggtttataactgcgctggctgcgggactcccctgtacaagtccgccacaaaatttgattctggctgcggctggcctgcattctttgaggggcttccaggagccataaaccgaacaccagatcctgatggtaggagggtagagatcacatgtgcagcctgcggtggccatctgggccatgtgttcaagggtgaaggcttcaagacacctactgatgagcgccactgcgtgaatagcgtctcgatcaagttcagtcctggctcctcctagatcatcttgagattctcgtgtcctggaactgtgggaagtacaccaaagcgacgaataagatttattgagcatgtgtgcgtgcgtgcattctgctactctggctgtgagatgaaactaatcataagcagctgttactctacgtgattcgtcatttacatcagctgttactctggcgtgattacacgaattttttgttcagacggtgtgggactgtgagctccaagttaagacgccttttccacgtgttttgtatcttattgcaaatcgggagcttattagactttcttttttcaaaactagctggatgcccgtgcaattattcggctagtatatggttcaaccctaataaaagttaacacgtaccttgttggtggcagcccc

SEQ ID NO: 5092 - DNA, 2110 bp, Zea mays
  misc_feature (1062)..(1062): n is a, c, g, or t
cctttcgaccgttgaactgatgatttaaatatatagtagagactaggagagtgcccgtgcgttgcaacgggaacgtataaaaccacgataaactatgtacaaatgtgtgttatacttttataggttagtgctcgtgcgttgcaacggagacatataatatatcgatatcttatatatgcatgtgtgttatatatacaaaatgtgtcttatattgttatagtaagatgctcgtcctaacgatactacgaacctaaggctgcctccaatggagcagctaaaagggtatgcaaagctattatggctactcatattcactgtagcaccatgcatcttccatccaacagagtagccaaacagagcagccaaattccatggcaggtgagagaaaagctattatggctgggcaggaactgagcaggcatctctgatgcaaattggtgggccattcttatcagtgagcatgaggcaagctatttttgctataccattgaaaagtgttatattatagatggacagctaaaacatctacgtcagccaacatgttgaatgcctgcttcttttagctgccgcatgttggaggcagcctaaaaggcaataaaattaattagtgggtcctggcaggccacccaggttgttacgggtccggaggattcgcagccacgagctccgagcatgcaggcatcagaaccggtcttcggttgaaggggaggaggagagggatgacagatgagccctaccaggcattgagcgcgcggtcggctgtcaagtggtcccaagtggtcagggcgcgagctgatttgcggacacgcgggcttgcgcggttgctaggctgggccacgatgacaacacgtgtagcgtgaggatgggccgcgcggttgtacaagggaggtgggccggaatggggataatcggcccaggcagggtttctttcttattattttcttttcttttcttttctttttctattatcctatttctttcctttccatttcaaatccaaaatttgaattctatagtgacggcaaaatatgtgatctgttttctgtatattgcgagaagcantttcatgaagacctggaggaagtgagaagaaactggggaattctaccatgccctagtcccaaatagaacagtgtatatattagtcccaaatagaacagtgtatatatagacaggcacattctacatgaacagttctgcatcgtgtaatgtcaataaacttttgattatctggcaaacgtggcattaaaaaaagatggaaatgccgcacagctttgctcatgctttgctcatgctggttcatcaaatttacacagaactcttcttgccgaggacatggcctccctcaaaagaattacgctattgtaagcatgtgtaacacgcgaaaagaacacaataattacatggctcaaaacttacaacacaacacaaggtagtgtgtactacccaacacggtataaaattatgaagcagcagtagtgcacaagacacagcgcatgcgagactggcctgatggggaaccatcctcatcgtccatgcctccatcactatcctgaccactgtttgatctcatcgagtctaagccaccttcaaggcaagacagatgatacgcatggcagcagtagaacacgatgacagatatgtcctggataggcaaaggatcgaagcacaaacaacaccgggcaccacatcttgttctggacttgatatctagagcccggacgctagatgatctctcgtgtccccgcgatgatccatcgtcagctctgtttccgtgtacctcctcgtccatgcttaccatgtataccccacgccgagcctcgtggtagtatttaaccaaaaggttaacacagtcagccttgaactatatcgttgcatccatttcgcaatgaagtttctgtccggtaatccgtcacaattttcacaagacgatcccgcaaccgaggtatttctaagccatcaggaaccaaactgacaatgtacagaggatcaagattgccaactgtatgttccaatagattccctaccatttcaggcttctggaggcattgtctaatcagttcctcccacagttcatcatcatgctgttctgtaaccgtaaccggccggc

SEQ ID NO: 5093 - DNA, 732 bp, Zea mays
ttttccacagaggccggccggggaaacttgtctcggattgacttcaatatataattgctccagtgaataactgccggccgggagtccgtactacccaggcaagcgatcgtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttgtttgttttttttccttcctctttctacttgattttcatttaacgaattggtatcgctgatgcaccagtttaatttggtgccctgttatttgttctttccctcgagtgagggatcgacacctgtaccattgcttgccatttgtctggaccagttcaacaattcgatttaaccatcaaaaaaaaaaaaaaaaaaaatttgcggcccccccccccccgc

SEQ ID NO: 5094 - DNA, 2840 bp, Zea mays
  misc_feature (1)..(1): n is a, c, g, or t
  misc_feature (5)..(5): n is a, c, g, or t
nttanttttttttttgcatcgtgtaatgtcaataaacttttgattatctggcaaacgtggcattaaaaaaagatggaaatgccgcacagctttgctcatgctggttcatcaaatttacacagaactctccttgccgaggacatggcctccctcaaaagaattacgctattgtaagcatgtgttatgtgtaacacgcgaaaagaacacaataattacatggctcaaaacttacaacacaacacaaggtagtgtgtactacccaacacggtataaaattatgaagcagcagtagtgcacaagacacagcgcatgcgagactggcctgatggggaaccatcctcatcgtccatgcctccgtcactatcctgaccactgtttgatctcatcgagtctaagccaccttcaaggcaagacagatgatacgcatggcagcagtagaacacgatgacagatatgtcctggataggcaaaggatcgaagcacaaacaacaccgggcaccacatcttgttctggacttgatatctagagcccggacgctagatgatctctcgtgtccccgcgatgatccatcgtcagctctgtttccgtgtacctcctcgtccatgcttaccatgtataccccacgccgagcctcgtggtagtatttaaccaaaaggttaacacagtcagccttaagtatatcgttgcatccatttcgcaatgaagtttctgtccggtaatccgtcacaattttcacaagacgatcccgcaaccgaggtatttctaagccatcaggaaccaaactgacaatgtacagaggatcaagattgccaactgtatgttccaatagattccctaccatttcaggcttctggaggcattgtctaatcagttcctcccacagttcatcatcatgctgttccgtaacaaattcaacagcctcctgcatgtcttccagtttgtttataattgtcgacagagcttccttagcattgcccattcgaccaaggacaaaaacttgctcccttacaagttctttttgtgcaaagatttcatatgccttgtcaagcctgtaatgctgactggttcgaaggaagggtagtagcatccttgtctcgtagtctgcataaagctccacctgcatatcatgaaaatcctttccagcgtgtatatctatctcaaataaagcatgcaaatacaggtgtaacaaatatctcttgtcacattttttactggtatgcaacagctgctccacaacttcatatgggggaatgatatcacgatgttggatcagtaggtgaactgttcttttattgtccactatcataagattgacaatcttatcatgaatggcatcatgcaagttgtatttctcaataaactcgaatacttctggcttcaggagttcagcataaagagaaagtgccttttcgtattgaccattgatcacatacaattcagctaatgactctttcaatgaatcagccatcgatgaggagtttagctgtggctcaatggcagatatgaccggtgaggctgagtataatgtcggtggccaattttttatagtagtcaagagaagttcatggaaagaaggattggtagttagagcaacaagggcaacctcatatgcagtatcactcagctgaggattttctgtaggaatataagggaccaaaacaggaagttggcggagatgagcaaagtggaacccacgcgtccgcggacgcgtgggcggatccccgcggcaactttgggcagcgctgagcagcttcagcatattttctttcaattatcaagtgatcaaggtatcttgagcccacctcatcaagaagctcagtgcgtccttgccctgcctcacctgcagccaatgctttttcatggcacccatgttgaagaagccaagcaatatgatcttcagcatctctcggctttgcaacgactatgtccttaggagacacaatgtaatacaaaggttcatcaccagcagcccactgtccacctgcattgctacttcctgagaaaggtgcatgtgcaagagcatagtcctttgccttgtaatgctcataaccatgaataggcagagcatctgtagtaagctcatcatttttccatgatacaagatgtatttctggacgctgtgcagttccctgtcgtgaagtaacagaagtactaaatgttttctctttttcatcctcatcaggaatataggcaagtacgactaaaaggtcaccaaatggagcaaccccagatatgtgatagcctgtttggaatgagcccacaatgtccacatacttctcagaactagctgtggtgatagttctttgtaggccattgagtccctgagatagatctgttcggatcgctgcaatcttgacacttgttccccatccaacaactggggggggggggggggggactagtgagctctcggaagcaagaactctggtcgaggaatgccttttggtctctctatgaatgcgatccctttgtctgttctcatatcatgcactttgacccctgcatcattagcccaagcaagaagatccgccctccacttcatcgaatggattggcccttcaccatcacgcaaaaccttcttgtggtaacctccccaagacttctttgtcagcacaagtacttggcctgctaaaccaccagtagcaaatcttctatagttccgggcataattagggtctagagcaattgccttcatggggcgatggtactcaaactttagcttttcatcggtgaagaggctgtttattgccaccgtgccatcatccgagcagctgcctatatattcaccatccgcgtcaaaacttatgtcgttgatagttgctgtgtgcggacgcgtggg

SEQ ID NO: 5095 - DNA, 958 bp, Zea mays
ccccaggggtgtctccttttatttttcggcgtttattttttggggaaattgggacgggaaaaaaattttcccacgggaaaccagttttggcctgtttttcccccaggcggccaattaacctcccctaaagggaaaaaaaatggggagtccccccccggggggcggcgccttttaaaattaggggttcccccgggctgccaggaagtccccactcggcgattgggttccgtcccgccggccgggaggccgtactacccaggcaagcgatcgtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttgtttgttttttttccttcctctttctacttgattttcatttaacgaattggtatcgctgatgcaccagtttaatttggtgccctgttatttgttctttccctcgagtgagggatcgacacctgtaccattgcttgccatttgtctggaccagttcaacaattcgatttaaccatcacgtatatgtgtgctttggataaacattattacattaccctcatggtgaggggattgccggtttgataaaaaaaaaaaaaaggggcggcccgccagcatttgcggcc

SEQ ID NO: 5096 - DNA, 3576 bp, Zea mays
gtccaaactcacaccatataagatttatatctctggacacacagacaaaatatgcccgttgccatttctaatagagatggtgccacacatttccgaccaaaaaatagggacaacgcaatggaaaaataacatgatgaagattacttaggttagagatatcatggcacttaaatggatgtgaacgtcaaaaatgatccgatctagtttaaattattattttttttataaatttatgggaattattggggattgaaagaatatccacttcaaatattttttaggctgcttcaaaaaacatggtttagaagtgctctaaatacttcaagtcaactccgttctagatgaacgctcgtttccctcccggcgactacttgcatccattaccggctattgcttccattaccgtccgcgcttagcactaaccacagtgaaaactgcgccactaaccgcagctttaaccccaattccatcaattagcggcgactgataaagtaattaagccggtggcgaagcatcctcgtccgcgtccgcggccccaccgatccggtacgggagttctcggctccgacgccccacgcggccccgcctcgcgctccttcctcgaacacctcgccgccggctctcctcagctccgccgactcgcttcgctgtcctcctcgcccccagcctcctcctgatcccagattcgcctcgccggcccccggcgcccgccacgagcgccgtcaagcgaagccgttcttccctggcgcgcgccgctggcgtagctgccaggctccttccgccggagcacgtcgcggccagctggtcccgcgctcgtcgtccaccgtcgtcgcggcggacttcgtcctcctcccggaagcacagatccgcacaggctcggctgcatttctccacttgctggtaaggaagctcgctccgatggattactccgagggttagttccgccctggtcttccgtttctacgctgccagcaatcaagttccaacaagtcgtcgatggactgcgatctgttcgctgcgtggtggagcagcagcaccagattagtctcctggtccggtcgcgggtcccctgatgccccgggcccgtcgccagcgaggccagccatgccgcttcaccagaagcaggcggggctcgctgctagcaagctgggcgtggggacctcgaagaaacacagggcttttgtcgcaagcgatgagcagtggtacaacaagatttttgatccgtcaagcgacttcatcttgacatggaaccgcattttcctcttctcctgcttcgtcgcgctatttatagaccccctctatttctatgtgcccaagatcagctacggcagccccaaattctgtatcggaacagacacccgtttcgccgtcggtgttacattcttcagatcgattgcggatttattgtatgtcctgcacatcataataaagttcagaacagcatatatcaatccaagctcgactctgagggtgtttggaagaggggatcttgtcacaaatcccaaggaaattgcgtggaaatatatcagatctgacttagctgttgatgtggcagcggctccgcctttgccacagattattgtctggtttgtgataccagctataaagtattcctctgctgagcacaacaataacattctggtgctcttgggtcccgcgcggccgcccccgagattgtatctcatattccccttaacttatgaaattgtcaaagctactggagttgttgcaaagactgcttgggaaggagctgcatacaacatggtgctctatctgatagctagtcatgtgctaggtgcactgtggtatttgctatctgttgatcgccagacattctgctggaagacgaactgcctgaatgaaactggttgtgatcttaagtacctagattgtgacacgacaccaaatgctacatgggcgaatacgactgctgtcttcagtaattgtaatgctagcgataccaatataagttttgattttggcatgttcgagcctgcattgtctaatcaagcccctgctcaaagttttgcgatgaagtatttctattccctctggtggggattgcagaatttaagctgctacggtcagactcttactgtgagcacctatcttggcgagacgctgtattgtatattcttggcggtacggcgcctggtcttgtttgcgcatttgattggaaatgtgcagacctacctgcaatctattactgtgagggttgaggaatggagattaaagcaaagagatactgaggaatggatgagacatcgtcagcttccttgtgaactgcgggaaagggtgagacgatttatccagtacaagtggcttgcaacaagaggagtgaacgaagagtcaatattgcatgctctgcctgcagaccttcgacgtgacattaagcgccacctttgcctgggtcttgttcgacgggttccttttttctcccagatggatgatcagcttcttgatgccatctgtgagcgtcttgtatcatcactgtgcacaaaaggcacatacattgtccgtgagggtgatccggtgacagagatgctcttcatcatccgtggaaaactggaaagctccacaacaaatggtggccgcactggcttcttcaattcaatcaccctgaaacctggtgatttctgtggcggggaccccccgggatgcccgccgggccccaggcctactacaaatttgccatcatccactcggacagtgaaggcactgatagaagtagaggcctttgcgctccaggcggaggatctcaagtttgttgccagccagttcaggcggctgcacagcaagaaactgcagcacactttccggtactactcgcaccactggaggacgtgggcctcatgcttcatccaagctgcctggagacggtacaagcgaaggaagatggcaaaggacctgagtatgagggagtcattcaactccgttagattagacgaagtggataacgaagacgacgattctccgcccaagaatagccttgctctaaaattcatagctaggactagaaaagtgcctcagaacatgaaagagttgccgaagataacgaagccggacgagccagatttctcagctgaacccgaagactaaagttgtctttgcttatgctattatgtacagtggtcatagctgactattgtgaattgctagtcctatttggttcgtgatggaggttacgagtcacaactaggtatggtgaattgaacttgggttgacggtgccatctgtggatgtgaggaaggtagcttgaatctcaatcagagcccatctgtggatgttgctacgttcatgttgtatattcagacatctctgggcctatagatttcttgaaaaaaaaaggaaagaaaaaacaagaatacatcattacatagactgtaatcttaaacatctgacattgaagggtgtggctacgttgtcagcacacgcagtggtgagagatatatcgttgagtcatcagggcgcagattcgaacaggcgcggagctaggccgcggattctaacaagcgcagagctaggtctgtttattgccacggggatcctatacatacgacctgcatgcatacaacc

SEQ ID NO: 5097 - DNA, 3360 bp, Zea mays
  misc_feature (2933)..(2933): n is a, c, g, or t
atctaatgtttccgtttgaatggcaattacgagtatttaatacagtttaattataaaaataattataatagatgaatcctagagatgagatgagttcaaatcctcgacctagccataggtgttcggcgatgttagactgttattatggtgcgtttggttgtaatgacagaacggaatgagacgagacgatctctcaaataatgttgtttagttcagggttaagggttgagacataactattctagtgttgtccttaatctctactactattatgtaagtagtgtaggcgtccacacgtcccctcggcgcacggttctgcctctgcccgcgacaccttgccccgcttccgtcaatcacgcgccttgcacaaccgccccatccgcagccctcccacccccatgaccccgtccgcccagatctggatcccgcccccgtcatcggcgcctcctcccccgcgcgtccgagacccggatccgccgcttccccgtcaagctccccagtctccccctccctgctcggtccgtatggcggcttgacggcgaatcggatcttcctcggcctcctctccctgcgcccctctggtcgccatggagctcgcctagaggttttctcaaactcctcgccgccggttttctcaaattgtcaatttgagaaaacctctagacccggatccgccgcttcctcgaactcctcgccgccggctctcctcagctccgccgactcgcttcgctgtcctcctcgccccaggccccagcctcctcctgatcccagattcgcctcgccggccccaggcgcccgccacgagcgccgtcaagcgaagccgttcttccctggcgtgcgccgctggcgtagctgccaggctccttccgccggagcacgtcgcggccagctggtcccgcgctcgtcctccaccgtcgtcgcggcggacttcgtccccctcccggaagcacagatccgcacggtctcggctgcatttctccacttgctggtaaggaagctcgctccgatggattactccgagggttagttccgccctggtcttccgtttctacgctgccagcaatcaagttccaagtcgtcgatggactgcgatttgttcgctgcgtggtggagcagcagcaccagattagtctccaggatttttcgggggtcagctgatgccccgggcccgtcgccagcgaggccagccatgccgcttcaccagaagcaggcggggctcgctgctagcaagctaggcgtggggacatcgaagaaacacatggcttttgtcgcaagcgatgagcagtggtacaacaagatttttgatcagtcaagcgacttcatcttgacatggaaccgcattttcctcttctcctgcttcgtcgcgctacttcatcttgacaagcgatgtttgttttttttctttcctctttctacttggttttcatttaacgaattggtatcgctgatgcaccagtttaatttggtgccctgttatttgttctttccctggagagagggatcgacacctgtaccattgcttgccatttgtctggaccagttcaacaattcgatttaaccatcacgtatatgtgtttgattaaaaaaaaaaaaaaaatcatggtgatgagattgccggtttgttatgccttaatatgcgtggttgaggatgtgctggccgtgtgccctgctctgctttttaaccgctgttatatttttttcaaacaaaagagaggcgtaatatccgtcaagatcaactccaataaaaagttgtatatttgagtcctaaaaattaaaatagggtctaatttcaaatatttaaaactatagaaaatatttgcagttgaaacagttgagtcatatatcatattattagaaaatagatcattttatttaagaaataaaaagtttggaagtaccatacaaaacgagggagggtagagattcaacatacgaggtcctacatttacaatctgagtactctaattaattgatgtttttttgaaatatgacccactagaaattttttttggtgataaagtatatttaaaaatatttacggcacgtacaacggccataaataaactgtctatataacgccacattagcatgattatccttgttggactcggttaaatgaagatagatcgcctcgcgtgaggacggctcctgctcatgctccaagggccaactggccaaggcaaatcgcccgctcgtagcctattgtacatagttgtcgccagtctgctgcttgcatatgattaaatactggtttgaatgtataaatatctgtagacgcccattgtatataatgtttttattactgtttgtgtatgacgcggcggctcaaatagacagcagtcgtttataggacttctattgaagatgctctaattagaatgatggtacctacgacgttagtacacactacttaatgacggaatgaatgccccctgcaagttgatactgttgcccctgaacgacatcattctatttctatgtgcccaagatcagctacggcagccccaaattctgtatcggaacagacacctgtttcgtcgtcggtgttacattctttagatcgattgcggatttattgtatgtcctgcacatcgtaataaagttcagaacaacatataccaatccgagctctactctgagggtgtttggaagaggggatcttgtcacaaatcccaaggaaattgcgtggaaatatatcagatctgacttagctgttgatgtggcggctgctttgcctttgccacaggtaattggtacttctattgtttttttgttcttattaattatatagtatactacttatgagttatgacccttgctgataagctggtttgtcacgagtttgctattcttgcaacggagacatataatacataagttaccgttatattatatgtccccgttgcaatgcatgggcactcacctatatgtanataagttattatatggtttcgtagcaacgcacgggcacccacctagttatctcttaaaattagagtgacaagaaaggacaccagaggacgtttatgtgctggctgtcccgcaaccaaaaccagagcagagactaaataaaacttaagcgttgaggtatagtgttcctagctgtgcaatgaccctgtcgacaagatctgactaaagaccaaataggcttttagagtagtagcctggtcccgggacggcaatcaccgtacgtttagtgcgtttaatacagagctttgtaccgtcggtggctatttaaactaacgtgcattcttttgtcagtaattctacactgaaatcctgctctctgacactgtacatatactataaaaaaacaggttgagctaaattaggatcagtccaaagtagatccatttttta

SEQ ID NO: 5098 - DNA, 3358 bp, Zea mays
cttctagattatataatctagcgtaaataaattaaagggcagacaaacaacacggattattaagtaaattatataatctagatacctagattatggtaatccacaaacatcttattaggtgtttatataattcataagctggattatataattccctaagaaaacaaacagtgcctaaagcgctcctccagaattttcgagtggcaaataatgttaaacagagtgtgaatgtgaatagtaagccacagatgtaatacataaaaaaatggcaaatactatacaaaaggtgcatcattaaccataggcacaaagtgatgatacagcacatcgatcagttttatcagcacgcagcaacccttcccaagaagaagcttccaaaactgaaaagggagaacgaacgcgcaagggctgcgaatcctgacaacccagtcgccagttgccactcccgtccttctagatgtccttccgtgtcttttctttgcttaacccggggcatcgaagcccaggttagccgcccacacgtcatcctcctctatctacaaaagcgacggcgcggcacaccatcagcctcccccccccggcaccgctcccaaaacctcacgagcaagcacgcgcggccacgaacaccatacgcgctgctcgctccctgtccctgccgtcgccgcgcgaggcggagaaaagagagagcggagcgccgatccatgaaggaggcactcgcgctcgtgggcggagcaaggcggctgtccgcgccggaggaggatgagctgctgggcctcctcgcgggcttccccgacgaagacggcggcggcggcggcggctccgaccgcgagctctccttctccgacctcgtcgaggccggcgccaggcaggcgatcgcggacgcggacctcggcgccgccaaggcgccgtgcggggatcgcccttgggcggccgtggcgctgccgtcgtcgcatgaggccgcgggcgctgcggcatccaagcagccggcggcgaggcagagggcggcgcggcggagcggcggcagcaggggcagctgcggcggaggcggcgacggcgtgctgctcaacttctacgtgccggggcttctcaccaggagcatgaccgcgccgaggcccagccgcgggccgccgtcgcccggggccgtgcagggcgcgccggcgaagcctgttgccgccgccggaaaagccagcagcagcaggtcagtgcccaacgcacgatcacacgcggttacagatgttttcatgaaagctttaaatttctactgttaatcgctactgcatttcgtgcttctctgtgtaccagcagaactagtcatgcgtacatgtgaatccatttatataaaaaaaacatcagcatctgcagttaagagtctgcaattgacactggcagttgactagtcacttagatgacaaagcgttactgacattcttggatgattttttttttgtgctggtactcaaattggtttgtttgaaacgcatgcacaattattacgttatggaaaaccaggccctaatccagcaatatactactgctgtactgcatctgcatggtaccaatatatgtcatcgtcagtcacttttcctttggtcagcatgagtgtatctgaaaatctgttttttttttgccaaccacatgccgctgaaagttataatcgatggatgcatttttccccctcctcatgggaccggtatccaaatgttcttccatccttttgacctatattagctttgtggagtcaacaatggaacaacctactatgacctaatgaccatgaaagtaaggaaatctgaccgaattacacagaaccagtccacccttgcccgtcagaagcttcttcattgacacatcttttcaggaacagttccattgctaaaagcggtttcgcatactgttcattctccgctgcttcagattcggttgtgaattgtgatattatatgtgtacgaagctgacagaaccgacacccgatctttcaggacgcagacggcccagggcatcggttgctggccggcgctgtggggacgcgggcgccggccagccaaggcctgcagctgaagctgagagacgaccgccgtcgcgcgccaccaatcggagtccggactccggagaagcaagcttgctttctttctttcatgagctttcgttcttgaatctacagcagtctacaaccgacctcagaccccctgctacctgcacctctgtaaaataacgccgtcgccgtcgtcgccatctccctttctggtgtgcgtgtgacgcagcgatctctgtcgcagctcttgacgtctgaaccgtagctcctcccgctttgagccggcgcggggcgcgggcctcacgttccagctgccgcattgcacgtgttcagagaaagcggacagaacagaacagaacccgacccagaccctgaagagtctgaatgagtggcccatggccagtgagacgcgctgctgctggcaaatcagaggaggtgcagtgtaggcatcggggggaaaaatgtcttcttgggctcgtgctgcggcttcgtgcctgtcaatcgtcttactactgttaatgtggactgtgctgtgttttccgagctgtggagagcgcctgagacgccacatcgcacgacgcggcacacatgagtacgtgacacatgggtctcggagctcagcgtagccaatccggcagccgaaacgactggtcggtgtgccagcgatgggactacgacatgacgagcgagcgaggcatcgatgtgccgtgtcgtacgctgctggcttccaggttccagcccgggggatgtggccggtttccgcggagaggcgcgtccgtttctggcgacctgaaatcggccgtctcgtcagggagataaatcgtgccccgtactccttccgtagcatagcataatcacataattgattgttcattgaatcattgttctgttcacctcaaatctacaagtgcaattgtttttgagacgaagtgggcacttcgtgcacctctcgagtcttgactccgtcgcgtcacgtcacgtccagtccgatgctgggaaatactgttgcaaggaaatctgacaaggacgattcaccaacacgaacaagctggagcggggagccaccgttaatctgctctctaaactctgtaaagggaacaatgcaaacaatcttatatacatctacatttgcattccccacaagagtagattttttgtatagttcagtctatgcacccagcaagtagcaaaagggtttctagctaggttgattaagtggtctgagtagcactctttaagtacttagttcgaatcctaattggagagaatttcagattaagttttaaaaagtcacttattggtttttttggttgtgtgtatataagg

SEQ ID NO: 5099 - DNA, 1060 bp, Zea mays
aggcccgtaccgaaaatcctcccacacgctgacgctggtgcccgttgctctgtcctctgttcgaaaaatttcctcttgttgagacctggggcatctctctctctcgcccccccccccccctgctcgcggcgcagcggagccgacgcgatgccgccgaggaggaaacggcgagcaccaccggccaagtcgcagaggcagacggagccggatccgcaaccgcaagtgccccctggcgccgacgcgccgctggaagagcggctgatatggggcagccaacaagaaagcgagcgccggattactgccatcaaagccataaaagacgcggaggctgggaacatacattaccagttgcaattggcacggtcctattattccgaggagcaattggagggaaacgccatgcagtattttcaggagaacttgcacaatctgtcggttgttccgaacgaggaatatgatgtgcttgagctgaaatggaataacggcgacgaatggatgattggagactttgcagatgacaggactctacgggcttcgattgcatcattcacagctgctgatggacttcagttcccaagggattcagacttctatacgcgcactagcaatttcagtgactttgcttggagtgagcagcctgaaggccaaatggcaggagcatcagaagcttttcagacacctggggctgtgagtaaccggctatcctgtggcatgacacccaaaactgtgaggctacccaagaatggtgagatgctcctatctgtgcatggttcacctcttggggtctataaagaagaaaatttagcagccattgaagaatctggtaacggaagtgaagatgctccctgataactcactgatatcacctgatggtgccagcctttgacaataacagtaatgcactttgaaattagtgtttaggtcactctgtattttgatgaaccctattgtagcatgccgacttttattcagctgacattattgtgctttcaacagttgttagctttgctgccaaggaggtcggcagaatcacttggctccggcctccgtgccatttcaa

SEQ ID NO: 5100 - DNA, 2332 bp, Zea mays
gcacgagaccattacctagaacatcctaatcgaaaagaggagtcacagagaaagtttggtggtgaggcaaaggtttccttccagggttcgtcaggaacgaggcgactcgcaatctgaagcctttcgtcggttccgtctagctgccccccctcggattcggccatggagcggcagtccagcatccggctgggcgcgctggagaagctgaggagcttccgggggatggagaagcagaagagcttccgcgggatcatgtccctcgagcggcggagcagggacagcccggggaaacgcggcgacacgccgctccacctcgcggcgagggccgggagcgtggcccacgcgcagaggatcctcgcggagctcgaccgggcgctggccgccgagatggccgccaggcagaaccaggacggcgagacgccgctgtacgtcgccgccgagaagggccacgcggaggtcgtgcgcgagatcctcaaggtctgtggcgtgcagacggccggcatcaaggccagcaatagtttcgacgcgttccacatcgccgccaagcagggccaccttgaagttctgaaggagatgctgcaggctcttcctgctcttgctatgacaacaaattctgtaaacgctacggccctggacaccgcggcgattcagggccatgttgacatcgtcaatctcctgctggaaaccgatgctagcctcgccaggatcacgaggaacaacgggaaaacggttttacactcagcagcaagaatgggccacgtggaagttgtaagatcgttgctgaataaggatcccaggattggtttgaggacagacaagaaggggcaaactgcgctgcatatggcttcgaaagcgcagaatgctgagatcgtggtcgagttgttgaagccagatgtctcggtcatccatatcgaagacaacaaggggaacaggcccttgcatgttgctactcggaaggggaatatcattatagtgcagactctgttatcagttgaggggatcgatgtcaatgcagttaacaggtctggagagactgcatttgccatcgccgagaaaatggacagtgtagaactcgtgaacatcctgaaagaggctggtggagaagccgcaaagcagcagcaagtacatcctccgaattcggcgaagcagctgaaggaaacagtcagcgatatcagacacgacgtccagtcccagttcaagcaaacacgtcagaccaagatgcaagtcaaccagatcaagaagaggctggagaagctccacatcggcgggctgaacaacgccatcaactccaacaccgtcgtcgcggtgctcatcgccacggtcgccttcgccgccatattcacggtcccgggaaacttcgtggaggagctgagccaggcgcctccgggcatgtccctggggcaggcgtacgtggcgagcaacccggcgttcatcgtcttcctggtcttcgacgcgctggccctcttcatctcgctcgcggtggtcgtggtgcagacctcgctgatcgtggtggagcggagggcgaagaagcggatggtgttcgtgatgaacaagctcatgtggctggcgtgcctcttcatctcggtggccttcatcgcgctgacctacgtggtggtggggcgcgacgactggtggctggcctggtgcaccatgggcatcggcgccgcgatcatgctcaccaccctcggctccatgtgctactgcatcgtcgcgcacaggctggaggagaagaacaccaggaagatcaggagggcctccgcgagccagtcccgcggctcgtggtcccgatcggtcgactcggacgaggagatacttaacagcgagtacaagacgaagatgtacgcgctgtaggatggatagcaagtgtaacatgacggattcttttgtacataccagtgctttgtttcgccagaggctgctccatggcatgcggcaccacatcagtcttcttcaaccaaagggactgaaggcccttcctgcggaaccaagttcaggtcacttgaccggtgtgcctgttcctggggagtgagagtctgctcaactgtgtggttcttagcgcctgaaaccgtcaatggtgatggagataattcagctagaaatttagaatagaataaagtgtccggtacaaaatgcattgtgtcgtgcagtagatatgatgatcttgtacacgaggatctcatctgagagagtgatttgttgaactcttgtgggcagttttttttcccttgggattgggacttgggcctgtggtctgtgacgcagggaatatatgtgttgacaagatgaaaactatcattgatcggccatttccgagacaaaaaaaaaaaaaaaa

SEQ ID NO: 5101 - DNA, 1748 bp, Zea mays
cattgggtacctcgaggccggccgggtcgtatatttgttgaaaggagcttttttcttctctccagcacaaccccactcagcacctgtctacagggaaggccgccatttaaacgggcctacctcggatccggacacttgggaccacctgccttctctccttccttccatccattcctccctgtctccgccctcttctgactcccgtaggccgtggtgccgccgccgactgctgggactgccctacaccaagtgcccaggtcatcttcgggccattcgccggcgacgagcaccaccaggtgtgccaggttgaccgagctatggacagcctgtggcatcttggggacgagctccgcgggcagcccaaggtggtggaggaccgccagtggtctctcatgacgtccaagctggcggagatcaccaggtccaagggcgagaggatgaacaccgtccctgacgccaagcagtgggacaagacgtcctaccagcttcacgacgacagcaggatgggccacatcggcctcatgaacctggatctcaagatgaacgaggctgccgccatgaagctccccttccgtggcatgccgtataacatgaaccagatgtacctcaaggggagcaatgccaattccaatgtcaatgcgttcaagatgaatgttggagtcaacaagtactccaatagtccaaacgggaaagacgccaatgggaaaaacaatggcggcagtggcggcaacaacaacaatgggagcgccaacggcacttctgtggctgacaagcgcttcaagacattgccgacgagtgagatgctaccgaggaatgaagtccttggtggatacatctttgtctgcaacaacgataccatgcaggaggatctcaagaggcagctttttggtttgccagcaagatatcgtgattcagtccgagcaatcactcctggcttgcctcttttcctctataactacacaacccaccagcttcatggggtatttgaggctgccagttttggtgggtccaatatcgatcctactgcatgggaggataagaagtgtaaaggtgaatctagattcccagcgcaggtgaggatctgcattaggaagctgtgcaagccgttggaagaggattccttcaggccagttttgcaccattatgatgggccaaagttccgccttgagctctccatcgcggagacattgtcactgctagacctatgcgggaaggaaggcatctgagctgtcgaggaggtggtggtggttgccttgtgagcttctagtaaataccaatcatctttgtatgttttgtggatggtggttggcaacgttgtttatttatgcgcaagctgctgctggtttcgggatggaaggaaagacctggtccctgaaacaagctgcggagagtgagcctgtcagtgtattgtgtctggcgtggtcaagaaccaaatcaatgttggaccgaccgactgagagtttggagtgtgtatgttttgctattactcttatctctagtagagtgtgggtatacctgggcagaatgtgtccccaaaagttgggggcctgtctgtgtactgtgtgcgatggacgccctaagtaaaaaaagggcaggtgatggtcgtgctccaggtttgtgttttgtactctgttgtaccttgaacctcctttgcgttttgcctaatcagagaatgaatgcaaaaaaaaaaaaaaaactgccagagtgttggctcctggttccaaaaaaaaaaaaaaaaaaactcgtgc

SEQ ID NO: 5102 - DNA, 1111 bp, Zea mays
  misc_feature (13)..(13): n is a, c, g, or t
ggccgctcgagcncggcgggcccgggccgcctgtcgagcccgcgcgaccctctcaatctctctgaccggtggactctgtgtgggcggagcgaagtgggagccaacgccaagccagccgagccgactcctatcctcctcttccccttccccgcagcagtttccccaaatccagcgccctccccgccggaatccggcgccgaatcgagcagagagcttgaactgagctatggacaacttgtggcatctcggagatgagttccgtgggcaatcaaaggtggtggaggaccgccaatggtctctcatgacatcaaagcttgctgagatcacaaagtcaaaggctgagaggatgaatgactttgagtatgcacggatgaacaccgtccctgatgtcaagcaatgggataagctatcctaccaccaagaagacaacaagatggaccacctcaatcttggcttgatgaacctggatcttaagatgaatgatctcaagatgaacgaggctgccatgaagtaccctttccgcaacatggcctataacatgaatccgatgtaccccaagggaaacaacggtaatgtcaattcgttcaagatgaatgttggggtcaacaaatatcccaataatcagaatgggaaggaaacaaacggcaaacacaatggtggtaacaacaacaatggaggcaacagcaacaacaactctgttgacaagcgcttcaaaacattgccaacaagcgagatgctaccgaggaatgaagttcttggtggatacatctttgtctgcaacaatgataccatgcaggaggatctcaagagacagctttttggcttgccagcaagatatcgtgattcagtccgagccatcactcctggtctacctcttttcctctacactacacgacccatcagctacatggggtgtttgaggctgccagttttggagggacaaactttgatccccactggttgggaagataagaaagggcaaaggtgaaatccagattccccagcccaggggagggatccccattagaaagggttttgcaagggccttgggaaaaagggatggttttccgggccagggggctggccccccctattgaatggggtcccaaaa

SEQ ID NO: 5103 - DNA, 1561 bp, Zea mays
tggggcccctccattgggcccggggacacctgccttctctccttccttccatccattcctccctgtctccgccctcttctcactcccgtaggccgtggtgccgccgccgactgctgggactgccctacaccaagtgcccaggtcatcttcgggccattcgccggcgacgagcaccaccaggtgtgccaggttgaccgagctatggacagcctgtggcatcttggggacgagctccgcgggcagcccaaggtggtggaggaccgccagtggtctctcatgacgtccaagctggcggagatcaccaggtccaagggcgagaggatgaacaccgtccctgacgccaagcagtgggacaagacgtcctaccagcttcacgacgacagcaggatgggccacatcaacctcggcctcatgaaccttgatctcaagatgaacgaggctgccgccatgaagctccccttccgtggcatgccctataacatgaaccagatgtacctcaaggggagcaatgccaattccaatgtcaatgcgttcaagatgaatgttggggtcaacaagtactccaatagtccaaacgggaaagacgccaatgggaaaaacaatggcggcaacaacaacaatgggagcgccaacggcacttctgtggctgacaagcgcttcaagacattgccgacgagtgagatgctaccgaggaatgaagtccttggtggatacatctttgtctgcaacaacgataccatgcaggaggatctcaagaggcagctttttggtttgccagcaagatatcgtgattcagtccgagcaatcactcctggcttgcctcttttcctctataactacacaacccaccagcttcatggggtatttgaggctgccagttttggtgggtccaatatcgatcctactgcatgggaggataagaagtgtaaaggtgaatctagattcccagcgcaggtgaggatctgcattaggaagctgtgcaagccgttggaagaggattccttcaggccagttttgcaccattatgatgggccaaagttccgccttgagctctccatcgcggagacattgtcactgctagacctatgcgggaaggaaggcatctgagctgtcgaggaggtggtggtggttgccttgtgagcttctagtaaataccaatcatctttgtatgttttgtggatggtggttggcaacgttgtttatttatgcacaagctgctgctggtttcgggatggaaggaaggacctggtccctgaaacaagctgcggagagtgatcctgtcagtgtattgtgtctggcgtggtcaagaaccaaatcaatgttggaccgaccgactgagagtttggagtgtgtatgttttgctattactcttatctctagtagagtgtgggtatacctgggcagaatgtgtccccaaaagttgggggcctgtctgtgtactgtgtgcgatggacgccctaagtaaaaaaagggcaggtgatggtcgtgctccaggtttgtgttttgtactctgttgtaccttgaacctcctttgcgttttgcctaatcagagaatgagtgc

SEQ ID NO: 5104 - DNA, 1050 bp, Zea mays
  misc_feature (957)..(957): n is a, c, g, or t
cggccgctcaaggcggcggcccccgctcccggccgccgccccggccctctcaacctctctgaccggtggactccgtgtgggcggagcgaagtgggagccaacgccaagccagccgagcggactcctctcctcctcgcagcagttcgcgattcgcccccaaatccagcgccctccccgccggaatccggcgccgaatcttgcagagagcttgaaccgagctatggacaacttgtggcatctcggagatgagttccgtgggcaatcaaaggtggtggaggaccgccaatggtctctcatgacatcaaagctggctgagatcacaaagtcaaaggctgagaggatgaatgactttgagtatgcacggatgaacaccgtccctgatgtgaagcaatgggataagttatcctaccaccaagaagacaacaagatggaccacctcaatcttggcctcatgaacctggatcttaagatgaatgatctcaagatgaacgaggctgccatgaagtaccctttccgcaacatggcctataacatgaatccgatgtaccccaagggaaacaatggtaatgtcaattcattcaagatgaatgtcggggtcaacaaatatccgaataatcagaatgggaaggaagcaaacggcaaacacaatggtggtaacaacaacaatggaggcaacagcaacaacaactctgttgacaagcgcttcaaaacattgccaacaagcgagatgctaccgaggaatgaagttcttggtggatacatctttgtctgcaacaatgataccatgcaggaggatctcaagagacagctttttggcttgccagcaagatatcgtgattcagtccgagccatcactcctggtctacctcttttcctctacactacacgacccatcagctacatggggtgtttgaggctgctagttttggaggatcaaacattgatcccactgcttgngaagataagaaagtgcaaggtgaatccagattcccagcacaaggtgaggatccgcattagaaggctttgcaggccttgggaagagatgctttc

SEQ ID NO: 5105 - DNA, 1693 bp, Zea mays
cattgggtccctcgaggccggccgggagcctgcatacccaacccggggccgaccgctgggggcccacgcgggcgacctgcctcctccccttctcccatctctccccgactccccctctccctctcgtggccacgactgccgccgctgccgccctacgccaggtgtccaggtcatctccggcccattcgccggcgacgagcaccccactagatcgaccgagctatggacggcctgtggcatctgggggacgagctccgcgggcagcccaaggtggtggaggaccgccagtggtcgctcatgacatccaagctggcagagatcaccaggtccaggggcgagaggacgaacgacctcgactacgccaggatgaacgccgcccccgacgccaagcagtggggcaaggcggcgtcctaccagcaccacgacgagggcaggatggaccaccacgtcggcctcagcctcaagatgaacgatctcaagatgaacgaggccgccgctgccgcagtcatgaagctccccttccgcggcgtgccctacaacgtcaacccgatgtaccccaaggggagcaacgccaacgccaatgtcaacgcgttcaagatgaatgtcggggtgaacaagtactccagcagcacgaacgggaaagactccggcgggaaaagcggtggcggcagcaacaacaacagcggcggcggaggcaacggcaatgggaccgccaacggcagttccgcagttgacaagcgcttcaagacgttgccgacgagcgagatgctgccgaagaacgaagtccttggtgggtacatctttgtctgcaacaacgataccatgcaggaggacctcaagaggcagctttttggattgccagcacgatatcgtgattcagtccgggcaattactcctggcctgcctcttttcctctataactacaccactcaccagcttcatggggtatttgaggctgccagtttcggtgggtctaatatagatcccactgcatgggaggataagaagtgtaaaggtgaatctagattcccagcgcaggtgaggatccgcgttaggaagctgtgcaagccgttggaagaggattccttcaggccagttttgcaccactatgatggcccaaagtttcgcctcgagctctccatcgcggagaccctgtccctgctagacctatgcgagaaggaagacatctgagctgttggctgcctcgcgaggttctagtaaatatcaatcatccttgtatgttctgtggatggtggttggcaatgttgtttatttttcaagcgcaagctgctccctgtcctggatggaagcaaagggacctggtactttgaagggcccccctcaaacataagctgtgagcctgtcagtgcacgtgtccgccgttgtcgtcaagaaccaaaccaaatcttgagatcttgcgccgacggagaattggagcgtgtatgttttgctatctctatctacatgtctcagtagagtggatataccctggggtccccaaaagatgggggcctgtatgtaacactacgtgtaatggttaaggtgaatgtgccgtgaggccccccaaaagttggagtgtgtatttttgttgtcaccttgaaccgactttgcgtatgcttttttttagtgctgctaccttctgcgctgtgtttggcttctggttcatgtttttgtaatataaggtggcttgcgc

SEQ ID NO: 5106 - DNA, 1764 bp, Zea mays
ttgggtacctcgaggccggccggacgctccccaccacctcaaatttctgggcctctctcctccagcctgcatagccaacccttttgataaagaaacgggcctacactacacgggacacctgcctcctccccttctcccatctctccccctctccctctcgtggccacgactgccgctgccgccctacgccaggtgtccaggtcatctccggcccattcgccggcgacgagcaccccactagatcgaccgagatatggacggcctgtggcatctgggggacgagctccgcgggcagcccaaggtggtggaggaccgccagtggtcgctcatgacgtccaagctggcagagatcaccaggtccaggggcgagaggacgaacgacctcgactacgccaggatgaacgccgcccccgacgccaagcggtggggcaaggcggcgtcctaccagcaccatgacgagggcaggatggaccaccacgtcggcctcagcctcaagatgaacgatctcaagatgaacgaggccgccgctgccgccgtcatgaagctccccttccgcggcgtgccctacaacgtcaacccgatgtaccccaaggggagcaacgccaacgccaatgtcaacgcgttcaagatgaatgtcggggtgaacaagtactccagcagcgcgaacgggaaagacgccggcgggaaaagcagtggcggtggcagcaacaacaacagcggcggcggaggcaacggcaatgggaccgccaacggcagttccgcggtcgacaagcgcttcaagacgttgccgacgagcgagatgctgccgaagaacgaagtccttggtgggtacatctttgtctgcaacaacgataccatgcaggaggacctcaagaggcagctttttggattgccagcaagatatcgtgattcagtccgggcaattactcctggcctgcctcttttcctctataactacaccactcaccagcttcatggggtatttgaggctgccagtttcggtgggtctaatatcgatcccactgcatgggaggataagaagtgtaaaggtgaatctagattcccagcgcaggtgaggatccgcgttaggaagctctgcaagccgttggaagaggattccttcaggccagttttgcaccactatgatggcccaaagtttcgccttgagctctccatcgcggagaccctgtccctgctagacctatgcgagaaggaaggcatctgagctgttggctgcctcgtgaggttctagtaaatatcaatcatccttgtatgttctgtggatggtggttggcaatgttgtttatttttcaagcgcaagctgctgccggtctcgttttccctgtcctggatggaagcaaagggacctggtactttgaaggccccccctcaaacataagctgtgagcctgtcagtgcacgtgtccgccgttgtcgtcaagaaccaaaccaaatcatgaaatcttgcgccgacggagagttggagcgtgtatgttttgctatctctatctacatgtctcagtagagtggatataccctggggtccccaaaagatgggggcctgtatgtaacactacgtgtaatggttaaggtgaatgtgccgtgaggccccccaaaagttggagtgtgtatttttgttgtcaccttgaaccgactttgcgtatgctttttttagtgctgctaccttttgcgctgtgtttggcttctggttcatgtttttgtaatataaggtggcttgcgcaaaaaaaaaaaaaaaaaaaaaaaa

SEQ ID NO: 5107 - DNA, 2496 bp, Zea mays
agcctgtagttgtgtctctcggaagttactaaccttcctatggcttgtagaagtgcctctagaaagttcataacttcctatggcagtcccctcccctctcggaagttagctgaataccgctaacgacgttaaagtcaggctcacagacggcctgtatgacccttacctctgcctttcccttttctcctcctatccctaacgcagtcgccgccgctgcgcggctctcccttgccaatgcacacatgcactcgccgccgccgctcgactctcccctcccaatggcaccccgtcgctcaccatcaaatgtttcctcccctacaagcgcaagatcgccaacgaggtggtatagccatccgccacacctgccactgtccctttgccatttctggtcctagatctgtgttacctgcatttttctttgccacgggatcgggacggtggaggagcagctggtggggatcagcatcttgcttcagatatctattctcgtgctctcgttcatgctcagatattgatggcgctgttggtggacccacctgacatcaagagggagatgcagatggagatgcagcccgcaccaccaccatctgctgcggcgtcggcatcgcagacggcgtggccactggattggccggtggacgggcgctcgctcaatcctccatcgccgcccactatatcagtccagtatgtgagtcatattgattttataattgattttatgcgccagttcttgcctcgactaatgggtcctcttccattttgtaatcacctctgcatgtttactgtatcactttggtaaattactattgttccatgttgtcttccacaacatactgcactagttcagtggttagtttcctattcaaccatttcgtaatgaaggaggtattggtatttaggtaaatatttatttatgattgtgctggtattatctcaataggctggaaaattttaaataacctaatatgacataaacctcaactgcccatgcactcttagttgttgttttgaaccggtctttcgttgtttttcttttcaccaaaaaataaaatcttgatgatgtgtgacacacctgtttggttatatcatgttatctatgtagttcggccaattaaactatgttatcaggtataactagatgaggcaaattatatatatatatatatatatatatatatatatatatatatatatatatatatatatatatatatatatatatatatgtatatatatcgaaataaattgttttatgaatatccaaataaaccatatagtgtcgaagctgggtactttccattgccatcattaatggacaacaatatgctactatctcacatatattatgaaatgtttctacacgcatggagcatttcttgcagtagagcgctaggtatgctctctatgcctacgatgatttatatgaggatgacttagataaggaggtggatcacatgtcagtttcgagcaaggtgagtgccatgttctgcatagtattctgtgcagttatttgattgattcacattttcaaatgatcggttgaaactctgttatgcttgactagactgaatctagattgtttactaaaattgggcatgggttttaattgtagtggtttgtagctatctgtcattgtacactgattcaagtgacaacgatttcttttctgtggatgcattttagtaggattggccaccaaggtcgtggagtatatgttgcccaattttaatgaggtctggtgggatatcattaccttagatatcttgatatgcaaatagtttggtgagacatttgaagataattgatgttcatgtcacaaacattcagttaccttgtttatattaatgtgatctgcaataagttagaattaagcagccgacatgccctccgcttgcttgattttatacagtttctttacatcagatatatatctattagtcagaaaggaaaataaaaactaatacatatttgacatacttctgacatcacattttgtttgactatactatttaatgttatgccacttgtcaaatatgcatggtcttgggaatccaagaagaattgttggcatttgtaataacattatttggtaatgatagttctaggttttctacttaaacaacaattatttttgatgcaggtgtttggactggaatgcgcacagtctgttactttgatggcaaaacgcaacgaagtaccatgggtaaggatgtgctggagaatgaaagcttctgtcttaaaacaataggatacaagaagcttgcaagtggttttgtgaaggcttttgtgaatcacttgaatcattagttcttttaagaatggttttgtaaagcgttagcaaatatgtgtaaaacacaataagatgtgtggcaaagtcagtgatctagttgtacagttttttatgtttatgtgatatgtggatatttcattgtgcaatgtcaaaaaaaaaaaaaaaaggtcgaccgtgtattagcgggcccggtacatgcaggcgtg

SEQ ID NO: 5108 - DNA, 2762 bp, Zea mays
cgccccccccccccccccacgcgccccgagagagatccggagcagccgcagtcccaccgacctcgccgccggtcgccctccatctcctcgccgctgcctctcgatacgagcatagactacaggctcaaagttccaattccaacccacccgacgtccgacgacagctggtccgggtctcctccatttcccggggacccgtccgatccgatcccagtcctcaacgccaacggtgggagatctagatcggagctagccagccagccggccgacgctgtccgccggccgccccggcgattctgacccgagatggcggtcgtccctgctgcagagaccctcgacgggctcaaggacaggttcgatctcggggtcttcgtaggcgacctcgccctcgatgaggaagtcaccagtgacgacgagtccctggaggggctgcagcaggagcttgacaactgcaagaatgaccaggaagtcgcaaacattctagccagtggcatcaaactgcgcgagtacacaaaaggcgtcgagaataacatacgccaaatcgagctggattctatccaggattacattaaggaaagtgaaaatctagtttctctgcatgatcaaatttgtgattgtgacaatattttgttacaaatggaaacagttctgactggattccagacagaaattggttccataagttcagagataaaggtccttcaggagaaatctatggacatgggattaaagctgaaaaatcgtaaggctgcagaatctaaattgtcaaaatttgtcgaggatataatagtacctccaagaatgattgacataattgttgatggagaggtcaatgatgaatacatgaaaacacttgagactctaagcaaaaaaatcaaattcatcgatgctgaccccatggttaaatcatccaaggctctaaaagatgttcaacctgaggttgagagactacgacagaaagccgtctcaaagattttcgagtttgtcatccaaaagttctatgccttgagaaaaccaaagactaatattcagattctacagcagagtgttcttcttaaatacaagtacacgataaatttccttaaggaacatgctaaggagatatatgcagaagttcgtacggcgtatattgacaccatgaataaggtgctaagtgcacatttccgggcttacatacaagcattggagaaactacagatggacatagcaacttccactgatttgcttggtgttgaaaccagaagcacaggcttcattttctccattggaaaagaacctctgaaaacccgtccttcagtgtttgctctgggtgaacgaataaacattttgaaggaaatcgaccagccagcattgatacctcatatagctgaagcgaagtcacagaaatactcgtatgaagttcttttcagaagcttgcagaaacttcttattgatactgccacttcagaatacctgtttactgatgatttctttggcgaagaatccatattccatgatatatttgcaggaccgattcaagttgttgatgaacatttcaatactgtactcctgaactgttatgatgcaattggcataatgcttatgatcagaataattcatcagcaccagctcatcatgtttaagcggcgaatcccatgtttggactcttacctagacaaagttaatatgtcactctggcctcgcttcaagatggtgttcgacttgcatttgaacagcttgcgaaatgcaaatattaaaacactttgggaggatgatgtccatccacactatgttacaaggagatatgctgaatttacagcttctctagttcatctcaatgttgagcatggggacggtcagcttgatctaaatttggagcgattgcggatggccattgaggatttgcttgttaagttggccaagatgttttccaaaccgaagctacaaactgtctttctgataaacaactatgatttaacaatttccattttgaaggaagctggaactgagggtgggaaagcacaacaacacttcgaggaggttcttaagagcaacatcgcaatatatgtggaagagttgctcctggagcagttcagtagtttgatcagattcgtcaaatctcgtccagcggatgagacggctgcaaattccgagaaagccagcattgccgaagttgagccactggtaaaggatttcgcgagccggtataaggccgcgatcgagctgatgcactatgatgtgatcacatctttcagcaactttctttgcgggatggagatcttgagagcgacgctcgcacagctcctgctatactacaccaggctctccgagtgtgtcaagagaatcaacggcggctctgctctcaacaaggaccttgtctccatatcctccatcctgttcgaaatcaagaagtattctaggacgttttagttgtttcacccccttccatgtacactaggacggctagctgaggggtagctgtgtatccttactttgtaactggtatgtgcgactgcaggggaaacaagggcattttgtcgtggtttgtatcttcgtctgtgttacccgacttgacccctgcccctttccagcacagaactatgatctctaggctgtctccacagttatcctattctatcttctgtcctatcatctattttaaacttcattttgtaaacagtatcgattatagtgcaaatctacaattttatacgatccaaaaaagggccccgggaaaaagaaaaagtggcgggccgactctagaaggatgccaaggacttacg

SEQ ID NO: 5109 - DNA, 3591 bp, Zea mays
tcgaggccggccgggccgggacatcctctcttcatactatctaccacaactagttgccagagttcgtcatggacttctacaaagagttcgtggagacttcgtccgatgacgattccgaagactgaggtcgacactcgacaccatgtacgtttagcaagcccttgagcaactaggtgttggaggttcgagcgggcgtcgtagacgctcttccttgccacgtctagtaatccatagggatcacagtgctagcgaaaatctgataaagctccactacttcggtccaaatcctgtctatcccgcccacattttccaacgaaggtttcggatgcagcggcctttgttcctgcgtatccttagaggtgtgcagcaagtggacggatttttttactgttaggtgtgatgctacgggtttagcgggactcggtccgttgcaaaaagtctctgctgctttgcgtgtcctcgcatatgggttgcctacggatgctgtcgatgagtacattcaaatcggacaaactaccgctagggactgtctcatccgtttctgccatgcaatcatctcatgctacagccaacgttacctccgtattcctaacagaaacgatgttgctcgcatacttcgtgtcaacgctgataggggtttcccgggcatgcttggctcaattgactgtatgcattgggaatggcgtaactgtccaactgtatggcggggtcaattttgtggccggaactcacgtccaaccatgatattagaagctgtggcgtcgtacgacctctggatttggcatgccttttttggaatgccaggaagtaacaacgacctcaacgtgctccataggtctcccattttcgatcctttacacaacgacgccatgcccccccgtgcactacaccatcaatggtacacaattcaatttcgaatattatttagcagatggcatatatctgaattggcccacatttgtgaaagctattcgtcacccattcgaagaaaagaagattcactttaccatgatgcaggagagtgctcgtaaagatatcgagagaacttttggtgtgttgcagtcgcgtcgggcagtactccgcgggccagcttatggttgggttcgcaatcacctcacggagatgatgattgcatgcattatcatgcataacatgattgtcgaggacgaaggcgaaggagcagaaaatgttgattttgttggtgccaccccacctcctgatctttcgactgcaattccgtaagtccggaacgagtggttgaacacgactgcctggtccgaaatgccaaatgaaggagatattgatatcacctgcaagaacacgtacctatctttgcagtacaaccttgtcgaacatctttgggcaaggcgtggttccatgggttgaagtatggctacttaattaagttgtcgagtatcagtgtaatgtgttggtgtctactttagtgtactttagtcgatgtaagcctccagttgtggtcaagataactgctgttatgtgagcgtcttggatgtaactatgtatggtttcatccatacttcaataaaatttagataatgtgtgctttgttcattagcaacttaaattgagggagttctcaaacataacaggcccctcttttggttttgtgctccttctttttttttagtggacaagttcaaactggcaattcataaccataagtgacgagaataagtttacaaacataacataatcttgagttcttcaactgaaatgaagacactaacgcagtccaaagtcacacttcaaaaaatgtgattattacagcacgcattactaaaacagaaactcaactagtgaaaaccgtggtccacaattttcactaaacgaacaactcagtttggattgttgacaaaccagtccacaagtgctttcctctttgctatgaaagcaggcctcaaatcttcggctatgtcctccaaatccacagccattgcttccttcaactcatcgttcttctctttgcgttcttgaaacttcagttttgttttctccacttcaatttgttcttgttgaacttgcagcttcttatattcgagatccttgaaaacctcataatgtgcttctttcttctccactttgtcttcactttgtttcaaccgggccatttgcaggtcatgaattctggtcaaatacttcatggactgggacgacgtggacatggccttcttccttgatgcctttgtggagtctcggcctaatggccttttcccagttaaacctagagaatcgctatccaaatcgtttacacttgcagttggtgtggcactgccaaccggtgacatccctgctgcccctcgtagtgaagtgccttgaacaatagcttgccatttgggttcgttcttgagtttagtccaacaatgcatgaaggggaaccctctcttattttcggttgtaaacagtgtggtagccattgaagtcttatcataatcagttaaaccactttgattttccctgaggactcttgcatacaacgaagcatacttcccacaatcagccttaattttgtcccatcgacttgttaaagccctgataactctcttaggatactcacctctcatttcgttatactgtttatcaattcttgcccaaagtccttccttcctctggccagtgctaattactggatcacaactaatttctagccaagttgtgcatagcaacaaatcctcttctggcgtaaagttttgttctttcattttcttccctttaccaggtgtaccaccttctttgctggggctgttaacctcctgtgcgctgtgctctgcctcggactccaaaaatattgggtccatagggttcgaagagttgttaggcagtgtgacaaaatggctaggtggttgcatttggccagcagcaagcgggggaggtgggcaaggataactaggattcatcataccaacgaaatgattccatgggcccctatttgcaaaacctcctacttcattttgttgttgtgataaactgggaattgtaaggtggctgctgctaaattggatattagatccactaggaaagtcgtagggattaggctgccagtactgtggattccacataggggggcattccttgaggagctgatgtgtgtggaggaccatgagggggaaactgcatgttatcattgttctcagccattcggtagatgtgcagatcggaagaagcagatcgatggacgggagctcgagttctggatcggcggacacccagccggggaaggagcctcgttgaatcgccggcggacagggttgaacggcggcggcggcgatgaagtcggccagtgggagcttcgatccggactcctcggtcgtcgaatccgttcgcgtggctctcctcgcgtgaggcccaacggatccggccgcctgtacccttcgccgcgcggggaggttggtcgccggcctccgcttccgtggacggcgacgaaggagtcgcaccgagcaactcggcacctctggagtcttcacgcgcgggagtggagagagggagagcggcgcctgccaatggtagcgtctcccggcactcactctccatgtagtgccggcccgaggctacacgcgcggtgaggaggagaga

SEQ ID NO: 5110 - DNA, 967 bp, Zea mays
  misc_feature (33)..(33): n is a, c, g, or t
  misc_feature (40)..(40): n is a, c, g, or t
ccggccgggagacccttccctaccgtatatagncgacggngcttcctaaactaactcattgcagagtgcagacaaacctcacttacattattaatgctctcgcatatttggccgtcaccatcatcagactcagaccccttaaatccgcaatttgccgaatttttcacccctccggtcgacccagcggatgcggatatgtttcttatctagcctgcaggtccataccattgtcctcctctctctctcactcaagtcgttgcacgccacaccatacacaaactgcagagggaggagcatcaagcatggcagggctgcagagatcgtcacagacattcaggaggtccggctcatcaggcttggtctgggacgagaggctcacgtcccaggacgacgaccagagcgggccagaggacgcggacgcagccacggatttaaaggagctgaggcactcccgcagcgttggctccgttgggctgcagccgcagccgctgccgcagccgcagcgccggcgcagcgacgacagcggccagggcttccgtactcggcgtgtggccccagccctggacccgccttcgcccaaggttcctggctgcatcttctgcggaattttcaggaaggcgggagcatcagagccaaaatctaagcccagaaggtactaactaagttgttttaccgtgtatgggggagctaggatcatagaccgtcagttttcctggagcccgcagaagttcgtgtttttcatgtatggaatggtagatgagatgtatatgtattgttgtaagtttggagtggacaaagcttttgtgtttcttcttcctgtgttgctgctttatggctctgcctgcacccataagcttctatccttgaccatcatgtacataataaagtttgcgtaactagcatactgcatacatgtaagttacaagtacatgaacatggtgctcttattagaaaaaaaaaaaaaaaa

SEQ ID NO: 5111 - DNA, 2862 bp, Zea mays
cccccccctcgagtttttttttttttttttttagttcaaaagatctcacagctgctgttctgtttttggctatcaaagtaggattcttataacacaactgcgagttcgacataaacccagcagagcccaaggtctcataggtttggaacctacgtgctaacagcatcacctaacaacgcacgtacctggtattacaccatccctacaggcagctacagacgtgtaaaaaacatggtcctggcttctatgcaacactcgtaataacaaagaacagacgactgctaaaacctagctagtgctccttgagcatttctctcagcggaagggctacgcagcagccgacttggcggcgttccttgcgcgggtcgtcctcttgggatgctcctggctggtcaagactgcgacggcgacggcgctgtcggatgagtccgagctgctgcgctccccggtctgccctttgccggacaccgttttcccgagcgccttctttggtgtcgccgcgccagcgccacctttggccaccctgccggtggcgcccttgttgccaccgtggtccttgtccttccccacgacgaccgtactggccgccgtgtcgcatttgtccaccagcttcgtcgtcttggacaggctgaggtcctccacggccatgacgccgtcccactcgtcctctgtgttcgttgtggcgcctgaccttgagctctcgtaggagccgatgccgatgctgtcggctcggatggcggtggctgcggcacaggcccttgtctgctcgtggtacagcacctgcaccacgatcctcagaggcaggcgctcgttctgcacggcatgagcgcacgcgtcgggcgacaacttcttgcagtccatcagggcacatagcctcttcttgtcgctcttgcccaagcttgggtgctcctgcacaaggagaacaactatgtcaactcacagagtcttctataatcaagggaaatggaatgtctatcttaatccccatgaaatactagtaacagcaatgtatttggaaaaaaaatttcttgaactgtgacaaagaaatgccacacaaatggatggcagcaataccttcagatacatatcaatggcacgatacagtccatcatgaaccggccttgaacctcccgaaaccgtctcagctaggctgaaaaacttgtagaccggtatatttgggtcccttgcaacctctgcgagatatccatcgacagttttggccactgcaaccattgacgcactaggagcagatacgtggtcgttcacctcaccaccgttatgtctctgggcattcttgctatcttgtctgacaaattcttcaacaatgctaagaatcaggtcgatgtcgtaaacggtggtatccccatccaccgtagggatcagaagatctgacactgacgcttcttccagttgccgtgcgatgcgcttcataagctctttcctgcacatctctccacacttgagcaagtttgttgccttcagtaacttcaagaggaagctgcacgaaaccgaacctttctcggatggcaacaggcatgtgatggtaactagcatagcccgaacttttgcgtcgccatggatcatcgagaccttgcttagtgacgggagcttcttgtaagtgtaggctttaatcgccgcaccgatcacatccttgggcaccgtacccttggttttgactgctgttatgacttgcttgtaggcgtcaatgtcgagatctgtcagatcttcgacccaccaatcctttggaacaaactgctgctgcttgactccattccatggcgaatcatgaccattctcaactgtgagcttcttacggttgtatgtgtatgaccattcaacttttgaaacgtcaatagaggcttttgaagcaacagagtcaatgcagtggctgaccagcttaagatcctctgcccaaggtaaatgagcctttgttgtaccaagaacaattatggagtctttccagctccggtgtatgcttgagctgaggaagatatcgatcttgtagatcagattgcccttgtcaacagtctcgttcatctccaggtactctgcggcacagcgggcggcaatcacattgtaggcattgagtgtgacaatcatgccatagcaaaacttggcacagatctcaaaagccttggcaccaccaggaatatcatggatgtggatctcaatattttcatcgccagtagttggaatcaacttctggaagcgagcacacttggataggagcggaaactgcaagatttgacaatgcaaataagaataacagtgataaatacacacactcaagtgactgcacagtgcataatgagaaccaaggaattaattaagtcgctgggatgtaaaaccggagaaaacaacaatcagatgacatattgacatatatgacaaaaacaagcgtcaccaagaatcttcagcatggagacaactttggtaagaaaatgtaaaccaaatcacacgaaaaaaatttgatctctcacagcacatgtagtttctactatagtctcacgaagcatcagtggcatataaatgaaaataacatgtcacttaccttgtgaaggtaaaactttgtagtccctatacgaacagtgatgtcgctcaccaattcagatgccgcaatactgcaaggataaacacttctcattagtagaggagtgaaaataacaggaatataaaaaaaaattaatgcttacaaactgaaagacggactctggattagtacttgaatatgattttcttgataagcattaggattgcttacattctacaacagagacatggttaaattgatagaataaaatatggtacacacagtagtacttcagatctccatacgaaaatctaattttgctattctataca

SEQ ID NO: 5112 - DNA, 3171 bp, Zea mays
cacagctgcagaacagtttaagtctatcaaagtaggattcttataacacaactgcgagttcgacgtcgacccaaccatctcaccgcacagcagagcccaaggtctcataggtttggaacctacgtgctaacagcatcacctaacaacgcacgtacctggtattacaccatccctacagcagctacagacgtgtaaaaaaacatggtcctggcttctatgcaacactcgtaataacaaagaacagacgactgctaaaacctagctagtgctccttgagcatttctctcagcggaagggctacgcagcagccgacttggcggcgctccttgcgcgggtcgtcctcttgggatgctcctggctcgtcaagactgcgacggcgacggcgctgtcggatgagtccgagctgctgcgctccccggtctgccctttgccggacaccgttttcccgagcgccttctttggtgtcgccgcgccagcgccacctttcgccaccctgccggtggcgcccttgttgccaccgtggtccttgtccttccccacgacgaccgtactggccgccgtgtcgcatttgtccaccagcttcgtcgtcttggacaggctgaggtcctccacggccatgactccgtcccactcgtcctctgtgttcgttgtggcgcctgaccttgagctctcgtaggagccgatgccgatgctgtcggctcggatggcggtggctgcggcacaggcccttgtctgctcgtggtatagcacctgcaccacgatcctcagaggcaggcgctcgttctgcacggcatgagcgcacgcatcgggcgacaacttcttgcagtccatcagggcacataatctcttcttgtcgctcttgcccaagcttgggtgctccttcagatacatatcaatggcacgatacagtccatcatgaaccggccttgaaccggtcgaaaccgtctcagctaggctgaaaaacttgtagaccggtatatttgggtcccttgcaacctctgcgagatatccatcgacagttttggccactgcaaccattgacgcactaggagcagatacgtggtcgttcacctcaccaccgttatgtctctgggcattcttgctatcttgtctgacaaattcttcaacaatgctaagaatcaggtcgatgtcgtaaacggtggtatccccatccaccgtagggatcagaagatctgacactgacgcttcttccagttgccgtgcgatgcgcttcataagctctttcctgcacatctctccacacttgagcaagtttgttgccttcagtaacttcaagaggaagctgcacgaaaccgaacctttctcggatggcaacaggcatgtgatggtaactagcatagcccgaacttttgcgtcgccatggatcatcgagaccttgcttagtgacgggagcttcttgtaagtgtaggctttaatcgccgcaccgatcacatccttgggcaccgtacccttggttttgactgctgttatgacttgcttgtaggcgtcaatgtcgagatctgtcagatcttcgacccaccaatcctttggaacaaactgctgctgcttgactccattccatggcgaatcatgaccattctcaactgtgagcttcttacggttgtatgtgtatgaccattcaacttttgaaacgtcaatagaggcttttgaagcaacagagtcaatgcagtggctgaccagcttaagatcctctgcccaaggtaaatgagcctttgttgtaccaagaacaattatggagtctttccagctccggtgtatgcttgagctgaggaagatatcgatcttgtagatcagattgcccttgtcaacagtctcgttcatctccaggtactctgcggcacagcgggcggcaatcacattgtaggcattgagtgtgacaatcatgccatagcaaaacttggcacagatctcaaaagccttggcaccaccaggaatatcatggatgtggatctcaatattttcatcgccagtagttggaatcaacttctggaagcgagcacacttggataggagcggaaacttgtgaaggtaaaactttgtagtccctatacgaacagtgatgtcgctcaccaattcagatgccgcaatactgacttcattcccatctccctgaaatgtatccggatttgatccaagcttcatgaacttcatcttgaccacgaaagaggagccgcacagcttcccgctcctctagtccaatgctcacgcagagaccagacgtccagaccaccaccaccaccaccacttgtaagaagcaagaactgcacagcaccacaaccactatcccatacttgtccaccgcagcaacggcaaatggctcagagcagcgaggcagcgcacaagaacaagttgctgctgcgccgagaagagaagaccgaatattgcaacgtgccggagccggccaggagatcgctcgtacagcgaaaacaaacaaatagtggggatgggttccgatgcagcaacagcgctgctgcttgaagcgcactctagcgcccaacctacttatgcggccggtgctgctgctatcgtaggcagtgaggggccagaagggggaggagcacaaagtacctcaggaggagtaaactaatgtatggagctggagtggagagcggggcagtgaaccagaggagggacacccacaaagcacaaagcctgctgcttgtttaattgctttgtccttcttgatctcgtattaaacaactagtcaacattcctcgccacacaccgttccccgagcatgatctgtccctctctcccggcgatctctgcggcaagcaacaacggcagaaacaagcgttagtggcgctctgcggcgcaagttgggggggcaggcaggagacacccagcatctattttaaatgcagtgcggggggaggcggcaacggagagagagaccaagaaccacttgctcgctctggtgatgtgctttgcgccggggagaatcttatcgccggcagcacgccaagatctcgcagtttttttgccgagatcgatcagatggcaagggagagagacgcacacgcacgctgcactagtaatacatggggatggccgggccagcagaagggagggaataataaaaataaccagaaaccatcaacgggcagggcaggcactgaggcaccaggcacagcaccctcgtgccgaatt

SEQ ID NO: 5113 - DNA, 1304 bp, Zea mays
ttttttttttttttttgctatagcattgatccataaacagctgcctccgataccgaatgatgtgaatgccagcggtgcaaaacatgcttgaatacaaacaataccccagggctatctgctacaggcagctagctcttttcattacaatagcactacatgttggttcacaaaatatccttatagacttgaacacgtgaagaaatcacagaccagaagttcaagccggccaatctccagtctaaaaattttaaaacatgcaaaacctcatgtttttgctgtatttttcttctacagcataaaaggctgattgtttcaatcctcattctgttgaattttctcaaaactcattctgttgaattttcgtggagcaaaacatactcccggctactattgccaaacttgattgtgtccttttcaaataactcataatatcgccgaggctcaatgcgatttccattgatgaaagttccatttgtactatcaagatccatcagataaggccttattttctttgtcatcatgccatctagttgctccttctccacaagtctgtattgaagaactgcatgttgcttgctgcaggagggatgatctgtggggacatctgcaactttcctttctcttccaaaaaggtagcaggtcatccgatgaacatacagtggttcattcagtggttcaccatctttaaatacatagagcctccatctaatctctgactttcgagcctctgggggttctgaatataatagatttacacctgcaactctgttggtctcctcagcaagctttccagacaattcaaacgatggcttttgcttttcttttgcttcaagagcttctgcagttgcgttcattgttgccaaagcatcaggatctccattccgggatgcttcacctcctctcgagttaatatcctcgatatgtgctgcacttctggacactctcgatgatggatgagattcatgcctgccccgatgcctgtgctcttctggagacattgaacgaccatgcctgaaagaccttcccgatcccccattgctcccatcatgatctgttggtttcactcttgtagaatcccttctgtcaccacagtccagcctttgctcccttgaagaagcagatttccagtcaccccgattaggccttccatgtctatcatcatcccagaccggcaatgccacctttgaagcaccatacttgtcatccctcccagccccccccccccccgaatgatccttctcatcatcacgaacatatttcttatcttttgcagtacctctggtatcctctcgatccgacttcct

SEQ ID NO: 5114 - DNA, 3598 bp, Zea mays
  misc_feature (3548)..(3548): n is a, c, g, or t
  misc_feature (3556)..(3556): n is a, c, g, or t
  misc_feature (3563)..(3563): n is a, c, g, or t
  misc_feature (3568)..(3569): n is a, c, g, or t
  misc_feature (3580)..(3580): n is a, c, g, or t
  misc_feature (3583)..(3583): n is a, c, g, or t
  misc_feature (3590)..(3590): n is a, c, g, or t
ttttgtaaccattatcattaccctttttgcgttacatttcttgaaccaaacagcacccaagtctcctggctgtctgactgcctgagccgaggcccgtggccttttggccccaggccgctgtcaaagccggcgacgagaagagctgcgtgtttgaccccggaccgtcgggcgtgcaaatgccgcgtgcgtgtgccgtccctgcaacgcaagcggccgccagcttcgtctcgcgcttttgctggtatcaggcaagcccggcctactagtacgtactccactgggagccgtgtagtaaaacttcatgttgcacactgcaggcacgctctgtctcggagtggcaaatattctgtagctagctaaggggccaagtccgaagtgccgtgttgccgcctaagctagcattattcagatcttctggtctgagctttggtgctggcaatggccaattgccatgacacaagcatcttctgagccaggtaacctgggctgatatgagccgttcaaactagctagcagatgcccaagtgccatttctagttagttacaaccttccgggctccggcacaggtttaccttttttttccatcttacatatagcacaagcatagatgcagtgcatgcaccacaccatcgttcctttgtttagctgtaaataatgtgacttgctataccttttttttccatcttacatatggcaagcatagatgcagtgcatgcaccacaccatcgctcctttgtttagctgtaaataatgtgtcttgctatatttcagatctgaaatatagaatgttttcagacaacgatcttcactggtagagtggtagttcataagcgattaagcgtaatgctaaggttcattttaatgcaaaacaaacaaacaaacaaacaaacaagaatactgtatctctagaagagaagatggcatgtgaccgttagaaaaaggtgataaataatatgcggcaattctatgtgatctaagacacatagtccagacttccatctgatggctttccatgaactagtcagaaaaggttaccacctttgcttaggatgaacatgcatgttcccaggtagaggtggtaattgatcacgatctaaatatttcttcacggttcgtttttgtccttaattaattttagtttaaaatagataaaaatatagtctgattctatatccttaaattctatagcataatatttagggccctttaccacagcccctagctacaagtcactgtgatcagatattcagatgaccattcgaacgacctaacagatctcacagcagaacaccaagaattcacagctgcagaacagtcgtgcttcaactctctaacaaagtaggcttcttatgacataaaccctcacagcacaacccaaggtctcataggtttcatggcaagcctacatgctaacaacatcacctaacaacgtacgcgtaccatcccgggctcccggcctacaagacgtttaagaacatggtccttgcttctatgcaacattcataacgcaaagaaaagaacggacgacgactgctaaaacctagtgctccttgagcatctcactgagcaaagggccgggcagctactactacacagcggctgacttggtggtgctccttgctgcggccctcttgggatgctccagctggcaaggcaaaatggcgctgtcggatgagtccgagctgctgcgctccccagcctgccctttgttgcctgacatcgtcgtcctcccgaccgccttcttcggcatcacgccacctttcgccctgccgttggcacccttgttgccgccgtggttcttctccgagacggtgctagctgcgtcacatttctctagcttcgtcgtcttggacgacagactgaggtcttccacggccatgacgccgtcccactcgtcttctgtgtttgttgtggcccctgaccttgagctctcgtaggagccgatgccgatgctgtcagctcggacggtggctgctgcagaagccctcgtctgctcgtggtacagcacctgcaccacaaccctcagaggcaggcgctcgttctgcacagcgtgagcgcatgcatcgggcgacaacttcctgcagtccatgagggcacagagcctcttcttgtcgctcttgcccaagcttgggtgctcctgaaaaggaagagaactttgtcaacttgcagtcttttattatcaagagaaatggaatgtctatcttaatccccatggaatactagtagatagcagcaaatgtatttgaaataatttcttgaactaggacgaagaaatgccacaatggaagatgcgtcaggagtgtacattgaagtaactaagtataagagagcgtttcgttctgcatatgaagttttggaataatggtcatgaagtttttataggtagtcacagcttgcaagtggcagcaataccttcagatacatatcaatggcgcgatagagcccgtcatggactggccttgaattggccgagactgtctcagcgagactgaaaaacttgtagaccggtatatttgggtccttcgcaacctctgcgagatacccatcaacaatctttgccactgtaatcattgatgcactaggagctgatacatggtcattcacttcgccaccattatgtctctgggcattcttactatcctgtctgataaattcttcaacaatgctaagaatcaggtcaatgtcgtaaacactggtgtcctcatccactgcagggatcagaagatctgacactgatgcttcttccaattgccgtgcaatgcgcttcataagctctttcctgcacatatcgccgcacttcagcaaattggttgccttcagtagcttcaagaggaagctgcatgaaactgagcctttctcagatggcaacaggcatgtgattgtaactagcatcgcccgaacttttgcgtcgccatggatcattgagaccttgcttagtgacggcagcttcttgtaagtgtaggctttaattgcctcaccgatcacgtccttggccaccatacccttggttttgactgcggttatgacttgcttgtaggcatcaatgtcgagatccgtcagatcttctacccaccaatccttcggaacaacctgccgctggttgactccattccacggcgaatcatgaccattctcagttgggagcttcttacgattgtatgtgtatgaccattcaacttttgaaacgtcgatagaggcttttgaagcgacagagtcaatgcattggctaaccagcttaagatcctctgcccaaggtagatgagcctttgttgtaccaagaacaataatagagtctttccagctccggaatatgcttgagctgaggaagacatcaatcttgtagatcagattgcccttgtcaacagtctcattcatctccaagtactctgcagcacagcgggctgcaatcacattgtaggcattgagtgtgacaatcatgccatagcaaaacttggcacagaccccaaaagcctttgcgccaccaggaatatcatggatgtggatctcaatattttcttcaccagtagttggaatcaacttctgaaancgagcacncttgganaggannggaaacttgtnaangtaaaangttgtagt

SEQ ID NO: 5115 - DNA, 3455 bp, Zea mays
  misc_feature (497)..(515): n is a, c, g, or t
taaggacatagagcctccatctaatctctgactttcgagcctctgggggttctgcaactctgttggtctcctcagcaagctttccagacaattcaaacgatggcttttgcttttcttttgcttcaagagcttctgcagttgcgttcattgttgccaaagcatcaggatctccattccgggatgcttcacctcctctcgagttaatatcctcgatatgtgctgcacttctggacactctcgatgatggatgagattcatgcctgccccgatgcctgtgctcttctggagacattgaacgaccatgcctgaaagaccttcccgatcccccattgctcccatcatgatctgttggtttcactcttgtagaatcccttctgtcaccacagtccagcctttgctcccttgaagaagcagatttccagtcaccccgattaggccttccatgtctatcatcatcccacctcgtgccgaattcggcacgagggagagatataagnnnnnnnnnnnnnnnnnnntcgtgtttttttttttttttttttttttttaactctctaacaaagtaggcttcttatgacataaaccctcacgtcacaacccaaggtctcataggtttcatggcaagcctacatgctaacgacatcacctaacaacgtacgtaccatgcatcccggcctacaagacgtgtaagaacatggtccttgcttctatgcaacattcataacacaaagaaaagaacggacgacgactgctaaaacctagtgctccttgagcatctcactcagcaaagggccgcgcgcagctactagtctactacacagcggctgacttggtggtgctccttgctgcggccctcttgggatgctccagctggcaaggcaaaatggcgctgtcggatgagtccgagctgctgcgctccccagcctgccctttgttgcctggcatcgtcgtcctcccgaccgccttcttcggcgtcacgccacctttcgccctgccgtggttcttctccgcgacggtggtgctggctgcgtcacatttctctagcttcgtcgtcttggacgacagactgaggtcttccacggccatgacgccgtcccactcgtcctctgtgtttgttgtggcccctgaccttgagctctcgtaggagccgatgccgatgctgtcagctcggacggtggctgctgcagaagccctcgtctgctcgtggtacagcacctgcaccacaaccctcagaggcaggcgctcgttctgcacagcgtgagcgcatgcatcaggcgacaacttcctgcagtccatgagggcacagagcctcttcttgtcgctcttgcccaagcctgggtgctccttcagatacatatcaatggcgcgatagagcccgtcatggactggccttgaattggccgagactgtctcagcgagactgaaaaacttgtagaccggtatatttgggtccttcgcaacctctgcgagatacccatcaacaatctttgccactgtaatcattgatgcactaggagctgatacatggtcattcacttcgccaccattattatgtctctgggtattcttactatcctgtctgataaattcttcaacaatgctcagaaccaggtcaatgtcgtaaacactggtgtccccatccactgtagggatcagaagatctgacactgatgcttcttccaattgccgtgcagtgcgcttcataagctctttcctgcacatatcgccgcacttcagcaaattggttgccttcagtagcttcaagaggaagctgcatgaaactgagcctttctcagatggcaacaggcatgtgatggtaactagcatcgcacgaacttttgcgtcgccatggatcattgagaccttgcttagtgacggcagcttcttgtaagtgtaggctttaattgcctcaccgatcacgtccttggccaccatacccttggttttgactgcggttatgacttgcttgtaggcatcaatgtcgagatccgtcagatcttctacccaccaatccttcggaacaacctgccgctggttgactccattccacggcgaatcatgaccattctcagttgggagcttcttacgattgtatgtgtatgaccattcaacttttgaaacgtcgatagaggcttttgaagcgacagagtcaatgcattggctaaccagcttaagatcctctgcccaaggtagatgagcctttgttgtaccaagaacaataatagagtctttccagctccggaatatgcttgagctgaggaagacatcaatcttgtagatcagattgcccttgtcaacagtctcattcatctccaagtactctgcagcacagcgggctgcaatcacattgtaggcattgagtgtgacaatcatgccatagcaaaacttggcacagaccccaaaagcctttgcgccaccaggaatatcatggatgtggatctcaatattttcttcaccagtagttggaatcaacttctgaaagcgagcacacttggagaggagtggaaacttgtgaaggtaaaactttgtagtccctatacgaacagtgatgtcgctcaccaattcagatgccgcaatactgacttcattcccatcgtcctgaaaggtatccggattcgatccaagcttcatgaacttcatcttgaacaagaaagaagagccgcacagcttcacgctcttctagaccaaatgctcacacagagaccagaccaccaccactaccagttgtaagaagcaagaactgcacagcacagcagcactatcccatacttgtccgcagcatcaacggcaaacggcccagagcagcgaagtagcagtgcacaagaacaagttgctgctgcgccgagaagaccgaatattacaacgtgccggagcccggccaggagagagatcgctcgtacaacgaaaccaaacaaataatgggatcggttcagacgcagcaacagcgctcgtgctttttaagcgcactccagccctcccccccaacctacttatgcggccggtgccgctgctgctatcgtaggcagtgaggccaggaggggagagcaggagcacaagtacctcaggagaagtaaacaatatggagtgggagcagtgagccagaggagggacacccacaaagcacaaagctgacacacccccacctcccccctgctgctgcttgtttaattgcgtgtccttgttgatctgggaaaaagattagtataatagttccttgcaccctccagtccagctctcttcactccctcttctcataagaaaaaaatactgccaagattcagaggggatcttgcgtccaatgcgttgtcatattattaagcaaccagatagtagtccacattcctcgccacaccgtaccgttccccgagtatgatctctcaacggtctcctttgacggaagatgccaagaagaagaaggcagggagcagcaaaccctttatggaacggaaggctttcct

SEQ ID NO: 5116 - DNA, 864 bp, Zea mays
tcatcatcacgaacatatttcttatcttttgcagtacctctggtatcctctcgatccgacttcctatctatcgatgcaaccctcccttcatcatgttccctgtgcttgccccatgagtccctctcttccccatgagagggcttgcggcgatcaccatttgttacatgcactgcctcccgatccactttcctgtctcttgaagcatccctcccctcatcatgctccctgtgcctcagtgtatcctgctcctccctgtgacttgccttccggcgatcactgccggtaggctgcaccgcctcccgctcaccctgcgctcccctcgtcctcttggagcgcggcgagggcgacctagagaagtgtcgcctagcaggtgagggtgatcgtgactgctcctgcttacgtttcggcgacctgacccgctggtccttcgccttctccctgggagacgacctctctctccccttgtgcaacaggctgaccttagcaggagactctggcgacctgacacgctccttcaccttctccctcggaggcgacctctccctgtccctatgcgacgcacttgacttcgcagcaggagaccgtgccctagcaggcgaacccttcctccgctctggggaactccgcctgcgtggcggcgttcccctccgctccctgccccgtgctggggaacgcgatctccgcgcgtgctcctccctccgccgctccaccgccgaagccattgctggccggagatggaggcggcggaatgggcctagatgctacctccccacggcggcggaggcggcgctgctacggcgactgattttttctgcttcaatcgcctcaattggggggatgatcctgccggccccgggtaccaat

SEQ ID NO: 5117 - DNA, 763 bp, Zea mays
gcaacatcacctgttccgaggggctcctgtactgggtggcgcagctgctggggtccaccgtggcgtgcttcctgctccgcttctcgacgggcgggcaggccacgggcaccttcgggctgacgggcgtgtcggtgtgggaggcgctggtgctggagatcgtgatgaccttcgggctggtgtacacggtgtacgcgacggcggtggacccgaagaagggcagcctgggcaccatcgcccccattgccatcggcttcatcgtgggggccaacatcctggtgggcggcgccttcgacggcgcgtccatgaaccccgccgtgtccttcggccccgccctcgtcagctgggagtggggctaccagtgggtgtactgggtcggccccctcatcggcggcggcctcgccggcgtcatctacgagctgctcttcatctcccacacccacgagcagctcccctccaccgactactaaaagccgaagccgaccgacccaggggtgcgcagcgcagcgcagctagcatccagcgctctctccccgctcgccgccgtttagtttctctcgtgcacgtgcatgcatcgtagactgtctcaggccgccgctgcgccggcgccgctcgcatcgtttgcttccttggaccagcagtcgtcgccgtcaggctgaactgcttgtaaccgtgaattccggacccgtttgcttctgtaagatttgtgcatttgcctgagtaaaaaaaaaaaaaaaaaaaaaactcgcaaagggggcccggtacc

SEQ ID NO: 5118 - DNA, 3038 bp, Zea mays
  misc_feature (2765)..(2765): n is a, c, g, or t
  misc_feature (2932)..(2932): n is a, c, g, or t
tgggacccgccccgccggccgggccgggatacacagcaaagcctcaaaacctgatcatcagagaaacgaaaaggaagaggtgagcgtgggagaaaaaacaaaagaaaggaaaagagatatagccctgagaagaatggcccttacaactgatgaactcaaggccaaggccgaggtatactacggtgacgagatctgccagctgtgtacccagctcctgctcagggaagcaggcctccccaatggcctgcttccattgaaggacctaatcgagtgcggctatgtccaggaaactggattcgtgtggctgaagcaaagcaagagggttgaccacatcttccatagtctaggaaggctggtctcttacggcacggagatcaccggctatgccgagaagggcaggatcaggaaggtcaaagggataaagaccagggagctcatgctgtgggtcccggtggaggagattgctcttgatgatgatccagcgactgggaagcttgtctgcaagagcattgctgggattaccaaaaccttccctgcatcggctttccatatcccggagaaggagaacaatgtgaaggcgaactgtgctgcactcaagccggtggtcctcatggagagagctccacgagttgttaaaaacagctgatccgccttcaattctgcatccactggtatttggagttgacgtacggccgccatatcagcccttaatcctacgtatttaaataatggttgaactagtgctttactgttttccgttcatgtacttgggaaatgataacacaaagttcttccgcctatatatatactgcggttgtacgattgccctggcatctatataatattgtcctgtaaggcaaccaccctcctgtatggtatctcacccaacttcctttcatgtactacgtagctctatattactaatacaaagcatgttgtggacttctatgagatatctcattttctctctctttctctctagagaaaatgcattcagatgatttatttttcatgtactatatatatggataaaatagcaccattggatggtatagtgtttcagagaaaacaccacttatacatgatgtgctttctgcttgtcatattttccatcttattttcagacaacagaacactgcgaagtgctatgtatttcttttttattttccatctttgcatcacaaaaagaaaacacatgacaaggcatgaaggaaccaaaagtttaataaaaggggcaacaaatttgcatatgcctttgtaattatgatctataaatggtctttgcaaccatttgtcatttctgtttgcaataatagactcccgccccacctccaccggcccttaggcgagctacgccgctgccgtcccgacctgtgccgtcctccaccaccggctacagccggcaccgccgacgaccactccgcctgcacgggccgccgctgacaccctcacccaccaccgcccacggtctctatgccggtcgacccgaccaaaagccctcctccagccggccaccggtccaccgagagtttaaattttttttatattttattctatatatttagcggtcattatccatttgccgacgaaattagtatgtatttcatgactaatatgtttatttaatgagggtgtgtgattagtatatttgtttgattcgaccctatagggtctattttcggtggtatctagccgaccaaaatgaatcagctttctatagtacgaagtagagaatgaaagctttactaccacaacaagtttaaattacgaaacaacagcgaagcaggttagcatacaaaaccatcacgtaaggtatgatagggaccgttttcctgtttatagaatcaggatcctccctagtgcgttttctacgactgtatcatcagaccatgggatgatcaacaaaatcatgattatccaaagtacaatttgttgggaggtttttccgactacaaaagtgtcatttttaggatacagggaaacgcaagtttgccattgccaagtaactttttataaatactaatgacttactaattaaagacataccagtaaatatactaaattaaacgaggtaatttcattcctttagtgctagtttataaactccatttttgcaagagatttttatttttcaaaaaaaaaatgaactaatttttcttaagaaaatagaaatcatttaggaaactggtgttctcaaaatagcccacttatatggacggagcgcgggtagttaagaatgtcggtgaccacaaattctgttgtccccatactatgtaatgtagcatacatgcagaaatcagtggacgagttctttcatatagatgatatgctgcacggcctttaaaaaaagttcccagaagtcagtgtaaggaccagaactgttacactaagatatggcggtactaaattttattattttgagcacatgaaatcatgggcctgtggaagatagatctgcattaatcgccaccgaatacttaaaaattggccaacacagttaggcatatccactacccgtgcagcatcaaatcaaagtactatgaaaccggaccatctcccgtcctacaacgagcccaccagcactcaattacagaaccaaatagcccctgcatggctacttgtgtcatcagcttcacttaatgagaataattggcttatcattgtaccgtgctgacaagttttatttcccaattacttgctaaccaaacctgatcagtccttcaattcactgcaaggttgtgtttctaaaacatcaaaagtattanccagtgtaagttactgaaaatgatggcgaatgttgtgacaataagttaggtcagttgtatgcaactcattaagtgaccaagccagctaacagtatgacaaaatttcatttctttatggaggtaatggctaatgataataaaaatgtgggaacatatctcttcagctnatgggtgatgcatgatagatatattcagggattacttggagaaacagtgtcacatactcacatttagtttgaaactcctgtacgcgatgatggtaggtctgatcat

SEQ ID NO: 5119 - DNA, 960 bp, Zea mays
  misc_feature (58)..(58): n is a, c, g, or t
atacacagcaaagcctcaaaacctgatcatcagagaaacgaaaaggaagaggtgagcntgggagaaaaaacaaaagaaaggaaaagagatatagccctgagaagaatgtcccttacaactgatgaactcaaggccaaggccgaggtatactacggtgacgagatctgccagctgtgtacccagctcctgctcagggaagcaggcctccccaatggcctgcttcccattgaaggacctaatcgagtgcggctatgtccaggaaactggattcgtgtggctgaagcaaagcaacagggttgaccacatcttccatagtctaggaaggctggtctcttacggcacggagatcaccggctatgccgagaagggcaggatcaggaaggtcaaagggataaagaccagggagctcatgctgtgggtcccggtggaggagattgctcttgatgatgatccagcgactgggaagcttgtctgcaagagcattgctgggattaccaaaaccttccctgcatcggctttccatatcccggagaaggagaacaatgtgaaggcgaactgtgctgcactgaagccggtggtcctcatggagagagctccacgagttgttaaaaacagctgatccgccttcaattctgcatccactggtatttggagttgacgtacggccgccatatcagcccttaatcctacgtatttaaataatggttgaactagtgtcctttactattttccgttcatgtacttgggaaatgataacacaaagttcttccgcctatatatatactgcggttgtacgattgccctggcatctatataatattgtcctgtaaggtaaccacccaacttcctttcatgtactacgtagctctatattactaatacaaagcatgttgtggacttctatgagataaaaaaaaaaaaaaaactttctctctcgagggagggcaaaaaggggcggcc

SEQ ID NO: 5120 - DNA, 658 bp, Zea mays
attattaatcaactcatattcgacaaagtatacattagatagtttaggtttgataatggatccaaaatatgttagcctatgcatcttcgtattacttgtattgcatggagatactactttggcagaaacttgcagggagtttgctaaatggcatccattctgctttagtgcaatgtgcaaggcaaattgttttatagaaggaaaaagctccgatggttcctatgcaaagggatatagatgtgattcacatggatttcattctatgtgtatttgccttttgtgtaaaagttagttatcttaagacaagcggggatatattctatgttcatatccgtcatttagggtgttgttcaaataattttatgggataataattaactagtttgtttacttctagatatatgtaatactacttaaataatccttatttctttaatttcttagctctatagctagaaacatgtttttagttgccaaccactttagtaatatatgtttcttctcctttattataaacctcaatacttgttgtgagcttctcattcatagtcttgtttccttgacaggtatatatatatatatatatatgtcgatgtattcattaatagtactatagggttgtaatcgcattgaatatggacagatatctcttgtgctc

SEQ ID NO: 5121 - DNA, 1487 bp, Zea mays
aagggcgctcattctgtcattcgacacacctgtctcgttcctcactaccacaggtccaaagcaagcaagaagaaacgaaggacgataatggctctggtcgggcaggtggcgacggtggcgcagctggtgggcgtggacgcgttcagcctcatcacgatgatcgcggaggcggcgcagacggcgcggcggaaccgcgccgtgtgccggcagctggcccggcgcgtggagatgatcggcagcctgctccggcggctgcgcgagcaggacgacaacgacgacatgcggctgctgcggcacgcggagacgcgcggccccgtggaggcgctggaggagacgctccggcgcgcctacctgctggtgcggtcctgccagcggcgcgggtacgcgttccgctgcctgatgggggcgcggcacgcggacgagctccgcgagatgcagggcgagatcggcttctacctcgacctcttccccctcatcagctacgtcgactgggcgaggcgtcgcggcaacggcaacggcaaggccgcctgtggtgacactcgttctttgcaagaggcacctatggtaagaccatgtcttgtgccgttcctgtttctctcgctcctgcgatggatgcaattgttcagggagtacgttatgcccctgctctgcttgcccccgctcggcttatcaccttatgtttactgacgtgtgtatctgtgaaatcattttgcatgttaattttcattaacaatgatctagctagctagctagcaccttaattttcattgctgggaaacaagctagctagctactagtatgcagctgttgttggtcctctgtttttcggactactatctgtcgagttcaggtgaaattgcctttcttttttgaaccagattaaataggtatgttggaataatcctatttttttcctcttgggaacgcaaccagcacacgttcatcaggagtgtttctgtttggcctggctatctgtttcggtttggatacatacagatagcttaccttcttggttcatcaggagtgcaaagttgcaggatctcaggcggcgctgacgatgacgcagcagccctggagccttccacggccgagcaaggacgagtaggaaggagggccacatgcgtcgtggccccgtgacacctgcttcacgttctctcagattttaattttatgacgcacagcgaaaagcccaaaaggaggggggggaagatgctgtcgatacagatcgttcgatccacacgggaagatctgaagcatgagagcatgtctgaaacagtcgagatgtcagacatgtcctgccgccattttattttttacccgctcatgtacgggggttatttttttttcgtatttctttcctcagcggcgctgcagaatagaaccgatcgaggcggagttgtctgtcatctcatcatctctcagtaatattcacacgcgctgcgtctctcccaagggcgccgccaacttgtacaaaaaaaaaaaaaaaa

SEQ ID NO: 5122 - DNA, 864 bp, Zea mays
  misc_feature (27)..(27): n is a, c, g, or t
cattgggtccctcgaggccggccgggnacacctgtcttgttcctcactaccacaggtccaaagcaagcaagaaggaacgaaggacgaaagcaagcaagaaggaacgaaggacgataacgataatggctctggtcgggcaggtggcgacggtggcgcagctggtgggcgtggacgcgttcagcctcatcacgatgatcgcggacgcggcgcagacggcgcggcggaaccgcgccgtgtgccggcagctggcccggcgcgtggagatgatcggcggcctgctccggcggctgcgcgacgacgacgacgcgcggctgctgcggcacgcggagacgcgcggccccgtggaggccctggaggagacgctccggcgcgcctacctgctggtgcggtcctgccagcggcgcgggtacgcgttccgctgcctgatgggggcgcggcacgcggacgagctccgcgagatgcagggcgagatcggcttctacctcggcctcttccccctcatcagctacgtcgactgggcgaggcgtcgcggcaacggcaaggccgcctgtggtgacactcgttctttgcaagaggcacctatggtaagaccatgtcttgtgccgttcctgtttctctcgctcctgcgatggatgcaattgttaagggagtacttatgccttggtgtatatatatgcacctgctctgcttatcagcttatgtttactgacgtctgtatctgtgaaatctttttgcatgtgtcaccgcagggatctaaagataaacgcgttactgacttaaaactctgtaacgtcttattaacaatgatctagctagctagctagcaccttaattttcattgttgggaaacaagcgcgcccgcta

SEQ ID NO: 5123 - DNA, 1086 bp, Zea mays
tcgagccggccgggtcccctcttttgattcccctctcttcttgcaagagggtgtaagaaaaccaagccgccgccgggatactacactacccagctcctctccagtctcaacccagcccgcctctcgaacttccagaaccgtcctctcgctgcctgcggctgctatctctgtcatctagaggagagtgtaagggcactagatagagagtgatggcttctcctgatccatcggcggcagatgccggcaccgggggcgagtcgacgagccaggcggcggccgtggaaccgatccggatgccgacggtggaggagatcaaggggcaggacatctggaacaactgcgccgttcgcagcgtcgtcagtggcgtcatgggaggcggtcttggtgtgcttatgggactattctttggagctttggaaaatccgataatggcagagcaaatgacagcaaggcagcaaatagtatacacagcaaagcagatgggtagtagaagtataagtaatgccaaaacctttgcagtcatgggtctgattttctcagcagctgaatgtaccatagagaaggttcgggcaaagcatgacactaccaatacagcagtagctggctgtgtcactggaggagctttagctgtaaaaggtggccctaaagctacatgctttggatgtgtggggtttgctgcgttctcagtggcaattgaaaagttctttgatcggcatacttgaaatgggtgttgtgaatttgaacgctttttggccatgttcgtttgatcccaaaaccatagggattgaggtggattgaaagagattgaagaggattttgacttgtaggggatttgatcccctcaatccctatggatcagcacaaaacgaacagagccttagctgagcatgagcagcgttggcaggagaacctgattgtttgcaacatccagtcatctacaactcatgaaggactgtaacctaaatttttttttacttattcccagtttcttgcctggattcgtaattactgaactaccgaaacgcctaagagatctaccctgatcaatatcgatgcacgatgacattgacaaaaaaaaaaaaaaaa

SEQ ID NO: 5124 - DNA, 940 bp, Zea mays
gcgtggtcgcggccgaggtacatcacagggtagcgaccacccagactgaaggctgatggaggcactccagatgagacagttttgcaggattatatggtcccagtaaacttgattgagcggtgggcctatgctatggatattgtataccctgaatctaagcggtgctgctgtttcactaaaagctactatcgttatgtgaaggggacaggctctttgttggctacatctaaaaacctcaatgttcctgaagagaagctccaaatttcttccctgaaggagttgggcctacgatttttcacccctcgtgaggttgccaatttccattccttcccttcaaatttctgcttcccggatcacataagccttaggcaacagtatgctatgctgggtaacagtctgagtatagcagttgtgggtcctttgctgcattatctctttgctgaggcctgagtcatagagaagtccagtcagccctggtgacattagcatggcacaaacactgtggctgcgatctgccaaaatttcttcatacgtgatttaagcaaggttttggggactacagtttggccatttgatgagcacaccgtgtaggcacaacctcacaatgtatcaacaaaagtgtaccatacagtagagaagctgtttctgcgcatacttcctccccctcatgcctatgctgtcatggtgaatgaattttggaattgtgatccgttgatgtgtgcatggatgaggctgtcgtaacgattgttgatctgagctttaagtaacttggaacctacttactccgagcaattccaattctattcttagctaacccatttaaagtttgacaatatttatgatgtaaaatatgtatagcaagtataaaatatactcaatgaagaatctatatcataaatattgacactttttttatataaacatcgtgaagctctaaaaa

SEQ ID NO: 5125 - DNA, 1594 bp, Zea mays
agcacgggccgcgcgactgccggaggcgatggaggcgccggcaccttggagagtgctcgagttctacagcggcatcggaggcctgaggtactcgctgatggcgtcgggcgtgcgggcggaggtggtggaagccttcgacatcaacgacgtcgccaatgacgtctatgagcacaacttcggccaccgcccctgccaggggaacattcaaacgctcactgctagtgacttagacaaatacaaggcacatgcatggcttctttctcctccatgccagccatacacacgacaaggacttcagaagcattcagctgatgctcgtgcattttcgttcatcaagattcttaacctcatgcaagacatgagctatcctccacaaatgttatttgtggaaaacgtagttggatttgaggtgtctgatacacatgaccagttgctggaggtcctttcaagtctcaattttaacacgcaagaattcatcctaagccccttacagtttggtgtcccatattctagacctcgctacttctgtttggcgaaacgtgaacctgtgcggtttcgacatgcattcgtcaacaataagttgctccagacacctatgtgcctgagcctgacactgagcagtacatcacagggtagcgaccaccagactgaagaagagctagagccagtttgtaagccaataaaagatttccttgtcaaggaggctgatggaggcactccagatgagacagttttgcaggattatatggtcccagtaaacttgattgagcggtggggcaatgctatggatattgtataccctgaatttaagcggtgctgctgtttcactaaaagctactatcgttatgtgaaggggacaggctctttgttggctacatctaaaaacctcaatgttcctgaagagaagctccaaatttcttccctgaaggagttgggcctacgatttttcacccctcgtgaggttgccaatttccattccttcccttcaaatttctgcttcccggatcacataagccttaggcaacagtatgctatgctgggtaacagtctgagtatagcagttgtgggtcctttgctgcattatctctttgctgaggcctgagtcatagagaagtccagtcagccctggtgacattagcatggcacaaacactgtggctgcgatctgccaaaatttcttcatacgtgatttaagcaaggttggtatttaagtatggttttggggactacagtttggccatttgatgagcacaccgtgtaggcacaacctcacaatgtatcaacaaaagtgtaccatacagtagagaagctgtttctgcgcatacttcctccccctcatgcctatgctgtcatggtgaatgaattttggaattgtgatccgttgatgtgtgcatggatgaggctgtcgtaacgattgttgatctgagctttaagtaacttggaacctacttactccgagcaattccaattctattcttagctaacccatttaaagtttgacaatatttatgatgtaaaatatgtatagcaagtataaaatatactcaatgaagaatctatatcataaatattgacccttttttatataaactcgt

SEQ ID NO: 5126 - DNA, 3011 bp, Zea mays
ccttagatcccttcttttatttcgatattagtgcggatcaaaatcgatgcaacgaaaacgaatgcatatccaaagacaaatataaaataaatatagaacaaataatatcgctatctatccgatatccggctcccgcccgcccgccgccgcgtgggttttaacgccacctcgcgacgcggcccccaacccccaccgctgcggtgctactgctaccgtgctacaccatcaggaatcggacgcgggacgctacaccaccaccacagctccccacctccaccctcgccgcgagttgctcagtcgcagactcgcagcgagcgaggcgggggcctcactcagcgcggggcgaggcgagcgtcccgggtgggcagcgtcgcggtcgcgggctcgatcgggttgggacggggaggtagggaggaggggccagggatctccactctcgtccgtgcgggagcgcgggcgtcgcatgcggcggcgcgccggggcaaatgctggtagcctcacgggcggccccccccccccccccccgcggcggccggggagcgatgcaggcgccggagcagcagccgcagcagcagcagcagcggaggaagggttcgtcagagatggacttcttcagtgaatacggcgatgcgaacagatacaaaatccaagaggtcattggcaaaggaagttatggcgttgtttgctcagctgttgaccaacatactggtgacaaggtggcaatcaagaaaatacacaatatctttgagcacttatctgatgctgcccggatcctacgtgagatcaaactgcttcggctattacgccatcctgatatagttgagatcaagcatataatgctgcctccatcaaggagggacttcaaagatatctatgttgtatttgagctgatggatacagacctccaccaagtcatcaaggcaaatgatgatttaacccgagagcatcatcaattctttctctatcagatgctccgtgcactgaaatacattcataccgctaatgtttatcatcgtgatttgaagccaaagaatatattggctaatgctaactgtaaacttaaaatatgtgattttggattggcaagagtggcattcaatgacactcctacaacagtattctggacggattatgttgctacaagatggtatagggcccctgaactgtgtgggtctttcttttccaagtattcgccagctattgacatatggagtatcggttgcatttttgcggagatcttaactgggaagcctttatttcctggaaaaaatgtggtccaccagttagatttgatgactgatctcttgggtactccatcacttgatacagtttccaggattcggaatgagaaggcaaggaggtacttgagtagcatgaggaaaaaacagccagtaccatttactgaaaagtttcctaaagcagatcctgctgcactcaaacttttgcagaggcttttggcatttgatcccaaggataggccaactgctgaagaggcattggctgatccgtattttaaaggcctcgcaaaagtagagagagaaccatcatgccagccaataacaaaaatggagttcgagtttgagcgaaaaaaggcgaccaaagaggatgtcaaggaacttatattcagggagatattggagtatcatcctcaacttctcaaggattacatgaatgggactgagaaaacaaactttctatatcctagtgctgttgaccatttcaggaggcaatttgcaaacttggaggaaaatggaggaaagagtggggcacacgccgcttcatcagacaggaagcatgtttcgctcccaaggacaaccacagttcattctaatccaatccctccaaatggaacctcccaggttcctcaaaagattcccacaggtagaccaggaagagtggttggtccagtaataccatttgagaacgcagctgcagttgatccatacagccaacgtagggtctcaaggaatccagtacttcctccaaccacgtcgaacatgtcagcctatgcctaccaccggaagtcagacaactcagacagagagctccaacaggagctggaaaaggaccgcatgcagtaccagccagcacagcggttcatggacgccaaggtagtatcacagatgtcccctgacttgaggtcttcctactacataccaaaaggtgtcccaaaggctgatcccgcagatagaaccgctctgcattctagcatgattcatgggatcgcccctttcagtggcattgcagctgttggaggtggctacaacaaggtcaatgcagttcagtatggagtttctaggatgtactagttctagttgcattggccatctccgaattcctcagctgatgagttgaagtaataacatggcgaagaccagatgtaggtaccgaagaactgccataccggctctgagccaaagatagaaaacatggaatacggatctcggatcgaggacgtgtccgtcagattgaaaacagatactgggcagcagtcatggttctgtccattggacctagcttttcgggaagcaatgccatcgccccgcggaaacggtaaaataaaaggagaaaaaaaaatgcagtactgtcagttgattgctgcttataaagaagcaaagggggcagagacgacgatttttacaggtaaaattatgtactttgcaaggagggaaacatgtgggaataagtagtgagcctacgtttagctctgtatataaagtgacttgattttatatgtactattacggctggtgaaacacgcttctttaattcaaagctatggagttttggcctaaataccataggcagctcagattgataaaaaaaaaaaaaaaagggggggggggggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggttttgggggttaaaattttattttggggtgtttggaagttattattttttttatggg

SEQ ID NO: 5127 - DNA, 1472 bp, Zea mays
tctgaccgttactcccttctatctgcaggacaaccacagttcattctaatccaatccctccaaatggaacctcccaagttccccgaaagattcccacaggtggtaatttctcctaacgaaatattatgttcttcaggcgccactatctaatgtagtgttattttctgaaaaaaaatcaggtagaccaggaagagtggttggttcagtaataccatttgagaacgcaactgctgttgatccatacagccaacgcagggtggtgaggaatccagtgcttcctccagccacctccgtccgccccccccccgcctatcaccggaagtcagacacctcagatggagaactccaacaggagctggaaaaggaccgcatgaagtaccagccagcacagcgattcatggacagcaagctagtatcacacatgtcccctgacctgaggtcttcctactacataccaaaagctttcccaaaagccgacgcggcagatagagctgctttgcattcaaacatgattcatggaatcgccccttttagtggcatcgctgctgcaggtggaggtggctacaacaaggttaatggggttcagtatggagtttctaggatttactagttctagttgcattgaccatctccagaacacctgatctgagttgaagtaataacatggcgaacagtgaaaagatttaggtgccaaagaactgccatgttggctccgagccgaagatacggagcatgaagagtatggtctccgatctcggatcaaggaggaagtgtgacgtcagattgaaaaacagataatattgggcaacagtcatggttctgttcattggacatagcttttcggaaagcaatgccatcaccccgcggcaacggtaaaataaaaggagagaaaaaaaggcagtgccgtcagttggttgctgcttataagagtcaaaggggagcagagacaattattacatggaaaattatgtactttgcaagaacggaaacattggggaataaaaaatagttagtctacgtttacctctctgtatataaaaaaagtgacttgattttatgtattacggctggtgagacccgcttctttaattcaaagctgtgaagttttggcctatattttgctctataataaagttcagattggtacaaaaaacaaaaaaagtatccgggactaaagattagtcactctattttagttctatttaggggatgtttatttggaattataatctacccatggtccaatgccagacccgagaacagcctctgagacccctctggtaaggcggtccagtgcttcccagttctacagattttatttgaacttcttaaaatcgtcttccactgcttcccagttctacagattttatttgaacttcttaaaatcgtcttccactggatttggctgttcttaagagtgttcttatgacttagacaaatatatctagtgactatccaactagtttaagtca

SEQ ID NO: 5128 - DNA, 2619 bp, Zea mays
  misc_feature (730)..(730): n is a, c, g, or t
ctgaagaggctgaacaatactttgaagatttcctgtcgaatgttgaagacactgacttttcttcttttgatggagagaaaagtgactcaagttcaaccaggaaagacctgttgttacttcatgctatgacagaaactccagttaagctcccagaagttgctttacctgcagaggcagatggcgttgtccttccctggctgcaatgggaaactaccaatgactttcagacctccccgtgcaaaaccaaggcccaggtaacgatgacatctgtttatctgcagaaatagtatcaattcttgtcttaaaatgtaaaatattgaatgttactccttctgtccaaagaatataattctagtacaatgccaaggtaaagtatcttgagtttgactaactatagataaaaattataatatctataatatcaaataagtatacctttgttccaaattataagtcattctaacctttttggagagcctaagcatctcaagtttgaccaaaattatagagagagttaacaaccttatgaaataaagctggtattactatgataatacaattaataaagaatctaacaatacttaattggtaccatgaatattataattttattatataactttggttaaacttgagatgctctggctctttaaaaagttgaaatgacttataatttgggacgaagtgagtgtcactagatttttccatgagatatgtttccatactatanttatttatgttataaacattaatatttttcttatatatttggtcaagctttagacaagttaaccaagaatacacctagaattgcattcgtttgcagatagaggtaatatttgtagggtagggatgctgagtcaaatgatgaggtgatttttttgttgttgttaatgacttcaacatgttaccttttctctaattgcatgttgaactcagggagaaagtaccagaggcagcactagcaatcagactgcgagcagccgtgggagttggagccctggagaccatgccacttcatcagttgcctccaaagatagtttactgaccagatttggtgaggttgggatttgccgaagcagcttgtctgactatgctcgaaccttgtcgtttcacatcgacgactatttgcatttaaggcagagtgaggatctcctcttggagacgtggatgcagaaacaaaggatcgactctggcggcctagtcctgtgcagtaaatcgacgatattgtagagtgcagccaaataggtagttgatggggttgagctagactaataattgcttggatttttacctttagctgccatggctcctgccgcctagtgtgtatagatgcatgcattatagttaacagattggataagctttttttaacgcttcatcgtgattaagaaaatttgttttttacaccaaaaaaaaaaaaaaacggatgatccacgacaatattgccgagattaagatccatattgtgttgcatctcaacaatataaaatgtcaatctctacaaaataacaatatagatgatacacattgattctagtattgtttttacagagtttcacacaagacgtgatggtaacaatatagataatacacattgatcgccctttgcctcgtcggctctgcacagtaggctggcatactctgccgtccgttgagcaacaggtttgatatttgggcaccgcccaacggtctagtgtgtcctagatggtacgagagtatagactaacgatttgtgattagattaacttaggcgaaagattttttttcccacgaaagttttttttctgcgtgtgcttatctggctaatcacacagaaatctgttggaaaacgtctagaaacaggttcagaccttttctataaatatagaggtacgatcgattaagggtaacataatcgatccaatcaatttgtttaccggttcctttacattttttctttaggggtaacgataattagtctttcacatccccaatcttaacctcttctcgactctacatcatttagatgtgtcttgaatggcccgccgatactaagacaacactaggatcttttcttcctgacggggtctctcccagaaggcgagattcaggtgatgaaggagatctcgaagcccaatgtgcacatgcggacagttcgctgtcctatcatggacggtctgattgcctatcgcagacggcccacacttccgcagagaggatctcaagccctcgctcctagcaggtgaggtccagggttcgttagatgatcggtctaaaagagcaccaacgttttccttgtggatgtggcccatttgcccttttcgtctcctatggaatcaaactgagaatattgcatatactgataaacaattatgaactagtaactgatgtgcgctccgcgtgcgtgtaaaacacagatatttgtatatactgtagactatatatgtaccaaagatagaacaactgaatagattcaatacttggtttatggaacaaaaaaatagagtttggtaaaatatgattgctagttattcaatatttgaagttggattgttatatacacacaaactatccccgaaggaatgaacatgcatacatatataaggctgtgcacaatagcatacattgtatatggat

SEQ ID NO: 5129 - DNA, 746 bp, Zea mays
gagctcactagtccccccccccccccccgtggacgggttctacgacccgctgctgtccttcatcgacatggccgtcaacgaagggttcatcaaggaggacgcccgccgcatcgtcatctcggctcccacggccaaggagctggtcctcaagcttgaggagtacgttccggagtacgaggtcggcctggtgtgggaggaccagatgccgccgtccgccgtcgccgtcgccgccgccgcgcacgggttcgccccggagctggtggagcccgggatcacctcctcgtcctgatctggacggggacgtcggccgggcctgcctacctacgctaaccccagattctgaccgacggccggcccggcggcaccaagtagaaaggctatctatactagtaccacctaattaataccgtaatctactactactactactaacaaagaagattgttgggatggaggatgacagctagctagcgtctgctcagttagcagcatatcgtcgttagccgcgcagtgtgcagctgcgtcagctctgccattgctgctcctagcttttgggcttttgtgttgtgctctcctagaagtagggaggaaggaaggaaggcatgctatgtatattccccgggtatgtggttgtggtctagcgattggatttgtctcgctcgcagcctcgcacgtgtgatggatggatcgtggaacaaaagctagttgcaatgcaaaagcgattcattcctatcctacagtaaaaa

SEQ ID NO: 5130 - DNA, 1492 bp, Zea mays
gctcaagctcaggcaagcggcagcaaggcgttggcaatcccagtccagtcgtcggagcactcgcaatttcccgtcacagctggccaccgccccaccctcacggcctcacctcctcccgctacacgcacgcgcccacctacccaaaacgaccgcgcgcggcgccctcctcccgcggtgccaccaccaccaccacctcgtcggaccatcaccacaccgatcggcagctaagcagctcccgcctccagcaccgcgagcggcgatggcaatggacgcggccgtggccgtgaagagcggcggtggcggcgccggatcgaccggggtcaccgcggcggcctcgcagtccccgcaggcggcgactaacggcggcgagcggcggtcccggttccagcgcatctgcgtgtactgcggcagcgccaagggccggaagcctagctaccaggacgccgccgtcgagctgggcaaggagctggtggagaggggcatagacctggtctacgggggcggttccatcggcctcatggggctggtctcgcatgcagttcatgacggagggcgccatgtgattggggtcatcccgagatccttgatgcccagagaggtcactggcgagcctgttggggaagtaagggccgtctccggcatgcacgagaggaaggccgagatggcccgcttcgccgatgccttcatagcgttacctggtggctatggaactctggaagagctgctggaggtcatcacctgggcgcaactagggatccataagaagccggtcgggcttctgaacgtggacgggttctacgacccgctgctgtccttcatcgacatggccgtcaacgaagggttcatcaaggaggacgcccgccgcatcgtcatctcggctcccacggccaaggagctggtcctcaagcttgaggagtacgttccggagtacgaggtaggcctggtgtgggaggaccagatgccaccgtccgccgccgccgcgcacgggttcgccccggagcttgtggagcccgggatcacctcctcgtcctgatctggactggacggggacgtcggccgggcctgcctacctacgctaaccccagattctgaccgacggccagcccggcaccaagtagaaaggctatccatactagtaccacctaattaataccgtaatctactactactactactaacaaagaagattgttgggatcgaggatgacagctagctagcgtctgctcagttagcagcatatcgtcgttagccgcgcagtgtgcagctgcgtcagctctgccattgctgctcctagcttttgggcttttgtgttgtgctctcctagaagtagggaggaaggaaggaaggcatgctatgtatattccccgggtatgtggttgtggtctagcgattggatttgtctcgctcgcagcctcgcacgtgtgatggatggatcgtggaacaaaagctagttgcaatgcaaaagcgattcatttctaaaaaaaaaaaaaaa

SEQ ID NO: 5131 - DNA, 1397 bp, Zea mays
ccacgcgtccgggcgcagcacgaggaactcgttggtggcatcgagcgagcggtgcgagtggcacgagtgcgtgcgcgagcaagatcggagcttttccttcgtcgcagttgtggggaacgcggcgagcgcttccgtgatgggcgccggcgcccaggaggatgaggaggagatccccccggtgtccgggccgcgagcccacctctcctctgatcctctccgccatttctgtgcgcatctggagctgttgttctaaacccccaaaccctccgtcctaacctctgcgccaccggcgtcaccaccgccggagccgcagccatgaacgccttcaggttcctcggggacatgacccacctcttctcggtcctcgtcctcctcctcaagatctacgccaccaagtcctgctcaggggtgtcgaggaagacgcaggagctgtacatgttggtgttcgtggcgaggtacctggacctcttcacggattatgtctcgctctacaactcggtgatgaaggtggtgttcatcaccagctcggcggccatcgtgtggtgcatgcgccgccacccgcaggtacgaaggacgtacgacaaggagcaggacaccttccgccacacggtgctcgtcgccgccgcattcctgctcgcgctgatattccacgagcggttcaccttccgcgagatatgctgggcattttcaatctatttggaggcagtggctattctcccacaattagtgttgctccagagaagcagaaatgtggataacttaactggacaatatgttttcttccttggggcctaccgtgcgttttacattctaaactggatttatcgttatttcacggagggtcatcgcagcagatggatcccttggcttgctggtttggtgcaaacagctctgtatgcagatttcttttactattatttcttaagttggaagaacaatgtgaagctcgagttgcctgcttgagcatgcttcgttttgccagaaagcgtgcaagctacgtgactcaagttttatagaatttagttgattatatgggcatggagagacttggtaatgacgtgagcagttgcagttgatgccaaacccttgatcttgtctgcgaaaattggcatttgtgtttcccatggccaagacgatacgattccaaagctaacagatgctgctgcacagaagtaggctagttcctttttgtacctcaatacttttgatatggaaaatcatatacagttcagttggtctgtttaacattcgatttcacttgctccaaacgaaaaatgcgatccaatgttcgtgcgatttctgtgtaaaactgttacacttttgactgtcctcaacaatccattttttatatataaaataatagaagttctttggcctagtgaaaaaaaaaaaaaaaa

SEQ ID NO: 5132 - DNA, 1228 bp, Zea mays
ttccgagactctccattctttcttcctgtcctgtcctggtgtcctgtcctgtccacctctcctccgactccgatcctctccgccatttccctgcgcttctggaactgttgttctaaacccccaaaccctaacggcctaacctctgcgctgccggcgtcgccaccgccggagctgcggccatgaacgccttccggttcctcggggacatgacccacctcttctcggtcctcgtgctcctcctcaagatctacgccaccaagtcctgctcaggggtgtcgaggaagacgcaggagctgtacatgttggtgttcgtggcgaggtacctcgacctcttcacggactacgtctcgctctacaactcagtgatgaagatggtgttcatcaccagctcggcggcgattgtgtggtgcatgcgccgccacccgcaggtacggaggacttacgacaaggagcaggacaccttccgccacgcggtgctcgtcgccgccgcgttcctgctcgcgctgatgttccacgaccggttcaccttccgagagatatgctgggcattttcgatctatttagaggcagtggcaattctcccacagttagtgttactccagagaagcagaaatgtggataacttaactggacaatatgttttcttccttggggcctaccgggcattttacattctaaactggatttaccgttatttcacggagggtcatcacagcagatggatcccttggcttgctggtttggtgcaaacagctctgtatgcagatttcttttactattatttcttaagttggaagaacaacgtgaagctcgagttgcctgcttgagcatgcttcgtcgtgccagaaagtgtgcatgctacatgactcaagttttctagaaatttgtttatatgggcatggggagacttggtaatgatgtgagcagttgagttgataccatacccttaatcttgcctgcgaaaattgatatttgtgtttccatggcaaagtcgatacgattcgaaagctaacagatgctgctgcacagaagtagactagttcctttttgtacctcgatacttttgatatggaaaatcacaaacagttcagttgtttaacatgctatttcactttacgtaaacgaaaatgaactgttcttacgagttctctgtaaaacatgtctttgactatcctgatttaatatctagcttttatgtccttggcgaaaaaaaaaaaaaaaaagcaaa

SEQ ID NO: 5133 - DNA, 1959 bp, Zea mays
atttttcatataaagaaattatctaacacaaaattttaataaacattccaaatagcattagatagcgaaccacatgaatgaactacatagaaaacaaggcaaagccacacagtttgagcctcttgttggaattatcacaaatccaagggccccagcagaaaaccgcaattctctcatttattcccctccccgtcttcagccttctggtttccggtggacgcgaaaccgctagaggcagagggaggcgcagcacgaggaactcgttggtggcatcgagcgagcggtgcgagtggcacgagtgcgtgcgcgagcaagatcggagcttttccttcgtcgcagttgtggggaacgcggcgagcgcttccgtgatgggcgccggcgcccaggaggatgaggaggagataaccacggtggccgagggaggagtcggagaggaggagcaagcggcggctgagggcgcaggggaggaggagcagttggagcagggtgcagggggcgagggagagggtggggaggagaaagctccggcggtgatgttgtgctcgatctgcctcgacacagtggtcgccggaggcgaggagaggtccaccgcgaggctgcagtgcggtcacgaatttcacctcgattgcattggttcagcatttaatgccaaaggaatcatgcaatgccccaattgtcgcacgattgagatggggaactggctttatgcgaatggttctcgatcatcacaggacgtaaacaatgatgaatggggttatgatgacctatatgatcatggtcactcagagctggcaacctttgtgcctcttcgcattcagtggtgtcctattgggcgcctagaacttccatccttatttgaagaaggagagtccccagctccagctacttttaatgatttcacgggacaattcaactctgagcccatggtaccggtacctgccacacctcatcctggtccgtatctagcttattttcagcctgccccgacaccggtatcatcaagctcccttgtcgctgagagaacaatggatggtgctgcatatcatgatcactggaacactctggctgggctatcagatggccgacgaccctgggcgtactatcctcaacccaacagtgataatggtatagctgagcagcaaggactccctctgggggcaatggcggttggaggggttgatagtgaaagccaacaacgaggatctctctccttattttatggaaacgggtctggaagaccaaggatcccaggtgttcctcctatggcaccacaatttacaagagcgcatggcaacataaacgatcagttccagcagacagctagcttatttgctgggtcacagcaatcaggaggtatgcgtccattgggagcagtagggccttccgtgccaccacctccggagaacacctccttctgtctgttcccgccagcttcatccgtccccagtacaatggaggccgaggatgtcaacagagcaaaccagttctatgcatgggagagggatcgcctggctccttacccgctgatgcctgttaatagtgaaggtacctggtggagctcttcacaacagcagcctcctccggagcctgctgcatctgcttcgaggaggctttctgggcagtggattggtaggttgccattgccaccaccagagaatagatcgccagacggctcgtccttccgtccactgcacattcctcggatgtagcgcaggaactggcaaggcgtaagttaatagtacaaacgtgggaaaccctgttggttgtaagtggtaacgccactgtaagaaagccccgtcggatggtaaaccttgtgataaaattcaggatgttgaagaaaccgaccctgaggtgaaaacatttttggcccggggtttatgcatttcgatcaagtacatatttccggtcatgttaatgaatttctaagaatcgcagttctgcttaaaaaaaaaaaaaaat

SEQ ID NO: 5134 - DNA, 6552 bp, Zea mays
  misc_feature (3114)..(3114): n is a, c, g, or t
  misc_feature (3179)..(3179): n is a, c, g, or t
  misc_feature (4432)..(4432): n is a, c, g, or t
ctgttttgttgtcttccatttagcttataagttttcactgaaagcatgtggcctactataacttgaactactagcctgattgtatctgtgtgcttttagcagccgatgtccactgcacaacgaagcgataggtcttctggcagtaaggtgagaggaggcccttgtctgttgcatttctgatacaatgatgtctttgagttgaacgggttttcatgtgtttgtgttttccccccttaaaaaaattgcagccatgggagatgcattcgtattcacaacagaggcctggttatggatccaactcccagttgagtgatgatggatcatactctgatgcccaggacagctatgctccttcctatcaccagaatggaaaggcccctgattttcaagcggatgaacctaggcctttgacttacaacactggggttgaggaaagaccgccaccgcagcgccgctgggtgccccctcagcctccaggtgttgcgatgccagaagcagcagctgccatacgtcaaccaaaggcccttccaaagcagccctccagcgatgcctctgaggcagctggtgagatgcaggtgaatggttcaagtgcatcggatgctgtgactgaggttcctgttaatggtgctactgcaagcgatgctggacgcagtgagatccaagaacaatcagtggcggcctaagtgaaaccaagaccagctaagaactgggaagcaatctaagagagattcaggatctctagtacatctggggggtttgtcatacatctctgaataacgtctgtatcagaacagcggggcaaccacgccgatgggtacccgtaataatgcaataagtagcagatagtttctgcatttagattaatgctacttgtacacaggagaacatatcaataatatttttttggctgttcgattgagggtgcttaaaaagtgtgcttgtgaattgttgtattttgatcttgatcttgtgatgactagcaatcgcaatggaccaaatggagatggtcgtttgttttcttgttgctgtctcgctttattccattcaggtgttgttttttcagggtctgccaagaatgagaatgaatccattcaggtgttctccaggggctatttcctgcgtttgccagggatgagaatgaatggcggcgtacacatggattgttttcgtcagttcatgatctccccagacccttgtcatcgttcaaattcagttggatatttcttttttgttttgttttgttttgttttggagtacaaagtgttaacttatgacaggattccaattattgttgttgtctcaggtcaaaggtgggataccaccagcaaaggaacattaccccgacagaggatgataaaggatgctagtgcggagtaccactagatagagcagcgatgcatgtaggtctaccatttacacaaatgcatggggagagaaaccagccgctgaactggtggatttcaggatccatttacaaaagactgacgatcagcagctacaaggaacatgggtcagtagctgaacgacctagatgcatcctaaccatacagactggtcagtggtggattgcatgatgatctgtagcagatgcacgctgcgcttgcagcaccttgtcaaccttggcaagaagatgttgcatttctcccacaagactgagactgtccacggccggctttgcattcgcttcttgaggtgacttggctttagacgacaaggacaagatcatcttcccaagattgttcctaatatctgtgagagggagctttggaagaggcgtgatgggagggagatcctggacggtcggtgctgcaaatgcgccgccaagagtcgcggcacagctcaaggcgctctctgcttgagccctggtggcgaacaccacgcgcgcggtgtgcttgttcttgtcttgggtgatgctggtctcggagtcgatcacaaagccaaacctgctgaatgtggagaggaggtcctccctggagggcagcggagttccctctgccaagtccagcacaagtgccacaggattcccgacatagctgtgctgcccaacggtcttcatcgtctttctcttcctcttcttggtcaaggacgatccgtcgtctgggcctgcattaaggttgagcatcatcttgcggccaacaccagcagctgatggaggcttgctgacaccatcgtcttgggaggcaccgcccgcggcagcatgtgaatcgggatggtcgtcgacgaaaatgctgttcctgttcctgctatccatggccatgaaacggagggctgccgcttccatccccttaccctgcccgagcgctgaggctcggagagtggggagcgcctccgcgccggagacatggggttgcccctcctctcgctgcttctggctgccggcggccttcttttcttggaggacgcctgtgtcggtgtagggaggggagaggtacctgcttctcttgcgctctctcttggtgacggccagggctgcctcgtccacggccggatggatcagctggctctggctgccgccgctcccctccatagccatggaaacgggcggcacgcggcagctggggcggccaggggcgacgggacggggcgggacgtggcaggacaagagtgaagtcaccgcagttgagtgcagggcgccagggcggacccgccactgtttggatcgagttttagggggttggaatcggctagagctgttaaaggctttgctttttcgattaggatgttctaggtaatggtctcgtgcatggattagatgggattggaaaaaattgagaagaagtttgacttatttgagattcaaactcatccaatctcactcaatccacatggattgagagctaaccaaacatgccctaattaaaatttatataaattagagaatcaattcggttaggaatcgttccgactcatcaatccggcacaacgaacaagaccttatggggttagaatcgggctttgcttctcaacctatttgtatgagaatcgtttatatgaaaatctctcaaatcaatatgaatgtacgattcgtcaagtcattgtaaatagagaaatctatcaattaagctctttaatagcctaaaccgacaagagctccataagagagagagaggaatngagtacttctcttgatataacatgcgagacaattacatacataaggtggtgaaaataaagtacanatcacatcggtgctttgtggttgcattgtggtttagggttacagaagatatatactagtttcctctggtagctagtgcatgcttaatcatcatatgcgtgcgaggtgaatggggcatccgtttctgagcctgggaaacattgcccacttctcaaggctggggtcgtcgtcggccatctcccatctccatgttgtaacaaggtggtgcagaaaaatgagcatcatgattttggcgaggttcatccccaggcaggttctcccgcctgctccaaacaccaggaagctgtacggctgcttcgtgtgcatgctatgcccgcctttgaatcttgaaggatcaaacatggtggggttgtggtagagcgtcgcatcgtagtgtagggccctcgcatcaatgttcacaatccaccccttgtggatgtggaaccctgcgacctggcagtcctcgagtgctacccttggaaaccaggaaactatgctcgccatcctcaatgattctttaaccgtctgcatgcaaattaatgcaataagcagcaagaattaataacatttaattaatttccagcttgctgatagagatgcatatgtatgttgtggatcggacgacggacagacaccatgtatgcaagctccatgctgttgagatgttggaggagatcatgatctgcctcctcctgctgctgctgctgcttcagctccagctgaactgactgcatcaacaacagattcggattattcgacatttatctggtctggtgtgggtggactactgatgatgattattgacccacccaccctcaaggtttcttggaagactttgttgtcagccaggtacttgaccatccatgtaattgcgctcgctgtcgtcacctgccctgttatcgttgttaatttataataatacgtaagaagaagaagaacgtgctgcatgtaattaaaagcaagcaagcaagcaagaaattatatattttttttgtaggttgtcgtaccggcaatgatgagcgtcaagatgttatcgagaatctggtcgtcagtgaggaagaggtcgtcgtcgtcgttatgatgagctgacgacgatggtaaaaggtgttgttgctgctggctccgcctcctcctcctactcctgagaagaagaaggctctgcagaaagtcgtcgccgtgctgctgctcctcctcctcctcctccatgtccatgatctgtctctgtcttgatcctatctcttgcctgagcacgtccatgatccttttcctggcccngaggcccgcgtggaacctggtccccggcagcctgagcgggaacgccagcatggcccgcgtcacggccagcacgtcgctctgcagccgcctcctcgcatcgggccgcagcgtcctcccgatgagcatgtcgcagatggcctcgaatgttaggtccagcgcggcgtcgagcaccaccacggccccagtgctgctgctccagtcgcgcttcatgagcctccgcgtgaggccgtcgaaggtggcggccagggacgccgtggcctgcgcgttgaagaggggcgccacggcgcgccgcagggcgcggtgggtggcgtgggaggcgcacagcaggctgtgctcgccgaggagctccgccacggtgcgcacgtagcgcttcgagaagccggctggctcggcgcccaggagcgacctggcggcgtcggccgacgagacgaacacgtgggtggcgcccaagagcgaggtgcggaagcaggggccgggaccgtacctgcggtggcgagcctccacgaagtggtagaagcccctgccgctgctgttggcggacaggaaggccagcgtctccacgacggaccaccaccagcggctaccccttctcggtggtggtggtggtggtggtgctgctgctgctgctgcatgatcattcttcaccctcctcctcccttggaatttgatcaatcgtctgatgatcacgacgcagtagatgatgaccgctgctaagaaaaagaaaaagaagatgctgctgctgctgctgtggctttggcaggctggtggtgcttggagttggcggtgcatgtcgtccatggctaggaaggaggagggataggagtcataggacagctcctgcccatgcatcatgctctagtgtaaaagagaagaagatgagcccgtcgtcggtcacattcgcaatcactcactccacttgccatcgcaatgcaacaggagcagccaccagctccggccggcctcccggcagtacaagtagaatagatgccatcaggatacacgacgactaggacactgctgctggtggaggatccactgtccaccccccacccagctacctctggaatgtcctgtccatattcatagcatattagtgtagcgggcgtactgtgaaggcaggcgcggcgtagtggagaagactgcgcagctgcctttcctgcgatgtgttttgcacgtacacatgtactagctggtgcacattggacgtaattggttggtgggttcagccgcgccgggctcacgccggtctggccagccagcgaaactctcgcctccccttccccgctgatgcaggtgacccggtggaaaagcgtctctcgaaccaatactcgtgcaggtcagcctccgcaatatcactgcacactattttcgtcggttaaaccctgatcgtcgaaaatagtgtcttacttttggcagctgtgagtggccgtcgaaaacaatgttactttcgacggctaagtttcacggccaccaaaaaaacttagggcttgttcggttattgatattatatatgtattggaatgtattgggtgcaatttaagatgaattttgacttgttatagatttaaatcggctcaatcccacccaatatatatggattatcaccaaaacgaacaagcacttatgggattttaacatgtagccgaaacatttcttctctctttcctcgctttccttctccctccatcctctgatgtcgtctgatgtcgtgactgctgctcccgccgcatcccctggctcgccccgcccacgcgctgccggctcgtggttccacctcccgatcctgactcgtcgtgcagccgctcgctccggctcaccgtattgtcaaccgcacgcgatgttaaacttttttttttgcatattttattgtttattttcggcaaccgttttttgtttgccatcaaaaatagtgatcagcagtttatttaatgtttgatagtgattagcagtttatttaatgtttgattgtactattttttattatttatgattagttatttgtttatgcatttaaaacacaattaattacacatttagccaacgatacgttcaattattgtttgattccattaactaatataatgttgatatgccttattacttagtttgatttgattaat

SEQ ID NO: 5135 - DNA, 1880 bp, Zea mays
ccccgggctgagcatttcagtttggaactgaactgggaatgacgaggccgaggacaaaagcaaattgacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgccgcctcagcccgtgagggaggactacgtccagaacgccgtcaagtttctctcccaccccaaggtcaggggctcccccgtcgtctacaggcgatccttcctcgagaagaagggccttagcaccgaggagatcgacgaggccttccgaagggttcctgatcctcaacccagcactacggctaccacttctccgcagcagcaggtcaacagccagaatcaatccgtcggggtgcaagcttatgcgccagcacaacctgtgcacccagcaaacgctggccctgtcgtccttccaacgcagcccaggtttagctggtaccaagcattcctggctgcagggctcttgcttggttttggtgctagcgctgctgtctttatcaagaaactgttccttcctaggctcaagtcttggatccgcaatgttgtagcagaaggtaatggcactgaaggcaaccagcttaagcctaggattgatgatgaaacggccgatgctgtaaaggcttctgcttcggctgtttctgctattgccaaaacaaaccaacaactgcttgcttcaaaggatgaagaaaagaagatactagtgacgttgacacaagctctagattcccaagccaaggagttaaaatccttgaccgattcaatcggtcataccagggaacccataaatattaccagggatgataggttttctcagtaccgcccactggaagaccatgcccctactgttataaggaatggggcaattaacagttcatggagagcctctcagcaaactaacatgtatggtgtgtcaaatggcgactttggttccgtgaggtcttcatttgcgccagcacctgctgaacctacagctggatcattttcaagatcctatggcgagcagccgatgtccactgcacaacgaagcgataggtcttctggcagtaagccatgggagatgcagcagtattcacaacagaggcctggttatggatccaactcccagttgagtgaggaaggatcatactctgatgcccaggacagctatgctccttcctatcaccagaatggaaaggcccctgattttcaagcggatgaacctaggcctttgacttacaacactggagttgaggaaagaccgccaccgcagcgccgctgggtgccccctcagcctccaggtgttgcgatgccagaagcagcagctgccatacgtcaaccaaaggcccttccaaagcagccctccagcgatgcctctgaggcagctggtgagatgcaggtgaatggttcaagtgcatcggatgctgtgactgaggttcctgttaatggtgctactgcaagtgatgctggacgcagtgagatccaagaacaatcagtggcggcctaagtgaaaccaagaccagctaagaactgggaagcaatctaagagagattcaggatctctagtacatctgggcggtttgtcatacatctctgaataacgtctgtatcagaacagcggggcaaccacgccgatgggtacccgtaataatgcaataagtagcagatagtttctgcatttagattaatgctacttgtacacaggagaacatatcaataatatttctatggctgttcgattgagggtgcttaaaaaaaaaaaaaaaaaaatgacaaaaaaaccggggcccccccccggtaccccaaaa

SEQ ID NO: 5136 - DNA, 2238 bp, Zea mays
agctgcgaattcggcacgaggagccgatgagatgaggtgattgaggtccgtccaggacaaaaaagcgaaacgactccttcagttccgtcccgttcgtgacgacccccggtcccgggagggggagggggagggggagggagaggcgaggtcatggcctccggcaccggctccggccagccgcaacccgcagcagctgatgctgacccgggagccggcgacaacaagctcgtcttcgagacgccgctgcagccgcagcccgtgagggaggactacgtcgagaacgccgtcaagttcctctcccacccaaaggtcaggggctcccccgtcgtctacagacgatccttcctcgagaagaagggcctcaccacacaggagatcgacgaggccctacgaagagtccctgatcctgaacccatcactacggctaccgcttctccacagcagcaggttggcagccagaatcaatcagctggggcgcaaacttatgcgccagcgcgatctatgcacccagcaaccgctggccctgtcgtccgaccccggttcagctggtaccaagcattcctcgctgcagggctcttgcttggttttggtgctagcacggctgtctttatcaagaaactgttccttcctaggctcaagtcttggatccgcaacgtcgtagcacaaggtgatggcgctgaaggcaaccaacttaagcacaggattgatgaggaaacggctgaggctgtaaaggcttctgcttcagctgtttctgctattgccaaaacaaaccagcagctgcttgcttcaaaggatgaagaaaagaagatactcgtgacattaacacaagctctagattcccaagccaaggagttaaaatccttgaccgagtcaatcaatcgtaccagggaacccataaacattaccagagacgataggttttctcagcaccgcccactggaagaccatgtccctcctgttacgaggaatggggcaattaacagttcatggagatcttctcagcaaactaacatgtatggtgtgtcacatggtgactttggttccgcaaggtctgcttcattcgtgccagcacctgctgaacctacagctggatcattttcaagatcttatgccgagcagacgtccaccgctgcacaacgagcggataggtcctctggcggtaagccatgggagatgcagcagtattcgcagcagaggcctggttatggatccaactcccagttgaatgatgatggatcatactctgatgcccaggacagctatgctccttcctattaccagaatggaaaggcccctgattttcaatcagatgaacctaggtctttgacctacaacactgggattgaggagagaccgccgccgcctcagcgccgctgggtgccccctcagcctccaggtgttgtgatgccagaagcagctgctgctatacgtcaaccaaaggtccctccaaagcagccctccagcgatgcctctcgggcagctggagagatgcaggtgaatggtgcttcaagtgcatcaccggatgctgtgactgaggttcctgttaatagtgctaccacaagtgatgctggacacagcgagatcgaagaacaaccagtggccgtctaagtgaaaaaccgagaccagccaagaactgggaagcaatctaagagagatttggggtttctggtacatactggggtttgtcatacatttctgaataacatgtgtcagaacagcatgacgacaacatgtcaataagtagcagatagtttctgtatttagagtaatgctacttgtacacaggagaatgtcaagcattatctatggctgttcgatcgagggtgcttaaaggttgtgaattgttgtcttttattttgtttgcattttgctgttcgcttcattccataaaggtgttgtttgtctgggtttgccaaggatgagaatcaatggcggtgtacacaggttgtttctgtcagttcatgctctccccagtttttttttaacttattgttgtctcaggttaaagggtgggataccatgattgtagctctggctaatcaactacaccagcacagtattttgaagcaaaggaacaataccctgatgaaggatgatgcgtattagcataatcagttacagagtaccactagatagagcagaatgatacatataagcataatcagttacagagtaccactagatagagcagtgatgcttgcaggtctaccatttacacaatgcatgaggtgagaaact

SEQ ID NO: 5137 - DNA, 2027 bp, Zea mays
  misc_feature (955)..(955): n is a, c, g, or t
  misc_feature (1233)..(1233): n is a, c, g, or t
caatttcagtttggaactgaactgggaatgacgaggccgaggacaaaagcaaattgacaccttctccgttcccgacgactcccgtgagcgtggagcggcgactaggcgaggccatggcctccggcatcggctccggccagcagcaacccccagttagattggatgccctagcagcgccggcggcagatgctgacccgggagccgtcggcgacaagctcgtcttcgaagcgccgcctcagcccgtgagggaggactacgtccagaacgccgtcaagtttctctcccaccccaaggtcaggggctcccccgtcgtctacaggcgatccttcctcgagaagaagggccttagcaccgaggagatcgacgaggccttccgaagggttcctgatcctcaacccagcactacggctaccacttctccgcagcagcaggtcaacagccagaatcaatccgtcggggtgcaagcttatgcgccagcacaacctgtgcacccagcaaacgctggccctgtcgtccttccaacgcagcccaggtttagctggtaccaagcattcctggctgcagggctcttgcttggttttggtgctagcgctgctgtctttatcaagaaactgttccttcctaggctcaagtcttggatccgcaatgttgtagcagaaggtaatggcactgaaggcaaccagcttaagcctaggattgatgatgaaacggccgatgctgtaaaggcttctgcttcggctgtttctgctattgccaaaacaaaccaacaactgcttgcttcaaaggatgaagaaaagaagatactagtgacgttgacacaagctctagattccccagccaaggagttaaaatccttgaccccgttcaatcggtcataccagggaacccataaatattaccagggatgataggttttctcagtaccgcccactggaagaccatgcccctactgttnataaggaatggggcaattaacagttcatggagagcctctcaggtatgcgcttataatatccacccatattcctgttccacaagcatgcacgtgctttgaattaccgtcctatttctgaccactttcccttctgtagcaaactaacatgtatggtgtgtcaaatggcgactttggttccgggtcgtaccttttgtgaatatctttttccttgtttgccatacaagtctgctggtttctttttgctttacctatgttggactctgtttagcagcgaggtncttcatttgcgccagcacctgctgaacctacagctggatcattttcaagatcctatggcgagccgatgtccactgcacaacgaagcgataggtcttctggcagtaagccatgggagatgcagcagtattcacaacagaggcctggttatggatccaactcccagttgagtgaggaaggatcatactctgatgcccaggacagctatgctccttcctatcaccagaatggaaaggcccctgattttcaagcggatgaacctaggcctttgacttacaacactggagttgaggaaagaccgccaccgcagcgccgctgggtgccccctcagcctccaggtgttgcgatgccagaagcagcagctgccatacgtcaaccaaaggcccttccaaagcagccctccagcgatgcctctgaggcagctggtgagatgcaggtgaatggttcaagtgcatcggatgctgtgactgaggttcctgttaatggtgctactgcaagtgatgctggacgcagtgagatccaagaacaatcagtggcggcctaagtgaaaccaagaccagctaagaactgggaagcaatctaagagagattcaggatctctagtacatctgggcggtttgtcatacatccccccacacccccgtatcagaacagcggggcaaccacaccgatgggtacccgtaataatgcaataagtagcagatagtttctgcatttagattaatgctacttgtacacaggagaacatatcaataaatttctatggctgttcgattgaaaaccccaaacaaacccc

SEQ ID NO: 5138 - DNA, 2403 bp, Zea mays
cattttccattttttcctgtatttttcgcccatctttattaaggctgggatattcctaaattcttaataaaccgaataaaatttataaaatataaaatcaagttttattagcttcgaataatttattctacataatgaacatataaaatattatgcttaaatacaaattactcgttaaaaatattaaatctagggtttattatgttaacttgataaagttagtttcgatggtccagttcatttgaaagtagagagacatttttcactacagttcgacatcgagtcaatagtggatgaaatagcgtgaatggaaaaaaaaaatgtttggaccggtggcactatgatgagtccacttttctaatgattttatatggtacctttaatcatttaactttttaattagtttataaataattataaacttttataatggcagaggtaaaaaagactggttccagaatcctcggccctcagactaatcagactaaacaagacctcggtcctcggcttgacctgttgctgttggccatacctcctctctcgcctccggtcagatcagattagcctccatggccgccgatcgccgcttcaagatctttgcagccgccgatggcttcggccagccactcaaggacgccgtcgtcgcttatctccgcgcccaccccgccgtcgccgaggtcgttgacctcggcgtcgacaagtactacgccgccgccgcagccgtcgcccgacacgtctcctctcccgactcggagcccgacgctcccgaggtccgcggcgtggtcgtctgcggcaccggcgccggcgtctgcatcttcgccaacaagtacccgcgcgtctacgccacccactgcgcttcccccgccgacgccgtcaacacacgctccatcaacgcctgcaacgtcctcgctctctccggaatcgccacgcagcccgacgccgcggccgccatagccgattcctggctcgccacgcccttccgcgccccttgccccgcctccggcgacgcgccctggccggaggacatccaggggttcttcgacaccgcgccagacgagatggccgccatcccggaggcggagggtgccccggactcggtctgcgccatctgctgtctcaggaacgggatggagttcgagccggtggggattatgcctggcggcgagatgcggatcgtgcgggagagccccacctcggcgtacgtccgcttcaaggctggcagtgtggagccagcgcaccaccacacctttggccacgacctggtggtcatcaagggcaagaagaaggtttggaacctcaccaagaaggaaagctacgacctggtggacggagattttctcttcacacctgccggggatgtgcacagggtcaagtactttgaggacacagagttcttcatccgttgggatggccactgggacatctttctcgacgaggatctcgacactgcacgcagtgccattgacgcggagcttgcagctgccagcaagtgagatcatgccatctatgtgcagtgatggcaacgcttctgaaggtgctatgctcacatatcctcatttgggattgtgattgatggtcttgcttccataatgtttgttattcgaactctgtgtatgatcctcatcgtcctgtcttgttattttgtggaattatggttattgacaacgatgatggtacaatttggttactgaatcaagttgcatatacatggaggttgttggccttgagcccgggaactaatttcatgtttatggtacctccattttacacctgtttagttgagttacccttgatacataaactagctgcgttagctctgctgttttgtgactttcaacatccaagatgtgttcaataccgatgattcagttcagtccataagaaagggataggatgattggtggaaaagaatctcttgtagcacgaccttatcttgtgtccctcgtcttaaattattattcgactggtatgcttcaccatactttcagcatagggcttacttctctcgtgcaaggaattataatatcaaattgactttgtgattgctgaattaaattgcatatgcaaggtaactgaaatgtgtttttatacctaattcagtggctatgttgacaactatgttttatgtcgtagttgttgagtcattgatgcgctaacttatttaggccctgtttctccatagctaatagttgctagctaactcacaactaacaatttattcattagataactcacaactaacaatttgttagttgactaactatcggttccaggggttccaaacgtggcttagccacaaatgttttctaagttttgacaccctaatttaactccaatcaatatgaattagggctagtttggaaactcaaatcaccttcggggtcgaggggatgaaaaggaaat

SEQ ID NO: 5139 - DNA, 8137 bp, Zea mays
gcctgatatatcatcattcatcaacggagtagaaaaatgttttaagagaatacatatgtcaacataaatcctaagtgatctttgattgcatagaagtgcacccgttctgtacagacccccagtacagtaagacaaggttaggaagaagtgagaagtttgtgtaccggttggagaaatggttaccggcaaaagattgacttggattctggctttggtagccacctgcgtttataaaaacacgggaggcaccggcggaggcagccccaagaggcatgctgaagcttgacagtcgcgcagcgcaggcaagccgatgccttatcgtggaccttgcgtgggttatggggtaatccctccgttcctcgtcttgaggtcacgaagttttatcctaaattaatattttaaaactttgaccattgaaatttctacatatagctgacctgcttcagtagcgttagaaactcattgctagctttctttgaatgcatcattactttgtggccattaaaatcaatattttgttgcttcaatgcatgtatatatccattgagctgtctacaaacagtaacattataatataacatataggctactgatgatgctatatctatagactgaactataagagcaactccaacagcctctttatttttgttagttaaatttagagtttcagccctctataaaaatagaaaactcaataattcgatggggtaatccaacaaactagctaaaaactgaatagctacttggcaggcccacgagacagaaggcccacgggtacgattcgcgcgcgggaatcactggtattgcgaggcggaggagctcgccaaaggttgcgaggcgaggggacagaatagcgagtgggattgcgagggaggagtttaccgagactgttggaacggacttctaccgattttttttttcattttttaccgatggaaaatgagttagagaggctgttggagctgctcttatactactactatagacaattttccgttcggacaattttatcacttctacattgttgtatcatcatatattaatgttttataactagagcaacactcttttaattgtgtaaaattatcgtcacgcgagcaaattactagtcaagcatgaaaaaagaacatgcatgtcattttcataatatgctcctcttattcttatcccatccaggcctctcgctgccatgcagccttcttccggatgatatttatttagatgacccgagaatcataagttcatcataactgtccatatgaccgggtgtcatgatgttgcattaacttctaaattcaaatccccaataccttcgccatgcatacatcccaacatcgttgatgctgtacaaccgtaggctaatcttgtggagaatctagtagtgtttgctaagatcaccagtctccacaactaaatagatgactcctagctcactgtacacaccacactctgcgtcccctttccttcgagctgattgttaagctcatctcttgcttccagcgataatcatccaagtgccccccatcattggtacctgcattggaacaagattcgttaaccatgcgatgtaccatcaaactgtgcctattcagcggataataatccagcattaaacaacaacctctgtggactgtagtttcttcttcttctgtatgcacacaatctgatgaaaatgataatcttacttgtcaggtgggctacactgtcacaacttccatgagggcgcaatggtggcaaggtgagtgactgagtgcatgtggtctttgaagagaggtaacctgcataattttagaattcgggtggttttgaagctcccggccctttttcattccttagatgcgtggcttagcttggtagctcaactagaaaacaattcttcttgtgcatatacacgcctgctgagtactgccccgctgctgtctcaaacagtaagccacatttgcccccctgcaggtaagcacctaccgtttattcgccgcagacgtattggatgtgtagcctctgataccagtcgtggtgcatggaaacgcggcctcacgggttcagcagttaacgcaggtctgcattctgacagcaggggggaggaggagagcaaatggccagggcccaggggaagtcgtccgagaactccgcagggaggcgagggacccggatggatgggagcgggagctgttttagtagcgctaatcttgtgtgcccagaagagtcaataatgggatatgcttttagttgcagacttgcagatataatttaacctattggaggattacgaatccagagacgacgaaaaggtgacggtcggccctttttcaacctggtatcgtcttccgcgcaccgatggcaccaccccttttgacttccccggcactgaatgttctgtaatcattcagcgatgctgcgataccctctactactagtgggttagtgatgaagtactggtggaaggcgatcctacctctttccttcgcctctggtaccgcgtgtccccgtgtgggacgcagtgcgtttttcgcgattaacatcgttcacattacattccactcactcccaaagtcccaccagattgcgccggcccgattgatggcgccacccaagtcagtcagttctgccggcgtccagcagaagaccgccatcgtcccaccacaaaagtcgactcacccacccaccacagtgcagggcacaggctgtcagctctgccaacggacggagagccggagacggctgtcgtggaccagggacggaggtggagaggccagggccacaggccagtagggcgggtcacctagtagctgctagtagtacagtaccaaacaggagcaccagtacttgcaagttctgaaggatggttcggtgcaagccgctgctgcgtcgtcctgttcctcgtcgcctacctgctgaggtgcagtagtgtagtgcagtgtccacgtgacctcaattcggcgttctgctgaagtgaagtgagtcacccgcccctaatgtttgaagtaccgacgagcacatggagacgagagaaacgaggaaatgtccaaggaggagggagaacttcacctgtcctgcttggtatggtatcctccttcccctggctctgtagagtactcaggcaaattgcacggcagagtccacggacgggaccaaacaaccacccgtgatccactgcgtcgccagcgctcagcagcggcacacacacgcgtggataggagtccgctccacccacaggcacacacggggacatgtccgtcacggcggcaaccggagaccagaccacgggccagagcgccggaacagagaagacaagtcgtcaggtcaacatgtccccggccagccagccagccagtcaacacccaacacatgctttaccacgcacacgtttgaccacggactctcggctggccgtctccagtcccccactccgcagctccgttcacacctcgccgcgggaacgggagtcctggtggtgttttttattctgctaagtggcccggcccggtcgtctttgctgcctcttgcgaagcgagtgcgccgtaacttccaagaaccggggggtgcgcggggggccggagcccggaggtagcaagcaacgagaggaaggagacgacgacgcggcctcggctcggaggagacgacggcgaggaagcgtccaggggaccccgtacgaaaggtgagctcttggctgccttctctctctctctctgccttctcaaccgaggttcttctcacggttagcttgattcagtcggtggattgagcttcgacatgggactttccagactgcagtgtctctctgttgtcccccgttttcccgttcttcttaaggcgaacttcagaatttgtcttaaccgaatgtacaagtcggatgatccgggtgctcgtcgtaatgccagctactagctgcctcctccatcgtttttttttggggggggggggggaagaatcggagatcccgctccgacttctgcagctgctctgtgctacctaccactaccagccaccatggctgttggctgacaagccttagttctagttcttctgtgaaggaggcccctttcgcggccggtatctgtaatatctgtaacagtaccgaaaccgtgacgacgcttctctggaagcgttagtttctggtggattgatttgtgggaggctgtcgaagcggaggatacttggcggcctcttgatttatgcacttgtctttcttggccagcagctgatctcgactgctcggtggatcgtgaacggacatcgaatttttcccatgcttaggtccagtccagactgctagcctgctctgctggcgagatatctgattgttgtttccttgtatgctttcgctttcttgcagacttgcagctgcgggtgtcttctgctatcacgatctgaagtgctgaacttggttggaagatactcttcttaagcctggaactgtcgtttccgatggtctggcactttctttcctgatggcaagcacagaaggtttccgcctcgtgagatgcccaaagtgtctgaacattctcccagaaccacctaacgtcacagtctacaagtgcggtggatgcggcaccacccttcgaggtgagaaaaaatcctaaaccctaaacattctcataatttgctgagaaaaaaaatccatcctctgtttccctcataatttctcaagttcccctcctttacgcttttgcagctaaaacccgtgccagcggtggccaacaagtggccgcgaccgcgaaacaaggtcgccaggactccgacagttattcggtcgctaccgccgtgagcagtggggtgcctcgtcagaacagagaccagggctccattggtgccgtcacggagagttccttcgacgctgatgtcgcgagcgccgagcatggcagcaacggagcaaggagcggtgaaaatggtggtggtatgctggctggccagaatgtccatttcgaaggccaggataataataccagttcaaggatggaaggtcctgctggccagacacgcctgaacgcaaatgccacgtatttagactctggtggaacagaaaaccacaccgtgcaacaaactgcagagaaatgccgagtgagtggacatgtcgatgatacagaatgccacttgaacacctctgaggacgaaatgtttccttccgagacaagcaaagcagccgtcggtatgcaggatcctgggcagaagaaggaagcgggcggaaccgagcatgcagcgaacaagaagagccatcttgtgagggcactgtctcggtcgtgtgatcttggatcatcgatgaacttgaccgatttccactctgctcgggcttcgctccagtccaaaagcttcagggccagcgcgcccctccagtcgaagatcatgagcacggtggatgagctgaagggcgacctctctgagatgttcagcaaacctgcggactgcaagccaaggccacacccacaccctccacgcccttccaaacgagatggcggccgcacggctcgtgcggccgtcacgtccagcgcaccactcgcggcgtatcgtcctcccgccgagcattccggctatgtgtctcgctctcgcctcagcaggtctgcccaggttcttcctcctcctcgtcgtgggctgccgtcactgaggtatcgccggcacagggtttatccgtgccatcacagtgtgcagatggaagtgagatcttcttgccgtcacgagtgctgctaccacagctgccagctgcccgcctgcaggtcctgcgagcaagaaccttcagcgatgcacagggcaccggtcgagcaggttaagcgtcgtcctccgcccagaaaccactgcctgcccgtcctaagcggcgctccgttcgtcatctgctccagctgcgtcagcctggtccagctgcccgccgacttcgccgtgccgagcagaggagcacgccggctgcggtgcggcgcctgctccgagctcctttcctactcgtacagggaccccgccgggaggaagaagccgcggtcgccattcgagggcgatgagtgcagcactgacgggtacgacgagatccgccaccaggctgccggcgccggcttcgagcgggcaggtcccgccgtgtcctactccgaagagtacgggctctcgttcggcatcggccactcgaccagcagcagcaccgaggacgggcagccgctgtacgtgtcgaggaactcttccttcaacaccgccgacgacggaaggatgggcagagacggcaagcttcaccggctgatgggctactcgtcggcgagcgagctgctgcggcactcgcccgacctattcgagagcttcgacaggcgcgcgcccagcgcgagagcgcacgtcgacggcaagggcaaaggcgtctgcgtggcaggaaacgacgcggcgggcgcgcgagacggtgcggcgaagaggtccaaggcgaggagcggtggcttgccgctccatgggatcctgaagaaagggatccatggcctggaatcgctcaagctcaggtcgtagctgatgatcctcgtttggcggggctctggcgatcgggtttaggagaaggtagcagtagcatacacgacatgtctttagaggcagtgtgtagtgatttgattattggcggcctgatgtgtgcttactgcttagtagctagcttgtgtgtgtgagttgtttgcaattcatctgtgtgtgtggagttggttggttggttcgcaaacttgtgctcttcggttcgatgtgtgtaagtgtaagatttgaacgccgggcatgctcgatgctgtggatgtttatagaatagaaatatgatgatgatgatgtggatctaaaccaagcaacctgagtaacttggtctaaccacaaccaaatctgaaccgattccgccacagggagcaagcggtgagtttttgttacccgcccgccaattactcaagtttgctctacaatcatcaggtaaccgaaatctgaaatttagttttcctcatgggccctaatctctgcaggggcatgcaaacaaatatctgtagcaccagaatccaaacggacagggactaaaattaatccctccgtgcaaacaccccgaggaccaactcgggcaggattgcggcaatgaagtcgttatgtaacatggaaaaaaaaccttatagacagttgaagtttcagaatcggataacccaagtgaattgaccaagcaataatcaaacttcctgtagtttttgaataacaagacctcttgtgcaagttaactgcatgtctcttgtgcgcgggtagcacctgctgctctgtgtatcctccgtgaatttgacttgtggtatcctccgtggattcatcaaacgcattaagttgaaatgtccttagagccgtcgatgcgcgtttttttttttttttttgaaccaaaactaagtttatggataaaaatacattttaagatttttaaaacctatatgacaccacctctcatattacacagtacgacattttatccaacaaagctgctacagctgcggctcgttatctttacaccgcgttcttgttagctgtttccgccgcggcaccagtagtcacggcaccaccacggccgctctggctctcgcttccgccgccaccgtcgccgtcgcttcgctgcttgagatcacggaagacccgcgagctctcctcgaagatgtgcgcgcggcggtcgtagtcggtgggccggcgcccctcgtcctcccccatgatggccgcctcctccagcacctccagctcttcgggcgccagcccggcctcctccgcctgatcgaccgccgacgccggcccgtccttgcgcggctcgacgggctccgtcgtcccgcctccgcgcggcgtgtttgcgcgcaagcgccgcgcgggagccgcgcgccagacgcagacgcggctcgtcgtggtggcccgggcctggcacgccgtggccgcgcgcgcgcggggtacctccggctgtggccgcgcgggggccaagcacgagcggcaaacgggttgcatgtctcgggagtcgggacagggccagcgggcgccgggggatcggtgaggtgatgcggcaggttcgtcgggaacggtgaacacacgatttgggttcggactttgggtgcagagccggtgagcggcatggcggctggcgtgccgccgcggcaaatctgcagccgggggatcactagttctaagcggcgcc

SEQ ID NO: 5140 - DNA, 1179 bp, Zea mays
acgacgcgtccgcgcacctggcaggctcggccccccggggccggccggccgccgatgccgagcaacgcgaggagttgagccgatggaggtggcgtcgggggacgaggatctggaatcgctgctccagaacttccatcgcgtgtcccaggggtacaaagatgcacttatgcaggtccaggttttaagagtaaattgcagcactgagttcaaaaggcgggaagctcttgaatcacatattacagatcttaagaaagataatgagcggttaagaaggcaatacacagaaactttattcaaggtcaccaaccaggtgaaattccacacagaagctcaaagcctgaaggaagagctggacaaggcaaatagtagattgttatccatggaagaggaacacaagagggaaactgagcaacttaagcacagcagtgaaatgaacatcaatgccctggagaacaagctcagccacgcccttgtacagcaagcaagagatgaagctgcaatgaagcaactgaagttggagctgagtgcccataaatctcacatcgacatgttaggtagcaggttggagcaggttactgatggcgtgcattcgcagtataaaaatgagatccaggatttgagggatgtggtttctgttgaacaagaggagaaaaaggacattcacaggaagcttcagaatgtggaaaacgagttgaggatcacgaggatgaagcaggcggagcagcaaagggattctgtctcggtccagcacgtggagacgctgaagcagaaggtcatgaggctccggaaggagaacgagtccctgaagaggaggctggcgagctctgaagtctgaactggagtgcacatgaaaactgcaactgctttccttcacgccgtagttttatctcatactgtaggatgtagaaaaatccactgctccaaaaacacatatcacttccagatgctttaaaaccagcaatgataggtatgttttcactgaaagttattatcaccaatcgacacactcataaccttttcatatgaaattatataaagataaaccctatgtccaagatatagagttcaaagaactttttagttgacaacattttcatataaaaaaaaaaagatgttcgaatattcaatataaagatcacatgcctattaaactatcttgggtaaaaaaaaaaaaaaaaa

SEQ ID NO: 5141 - DNA, 1190 bp, Zea mays
acaccactgtcgtctgtcgacaactcgacatggtgagttggcgacgctgaaaaccgaagcaccgaacacacgcgcacaggggacactcgcgcacactgcagtctgcagctagcccgtatcgccaatcgccatgctcgcctacgtcctccacgccccagccgccgccgtcgccgtcgccgcggcgccctgtgcctcctatctccgctcactcccgccggcgaagaccccgttcctcccctcgctcccgcgcccggtctcgccgaggcgcgccgccgccgctttcgccttctcccccgccgccgcggcggcccccatcgcggcgtcgctgctccagggccccgtgctggtctgggccggccggctctgcatctactacgcgctcctccacgtcgggctcgccggctctccgcgcaatcccttcctgtcccacgagatcggcggcgaggacggcgccggggacagcgacctagggttctccaaatgggccgagaagctccgtggcggtgcctcaggtgaaaaagatgctcagcataagggaaaactaactagcaaatggaagccgacgaccaaaggcacactgaaaagaacttacagagtacgatcaacggatgaaggaaggcgggtcctcaaggagatcgcttcagttctgtcccaagatgaccattttgtggatgcctcgtctcacaagggttgccaagttaggagggaaagtgctcatggcgaaagtgtttgctgctacaacgtgagagcgttgttcgatgagcttccaactcctcacctgcttctggagattacacctttccctgctggacaacttaccgacaacgactaccgaaaggcggagaggcttgagatggtgctgaggctcagcgcttctatttaaaaaactggggactggtttttcaatttcccctagtactttctttgcccaagttgtaaattgtcttcctgtgggcctgtaaattgacgcagttggctaagaactacttgcaaaacacaagttctggttgattatttgagcttaagaacctgatatgatatacacttgggcgtttccctgaactgtatcaaatgcttctcactgtttccttttccttgagtaaggaaaatagggatgggcatggattgatccattgatctacttcgcttaagtaacagatttttccatttgttaaaaaaaaaaaaaaaaa

SEQ ID NO: 5142 - DNA, 1029 bp, Zea mays
  misc_feature (995)..(995): n is a, c, g, or t
  misc_feature (1007)..(1008): n is a, c, g, or t
  misc_feature (1012)..(1012): n is a, c, g, or t
ccgatcctaagggacgggggaaacccggcagatagcgcgatcacgcgcgtcacccgaaagggaatcgggttaagatttcccgagccgggacgtggcggcagacggcgacgttaggaagtccggcgaagaccccgttcctcccctcgctcccgcgcccggtctcgccgaggcgcgccgccgccgctttcgccttctcccccgccgccgcggcggcccccatcgcggcgtcgctgctccagggccccgggctcctcgaggccggccggctctgcctctactacgcgctcctccacgtcgggctcgccggctccccgcgcaaccccttcctctctcacgagatcggcggcgaggacggcgccggggatagcgacctagggttctccaagtgggccgagaagctccgtggcggtgcctcaggtgaaaaagatgctcagcataagagaaagctaactagcaaatggaagcccacgaccaaaggcacactgaagagaacctaccgagtacgatcaacggatgaaggaaggcggatcctgaaggagattgcttcagttctgtcccaagatgatcattttgtggatgcttcgtctcacaagggttgccaaattaggagggaaagtgctcatggcgaaagtgtttgctgctacaacgtgagagcgttgttcgatgagcttccaactcctcacctgcttctggagataacaccgtttcctgctggacaacttacggacaacgactaccgtaaggcagagaggcttgagatggtcctgaggctcagcacttctatttaaaaaagctggggactgatttttcaatttcccctaatacttaatttgcccaagttgtaaattgtcgtcctatgggcctgtaaattgacgcagttggcaaagaatcacttgaaaacacaagttctggttgcatggattgatccattgagatactctagttcattaattttccccccgccccccgggaactaactccaattaactgaaaanaaaaaaaaatannaaanaaaaaaaaaaagcggcc

SEQ ID NO: 5143 - DNA, 1104 bp, Zea mays
  misc_feature (1078)..(1078): n is a, c, g, or t
gttccgtgtgcacaccacccccccgtccgcgggcccgggggcgacgggctgaaaaccgaagcaccgaacacacgcgcaccgtagcttgtccgtatcgcccatcgccatgctcgcctacctcctcaacggcccagccgccgccatcgccgcggcgcccagcgccttcctcctccgctccctcccgccggcgaagaccccgttcctatcctctctcccgcgcccggtctcgccgaggcgcgctgccgcagccgcgttcgccttcaaccccgctgccgcagcggcccccatcgtggcgtcgctgctcgagggccccgtgctggtctgggccggccggctctgcctctactacgcgcttctccacgtcgggctcgccggctccccgcgcaaccccttcctctctcacgagatcggcggcgaggacggcgccggggatagcgacctagggttctccaagtgggccgagaagctccgtggcggtgcctcaggtgaaaaagatgctcagcataagagaaagctaactagcaaatggaagcccacgaccaaaggcacactgaagagaacctaccgagtacgttcaacggatgaaggaaggcggatcctgaaggagattgcttcagttctgtcccaagatgatcattttgtggatgcttcgtctcacaagggttgccaaattaggagggaaagtgctcatggcgaaagtgtttgctgctacaacgtgagagcgttgttcgatgagcttccaactcctcacctgcttctggagataacaccgtttcctgctggacaacttacggacaacgactaccgtaaggcagagaggcttgagatggtcctgaggctcagcacttctatttaaaaaacctggggactgatttttcaatttcccctaagggctagtttgcgtactctagtattgacctcaatccacttcaacacatgtggattgagtccaatactagagtatccaaacaaagcctaatacttaatttgcccaagttgtaaattgtcttcctatgggcctgtaaattgacgcagttggcaaagaatcacttgaaaacccaagttctggttgcatggnattgatccattgagatactttagtcc

SEQ ID NO: 5144 - DNA, 3978 bp, Zea mays
  misc_feature (2066)..(2066): n is a, c, g, or t
  misc_feature (2326)..(2326): n is a, c, g, or t
  misc_feature (2616)..(2616): n is a, c, g, or t
  misc_feature (2755)..(2755): n is a, c, g, or t
  misc_feature (3626)..(3626): n is a, c, g, or t
  misc_feature (3660)..(3660): n is a, c, g, or t
agcaccgcggcggccggagtcgcctccccgtgcccgcgttgcccccgccggcctgcaagggttggtggggttgggtggcgcggttcgtcgggaagaggcggcgcttgcaaccacggttgatgccggcgacgagcgatgacgactgcccgcggtcggagcgcgcgcgatgatggccgcgcgggttcccccaaaaacactacacgagatagttcgccttggtcttttcctttgagatgttcttttttcgaaaaaattgaagtattctttattaaaaaaaggcttttttatgtgtgtttaatccctcttgtcttctgtttgtgcttagtcgttctattagtgtggtttgattttgtatcacgctcgtcattgacaaagtggttccgttccggactgatactaacgaagaatgtgcttctactctgttaccacgggtggtcttgggtccatacccttcagatgttcttgttaacggttctgctttttctgtccaacacattaaactttatatagtacacttagtatcattacataggtccttttatgatggagggtgaactattagagttattattaagatggtggatgttagctacgctttcatggtggatgtttactatgttttgttatgtaaacaactgcatatctttaaatttgtctatcagtatgaatagtcactgcacatgcttaatatggatagattacaacatctgctgcagtcctctccatatctgaaatttttctgttgcatcgatagccctcatggttatttaaaaaatgtacttgtttaccatgtatgttgctcaatatatgattggtgactcaccttgcttgacaagttggtatgattaagcattttttggatcatgagggtgagatgataaacaacctttggtccacatatttggagtgaggtcgaagcttcggatatagaggtgggctttacggttgccctaatagtgaacaggtccagcacatttactaccatatttttcccttcgtaatctaatcactaaggaggatcgaaattttttcatgcatagctttggttccctctcagactgattattcacttcaactgttttttaaattcgttaagatggaatgaaattgcttatttaaccacctatgctgccaatttgtccattagggtttcagtttatcctgacatttcatatatttgggacttttaagttgcccctatggctttttgctgtgcctgtgggatgaacatgtcccaacatttactccatttattcactttgtcagctaatagccatacatgttttatgtttagctgatcattaagaatgggaaatttacactttccatactgtgttatacatgttatgtttgcctgcttgaacaccccttgttttgaggtatcgtttgggagcaaaataggtgttctggtggcaacagcagtgccggtgagatgagcttttgtcccagtttaccaccaagtgtgtcacttggttgttagtgtcctatgggttctttgtagccttctgttttcctactttgtatcttgaatgtgatttcatggtcgctggttttttatcaagaggagctgggttcaatcgccacttagatcagtgttttttgtgattctctaatgcaacaacagcaaccttgtgcttggctaaagctacaataaggataatattctgaacttatttgccctggtgatgttgtaggtttacagaagagagaaattctggcagatccaattgctgttgccgtcattctgatacaacctgacttgatgactctcaatgaagctgaatgctgaaaggtgttgctgccttgcagaatgaagctttgagttcaatacatggaattcatatttggtggtggtgttttggaacttgtttatctgctaggtgttgctgccttgcagaatgaagccgtccacattgtccttgtttatctgcaagatgcatgcctgctctatttcttgctcttcagtcttgactgatgcctactgcctgagtgcagattcagtgtgatagttagattctgctgatgtgttaacatgttcattgtaaacaaatttcttgttaaacatngtgtgatctcttcaagaccatgtgtctttgacctaatatattgcgaaacattctgcagttgtgtggtgttatcggtttacatgtgaacaaatcaattttcatgattaccctcgttggtagtagctccatgcccatcgacataactccgctaatggtcccggcgtccactacactgcgcagtcgctcacacccttgtaccccaccacctaccagtccacgctagatcaggaataattcaggctgtagttagtactcgcttngaagaatgcaggcttgcagcaaccggcagttaactagaacattagttaggcatggtttggatctaaggaaataaaagttagatgttactcctctatcctgaattgtaaatcgttctttctaaaagagttaaagcatctcgaatttgacgaagtttatacaataaaacaataatatttgtaatattaaataattattatcagagtttgtttgcctggtgcaaccatcacaagcaaattctgaaataaaagaagtcaaatgctttggttaacattgccttcctctatccttnatttcttcggggcagagataaaaatgatggttccagcatatgccagcagtaaaatggcaataaatgatgaaaggtagcattaagatggcaatagaaaccgaataagccagaatacgccaggagtaagatggcaattganactgaataaattaaaggcaaaataaaatctgctacgccacagaagaatatggtttcatcccacaatgttccagaaacagcaaaaccaagtctttctttcatgatttcatttaacataccttacaaaacaacaaacctttgacttgacagtatatgcttcaactgaaccaacaaatcttaaggtacaaacctttcctaaagataacctgagtattacaatctatctattttgtgcaactgggaaaggctgagagcctgtgtcagtgaaatgtgttacattagattagccaatagagacaagatagacacacccctttctgtttattttcctctgttagatcttgaaaatctattagatctgtgaaccttcagcttaattgatggcacctttctagacaatgcttgccagatcatctggactgcatcatccttctgtgatggatactgatactcaaaatgtttatccacctctttgagcctatcccacatctttgtccattgttgcttgcttacaccactgagcagtctcatcaggtaacctttcttaacagcatcagacgaacggacaaagatggagaattttgaataatccaacacatcctcataaggtagctcaatgtcgtcactgatgataacagggacacagtgggtaactatcgcatcaaacagacgattggaagaaggggtgtccccagcaatatttaggcaaaattttgatgagtgcattccttggctagctttgctggccccatggtcctggacacttccaaaggaaaagtaaacatccttttcttcgtggggcatataatatagctcctgtcgaatgctccctccctgggtatggatgatgcaacatattaaattacaaaacnccaattgtcactaaacgacagaatcacttaaatntgtagcaggacagttcttaagtaagaaaataacaactagctagcagcaattaaaataggttcacacaattgtttttggcataatagttcatacatggtaccatttgttagtgttaccatcacaaagggttgaaacagggggaagatgttaattatcaattaatctttggaacacaaaccaagtgtctttctgacaaagatagaagactgagaaagcctgtgtaaacctctatgaagattatcaaattacataaaattcatccagaggttcaagcgtttaaaacaaggtgatagatgcagattaatcaagaaagggcct

SEQ ID NO: 5145 - DNA, 1933 bp, Zea mays
ttttttttttttttttcttttaaaggcaaaataaaatctgctacgccacagaagaatatggtttcatcccacaatgttccagaaacagcaaaaccaagtctttctttcatgattacatttaacataccttacaaaacaacaaacctttgacttgacagtatatgcttcaactgaaccaacaaatcttaaggtacaaacctttcctaaagataacctgagtattacaatctatctattttgtgtaactggggaaggctgagagcctgtgtggctgtgtcagtgaaatgtgttacattagattagccaacagagacaagatagacacaccccgttctgtttattttcctctgttagatcttgaaaatctactagatctgtgaaccttcagcttaattgatggcacctttctagacaatgcttgccagatcatctggactgcatcatccttctgtgatggatactgatactcaaaatgtttatccacctctttgagcctatcccacatctttgtccattgttgcttgcttacaccactgagcagtctcatcaggtaacctttcttaacagcatcagacgaacggacaaagatggagaattttgaataatccaacacatcctcataaggtagctcaatgtcgtcactgatgataacagggacacagtgggtaactatcgcatcaaacagacgattggaagaaggggtgtccccagcaatatttaggcaaaattttgatgagtgcattccttggctagctttgctggccccatggtcctggacacttccaaaggaaaagtaaacatccttttcttctttgagcatataatatagctcctgtcgaatgctccctccctccttcctgtaaattgctccccggaagtataacagggtcggccggtcatcgaacccggccgagtcattggcgtacgtcttagccatgtgcttgtagggcgcaatgacatccttctccaagctagctaccctcggagggtacctcccgaagtctgacagcacgaacacggcggggtgcagcaccgcccgggcgtgcagcaagctgttggggtggtgcgcgacgatgacgtggtcggcgccaccgaacctcctccactccggccgcggccgcgaggtaccgcaccagcttcctcctggagggccctgtccctgctgaccttctcgggcggcacgggccggtagtggcggttgtagctgagggacgcgaagaaggggacgaagacgaggtcggcatcgcgggaatcggagacccgcactgcggagtgacggccgcaggggggcgaggaggaggaagaggatgagaggaggtcgagcgtgagccagtactccacgctgtgctgctggttgagcccccctgggtagcgcggcggcggggaggcggcggtgacgtctggccagactgagtcaggggacggcggcgaccagccgaggaggccgaagtggaactcgggcggcatgtcgtacatgaataccctgacggcgtcgcgggggtcgcatctgacggcgccagcggccggggtggcgccggaggtggagctggatgctgaggcggaggaggagtcgtcggggcggccgttctcgtcgagaaaggagagctccttgccggcggtggcgttggaggaagaagaagcggtcacggccgcggggacggccgtggggaaggcgtggggcgggacggggaggtcggtgtcggcgggccgccagcgcgcaccggcggcggcgaagaggaagatggtggaagcgacgaggacggtggccgcggcgagcgggaggagggtgcggccgcggggcgccatggggcagagcgggtcatgtctggactggaggcggcgacggagggaggagcatggccgggtgaggttgcgtgccgtgccggatggatcgatctaggaaggggagaggagaggagaggacgcgtgaact

SEQ ID NO: 5146 - DNA, 1422 bp, Zea mays
gcacgagaccattacctagaacatcctaatcgaaaaagctagggtttcggccctcacgaacactacttgatcttatccgagcgcgccgtccggctgcgccgcggcggccggagccggctcctccttggccgtgtcgcccccgccgacctccaagggtcattgggttggtggcgcggtttgttggaaagaggcggcgctggcacccgcggttgctgcaggcgacgagcgatgacgactgcccgcggtcggagcgcgcgcgatgatggccgcgcgggttcaccccaaaacagcaaacaattcgcgatgctctgctttcctttcatttgttcttttcgaaaaattagaagtattttttagtaaaaaagatatctgttgtttgttgaatggctctgtcttctgtttgtgcataatcgttttcttagtggggtctaattctatatcacgtcattgtcgtggctctgttattgcgggtgcagctctgttataagggctattaataaggtggtggttgttaaactatgtcctgcatatagtagagactgagctgatattatgttttcagctaatcattaaggatgggaaatcttcatacaaattccatctctactgatcattcacttgctgcagcttttgtgatccttaagatggaacagataattgcttatttaaccacgttggcttctaacgtgtccattaggctttaagtttaacctgatgtcacgccatatatttgagactttttagttgcccctatggcttatatgctgtgcctgtgggaagaacacgtcccaacattcacttcatttttttcactttgtcagctaatagccatacatgtttagctgattgttaagattgggaaatgtacccttttcatactgtgttgtatatgctctgtttgcctgcttgaacatatcttgttttgagagtaaatatgttgccccgatggtggcaatggtgcctgtgggatgagcaggtctcgatgtttggcaccattttgctcagttgttgttattccataaaccatttgttggtcattcacgaattggaaaagttaagtttatattttgtagccttctgttttcccagttttataccttgaatgtgatttcgtggtggctgatttgtttcccttcagttaagaggtgtttttctttaatgaagaggtgaatcacctcctagcctagtgtttttcgtgtttcttctatgcatcagcagcaagcttgtgcttggctttaagctacaggaggataatatgctgaacttttggccttggtaatgctgtatgtttacacaaatatcctggcaggtgcacttggttctgctgtgattctgatgctactcgacttggtggatttcaatgaagccgaaaggtgttgctgccttgcagaatggtgtgatggtatctagacacgacccaat

SEQ ID NO: 5147 - DNA, 3428 bp, Zea mays
acttcattttttcactttgtcagctaatagccatacatgtttagctgattgttaagaccaggaaatgcacgcttttcataccgtgttgtatatgctctgctcgcctgctcgaacatatcttgttttgagagtaaatacgttgccccgatggtggcaatggtgcctgtgggatgagcaggtctcgatgtttgccaccatttagctcagttgttgttattccataaaccatttgttggtcattcacgaattggaaaagttaagtgtatattttgtagccttctgttttaccagttttataccatgaatgtgatttcgtggtggctgatttgtttgctcgtgtttctcttcagttaagatgtgtttttctttaatgaagaggtgaatcacctcctagcctagtgtttttcgtgtttcttctatgcatcagcagcaagcttgtgcttggcttaaagctacaggaggataatatgctgaacttttggccttggtaatgttgtatgtttacacaaatatcctggcaggtgcacttggtgctgctgtgattctgatgctactcgacttgtggatttcaatgaagccgaaagatgttgctgttgctgccttgcagaatggtgtgatggtgtctaggcacgactctatgtattttaatggtgtgtttggttggacataccaggaaggatggaagatggtggacatattttctatgatgtttggatgagagttatgcaggagtgaggtgaaccccagagcaatttttagtgccggtgtggtcccaaaaaatcgagcagagtgtgtctctctcgtctcatcctattttgacctcgccggtgtggtcccaaaaaaatcgagcagagtgtgtctctctcgtctcatcctattttgacctcaaacgaaacacattctaactccaccagtgaagaaactctattgtcttggttagttagaagaaaagaatgtctgatgtgtttcatactcgcaccggagcagactgctctgtcaaaatgtttaatgtgtacaacttgttttctgagatgagttggtaaacatgtgacctcttccttcaatagtcaagacctgtgtcctttaccctgaccgcaccatccttggctccttgcatcgtgggagcctggtgtttggtagtttgcgagtgctcactcttactgatttatgttctgtttagtttatatatttgtaacgtgattgttaactgataacgtaatagtaatatcatgattgttgataccagtagcaatgtaaagcgctacttgtttggttggtggtgacgacttcgcacgcgagcgcatcggttcctcggctatcgattccgtattcggctgaaaaaaaaacagaatgttcaccgtgaggaagttatatattcatctaaaccgatgcgacattgcttgagatcgatcacgggtgtcttgtgaccgaggaggaggcgactctcctcttagtccagtgttcatccagcaaacctggttccagaccctccttactgtcgaattacaaggtatgtggctatctcctgaggactggtgattcagaacaggtccccttccatcaagctcaagggttcctgatgcagccatctagtcacaagtgtcttctcagatgccgcaccgcacctgatgcagccatcataggcaaattcttgaagagaagtggtcacgctttgggtcaacattgacctcttatcctagatctcttcacagcagagattgaaatgatggctccagtatatgccagcagtaagatggcaatacaatacactgaataagataaaggcaaaataaaatcttctacatggcagaaaaaatttatggttccatccacaatgttccgaaacggcgaaactatgtttctctttcatgattacattttaccataccttacaaaacaagccccttgacttgacagtataagcttcaactgcaccaacagattctaaggtagaaactttcctaaagataacctgaatattacattctatctattttgtacagctgagaaaacatgacagcctgcgtcagtgaaatgtgttacattagattggccaacagagacaagatagaaacgcgcaccttcctgttttattttcccctaccaggtcttgaaaatctaccagatctatgaaccttcagcttaattgacggcacctttctagacaaggaccgccagatcatctggaccgcatcatccttctgggatggatactggtattcaaaatgtctgtccacctctctgagcctactccacatctctgtccatcgttgcttgcttacaccactgagcagtctcatcaggtgacccttttcgacagcatcggacgagcggacaaagatggagaactttgagtaatccagcacgtcctcgtaaggtagctcgatgtcatcgctgatgataacggggacacagtggctcactatcgcatcaaacatgcggttggaagaaggggtgtccccggcgatgtttaggcaaaattttgatgagtgcattccttggctagctttgctggccccatggtcttggacgctcccaaaggagaagtaaacatccttttcatctttcagcatataatatagctcctgtcgaatggttcctccctccttcctgtaaattgctccccggaagtataacagggtcggccggtcatcgaacccggccgagtcattgacgaacgtcttggccatgtgcttgtatggcgcaatgacatccttctccaagctggccaccctcggtgggtacctcccgaagtctgacagcacgaacactgcgggggacaacgccgcccgggcgtgcagcaagctgttggggtggtgcgccacgatgacgtggtcggctccgccgaacctcctccattccggccgcgccgtgaggtaccccaccagcttctcctggagtgccttgtccctgccgaccttctcgggcggcaagggccgggagtggcggttgtagctgagggacgcgaagaaggggacgaagacgaggtcggcgtcgcgggggtcggtgacacgcactgcggagtggcggccgcaggggggcgagaaggaggaggagaggaggtcgagcgtgagccagtactcaacgctgtgctgctggttgagccccccagggtagcgcggcggcggcagggagccgtccgtgacgtctggccagacggaggcaggggacggcggggaccagccgaggaggccgaagtggaactcgggcggcacgtcgtacatgaagaccctgacggcggcggcgcggggatcgcatctgacggcggtggcgccggatgctgaggcggaggaggggtcgtccgggcggccgttctcgtcaagaaatgagagctctttgcctgtggtggcgttggataaagaagtggtcacggccgtgggaaggcgtcgggcgggacggggaggccggtgcggcaagcccgggggtcc

SEQ ID NO: 5148 - DNA, 4184 bp, Zea mays
agagcttctagttagttttagcgttttagcgttttgtttgtgtgacgtgttgggtttctagtgggctgttttgctagtgcttcttttcttttctttgccctcctctaccctagtgttgttttttcttttcctttccggtgtttgtaagtgtctctttctaataaatttttggtcatggcaatactcttgccgtgtcctttttcaaaaaaaaataatagaccaagcggtggaggagaggtggttttgcattttgctgccgttgctatgctcggtctctagatctcaccatcagtccatcaccattcaccaccgcctgcgcctgcaccttcacctgcacctgcacctacacctgcacctcgactgcatgccaaccgggggctgcctttcccgccgcccaccacgatcatcgtcctggaacaggaatcagaatctcgctgttgtgttgttcacttgtgctgctacagcgacacgcctggatcccgagtcccggcccgattcccgttcccgttcgactccctctgctcatcctcggaaacggattccgccgtcccgtctagcaaacctctctctcttcagccttttgattcccacctctccattcccagcggctataaatccccgcgtcgccgctgcgccaaccccccctggccccctccctctccttcctaacatcttccttcgtcagccgcagatgcgccagcatctctcccacgggcagcaggaggaggagcgagaggcacagtgacagacagagagagagcgcgcgcggggggagcccagcacagcacctacactagctagccaccaccaccaccaccaccgaccgaatcgggtgcgcgcggcgcgctgctcgtcagctccggccggccgcccggccgctttataaagccacccacccagccccgcccgatcgccatcgccatacccccgcctccgtccacggacacacacccgccttgccagccggcaccctcccggcctcccccacctgtgtcctccggcctcgccgccgcaaaacccgccgcgcaggccggttgctccgattgggagtgccaatcggagccaacagcgagggaagcacatgctgccgttcgtcctagagttcctcattgatgtcgcctgtgatcagtgagatcctcctctcggggtttatgatcaactccacactccggcgccgcacccacctggtccagtccttctccgtcgtcttcctctactggttctatgtcttctcatgaactactcgcccccatcatagccacgccccttctctcccactcctcctcctcctctttcccttccatctagtagcatctaccgtcctcctcttctctccgtgtcagtctctgccttcgtcgtcgccgtttcagtcgttccctaaaccttctttagcttgcatgcacttccctactgctgctagcaaagacctttattactagtgtcaattaagttacgaaagaagaagaaagaaagaaaatttcgaggccgagaaaaaagacggctttgatctctcgctagtgtggtgtggtagtgtgtgcttctagtaagtaagcgagccagggatcaagaagcagagagctgctctgtctcttttgtctcttgcaagaatggcttcctccagcgggagcgggagctcgggctccctctcggcggcaacggcggccctggccgccgcggcgggcacggaggaggagctgcgcgcgctcatggagcagcgccgcgcgaagcggatgctgtccaaccgcgagtccgcgcggcggtcgcggatgcgcaagcagcgccacctcgacgagctgaccgcgcaggcggcgcacctgcgccgcgagaacgcgcacgtggccaccgcgctcggcctcaccgcgcagggcctcctcgccgtggacgccgagaacgccgtcctccgcacccaggccgccgagctcgccgcgcgcctcggctccctcaacgacatcctcgcctgcatgaacaccaacgccgtcggcgccgtcgccgtctccctcacagccgccgccgccgccgccgcttcctccgacccctgcctcgccttcgacggcgccaccgccctggacgacctcctcagatcctgccccgagaacatgttccagtaccagctctgctagctccagaccgcgcgaagtcaccatggcagcgcaaaacaccttcttttgttttgttttgtttttgtttttttttcttcttcttcttctggtgtttcaggtttagtaatctgctagtgagatggaagaactgaggtcagatcagacgtggtggtgactagccatgaaagtgaactttactgttactgtactgtgcgatcaactggtgggggtaattagctagctagctagctgctggggctatggttaatgcatgaactgctattagttaccaggtgtaagtgtaactctcgagtcctgctcttgttactgtttgtgtactgactgtgtcactccactactatgtaagaatcagagcagtaagtttactagtgtctctgctgtcaaacaaaggaagtgcaccatataatctacactttaattactcttgcctgtgtgccctgcagcgatcttaacgttaaaaaaaaccctgtcagtttttctctttattttcaatatatctatcttgagcaaggtttatcttttcctgcacctctgaattatggcactattacactgtcagtcgccagagctggctctgcctctctgtgctgctgtctagctgtgagcttcagattttaacagctgctggtacattttttctgatgcccatgggcaaaagtggtgcacaagcatatcctccccgttttaaaactatatttgcatctaggcatattttatgtcgtcaaggtacataatgaaatttatgaacgcgtagaaatgccgaaacattttataatttaagacagggatagcattatctactattcaccggcagaaagctcagcttgatattcttcaaggtagtgggaataatcagagtgacaacagccggtctttttacggagagaatggaataacttggcctcattttcctgtttcacacacatatatatatttctgtggattcggtcgagtacagtatggacggcggccattgagcgtcgagaaagagattctccaaactactctctctgtcctctcccactcgtagacatagtcacagccagccactctgttcccttgttttgttcttcttctttttttttccttgaggggcttgattgtaccagaagaccactttctagttgtcatgggttcatggaccagcagcactgttgcgtgcattggtaccgccagtacaatgatccctgcctgcaagctaatggctgcagcactagtggcagccctcagtgccatctgtgtagctctgctcatctctcagtcccacggcacacagatatttcagttcattgcattccattccattccattcatcaggacacagctcacatcatctctctctctctctcttgggcttggtacccacatggtgcactcactgactctcacacacccacaagcaaatctgatcttccagtggctgtaactggagctgcagaccaccaactactcccccgagtatacgatgcatggtgctcttgtatggcgttggcatgcatgcaatggaatggaatggaatggaccactggcactgctctctgcaaacgcaattggtgcaatggacctgcaatgcctggggctgggaggtagcggctacattgatggagtggaatagagccagacagccagctctctctctctctctctctctcacgcgcacacaggggaggggaggggaggggaggaggggattgctgcacaagccactgcgcaaaggggcgggaatcaaggccaaggacgtggtcacctcccctccttgcagcccaagcctccacctttcctcgtctccacccatccatccacacagagacggaggagaatatgtcgagagccgcccggaatattctccaccgtaccctcgggtctgtctgttcactgtcgacgccgaggcgacgatcatcgatcacttccggtcctgaagatttcagattcatcagtaattaatggttatatgcgaggctgaggcatgcacaaatcaagtcctcctcctgatatggtgaatggtgaatcagtggtacatttttgtcgggttttcttctgcttagtacatgtctctgtttagta

SEQ ID NO: 5149 - DNA, 1673 bp, Zea mays
ttgggtacctccgctccaggccggccgcccgctcgctcgctcgctcgctttataagccagccacccagccccgcccgatcgtcatctccatagccccgtatccgtccacgcacacccgccttgccaccagccagcactccccctcaacccccggcctcgccgccgccgccgcaccccccacacccgctgccgcgcaggccggttgctccgattgggagtgccaatcggagccaacagcagggggaagcacatgctgccgttcgcgcgccctagagttcctcattgatgtcgcctgtgatcagtgagatcctcctctcggggtttatgatcaactccacactccggcgccgcacccacctcgtccagtccttctccgtcgtcttcctctactggttctatgtcttctcataaactactcgcccccgtcaccgccacgcccctctcctcctccccgtccctgctgccttcttctcctccttcttcccgttccatctagtagcatccaccgtcaccctcttctcgtttcttctgcccagtctctgccttcttcttcgtcgtcgtcgtctcggtttcagtcgtttcctaaaactttaccttgcatgcacttccctactactgctgctgctagcgaagacctttattagttattagtagtgttaagttattaccaacaagaagcagaaagaaagaaagaaaaaagggatcaagaagcagagagctgttctgttcttttttccccctctcttgcaagaaagggcggttcttgcgcggacggaacgcaggaacaatggcttcctccagcgggagcgggagctcgggcttcctctcggcggcactggacgcggcggcggcggcgggaacggaggaggagctgcgcgcgctcatggcgcagcgccgcgccaagcggatgctgtcgaaccgcgagtcggcgcggcggtcgcggatgcgcaagcagcgccacctggacgagctcacggcgcaggccgcgcacctgcgccgcgagaacgcgcacgtggccaccgcgctcgggctcaccgcgcagggcctcctggccgtcgacgccgagaacgccgtcctccgcacccaggccgccgagctcgccgcgcgcctcggctccctcaacgacatcctcgcctgcatgaacaccaccaacgccgtcgcctcctcctccgacccttacctcgccttcgacggcgcggccaccgccttggacgacctcctcagatcctgccccgacagcgtgatgttcgagtaccagctctgctagctcgggaccgaagtcgccatggcaggtggcagcacaaagcatcgagaggagggggggaaaaaacatttttttttttttttgctgctggtgtttcaggttagtgatctgctagtgagatggaactgaagggcagatcagacgtggcggtgagccatgaaactaccgtcactgtactgtgctatcaactgggggtgggaaaaaaaacccaactgggggctgggtcactgcacctaattagctagctagatgatgctggggttattgttaatgaactactacttactactaaccaccaggtgcaagtgtaactcgaggtctgatctgctttcgtgtactgtgtcactccactgtgtagcaatcagagcagtaaccttactagtatccctgttcagaaaaaaaaaaacaa

SEQ ID NO: 5150 - DNA, 1547 bp, Zea mays
ccggccgggatcctgtgcagctcccccgagcccggctgggctttcgttcgccaggtgtcgttcgctttgccttgccccggcaaagcaatggcgctccgtctctctgctccgttcctcacctcgcgctttacgccgtcgcaagcgttggccccgcgcaggcgcacccgggcccgctctttctctccgtcagccgatgcgcgagccgcgtgcttcaagagaccctacacgtccgttctaattatccccacgggcgtcggcgcggccgtcgggggcttcgccggcgacgcccttccggttgcgcgagccgtcgccggcgtcgctgactgtgtcatatcccacccaaacgtgctgaacgctgcgatgctatactggccgatgcccaatacactttacgtggaagggtacgcccttgacaggttcgcagaaggatcctgggctctccaacctgttcaccagaacaaggtaggtttggtgctggattctggaatcgaggaagacctccggctgcgccacttgcagattgcagatgccactagggcttctcttggcttgcctgtagtggagtacattgttacagatgctcctctggagatcaagacatggtttgatcccaggtgtgggaagtcaacagggagtgttggtaactctgattctcttctgagagcagttgacgcactagtgaaacattcagatgtgaatgctgtggctgtagttgcacgctttccagatgatgacccagaagattcagattgttaccgggaaggaaagggtgttgatctattggcaggagttgaagcaattatcagtcattttagttgtgaaagaattcaaaatcccttctgcacatgctcctgcagtgttacccccaccactcagcccattagtatgccctagatctgctgctgaagaggtatatgtctatcgttgtgtaacaacatcagggtacacgtacacagagtactagaaagagagaattaggagatagcatggcacaattcggtggtcatgttgaacctgatcacgagtgagagtcaacatgcggttagttagagaggtttaggctgcagtgtacgtccccttgcatcaattgatgagcacaaaggagaaaaaaattacaagctcaaacaccagtgagtatcaagaccttctagctcctcctcacctcctaattgtggtggtagcctaatggttctaatccccctttatgcctgcctgtgctgtagaatgaattctatcgacttttgatagatttgggtcaacccttttctccgttggaattcccttaaatgtagctcactccctcttgcaagggggagagaggttacatgaacatcggattctatcggctaagacccaactaccttgttcttatcatgttcttggagccataccagggctcatgtcccgaatgtggcatagtgtgagaggtgtcctttcttcaggcgggttgccatacctaccatgtcgtgtcctctggcgtcggggtccataggtacaatttagctggtaaccggggcaaccttttatacttgatagtgatttatggg

SEQ ID NO: 5151 - DNA, 1622 bp, Zea mays
cccacgcgtccggtgagtttccggcaagggatctaccaggaggcgatcatcttctcctccaccaagaacgcccagctccccgacggccaagttcccgtgccggcgcagctcgtaccgtcgaatccggtgctgaattccgaggtctcaccggcgacagtgagccaaggtcctccagaccatcctcccggcgctcgtccgtcgccgcacagcggcgtggccaacggcaagcaaacgccacggaatcccgtcgctacctcgccgagccaggatgaccggtccggggcagggaaagagaaccagtcgtgcagcaacacgccgagcacgagcagccgccagtcgccgtcgcagcagaagacgcccaagtccagggcgacgccgccgcctgacaggcgcagggttactcctgctcagacaagccctgctattgcgcctgaccgtaaacggcctgccgacgctgctgctggcactggcagcaactctgacaaagtgacgacgtcccacgacgacgcgagctcgagcgtgccgaacaaagtatcggaggagctgctccggtgcctgctggccatcttctcgcagatggggggctcggctgctggcggcggccgaggactaggagacgaggaccagcagcaggcgctgtccccgtcggtctccggctccagcgagagctcggcgtcgtcggaggcggacgcgtacccgcaggacccctacggcatcctggagctgggcgccagggacatcggcgcctacaagcggttccacgtggtcgacgccgcgtccttcgacggcaacggcgacacgcctctcgttcgtcggagactcaaggccttgctgcggaggctgtcgtcggttgacctggcggggctctcccatcagcagaagctggccttctggatcaacgtctacaattcctgcatgatgaacgcgttcctggagcatgggatacctaccaccccgcaaatgctggtggctatgatgcccaaggccaccgtgagcgttggtgggcgcacgcacagcgccatgtccatcgagcatttcatcctgaggctgccctacagcgccaagcaggtgaaggtgagccgggaaggagccaagtgcgacgacggcgacgtgacggcggcgcgcggcgcgttcgggctggagtggcccgagcccctcgtcaccttcgcgctctcctgcggcagctggtcgtcccccgcggtgagggtgtacacggcggcgcgcgtggaggaggagctggaggcggcgaagcgggagtacctacaggcggccgcgggcgtgtgggcggcggggaggctggcggtcccgaagctcctgcactggtacctgctggacttcgcaaaggacgtggacgcgctcatggactgggtctgcctgcagctgccgccggagctgcggcaggaggcggtgcgggccgtggaggccgggcggcgcgcgggcgccggcggccgcgtccgggtcctgccgtacgagttcaggttcaggtacctgttggcctcctgacgacgcgtgcgtactacggtaggagtagtgccgtgcgtactggaggtggtagtagtagtctttgcaataataaaacggagatgggattgactatgcagttttcattaaaaaaaaaaaaa

SEQ ID NO: 5152 - DNA, 1183 bp, Zea mays
tgcgctggaatggaggaagacctccggctgcgccacttgcagattgcagatgccactatggcttctcttgggttgtctggctcggagtacattgttacagatgctactgtggagatcaagacatggattgatcccaggtgtgggaagtcaacagggagtgttggtaactctgattctcttctgagagcagttgacgcactagtgaaacattcacaggcgaatgctgtggctgtagttgcacgctttccagatgatgacccagaagattcagattgttaccgggaaggaaagggtgttgatctattggcaggagttgaagcaattatgactcatttagatgtgaaagaattcaaaatcccttctgcacatgctcctgcagtgttacccccaccactcagcccattagtatgccctagatctgctgctgaagagattggacatacatttctgccttgtgtgcttgctgggttaagcaatgctccacaatatgtcatgaggagcggaaccttggaccatggttgcatagtggctggtgatgttgacagtgttattcttcccaaggactcctgtggaggagatggtacacttgcttttgctcgagctgcaagaaaggacaagcccttaatcattaccgtgcaggaaaatgagacagtgcttgatgatactccagacaagttcggcatagaagtgctgaatgtccgaaactactgggaagcaattggagtcatcgctgctcacaaagcaggtgtcaatccacatgctcttagaagacgagggattgatcatcttaagagccctcaacgatcatattctgcctactctgcaagtcctaaaccatctgcccgtcctccagtgcacgataaagtacagagacagcagctagttaggcaaatttagtactaaaaagagcactagcagcagtagaaattactttagatagtcgtgattaggaacttccaaaattttgaagcccagatacatatttttcagaccgtcctgaagtgtaggaccatagcatcacacgaattttgtcgtgttatccagtctggacttcgctgacatgagtctttctccactgccttacatttctccaatctctagtcggtttgtcaatcatttacatcattattttgccaaggtatacacagcgctggtaatcattttcgtccgacaatattttagt

SEQ ID NO: 5153 - DNA, 2076 bp, Zea mays
agcaacacgtaacagcgattgagcagcatctctagcggaaaggcggaaaggctaaacaaaaacgaaccaagccgctaaaaccctagacccccagccgaatggtcgtcgtcctcctccgcgcgccgccatgctgctccgccgccttctgcactccacacgccacttccggcacgcctccggaccgtaactccggccaccaccaccaccaccaccaccacttcctcctcctccaccccccttccatttcgctgcttcccggacctccccctctctcgcgtcctctccccgcggctcctctccacctccggccgcgacgacgaccgcaacaagccgtggagcttcgaggcggactcgggcgatccggaccccttcgccaatgaggacgccgcggccgctggcgctgccgaggggccgccggtaggacccacgcgcgccgccgacaagctctgggcgacggagttcggcggggaggacggcgagaacggcgacgtgttcgaggggatctacaaggaggctgcttcggcggcgcccgggcgcggagaggcggctccggtcggaaatgacgagcagtggacgctgagtggggaccacgaggataaggatccctttgccgagtccgtgctcggggaggggatcgaggggattcaaggcgagtgtgatgggctagatgacctcggtgctggggaggaccccgaggttgagctgaagcggcagcggaacaaggagagggagaaggagttgatggagatactcaaaggtccaaatcgtgcttttggtgatctcattgaggcctctgggatcacagatggaatgattgatagtttgatcctcttaaaggatgtcagagacgttccagggttgcctcccctaagagaaatagaagatgaagctatccagaatatgagtgtaacatcaagcagagctgaagttgagcgccaaaaccaagaggccattgctaaggcacgagtaagacaggttgatgagaaaggaagagcttatggaacagggaaaaggaaatgcagcattgctcgtgtttggattaagcctggtgatggtaaattcattgtcaatgaaaaggagtttgatgcttacttcccaatcctggaccatagagctgaacttcttcgtccatttaatgtgaccgatactttggggcgtttggatgtgacctgtactgtgaaaggtggtggcgtatcaggacaagttggagctatccgcttagggataagcagggccttggagaattgggaaccaggatggcgtccatatctcaaagcagctggatatttgacgagagattcacgtgtggtcgaaaggaaaaagcctggaaaagcgaaagcaagaaagagcttccagtgggtcaagcggtaacagagctatctgcatggctacgtattttgttgtggcgggtctctgccctttgactttgatgtgggttttctactcaacacagatcacttgatctgctgttattttttccgaaggtcctgtccttttcagcttctccaacctgtgtcgatacgaggaccatgctacactttggattccgtttccgaaacgttgtgacagcaaaattgatgtagaaaataccatttgacctaatcaagaccgagaagttgctttgcaatgagctgccaataaaacaggctgtgccaatgagactacatgttcgtctcatcagaaggaagacccttctcgacccttatgatttaatggctgggaaacgggtttcggatgccaactgatgattatgataatttgcttcgtttttttcttcctctccgtgtatgtcttgcgcagtactggtaaaggaatgataagcgttcgttttgtgcctgaaataatagaaccaggcaaactgctttttgcgggtttgaatcatgcagtttcgaatgcggccctcatctgcttgacatcaggttcattgaatgccctgtttccctggctcccttagataaatggctggcctgatccggagctgtagacaacccccctgaggctatttccaacaggactttggatggttatttaccccaaagatggcagtaaaaaaaatggaagggaacgttttggtcg

SEQ ID NO: 5154 - DNA, 1213 bp, Zea mays
agcttttccctccgtaaaaagataacattcccctacccaaaccaccggcgcgcacgccaagcggtgaagcagcatcggccatggaggagaccaagccagcgccagaggccatgctccgctgcgccagggccgcgctcctcctcgcctccctccgccggccacgcgcgccgacgccgacacaggatcgccgccggacctcctactctccctcctcggccgccgcagcggagctcgcgcggctccggtccgaggggctcctccgcagcgccgagatcgcagcggcgcggcgcgaggccgcggcccacgcgcgggtcgccggctccgagctgctcctcgtcctcgccgtggcgcccgccgtcctcctgctcctcctcctcgggcttctctaagccagcggcggcgtgggtagcgcgggggctggagtctggggccgcctctcctctccgtgagttcagttttggagtgcactaggtgttcgatgaaatgcatgtttgagtgtggtggcgagtatataagcatcagatttgtcccccttttgttttggctgcattgccctgtggacaaatgtggtctgggtttctgtgcggtttgggcattcgacgaaaagcctgttcgtgtttggtgacttcatttcaatttgattccggtgcttgttgccaacagaaagctgtgcgtcctggactccgggagatgttgcatgtttcgtcgatgcacattggtcagaactcagaacgggacgatgcagccaaatatattccccgtgaattggtctgacgaagtagattgtgctgtgcctgcccttgtaggattatgtatgggttgctatggaacggatgatactttgtggtgctggcagcacagcagcatcagagtaatgtttctcctcagttgaatgcaaaggaactcgatcgtcggccaggagcccaggatcaccaaccctactataaatgtgcgatgcaatacgcagacaacacttggcgtttctttctcccgagcccatgactctgtgtcgctcacactagtgtatatgtagacctgtgtatctgacgtaacattaattcacagaaccgcgtccacccaggctcagatacggttattttgagcatacaaacggatgcaggaaaataacttattttacacccgctcatatagcccgccggcgtatctcatatgcaggtaactagctcggacaaaatccgcataattactaaaa

SEQ ID NO: 5155 - DNA, 1589 bp, Zea mays
gcggaaacgggaaacctgccggcccgttcttccccgggccccccatcgtttcatagtgacaaaatagtaaaaagctcgtccctgtctcgggtatcgtcgctggtcgctgccgcagccttcgtcctccctctcccactcccgatcgcatccaccctggaaccctagcggcccagcccgcgaccatggcgcggcggtcgacccctctcctacgccgccttctcgccccgtcaccttccctctccactcccctagccgacgccgtatcccgccgcaccgtcacctacatgccccgcccgggggacggcgctccgcgcggcgtcaccctcatcccgggcgacggcatcgggcccctcgtcacgggcgccgtgcggcaggtgatggaggcgatgcacgcgccggtctatttcgagacgtacgaggtccacggcgacatgcccacggtccccgccgaggtcatcgagtccatccgccgcaacaaggtctgcctcaagggcggcctcgccacccccgtaggcggtggtgtgtcctccctcaacgtgcagctccggaaggagctcgacctctacgccgcgctcgtcaactgtttcaacctccctggcctgcctaccaggcacgacaacgtggacatcgtcgtcattcgggagaacagtgagggagagtactcggggctcgagcatgaggtcgttcctggcgtcgtggagagtctcaaggtgataacaaaattctgctctgaaagaattgcaaagtatgcttttgagtatgcataccttaacaatcgaaagaaagtgacagcagtgcataaagccaatatcatgaagcttgctgatggtttgttcttggagtcttgccgtgaggttgcaaagaagtaccctggaattaaatataatgaaatcattgtggacaactgttgtatgcagcttgttgcaaagcctgaacaatttgatgttatggtcaccccaaatctttatggcaatctggtggctaatgtagctgcaggtattgctggaggcactggtgtcatgcctggaggcaatgtgggtcaggaccatgctatcttcgagcaaggtgcttctgcaggaaatgttggaaatgagaaaattgtggagaagaagagagctaaccctgttgcgctgctgctatcttctgccatgatgttgaggcacttgcaatttccatcatttgctgaccgtttggagacggcagttaagcgtgtcatagcagaaggcaagtacagaaccaaagatttgggcggcaccagcacaacccaggaagtgatagatgctgtcattgccaaactgggttaaacacaaaccgtgtgtttaatacattttttttcctcatggactaggtaactagtccttactaaatgtttgttcttcgtataggtttagactttagaccaccattttgttcggcaaattcttgtacaatcttcaggtatcttgtttctggcctggtttgggtgtgtggtgtaactgagcaaactcgtattaatttttacgcaaatttttgtgaccttaattcttaactggaaataagagaaaaatatggaacagttctccgtgcaaaaaaaaaaaaaaaaagcggcc

SEQ ID NO: 5156 - DNA, 1626 bp, Zea mays
cattgggtacctcgaggccggccgggagaacgcggaaacgggaaacctgccggcccgttcttcccctggccttctcgagtcctctccctgctcgctgtcgctgcccctgtccctgtctcgggtatcgtcgctggtcgctgccgcagccttcgtcctccctctcccactcccgatcgcatccaccctggaaccctagcggcccagcccgcgaccatggcgcggcggtcgacccctctcctacgccgccttctcgccccgtcaccttccctctccactcctctagccgacgccgtatcccgccgcaccgtcacgtacatgccccgcccgggggacggcgctccgcgcggcgtcaccctcatcccgggcgacggcatcgggcccctcgtcacgggcgccgtgcggcaggtgatggaggcgatgcacgcgccggtctatttcgagacgtacgaggtccacggcgacatgcccacggtccccgccgaggtcatcgagtccatccgccgcaacaaggtctgcctcaagggcggcctcgcccacccccgtaggcggtgggtgtgtcctccctccacgtgcagctccggaaggagctcgacctctacgccgcgctcgtcaactgtttcaacctccctggcctgcctaccaggcacgacaacgtggacatcgtcgtcattcgggagaacagtgagggcgagtactcggggctcgagcatgaggtcgttcctggcgtcgtggagagtctcaaggtgataacaaaattctgctctgaaagaattgcaaagtatgcttttgagtatgcataccttaacaatcgaaagaaagtgacagcagtgcataaagccaatatcatgaagcttgctgatggtttgttcttggagtcttgccgtgaggttgcaaagaagtaccctggaattaaatataatgaaatcattgtggacaactgttgtatgcagcttgttgcaaagcctgaacaatttgatgttatggtcaccccaaatctttatggcaatctggtggctaatgtacctgcaggtattgctggaggcactggtgtcatgcctggaggcaatgtgggtcaggaccatgctatcttcgagcaaggtgcttctgcaggaaatgttggaaatgagaaaattgtggagaagaagagagctaaccctgttgcgctgctgctatcttctgccatgatgttgaggcacttgcaatttccatcatttgctgaccgtttggagacggcagttaagcgtgtcatagcagaaggcaagtacagaaccaaagatttgggcggcaccagcacaacccaggaagtgatagatgctgtcattgccaaactgggttaaacacaaaccgtgtgtttaatacaatttttttcctcatggactaggtaactagtcgactaggtaactagtccttactaaatgtttgttcttcgtataggtttagactttagaccaccattttgttcggcaaattcttgtacaatcttcaggtatcttgtttctggcctggtttgggtgtgtggtgtaactgagcaaactcgtattaatttttacgcaattttttgtgaccttaattcttaactggaaataagagaaaaatatggaacagttctcctttctgcttgctgtc

SEQ ID NO: 5157 - DNA, 1132 bp, Zea mays
cccacgcgtccgctctttacaggagcgctttttcactgaaagtggaacgtgttgcaagttcttttagtacactatttactatcactttgttgatttgctaggtgataacaaagttctgctctgaaagaattgccaagtatgcttttgagtatgcataccttaacaatcgaaagaaagtgacagcagtgcataaagccaacatcatgaagcttgctgatggtttgttcttggagtcttgccgtgaggttgcaaagaagtaccctggaattcaatataatgaaatcattgtggacaactgttgcatgcagcttgttgcaaagcctgaacaatttgatgttatggtcaccccaaatctttatggcaatctggtggctaatgtagctgcaggtattgctggaggcactggtgtcatgcctggaggtaatgtggggcaggaccatgctatcttcgagcaaggtgcttctgcaggaaatgttggaaatgagaaaattgtggagaagaagagagctaaccctgttgcactgctgctatcttctgccatgatgttgaggcacttgcaattcccatcttttgctgaccggctggagacggcagttaagcgtgtcattgcagaaggcaagtacagaaccaaagatttgggcggcaccagcaccacccaggaagtcacagatgcggtcattgccaaattgggttagaaaccaaccgtgtctttaatacaactttttttttatctcttggactaggtaactagtcctgtcaaaacatttgctcctctcgtaggtttagttcaccattttgttcggcaaatccttgtacaatcttcaggtatctcgtttctgaccaggtttgggtttggggtaactgagcaaactcagtattaatttttacgcaaatttttgcgaccttaattcttaactggaaataagagaaatatggaacagttctcttttgggcttgctggttgctgtcatgctaccatgtaaccttctgtattccagtgtgtcatacatacgcatattaaggttcccgcctgacaaccgttgaccaaccccaaaaactcaacaccacctctacaccacccacttttccttccatttataaacaacaccccaaaaccaaaccccctttgggg

SEQ ID NO: 5158 - DNA, 3466 bp, Zea mays
  misc_feature (19)..(19): n is a, c, g, or t
  misc_feature (287)..(287): n is a, c, g, or t
cgctacaatagaacaccanttaggacgcatcctgattcccagcctagtagaactgaactgggctcgaggagttccccgaagatatgggaaatcatatccaattcggagttccgtctccaaactgctgattgactgctgcttactagagacaggatcatgccgaggctaaatcacagtgtattccggaccacaataccaagccacaagaaaaaaagtaggcacgaggatggcgtcagggccgcaggaggcgtggcgtaccgcgagctcgtcgacgtcgaccttgacgnaagatggcatcggtgaagcgggaggccagctccttgaaggccggctcgatgaagcggcagggcccgcaccaggacgccgagaagtcgatcaccatctgccaagcaaagagcgcaagggaaccagaccctcgcgttcctcagatccagggcgcggaaggcccgggggcaaggcaacaagagccgagaagggaagaggggctgaccagcttgctgctgctcttgtgggccgcccactgctcgtcgtaggtggccttggagtgcgcggccaccacggcgcagttcgggtcgtcggcggcgggcggagggggcgtcactaaggtcgagaagaaggagcccatcgctgatcgctctcgcggttgtttgcactcgctgcctgcctgtccttctgtctgcttgctgcgttggagagtggttgttgccgcgggccggtgtgcgtgcctgcgggtactcgtgattaataagcgcccgcaccgcaggccacggcacgagacccacacccacccgacgagggaatcgtgtgctcgaatcgcgcgggtctccggcttttgaccttttcggtttgagaaggggttcctactaaaaactgctacataaattaattaataattgtgtcaatcaacgaataaaaagccctagtttagttttctttaataattttaaattattagctttcctagagaaatgaacccctacggcaaaaggtgaaatgttagaggatcgtttacggtttacggaaatatttagttagagaatgaaatagtaaaccatgctcaacaggatcgtgcatataactaaaataccttttttacattataaatgtacgatatatagagtgaggcctactggagatagctttaaaggtcgtttttcttatctacagaaaattaattcttttaaggagctattgagatatttaacacaactattggtttgccgagtaattatcctaaaaaataaaaagaaaatagccacttttagagatgctccaagaggcgatgcagaaagaacaaagaagccaaggattcgtcacgaaatggcgaatcaaaaagatgtcacggcgagctgtgagtagaccgtaatgttacgtaataatatggtaagaatatcttcgagagactagataaataattcgttaaaccaaattttggttactcgatagcaaaataatttttcaacagattagctatctgacttaacaagttatccgactcttcaaattggctctctcactagttaaatttggctagatacctgactagttaaactagatagatagtctgttggagtgatatgctacatataaagtgtaatctttatgaaaagacaaatagatagttaggctggctctagcaaaggccgctaaaggctcctctaccctaaatataccgtatgattggttagttgtgcaatccgcacatggctcgcgcgagcctatctctccacaaacacagtttttctccgtttgcgtgcatgcaactgaaaaactttaattttgtctaaactgcatccacacatgcaagcacgatcatccatatgcaggcttccaatcaaaggttgaggagcagtcaacgcacgggtagagacgggttgctgaggagcatgcaaccaatcatgcggatagaggatcaaacgatcctctactctctccagcagcctctaaacgttcttttaaacttagaggacactgctggattctctatatatagagttcctctaaacgatcttctatctatttgaatattttaaataaccggtttagcaaaactaaaatatgttaagtacatttgagagtacgacaaatacgtatgtacaaaaattaaaaatatctctaatataggtatttacgtatagaggatgcgatttagatgatgttggagagaaaggagatatatagaatacaatcttttagagaagactgtaaaggacgaatatagagggtggatataaagtacgttgctggagaccgtcttaaatagaaagaaaaaaaataaagagtatattaaagatgctctaacagaggtcgcataaaccaatccgtaatcacacgcggtggaggatatgtgctcacacatcaattgccacaaagaaaaccgttatgggcacggtggaggatatgtgttcacacatcaattgccacaaagaaaactgttatgggcacgcatcacgcagaacatgcaaaacacatgccatgcgaacaaggagacatagacatggcatttcaacatgagaatatatgtacacatatatattaaggatctgtttaggaaagcttcatttcaacaatttgagttttagttcatcatcttatattcaaataggtttagctccatcagatctagcttcaaaaaattaaaataaactcaaaggatatttcaaaaacgttgttttcatatgctcataaagttacacgaaattatctgccataccattattcctttcctattaagccgatgtagctcccttcccgttcaaggcatccacgccgactgcaatatcgtggccacacgttttcatcttcgttgcacgcgtggcaagtccggcatcctaccttcctagggaaaaaaaagctgaaaaatccaactccgcagtactgtcttacttatcttcgctacatctggatgctgcttcttatcttcgctacacaagcatgtctccaactccgcagtgctgtcttggaaaaaggggtctgtaccttctctcaccccgacggcgcttcctacttcctagggcgaccgcggcggcgccacatgcttcgccagcgtcggtcttcccgtcgtcatttctacttcttctgccggcgtcggtctacagataagacgggtcgcagagcttgcgctaccgtgccctctcctcttacgtaggggcctctaagctcgcagcggctaacactaaagagcgctctatacgctgcagctttaggagagggcacgcacgttcccccagatcaaggggaacactgtagcgtctccttgcacagtgctttcatatttaatagttaataaaaatagtaataaaagataaataatgttagataatgatattttataattgtagtgggatatatgagataatataggggaaccgttgcggaagatgaaaaaatagggggtgaaatattgattatgtgacgcaaaaagtgatataatgggaaaaatttagaggcaaccgttacggataaa

SEQ ID NO: 5159 - DNA, 1028 bp, Zea mays
gggccccccagggcggccggggccggcaggacagatcttgggaatgcaatatccgcttgttccatgcaaaagaaaatggagacgtggctcgttttgacggcactcctgctttcactctctctggctgccgccgccggcacggagacggtgaaagtgatcaccaccccagtcttcccccacatccctcgacttcaggcaagcaaggatttccaggtgctcgtgcgcgtcgaggcgccaccggcgctgcagcagcatagacgcgtccccgtcgacctcgccgtggtgctcgacgtgggtgccagcaccggcaccggcaccggcgtgccgaggctggatgcggtgaagaaggcggtcaagtttatcatcagccaggtccacgacgacgaccgtctcgccgtcgtcgggccgtccaactatcggctagtcaccgggttcaaggacacctacgacgcccgacacaatgcccagaaatccgtcgagcagctgcagcaccgtggtgagttcacgtcgggcgccggcttggaggaggccatcaagatcctggaggagctaccggcgacggcgagccgtagcagccgcgcgcgcttcgtcatcttggtgacggacagggcagtggcagagggcagcagcagattcagcaagctgccgcgcgagtccctccccccggtgcacacgttcgggctcggcgaggcgcacgaccccagggagctgttgcatatcgccagggaatcccagggcacctactcattcgtggacgaccagaacacggacggcatcaccggcgccatcgccgtctgcctcagcgggctcaagaacgtggtcgccgtcggcgcgcgcgtccgccttgagacgcccgtcgggagcggggtcaccatcgagaggatccagtcggggggatacacatacagcaggactcgccccatcaccaccagagacgacaagacgtacgtcgaggtcgccctcggcgccctatacgccggcgaggtgaagagcttcctcgtccacctcagggtggctgctcttcttgg

SEQ ID NO: 5160 - DNA, 2402 bp, Zea mays
acacaacacagccgactgaaaatgcatacgtcgtcggaagtggcagctccaatgacgtggctcgttctcactggagctcctgctcgcggtggcggccgccgccgtggagacggtgaaagtggtcaccaccccagtcttccctcagatccctcggctccaggcaagcaaagacttccaggtggtggtgcgcgtcgaggcgccaccggtggcgcagcagcaggcgcgcgtccccgtcgacctcgccgtggtgctcgatgtgggtgccggtggcggtggcagcaccggctcggcgaggctggatgcggtgaagaaggccgtcaagtttatcatcgggcagatccatgacaacgaccgtctcgccgtcgtcgggccgtcgcccaaccgccggctagtcatcgggtttccgagcactcacgaggctcgacagaacgcagaaaaatccgtcgacgacctggagccccgtggcgagttcgcgtccggcgccggcttggaggaggccgtcaagatcctcggggagttaccggcgacggcgagcgggagcagccgcgcgcgcttcgtcatcctggtgaccgacacggcggtgacggagggcagcggcggcagattcggcaagctgcggcgcgagctcctccccccggtgcacacgttcggcctcggcgcggggcacgaccccagggcgctgctctccatcgccagggagtcccagggcacctactccttcgtcgacgaccagaacacggacggcatcacgggcgccatcgccatctgcctcagcgggctcaaggacgtggtcgccgtcggcacgcgcgtccgcgttgaggcgcccgtcgggagcggggtcacgatcgagaggatcgagtcgggggggtacaggactaaccccaacaccggagacgacaagacgtacggcgaggtcgccgtaggcgccctctatgccgaagaggtgaagagcttcatcgtccacctccaggtgcctgctctgccttcgacgtcggcgatgacgacctcctcttccgtcgacaacggaggctgcgacaagcaacagctgctcaccgtcaccttcgccggccactacaccaccagggacgagggaggtgccacgtctccagcttctccacgcccgccggcgaccaccacagcagtcttgtacgtgcaaaggccgcagccggaagccctcgacgttgccggcggcggcgcgctgcacagagtccccgtccccgcggtgatgaacctcatcgcgcggttcggcctgctcgagctgctccccccccgcccccagctcgggatctggcggcttagttcttccagttccagcacggtggaagtggcgacaaagctgcggacgcagtgggagcagttcgtgcaggcccggcagttctggagcggcctggacctgggagtcctcgacgtcgaggtcaacaggatggcgagcatcctagaagcagcaggaacccgaatcggttcgtcggcgacggcctacatgctgtcgtggctgtcgagctaccagatgcagcggccgacggccatgggctcgccgagcatcgtggccgccgcgttcgtcaccgtgaagatgcagttcacgctgcagcaggcgaccatcgtcaacactcgtccaccaccatgcatcggcggctgcccggcgtgcgagtgcgggtgcgaggaccgctgcgtgcagccactgccgccgccggtgctcctgccgtccggacgcggcgacgacacctaccgcgtcaaccccgcgtacccgcagggcgtactgttcaacgccatcaaccaagcaatggagcagatgtacctggcgttggtccgggcgagcaatctgacgcgttgcgacgacgctgcccgcgtcgagttgttcctgccggcatgatccggcgagcgacgacgactcatcacggggtacgggcaactcaccgccgatcgatccatcgaggatctagctagctataccgtctaccgtataccgtcctagctagtaggctagtagtatacggtggtgtgcttaactatacaagctaagtactgtacgaccaagcttagcttgtcataaataagcaatcgatcatacgcactccataactaatacatgctcgtatgcgttgccttgtgctctcatttcctttctatccagaaaccctctacactacaaagtactccgcgctgttatgttactcgccaacgagcattttcgatgcatggattggtcatgcctccataatctcctgctaggcagtttgatatcaatatttcgtaaccttgtacttcctctatcccaaaatataaggcgcacatttttttaaaaatactcaacgttgtaaaactttaacaaacgattccagcaaaaaatatattttgtgtaaaaaaaaaaaaaaaaaaaaaaagggcggccgtcgcactagaac

SEQ ID NO: 5161 - DNA, 1850 bp, Zea mays
aagagcgcaacaagggtaaagtgctagtaacgagcaacaatgaaacctctcacaagaagaccaaaatgaagcaactcagcaaggctagcgagaagataaattaaacaaaattatacgaacaattaaccaagtatgaatgaagacatgaaaaagatccatacgttgatcgtaaaaagttggctaaacaattaaaaaatagaaaatgaagaaaaaaattcgagaagtgtgatgacaatgatgagtagtagttttattttgaactatatatttttttaatttttttcattttatttaatttgtttaatctatacagttttattttttacaagatatgatttgtttcatattttatatactttattcgaattatagatttttcttaattatatgttctacgatttattttgtgttttattttaaatatatgctagtggccccccccagcccggccggcgaaaggccgtaagcccagtcggaccacgccactcccaaaccctaagctgagcctgtgacgctttcatccaatggtgcaagagcaagacgcacccaacgcacttgcctccgacgccgatcaccccgctccgccgccccgcctcctttctaagcaccgcccgcgtcgccgcgccgctgcccctcgcccgcccctgccaccacctgcgccaccactgcccgcgcgtcgcctgcccgatctcagccagtgccactgctgcggcttccgcttccgaacgccccagccgggggccaggcccaagcgccgcccgctctgtccactcagttccctatggcgcgtcgtcctcctctgcgccgaatgcctctccctggtccgctgtggcgctgtatgctcttactgcctctccctcgacaacctgccgcccgaggattccgccgtcgtctgtcgccgctgcaaccgctatgtccatcgatcctgtatccctgccgaacaccgcacggccgtgatccagccggtcgatgtggaggatttcctctgcgtcgattgccgtcccaccgtgagatcgaagaacgggggcttcaatttggggctgaatctggatgcttgcatctgggatcgtacatccgttgccagggagaacgctctgaggaaggctgtggaggtgaagcccgcttctaagcgggggaacgacgctgttggcggcagtgggttggtcggaaggggcagtgatgttccagttctgccggacgaagagttagctttgcagctgcacctggcaatgaatggatcacagaggatttcacgttcaggtggtgcctctgccgatccagccaaggggaagaatgatggggttgctagtaggatttgcaacacaaatcaggatatttgcgtaacaaatatgatggctcagcttgatgaagaagaaccaggttgcaacagggtattaaagggccttaggaattctgattcctctgtcacagtggttcttgcctggaatgtgtgaaaggtaaacgcactgaggaaagcatgaaagctaaaggaaaaggtcctcatgtgattacacagaaggatgatttggtggatccctataagaagtatagtaaaaggagttcaagcaaattagcaaaagatgaatatgttgcaagcccgaaaatgtatgatgggatggacatagaagatgctgatcatgatggtaatggggtagctcctatgaaatagactgcttataccattctgaggtactaattttttttaatgaattccttccgtgtcattctgcaatgaagtgcagcatttagtgcaatttcaatgttgcctgttggtcacttgttcaagtaaatgttacttatattttactgcaaagatggaagatgttgaagccacaaaaaaaaaaaaaaaa

SEQ ID NO: 5162 - DNA, 889 bp, Zea mays
gtaccgactccggtttaaaagatccgctactagtgtcaccggcaacgtgtcgacgcggtcgtgtgtgttcctggtgaggaagcgaaccctgcctgcttacttgccgggcaagaagtgagaacagcgtggggtgcggaagcgaccggaccggggatggctacaagaaggaccgtggcggcgagcgttactgcccagcggcctgcgtgggcggccgtggcgaggaggatggagggcgtgtcgcgctacttcagcgacaaggcctccggcaggctgctcagcgaggaggagcgcgccgccgagaacgtctacatacagaagatggagcgggagaagctggagaaactgaggaggaaggaggacaaggccaaggccgaggcggccaagagggccgccgccgccgccagaggcgacacgaagaatggtgaggaggctcatccgagctgattgatcatcgcaaaatcagaccggtgctcccgtgaatcctgtgatgctgtactactgatgacacgtagatgcaaatagacgccgtcgtactaggtactactctgcatggagaggaacgtttgctctcttttgcaactctgctcgtcgtgtcgtgtgtaatcccatccctgtcacggttgtgaacttcgcttgtagctagcgacggttttgccttgccttgtcccttgtcggtgcaactggagtggagtggaggcgtccttgagcctcttccatgtacataggttgtcaataataataatgaataaatgtagtcccctcgtcgaaaacaataaaaaaaggtcccagaagagtggaaaaaaaaaaaaaaagagtcaccgtacgcgcctgcctccgcggctcaaacttttccccttctcccattcccctcgtcggcgcgctcatccgt

SEQ ID NO: 5163 - DNA, 793 bp, Zea mays
aaccgatccggtttaaaagatccgctactagtgtcaccggcaacgtgtcgacgcggtcgtgtgtgttcctggtgaggaagcgaaccctgcctgcttacttgccgggcaagaagtgagaacagcgtggggtgcggaagcgaccggactggggatggctacaaaaaggaccgtggcggcgagcgttactgcccagcggcctgcgtgggcggccgtggcgaggaggatggagggcgtgtcgcgctacttcagcgacaaggcctccggcaggctgctcagcgaggaggagcgcgccgccgagaacgtctacatacagaagatggagcgggagaagctggagaaactgaggaggaaggaggacaaggccaaggccgaggcggccaagagggccgccgccgccgccagaggcgacacgaagaatggtgaggaggctcatccgagctgatcatcgccaaatcggaccggcggtgctcccgtgaatcgtgtgatgctgtactactctactgatgacacgtagatgcaaatataagccgtcgtactaggtactactctgcatggagaggaacgtttgctctcttttgcaactctgctcgtcgtgtcgtgtgtaatcccatccctgtcatggttgtgaacttcgcttgtagctagcgacggttttgccttgccttgtcccttgtcggtgcaactggagtggagtggaggcgtccttgagcctctttcatgtacatataggttgtcaataataataatgaataaatgtagtccccttgtcgaaaacaaaaagggggggaggagg

SEQ ID NO: 5164 - DNA, 809 bp, Zea mays
actcctatgggcgattgggaccctcgaggccggccagggaaccgatccggtttaaaagatccgctactagtgtcaccggcaacgtgtcgacgcggtcgtgtcgtgtgtgttcctggtgaggaagcgaaccctgcctgcctgcttgcttgccgggcaagaagtgagaacagcgtggggtgcggaagcgaccggaccgaggatggctacaagaaggaccgtggcggcgagcgttactgcccaccagcctgcgtgggcggccgtggcgaggaggatggagggcgtgtcgcgctacttcagcgacaaggcctccggcagggtgctcagcgaggaggagcgcgccgccgagaacgtctacatacagaagatggagcgggagaagctggagaaactgaggaggaaggaggacaaggccaaggccgaggcggccaagagggccgccgccgccgccagaggcgacacgaagaatggtgaggaggctcatccgagctgatcatcgccaaaatcggaccagtgctcccgtgaatcgtgtgatgctgcactactgatgacacgtagatgcaaatagacgccgtcgtactactctgctttgcaactctgctcgtcgtgtcgtgtgtgatcccatccctgtcactgttgtgaacttcgcttgtagctagcgacggttttgccttgtcccttgtcggtgcaaatgtaatggagtggaggcgtccttgagcctctttcatgtacataataatgaataaatgtagtcccctcgtcgaaaacaaaaaaaaaaaaggctcccagaagagtggacgtctcgctttact

SEQ ID NO: 5165 - DNA, 1055 bp, Zea mays
tgcagcgtattttttacgacaaggatgaaccacaatatatctatgaatagtatcttccacttcctagatcctcaggtgctaaggctatatatagtccccgaggggccggccgcgtcaggcgcgcctctttctatcacacaaatttgggtgagcaaattcatccaagtctatacacatcgatctacaacaagttgcagaatggaaagaacactggtcacttctaacctctccatgagtgcacatgcttcaagatcgtcccggagggttcactacatctctcctgcggcctctgctgctgcacaaaactccagctacaggaagaagaagaacgccccgtctccgccgccgtcggccgccgcaactgacaccgttgtcatctcccctcctgccactgacaatgttcagtccactgctccgaagcaggccgggcgacaggagcttgaagagctcgtggccgccaagactaacacttcaagaattgctactgcaagaacaagccagtctcgggctaagcttcgccgccggcctgccccggcagccacgtccctgccgatggcgttctgcagcgcgctggaggaggcgatcaacacgttcgtcgacccgccggcgctgcggccgtccgtggacccgcggaacgtgctgtcgaccaacttcgcgccagtggacgagctgccgccgacgccctgccccgtcgtgcgcggcgccatcccgcgctgcctcgccgggggcgcctacatccgcaacgggcccaacccgcagcacctcccccgtgggccgcaccacctcttcgacggcgacggcatgctgcactcgctcctcctcccgacggcggggtccccgccgtcgtcggaccccgtcctctgctcgcgctacgtgcagacgtacaagtacctcgtggagcgtgacgcgggagcgccggtcatgccgaacgtcttctcgggtttccacggcgtggccggcctggcgcgcggcgccgtcgtggcggccagagtgctcaccgggcagatgaacccagccgagggcgtggggctcgctaacaccagcctcgcttcttc

SEQ ID NO: 5166 - DNA, 1002 bp, Zea mays
  misc_feature (992)..(992): n is a, c, g, or t
tcgcgggtcgacccacgcgtccgcccacgcgtcctcggacgcgcagattgcgctgctccataattacttgtgctctaagccttgatccaaatccacacacattgatctaaaggccaggttgcagaatggagagaacactgatcacctctaacctctgcttgagtgcacacgcttcaagatcgtcccggagggttcactacatccctccttccgcctctgctgctgcacacaactccagctacaggaagaagagtgccccgtctctgccgccgtcggccgccgcatctgccactgttgtcaccgcccctccgtccactgacaatgtccagtccactgctccgaaacagaccgggcgacaggagctggaagatctcgtgtccgccaagaccagcacttcaagaaccgcacgtgcgccgagccaggctcgggctcgggctgagcctcgccgccggcctgccccggcagccacgtccctgccgatggcgttctgcagcgcgctggaggaggcgatcaacacgttcgtcgaccctccggcgctgcggccgtccgtggacccccggaacgtgctgtcgaccaacttcgcgccagtggacgagctgccgccgacgccctgccccgtcgtgcgcggcgccatcccgcgctgcctcgccgggggcgcctacatccgcaacgggcccaacccgcagcacctcccccgtgggccgcaccacctcttcgacggcgacggcatgctgcactcgctcctcctcccgacggcggggtccccgccgtcgtcggaccccgtcctctgctcgcgctacgtgcagacgtacaagtacctcgtccccccccccccgggagcgccggtcatgccgaaagtcataaaagggtttccacggcgtggccggcctggcgcgcggcgccgtcgtggcggccagagtgcccccccggcagatgaacccagccgagcgctggggctcgctaacaccagcctcgcctcttcgggggccgtntagaggacca

SEQ ID NO: 5167 - DNA, 2502 bp, Zea mays
gacagcgggccccaaaatccacgtccaaaatgaatgctgatgtatgactggaaatccacccaggtgcacatgtgctgcttttcccattagaaggccaggatatgacagttaagacctctttgtttgtgactaattatgtctcactttgtctaagattaatcgttcgaatcgaataaataatattaaacaggaaacttaatcaaaacgtgccaaattaggtagcaaaccaaacaagcctggattttattttaaaatataagattctaccaccaaaagcatacttcaacagggactatattttactaaaattcatcaaatcattatatggcttggcctctcgagtactaaatatagtacccatctaccgaagctctatcctcgtttgtatactatttctattttttttatttcctaaataacatgatttatttactaataatgatatatgcctcaattgttgtagctgcaaatgttttttggccctaaactctttaaatcaaatcttatttcaattttgaggactcaaatatagaacttattttagagatgctctcaaaccttggtaaatcaacaagaggaatgtacctaagtttctgttcgtgtcattttgtttatggaaatagccgaagttggggctatatgcctatatcattgttacaaagaataattgtcctgccatagagaatataaatgatactgtactaattagggacggaatgaaacatttagatcgttggccaaatgtttcattcacgatttgtttgatcgcttaattaactttagttcaagtgacgattattgcatacattttatactgattatatagatgcaatctgtaactttcagttccaaaaaaaatcatatgaaacaaaattatgacccaagaaattttgatttgtgttggtacaaagacaattgttatggaagaaagataaatcatagattataaattaaatatgacagacagataaatcataggttctaaaatcaacaatttaattataacaacctaaaattattaaaaaccaggcacataaatatatagaagtgtaaaacaaaacacacatgtgtgtaactttaaatatactatccagatgtccgtgcattgggtttctatatattatacaggtaaactttattttattaaaacacaaacatatttttgttaggtaggtcgaatgagaagccaacaactaaggtgtgaatttctatttatacataattttgatttatttttgtataaagcaggaagggcaagggtgactgtagaaccgtgtggaaactgatgttttttacactagagcttttgatttgtttgctttaatttttttttcctttacacatgcctttttcaacatataaaatgtagcactccaaaatgtctccgagtcccaaaatatatatgcgctttctgcagcgtattttcacgacaaggatgaaccacaatatctatctatctatgaatagtatcttccacttcctagatcctcaggtgctaaggctatatatagtcacatatatatgccacatcagaagcgcttctttctatcacacaaatttggtgagcagattcatccaagtctatacacatcgatctacaacaagttgcagaatggaaagaacactgatcacttctaacctctccatgagtgcacatgcttcaagatcgtcccggagggttcactacatctctcctgcggcctctgctgctgcacacaactccagctacaggaagaagaagaagaacgccccgtctccgccgccgtcggccgccgcaactgacaccgttgtcatctcccctcctgccactgacaatgttcagtccactgctccgaagcaggccggccgacaggagcttgaagagctcgtggccgccaagactaacacttcaagaattgctactgcaagaacaagtgcgtcgagccagtctcgggctaagcttcgccgccggcctgccccggcaatcacgtccctgccgatggcgttctgcagcgcgttggaggaggcgatcaacacgttcgtcgacccgccggtgctgcgaccgtccgtggacccgcggaacgtgctgtcgaccaacttcgcgccagtggacgagctgccgccgacgccctgccccgtcgtgcgcggcgcaatcccgcgctgcctcgccggaggggcctacatccggaacgggcccaacccccagcacctcccgcgtgggccgcaccacctcttcgacggcgacggcatgctgcactcgctcctcctcccgacggcggagtcgccgtcgtcggaccccgtcctgtgctcgcgctacgtgcagacgtacaagtacctcgtggagcgcgacgcaggagcgccggtcatgccgaacgtcttctccggattccacggcgtggctgggctggcgcgcggcgccgtcgtggcggccagagtactcactgggcagatgaacccagccgagggcgtggggctcgctaacaccagcctcgtcttcttcggcggccgccgacatatgagctc

SEQ ID NO: 5168 - DNA, 3374 bp, Zea mays
gctgcgcctcacaaaccgcacacattattgggtgccacggcccaaaccggcgggtattattggccgccacaaaccaacgcatgtggcatgtgtcctgccgatcggacggctgggcgcgctcggccccgcggatccaacggcaaggaaaggaaaccccatcagccgtcagcggctgccggctagcgccccactccgaacaagatagagccagccgcagctataacattgcgcgccacccccccggccggggtgtgtgtgtgtgaccgtgcgtgaggcgtgagtccgtgaccattcccgtcggccgtcccaaaagaagcggaaatttacaacccagtccaccacgggccacacaatccccaaatctaacccctccgacggcgatggggatctcgagcatgccggagccgcgggacagcctgctggggtacctggtgtacaacacggtgatctcgatcgcggcgctggcggggctggtgcgggcggcgctggtgttcctggacctgcaggccgcgctgccgcccggggacgacggcggggaccgactggcggcgtcggcgcccggcctggcggagcggttcctcagggccttccggccggcgctgtacgaggtgctggcgtcgacggcgacgacgtgcgaggcggacggcggcggcggcggcgacgactgcagcgtgtgcctggccgggttccgggcgagggccgtggtgaaccgcctcccctgcggccacctcttccaccgcgcctgcctcgagacctggctccggtacgagcgcgccacgtgcccgctctgccgcgcccacgtgcccctccccgccgacgagacgccgctgctccgctacccggagttcgagtgatccggtaaaaacccaccccggtcgcgtcgcgcctcggctgtgtgctgcacgttccgtgtggccttccgtgtacgcgtagcaaaccaaagaagaagaaaaaaaaggtgtaggagcagtagtagtagtgcagggttgctgtcgcttgctttcccctttcgcttcttgtattccccctccctcccattctctttgctgtttccgttccgtgctgtagcctgtagcgtgtaaatactccggttcgcacttggcagcagaggcagagtgtagagtgctcccgtggccgtggctgatggtgtagcactttttacgagctcagctcgtgtagtacattgcatccttcttcctattcaaaaaacccccgactggctcggccatcgaggactgttttggaattggaacggttgtatgtgtgcgtgcagtgcatactgtaataataactccacagcaaaaattacagcaaaatctgcagaattcatgtgcgaaacacgaaggcatcttctacgtacgggtgttccgattcgttgaaaggcacggattggttgggcgtttgcttagacggggctgcgacaggtcacatggacgacggcgtggtggagcggtacgtgcgtgggccccggcgtcgccgatggcacatgcggtcctcgcacccgaaaggaacctcgcgagcgtgcgtgcagtgcaccaggccaggcatcggaatggatcaagaccaaccgtactgcacgtctgcaccggaagccggaagggatgaacatgaaccccggaaaagaggcgtcacagtcacagcagcatggcggcagaggcacgatacacgacaggagaagcaccatagctacaagagcacaggtgcgttggatgaggacgcgcagtagccgccagttctcatccgatccacggtacggggggcatggcttttgtcgcatcgcgccgcgcgaggatttgcctccgatccttcgggcttcggggtgaagtcgaaccggtgcgccgaccgcggacgcggagtgagtgagcgagcgcatgtccttgttgtcgctcgcacaccaccgtccaacagcacgcagtacgcgactgcgagcagcaagtttgttgcgacgtcggcttcagaccagaacgtcgcgttgtgcaggcaggcaggcaggcatgtcatcagcgcctggcttggcttctccactccacccagccagcgtcatctgataaggcttggccggctggcctcgtccgactacgacagacgaagcaagcaaagcaaacgcgcgtttttgcctgtggacttttggagtgtagacacacgccgcacgcacgcacagtaagcagctggagataaacgtggttcgagctggacgggaggcccccgagcaggaccgtctcgcgtcgacacgacacggcttgactcctgagcttgtgttgtgctttggtaaccgccgatcgtctgcttgctcacactcacacagcggcggccgcgcgtctccccactggcagtgggaacatggcaacgcaatcggtgctgttttgccccccatgtcgaccatcagggagggttgaaacaggcaaacaccattactgtacgattcacggccgcgcccgcatccgcaccgcggcacgggtgtgtttctgctttcgacaccacgccatcgccatggcggccggacaggcagttgcgcagtcgcacatgagctcctgttggggataataaaatggataaggatataagagggccaccccacacgcacatcatcggctcgccggacaggacgagcagacgatacgtaggagtaacgtgctacaatggctcaaatcatcgaaagatgatgacgggatgatctggcctgccagtccgattcacgtggcgcggttcgatggtcggtcaccgccaagccaggccgtgagaagctcgcgagaaggaagaaacaaagggccgtgtgtccaatccatccagggtacggctctgtgtggtttctgtgcgcacggatgcgatgcgggtgagaatttcatttcctattactcacgggtcactgttggggtagaaggacattctatctgtaagtgagaagctcgctagagggaagaaataaaagatcgtgtgcaacagttaacttatatggtcatttaaaatattatttagactatattatttgtatattggagtttgaatataagtatagaggtggataaactgctagagatagctttaagtagttaataaattattagctgattttagcttggttaaagcaactaacaactatgagcatggatactatgagcatggatggacgatgtgtgaacctgcgcacggctaaataggtagagcatggattttttccccagtagaaacatgcgacactacagtaatctactaatctggttgagatctctcccatattcgacattcttctatgttttattttggtatagcaatgttcataaggcctttcactatactaaaatagtaaactttctagagcttaaactataggaagttagccctaaactctagaaagtttggctctagaagaagct

SEQ ID NO: 5169 - DNA, 730 bp, Zea mays
cctcgaggccggccgggatcgcgggcataaactaatccggccggctgcggctgcagctactcatcggcaaagctgcagtataaattcaggggagctccatcgacgagtgagctccctgggggaccaggctgggagagcccccccgtcaggccccctcctcctcctggtctcctctcttctatccgagctcggcattcagggctactacacctgcttacatccatcgttcatgcatggtgcatacaatggtatgcgcatatgcactgcattgttcgttcaaaataaataagtagaccatgcaactgctacatacacagtggaaaggtttttgatcgagaggcaacgcaattgcaatggtgatcaggatacaagcagggtgtgctcgaggtcgatcgtgcatcatggccgcatgcatgcatgggagatgcagcaggcgttggcgtcgtctgtcgccacagcttggatagcggaaccaaaaataagggtcatgtggctagcagcttctgtttattttcactttcttcgttcatcgcatgctcttgttgttcactgttgtactatctagtagttctctttatctggtgcttccaatctaactagacgcttccttgtcgtgacatttttttttctttcaaaggtcgatgtcttcgtcatgaatgctttgtactctgcgtatatcggtatgcagttgtacgtgccctttatcaaaaaaaaaaaaaaaaaagcggcc

SEQ ID NO: 5170 - DNA, 3879 bp, Zea mays
  misc_feature (326)..(326): n is a, c, g, or t
gagagccattgaccatgttctttttttaggctatgtgcatcttattgttgcagaggttaggagatgatttgtatcaaacttttaaatgcaatgaaaatcttccttaacggaaaaagagtgaattcttactacattgatcattgccgaccttgctcagttgatctggagcgaatcctaccacaatgctgctacttactagtcattgcgctatgattttttgacctactcaagctatgattgaactattgaatatattgacacgcactacttgttcttgatctgcattgctgtagaatatggtgacctgttgcatttcatttttccantgttttgaactcttgttgttcaaagatttccaaatatagtgacctgttgcatttcttttctgcagtgctttgaggttgatatggccggctgagaagttgagaaatgaggaagaaattatttatctattgaagaactcatagacaaattactcatagacaatcgaatagatagtctattgtacaagctgtctatttatctatatgtgtattagatttaaagaaacttacaaacaacctcctgtctatggatggtacgtgccccggggcttcatctcgtcccagagacctgctcagggaaagcgtctccaataagtaggggtgaaaacgggcggatacggacggatattagctcatcctgtatcctaccctaatgtatttaaaacggattcgggatcggatacggatagttagaaatgggacggatacggatacagggaccgaatatttatccgggcggataagtgacagatacagatattatttgatcggatatcggatacttgtcggataatgcattaattggttatcaaaaaatattcttgttcgaccacgaaattgcaagtaaattaatactaataagcatttaatagaagataatctcaagttcccacgtaaaaatggtaaagtgaagtattgattatgttgaaacttggatacttagagtgatttcacgtgtaactcacgcaataagtggaaataaaatagaagaaacgttgacatcctgtggattttatggtcccattattttttatgactatatatggccatatgttgtaccttcgtataatttcatagatttctgaggctatttatacattattaatttctttctacagcagtgcttccaacgctgagtacgcggcataaatacactagttttgatccaaaattgcaaaaagcttaccaaaacaaataaacattctattcaaataaaacctcaagtcgccacatgaaaatgataagtgaaatattaattatgttgaaacttcgatacataaaatgatttcacatgtaactcacgcaataagtgggagtagaatggaagaaacaccaacatcttgtggattttatagtccaaatgtttttgagaactatatgtggatatatgttgtgtccccgtaaaaattcatgaattttttaggctatttggtgtattattaatttcttgttgtagaaaatcatcaaaatacaattaaactcataaaaatattgtagcgtcgaccggaaattgcaaataagttaccaatattaataaatagtttataaaaagataatcctaagttcccacatggagataatcttaagtccccacatgaaaatgataaagtctattattttgatataaatttagacattacttcaatgattttggcctaaagatatgtttaaacaaaaatgtgttgtactacaaagttatagatctcttcgagctctacaattttcatataaactttatcttcatccgatttcatatgtaaaagttatgattttataactatactattatgcagaaaaagaaaaaacgggtatccgaattccgggtacccgtatccgacccgaatatccggttatttactgggtagtactcgctccgtatccgacccgaatccgaatctgtactatccgggtattacctgtatccatctcgaatataaaaaatactcgtatccgtatccgaaaaataattccgaatcagtatccgtatccggtacccgtttcggatactctacctgttttcaccactacccgcggcaactttcttcaggaaaaacccgcggcaaaattttccgccataaagtgcacgcacggcgccgcagctaatccatcactagtcagtgaccggtagtccacaactccacactcccctgctggcgctcgcaccggcagtgcagatgctagcagaggatgagctcttccgggaccgggacgatcgtgagggccaccgacgccgagcccccggcgccgccccccgcttcccgaacagggcgtcctactacgtgccgagccaggaccgcgccatcccgcgccgcctggccgtcgccagggaggaaaacaccaagctccgggacactcggttcccctcgcacagcccgcagccgagcgacatcatcttcgacgtcgtcgcagcccgccgcgacgaccggttcagcgccgccgcgccggagctcaagctgcggcccatcctcacgaggcggccgccgcccaggcccgacgccgccggcgacggcggcagcaacgcggccgcgtcgccgacgggaagggcgcgcccaccacggttccgcctccacgccgcgaagggcgggccgccgctgccgccgccggaccagcacaggcggaacaaggcggagggaggctgcacccggcggctgcggcgtggcagccggctccagtgggtgtacgagagcctggtggtggtgaaggagtcggcggaccccgaggaggacttcctggagagcatggcggagatggtcgctgccaacggcgtgcggtcgccgcggggcctagaagagctccttgcctgctacctcgcgcttaacgctgctgaccaccaccgcgccatcgtcgttgcgttccgccgcgcgtggctgcacctgcacctccacctgcgccgcgtgccgccaccgccgtcgttgtagattagctctagcttctagctagccatcttttcttcggtctcgaactcactagcgatcgctgcacggagctagacgcaaagatcgcgatgtgcctgctctgttgtacagtgcgtgtatgtatgatgattcggggacgcgcgcgttcatgtgaattgtggtgtgcgtgctacggttatgaattatgaccacacttgtcgtcaaaaaaaaaaaaaaaatcaattcgtgtgtgtgtttttttagcttggctcttgtttggttcttgttgatgatggtgtgatgctgcaagcctgcgtaaagctgaaggatcgatcgatcgtcctgtgcgttgtcactggggtgtcacatgcatttcagtttcggtctttctttcaggaaagggtgtacggtctttagtctttacggaggctgctcaacttgctagccagagcatatttaagttgagcatccactctttacttttaggtaattgcttagttttaaaagtaaattaatttttaaagcaactactaaatgaataatgaataaatcatacgtggcaaataaaagcttgtttgcatagtagattaaatctacccagaactcatctagcaataacaagagccatgaactcattattactcacaacagagattggtctagccggactaaagacgagttcacggttttaatgaagtccataaaagttgcaacacaaatcaattcgggagcaatcgtgtgatcgctatctaaaaacatgattcacaccaacccatcgtcgtcgttacaccgatgactctcttatctaaaatcttaacccatagtagatacaaaattgtttctcatcctttacgaggataataccctctctattataggggaggattaggcttacggtaaccacgcgtaaaatgttataaactaaaatcgacttagttatg

SEQ ID NO: 5171 - DNA, 811 bp, Zea mays
ccggccggcccccccccccacttcgcctgtgtgtgtctgtctgtccatccatccatccatcccgctgccagtcctcgcgccggccaccccgaaataatcggaaattgcaacccggtccacgggtcggatcccccaaaccgacgaaccctcccgagctcgcccggcgatggggatctcgagcatgccggagccgcgggacagcctgctggggtacctggtgtacaacgcggtggtgtcgatcgcggcgctggcggggctggtgcgggcggcgctggtgttcctggacctgcaggccgcgcagctgcccgggggcgcgggcgcgggcgcggacgacgaccgtctcgcggcgtcgggccccggcctgggcctggcggagcggttcctgagggccttccggccggcgctgtacggggtgctggtgtccacggcgtgcggcgcggcggcggcgccccggtgctccgctacccggagctcgagtgatccgggcctcggcggccgtcgcgcgcctcggctgtgtgctgcaagctccgtgtggccttccgtgtgcgcgtagcaaaaggaaaaaaggagtataggagcggtagtagtagagttgctgttgctttccctttctcgttttgtgttttgcggttgccctgcccccatgctcttgttgtttccgcgctgtcgctgtagcgtgtaaatactccggttcgcccttggcagcagagagtagtagagtgctcccgtggctgggccgatggtgtagcaccttttacgagctcagctcgtgtgtgtacatttgcatgctttcaattcagtttcccgagcc

SEQ ID NO: 5172 - DNA, 4940 bp, Zea mays
  misc_feature (3330)..(3330): n is a, c, g, or t
atcttaagtcaccacatgaaaatgataaagtctattattttgatataaatttagacattatttcaatgattttggcctaaaaatatgtttaaacaaaaatgtgttgtactacaaagttatagatctcttcgagctctacaattttcatataaactttatcttcatccgatttcatatgtaaaagttatgattttataactatattattatgcagaaaaagaaaaaacgggtagtactcgttccgtatccgacccgaacccgaagctgtactattcgggcattatccgtattcgtcccgaatataaaaatatccgtatctgtatccgaaaaatggtcccgaatcagtacccgtatccggtacccgttttgggtatgctgcctgttttcacccctaccggggagggcattgatggacaggcagtttagccctgttcgtctcgtctcgtggatggagccatgctgggcttgaggggcctggggccggccgggacgacgacatcgacacgtgcggcgcgctgtccagattgcagaggcgctcggctcagacgccgccgctgccgctgccgctgcccgtgccccggctgctcctgctcggtacggttgtcgccgtacgcggtgcgcccgcccgtgtgccctgcttgcgactgcgactgcgaggacgtcgtcagcgcgtgcgtgcaagtgcatgcatgcatggcggggtggggtgggggacacgctgcacggtaaagctagcgagatctctcaaatctaccgtcgccgccggccgcgacgctcacgtacgttttccgccatggtgcatgcatggggcgttatcagcagccaggtgcagagattctccagatatgaaacgatggtaatgctgcccgttgcccgtgccgcgtggcatggcatgcaatgcagcacacagggcgccacacggatggacgtcggcatcgctcgccgcactactggacatgcactgcacacgtccatttacgagcacatgggtgctctcgcagtcgcaggcagcaggggctcttgtcgtcgaacgttttcacgtgcgtcctgtgatgaactgatgatgaggctcgtcaggctgacaccgtgtgtttggttcgtgaattgtgactgccgctgctctgcagtgttgggtccgtccgcctaggcacatcagcactgctcctactcctgctcctgtcaccttcaaagttcagatggccgcccatatatataatcgcagtcgcagcgcttaataacttgggtaaagtagctagtagttctgtaaaatggcaagcgatgatccagctcgcctcgatcgatgcatgattgtagccacactagccagcagctccagctctatgcatgttacgcacctagcactgaaattgaggcttgcacggaactactacatgctctagctactacgacatggcgcgtgcagggagattctccagtcttttcgcgccagtcgacaggcgtccaaggacaagccctttgcatgcaacacaacgctcagtcactccactgccagccctgccactccctatgcgcagcaggagcaaggcgcagcatgatcccaaagagtcagtcgacccagagctcaggggcatggcagcgccccatgcccatgccccaagctatgtagctagtcctgtggccgcgctggcccgtccctcactcccttgctatgtatgctattgctacccatccactatcgatcatcgcgggcataaactaatccggccggctgcggctgcagctactcatcggcaaagctgcagtataaattcaggggagctccatcgacgagtgagctccctgggggaccaggctgggagagcccccccgtcaggccccctcctcctcctggtctcctctcttctatccgagctcggcattcagggctactacacctgcttacatccatcgttcatgcatggtgcatacaatggtatgcgcatatgcactgcattgttcgttcagaataaataagtagaccatgcaactgctacatacacagtggaaaggtttttgatcgagaggcaacgcaattgcaatggtgatcaggtacggatttatctggacacatttagttccatgcatcatatatgcatcggttagcttcttcttcagtccaaatttctgtggtttattttctgcccatgcatgcgtctctgaacttcgttatgttctctgcgcgcgcgcgcgcgtgtatgtgatcgaaggatacaagcagggtgtgctcgaggtcgatcgtgcatcatggccgcatgcatgcatgggagatgcagcaggcgttggcgtcgtctgtcgccacagcttggatagcggaaccaaaaaaaaaaaagggtcatgtggctagcagcttctgtttattttcactttcttcgttcatcgcatgctcttgttgttcactgttgtactatctagtagttctctttatctggtgcctgcaatctaattctccgcttccttgtcgtgacatttttttttctttcaatggtcgatgtcttcgtcatgaatgctttgtactctgcgtatatcggtatgcagttgtacgtgccctttattaacacttccactgttctatatacttagacattaatagtgtgtttggtttgaggaatgaagtgatccatcttcttctcactcatcactttttatttggtttgtgaaataaaatgagttgatctatcaccaccatattcatcataataagccaataattagtatatacatcaggagtgggttgattccactaaaattgatagaatgaacttatgttgcatcacctcatgaagcatagagtgactccacaaaccaaacacaccataaaagcatcattacaccaagcgtatggttgatataaaaatagttgttagaacatatagagagggggggttcaactgataaagttgttattgtgaaagggtgtgtagccttagtaccatctttaggtcctgtctgtttatcctcaaaattctacaatccatattaataaataagttaagaggcaaacaaacagcatacattattagcataaattattaaagtggattatattatctaggtactcccaatatattgaaatagaagttgtttatgatatgattgtgcataccaatgagtggttaattagggtgacatttgtcatatttgcccatcttaaatagctctgcggctgtattatggacaaaaaaccatgcatcttgattcgttgtcacggttcaatgcacaagaggtcctaggattgactccctcccttctcaacatatgtttttttgcagcgtgctacatagaaaacaaagagttggaggggcaaagtcgtccaaataaagtactaacatncaaacctacacgtaatggcaggagcgctctgcctctcgattaagaagaatgtaatttatctagttttaaagaaaaccgagtctgaaacctacacatagtgcacgccagataagtcggcggaagacccaacaaataacctagacaatggcagccccctctccccccccacaaacttcatctagcgtcatcgttgcaagctcaacacaaggggcgagcaactctgacttctcaagtcggacaacacacgtccaaatgaactcaacgacgactacactcaaacaccggcacacaaggaggaagaccgcgacacgccatcgttaccaagcctcgacacgcctcacgcgagacatctgatctgattcttcacaatgagcaagtatccttatcgccgaacaccgggaacaagcaaacacctagagctacaaatgcccaggcaccatcgagccaagcggagcgacgaaaagcctccacaatgtcgacaaccccacaaattgaaggtcttctgggcagcgccttcgagaaggagaaacgacgccaaatcgccgtcaccactgcccgcctagaacataccaagcaaagttttctccgaagacccagtagagcagcggagatcgtcagcaccaaggagaaagttgcagggacagtcacattgatgtcatcctaccaagctgccgcgcgttgccaccttctgttgtctaccaacgcaccaacccaacaggctccaaccttaaagtctcgatgtcggccgagcagccagcgagaaaccacaagaaggctaaggtgaggacacccaaacgaagggtgaggggtccaaggacgatactctcaatagggtaggactggtgtccgcgcgtgtcaccgttgttcgcctgcaagcgggtatgactttcgctgaaggacctcccaccacacgtcaggatccagccggctccacccacaccaccggcgaaagggaagtggagagatggatctggctgaggaggctcaaaatccggtctccagtcaaccgaggagcgtggaccgaagccgaaccagcgaggacgccgccccatggccatgacccaccacttgctgctccgccacgtcgaactcgccattgccagctgcaggtccactgtcaggctaaggcccatgtggcccatgtccctgacccaacctccgcgccacgagcacgagcaagccgtgcaaccgccgccacagctgcgggccagccacactagatcaaacattgtttagtactctccattgttaagaaacagatcctaaatacatcctatggtaccatgttgtgtgtcttccgcttaaaatattgtgtagtggtgtgggttgtacacttgtaaatgccatcgattacatttgtgcgtgtccgtcgttcatctcttgcgcagcctatttgactccatgcacgacgtgatatataccttgatgagttttgaacgctctgccaatcagagagactatccagctagcgaagtgcgaacacgtacgtgttgatcttgtcgctagcttgtccacatgtcggccggtgagaatcgtagatgtccgctacgttgctgtgccaggaaacgctgcggtgacgaccactcgaccagtggctgatggttccgcag

SEQ ID NO: 5173 - DNA, 3191 bp, Zea mays
attggttttcctagtttttgtacataaacatttggcctatgcgttagtgtctctcacattatccgctatataacattacaattaagattcagctaaattctggtaatttgaaagcgacagaaataaaacttgtagatgaattattgtcttccataggtaacagtgaaaggatgaataacaaattaacaccagaaatctgaaaaacgaaataaaagtttaataagtgaagaaggatcgacaaggagaatgaataggaattaatctgtaccagagtgatgaaggatcgccgatagaatttgatgagaagaggcggcggcggcggagaggtctgtctgggctacgtacgtaggctcgtgggggcggctggattagccgaacggaagtcacgttcctcttttaatcgtacgaccactggctatttaatcggacggtcgtgcggccgttggacggctctgggtccaacgcgcgttggacgccccccgctccccctcctccagtcctcctctcgcttggacttggacgcgcgagctggctccgagattctgcccagttcttttcacgtttcggatgctccgtaaatgagtagtacgtataagcgacttgtgcaaattttggtccgggacagtgtgactacgcgagtaatggttcgggatccattccattattattgtagtgcttatgctagtagtacgtacttactccgtattattacgccgttcaaactgtcttgtgacgattcactgtcctgttcgtactaagctcgacggaccgttttccatcggactgaataattggatcccctgcgctgcgctgcgcctcacaaaccgcacacattattgggtgccacggcccaaaccggcgggtattattggccgccacaaaccaacgcttgtggcatgtgtcctgccgatcggacggctgggcgcgctcggccccgcggatccaacggcagggaaaggaaaccccatcagccgtcagcggctgccggctagcgccccactccgaacaagatagagccagccgcagctataaaaatgcacgccaccccccgcccggccggtgtgtgtgtgtgtgtgaccgtgcgtgaggcgtgagtccgtgaccattcccgtcggccgtcccaaaagaagcgcaaatttacaacccagtccaccacgggccacacaatcccaaatctaaccctccgacggcgatggggatctcgagcatgccggagccgcgggacagcctgctggggtacctggtgtacaacacggtgatctcgatcgcggcgctggcggggctggtgcgggcggcgctggtgttcctggacctgcaggccgcgctgccgcccggggacgacggcggggaccgactggcggcgtcgggcccgggactggcggagcggttcctcagggccttccggccggcgctgtacgaggtgctggcgtcgacggcgacgacgtgcgaggcggacggcggcgccgacggcgacgactgcagcgtgtgcctggccgggttccgggcgagggccgtggtgaaccgcctcccctgcggccacctcttccaccgcgcctgcctcgagacctggctccggtacgagcgcgccacgtgcccgctctgccgcgcccacgtgcccctccccgccgacgagacgccgctgctccgctacccggagttcgagtgatccggtcggtaaaaactaccaccccggtcccccaccccacccaccccccggcgagcggtgagcggtgacccccggtcgcgcgcgcctcggctgtgtgctgcaagttccgtgtggccttccgtgtacgcgtagcaaaccaaagaagaagaaaaaaaaaaggtgtaggagcagtagtagtggtgtagggttgctgtcgcttgcttattgctttcccctttcgcttcttgtattccccctcccattctctttgcgttttccgttccgtgctgtcgcctgtagcgtgtaaatactccggttcgcacttggcagcagaggcagagtgtagagtgctcccgtggccgccgtggctgtggctgatggtgtagcactttttacgagctcagctcgtgtagtacattgcatcctccttctgttcaattctcccgactggctaaaatatcgaggattgttttggaattggaacggttgtgtgtgcgtgcagtgcatactgtaataataactccacagcaaaaattacagcaaaatctgcagaattcatgtgcgaaacacgaaggcatcttctacgtacgggtgttccgattcgttgaaaggcacggattggttgggcgtttgcttagacggggctgcgacaggtcacatggacgacggcgtggtggagtggtacgtgcgtgggccccggcgtcgccgatggcacatgcggtcctcgcacccgaaaggaacctcgcgagcgtgcgtgcagtgcaccaggccaggcatcggaatggatcaagaccaaccgtactgcacgtctgcaccggaagccggaagggatgaacatgaaccccggaaaagaggcgtcacagtcacagcagcatggcggcagaggcacgatacacgacaggagaagcaccatagctacaagagcacaggtgcgttggatgaggacgcgcagtagccgccagttctcatccgatccacggtacgggggcatggcttttgtcgcatcgcgccgcgcgaggatttgcctccttcggccttcggggtgaagtcgaaccggtgcgccgaccgcggagtgagtgagcgagtgagcgagcgagcgcaggtccttgttgtcgctcgcacaccaccgtccaacagcacgcagtacgcgactgcgagcagcaagtttgttgcgacgtcggcttcagaccagaacgtcgcgttgtgcaggcaggcaggcaggcatatcatcagcgcctggcttggcttctccactccacccagccagcgtcatctgataaagcttggccggctggcctcgtccgacagacgaagcaagcaaagcaaacgcgcgttttttgcctgtgtggactttggagtgtagacacgccgcacgcagtcacgagcacgcacacgcacagtaagcagctggagataaacgtggttcgagttggatgggatcggaggcccccaagcaggaacgcatctcctgtctcgcgtcgacacgacacggcttgactcttgagcttgtgttgtgctttggtaaccgatcgtctgcttgctcagc

SEQ ID NO: 5174 - DNA, 3465 bp, Zea mays
agcttatctccgacggcctcgtacagggccgtcggagataagaaggccgtcggacgtgtctccgtttactgtagtgtgctcactatctttgtgagtttaccaaccggtgagcgtttgagaacttgtagcgaacgatttcggaggtggctccccaatcaagtcaagctggtgggctggtggccaagctcagatgcaacgggagatttgggttgcacgtacgtacgtggtaatagtagcgccgagcaaggctagcagcccgtccttgctcctggttccgatccggtcgccaatgattttctcggcgccgatcatgacagcccccgctggccgcggcctttgctagtttgcatctaacaatttttataactactgtttttccattttcttagttgtgaagactagtattcttttgaggaatatatgagtctgcgtgaaggtaaaggtatttaagactagtgttattctaccgcaccattattatgttcttgttgaatctgaactcttagtttcatacgagtgtatatctaatctattgcaacttattgaaagaaaatgctgtctttcttggagtgtgttcaggctcttgcttacatgattaagcaacatttgttattgaaaaaaaaactgttggagcgttaagtacatctaactaactaggctatacaaaatcattaaatcattatacgttatgcgaacaatagttttttttttccatacatgtcgacgccagctcaaatggaaatggtaaaccaaacatcttagagccattacgtgttaacctgacgtcatgatctacgacgtcgactttaatctctcgagaatctgaacgtgattttttttaaaaaaaggttaaaataaaaaaaaaaccgttcggtttttacgcgctttgtttcgtcaccgcgatggctcgtcgtcgtcgcgcacggagcgatcgccgtccgggccctgcctacctagcgtcccactagtcgcagcagcagcagcagcgcccgcagcgtctgagactctgagtggacgttcgtcggggaggcgggcggccacgcttccaaccaagttggtgccgccccgatcgcgacccctcgctggctgcggacgtgcgcgcgtcgtgtctgcccgcggtcatcaattcatcctcttgcttggacgctgcgtccgataccgagattcttctcaacttttttccacgttccggatgctctgtgaatccgtcagtacgtatagtgctcctctgagtactaactttggtgcttatcatggtgtttaaatagttgagatggtcgatgcgtagcggattttccggaggacactgtcttgtgacgatccactgtgctgtgctcttggtactatagctcgacagaccggtttggatcggcctgaataattggattcccctgcgccgcgcctggcctcacgaaccgcacgcattattgggcaaagcggcgggcatattattgggcgccacgaacctacgcatgtggcatgtctcccgccgatcggacggccaggcgcgctcggccgcgcggatccaacggcagaggaaggaaggaggcaccagccgtcagcggctagcggctccccgagcaagatatagccagccgccgcgtcgccggcccgcgcgctacccgccccacccaccgctccccctcctccactcgcctgtgtgtgtctgtctgtccatccatccatcccgctgccagtcctcgcgccgcccaccccgaaataaccggaaattgcaacccggtccacgggtcggatcccccaaaccgaaccctcccgagctcgcccggcgatggggatctcgagcatgccggagccgcgggacagcctgctggggtacctggtgtacaacgcggtggtgtcgatcgcggcgctggcggggctggtgcgggcggcgctggtgttcctggacctgcaggccgcgcagctgcccgggggcgcgggcgcgggtgcggacgacgacggcggggaccgtctcgcggcgtcgggcccgggcctgggcctggcggagcggttcctgagggccttccggccggcgctgtacggggtgctggtgtccacggcgtgcggcgcggcggaggcggccgcgggcgacgacgactgcagcgtgtgcctggccgggttcgaggcggaggccgtggtgaaccggctcccctgcggccacctcttccaccgcgcctgcctcgagacctggctccggtacgagcgcgccacgtgcccgctctgccgcgcccacgtgcccctccccgccgacgagacgccggtgctccgctacccggagctcgagtgatccgggcctcggcggccgtcgcgcgcctcggctgtgtgctgcaagctccgtgtggccttccgtgtgcgcgtagcaaaaggaaaaaaaggagtataggagcggtagtagtagagttgctgttgctttccctttctcgttttgtgttttgcggttgccctgcccccatgctcttgttgtttccgcgctgtcgctgtagcgtgtaaatactccggttcgcccttggcagcagagagtagtagagtgctcccgtggctgggccgatggtgtagcaccttttacgagctcagctcgtgtgtgtacatttgcatgctttcaattccaatttcccgagacaaaatatcgaggacaaaaaccgaaagcccccgcacacgacctcgttagcagaaacatctcatggcttgctcggttattttcgtcccctatagatatcccctatagcctataagctgaagggaattgatatgaattatgagagattttaaattacttggaattaaaaccgacaaaatctcctcaatctatatagattgggttaagggcttaatttgtttacatctggatcgaaatggattaaatccctccggtagttaaaaattgaatagaagggatttaatcctgttcttaagcaaccgaacgaacgaaaagggaagcgacgggcgatccgattcgttgagtgcgcgagaaggggggaacggggacggggggacagcgcgctgaaaggcactgaaggttgggcgtttgtttaggcgggcggggcaggggcaggggcaggtcacatggacgacggcgtggtggagtacgtgcgcgggccccgcgtcgccgatggcacatgcggtcctcgtccctgaaaggaacgtcgcgtcgcaaccctcgcaagcgtgcatgcaccaggccaggcacgggaaggaagggaccaagatcagctgcaatgcaccggaagggatgatgaaccctagaaaagagagggagagaaagagagtcacattaggaaggcggcagaggcaagatacacgacgggaagcaccaccgggctagagcgcagtatccgccggcgagtcaatccccggtatggggtcatgacgtgcgtgcgccaccggtaccgtaccccgagtgagtgagcagatcacacaggggtcgtccttgtcgctcgcacaccaccgtccaacgccaagcagcag

SEQ ID NO: 5175 - DNA, 1770 bp, Zea mays
cattgggtacctccaggccggcccgcgaggccggccggaaaggctcccccttccacgaacaaacacttgcacctcctcgtccccacctccgtcctcgtcgatcccatccacccccagcgctcctcctcgccggcgggcttgctgggtctcgcgatcgtcctcctcctcggctgtgccttctggggcggcggcggcaggaattaggtaagtggaggcaagggaaggggaggtttgaggtagagcggagccgcagcggcgatgccgtcgcacgcggatctggaccaccagatctcgcagctgcgggattgcaagttcctgccggaggtggaggtcaagacgctatgcgagaaggcaaaggcgatcctcatggaggagtggaacgtacagcccgtgcgctgccccgtcactgtgtgcggcgacatccacggccagttctacgacctcatcgagctcttccgcatcggcggcgatgcgccagacaccaactacctctttatgggcgattacgtcgaccgtggctactactctgtggagactgtgtcgttgttagtggctctaaaagtacgttatagagacagaatcacaatattgagaggaaatcatgagagcagacaaataactcaagtgtatggcttctatgatgaatgcttgcggaaatatggaaatgcaaatgtgtggaagtactttacagacttgtttgattatttgcctctcacagctcttatagaaaaccagatcttctgcctacatggtggtctctctccatcactggatacattggataatatccgcgcccttgatcgcatacaagaggtcccacatgaaggacctatgtgtgatcttttgtggtctgacccagatgaccgatgtgggtggggaatttcaccaaggggtgctggatacacatttggccaagatattgcacaacaattcaaccatacaaatgggctaagtcttatttcaagggcacatcaacttgtaatggaaggcttcaattggtgtcaggataagaacgttgtgacagtgttcagcgcgcctaactactgctaccgatgcggaaacatggctgccatcctcgaaattggcgagaacatggatcagaacttcctccaattcgacccagctccgaggcaaattgagccggacatgacgcgcaagacaccagactactttttgtagaaaaaacaggtgtggctaaaaaaaaaagagaagagacgaggggaagatgcaggaaatggacccgatgttctgttgtgtctgtattgtgatgccttgctaggtgagatttttcgtttctgttttgactcaacctggtcgttcaacctacgtcggctcatcgtcgaacgttgcccaggctgttaaagatgatttcactttttatgtgtagacatcgttgtacactaggcttttgcaatgctttcatataggacgtcactgtataaggtcagtcaccatgccgcgcccatgccaaccggacgaccggtgctaatgccatgctggatcgggatgagtaagcctgctttggcataagagttcagcaggccgatgaggacgtgggaggcgaaggtccgtgacgtttgaaagggagatggacgagattaaaaagatcgtaacttctaagaggtgaattatgaaagttagaactctttctaagttttggtagactgtttgttgttttggttattaatgacaacataagattattttaactaatgtatgttttgtacagataattgaagtcaggctaataataataccgattgtttaagc

SEQ ID NO: 5176 - DNA, 2064 bp, Zea mays
gtgggaatgatttttattggagtttgggcatgccatagtttataaaaatatgtgtggagatgaattcatagtcccaaagtttttgaggaagttttggtcacctgttagggctagtttgggaacctcattttcctaagagatttctatttttttcatgggaaaatgaactaatttcccttagactttgtttttcgctagtttatcctaattttttttgtaacatataggtctttctggagatctctatgggtacatttggttacaatgatagaacagaatgggatgagacgattcctcaaattaggttgtttggttctaagtcgagggttgggacatgactatcctaatgttgtcctctgttgtcccttaaaattagagggacgagagaggacactagaaaacgttcctatcctagctgacccgtaatcaaacgcataactctctacctggtaaggaggtttgcctttatttcataaaacaacacataaaactactataaccaaggactaaatcaccaaaaagaaaagccccaagccaaatcgaaaacaaataccaagacagcgaggaaaacaaaaattttaaagaaaagctccccccatccacgaacaaaagatcgcgaagcgagagggaatgatggaggcataggcactagcacctcctcgcctccacctccgtcctcttcgatcccgtccaatcccccgcgccccggcgcccctctccgccggcggctttgctgggtcccgcgctcctcctcctcctaggctgttctggttggggctgcggcggagggaactaggtaagggggaaggaaaggggaggtttgagggagagcgcagcggcagcggcagcagcgatgccatcgcacgcggatctggaccgccagatctcgcagctgcgggattgcaagttcctgcctgaggcggaggtcaaaacgctatgcgagcaggccaaggcgatcctcatggaggagtggaacgtgcagcccgtgcgttgccccgtcactgtctgcggcgacatccacggccagttctacgacctcatcgagctctttcgcatcggtggcgacgcgcccgacaccaactacctctttatgggcgactacgtcgaccgtggctactactcagtggagactgtgtccttattggtggctctaaaagtacgttatagagacagaatcacaatattgagaggaaatcatgagagtagacaaataactcaagtgtatggcttctatgatgaatgcttgcggaaatatggaaatgcaaatgtgtggaagtactttacagacttgtttgattatttgcctctcacagctcttatagaaaatcagatcttctgcctacatggtggtctctctccatcactggatactttggataatgtccgctcccttgatcgcatacaagaggtcccgcatgaaggacctatgtgtgatcttttgtggtctgacccggatgacagatgtggatggggaatttcaccaaggggtgctggatacacatttggccaagatattgcacaacaattcaaccatacaaatgggctaagtcttatttcaagagctcatcaacttgtaatggaagggttcaattggtgccaggataagaacgttgtgacagtgttcagcgcgcctaactattgctaccgatgcgggaacatggctgcgatcctcgaaattggcgagaacatggatcagaacttcctccaattcgacccagctccgcggcagattgagccggacatgacgcgcaagaccccagactactttttgtaatcagcatgctggctttctttcaacttgtctactgcagcgccagcacctgtagatctccttagaaaatggtgtttcctctagccgccttgtacccccatcattcttttggtgtggagattttattgccgcttctcagaacattgaggttgttgaaagtacatggcattgggtcttcctttttttttgccgtcttgtatctccattttgtatgattctgagacaaaagagaagagaagctgcaatagaattgtctcgaaatatattgtcccatccagaaaaaaaagtaaaag

SEQ ID NO: 5177 - DNA, 1539 bp, Zea mays
ccttgggtacctcgaggccggccggggctctgcacacctggaacaacgtgttcctcgtcccgagaagagtcgaggaaaaatctcgcattcgcaaaccaagcaaatggaggcatgagctccgccgcctccccgtctctcgccgatctcccccaaaccctagcctcgacctgaccgccagcgggcccgcaggccggagaaggagtcggagtcgcccccacccacccaccctctgccgcgggcggggagcgggcggcggacgagatgccgtcgcacggggatctggaccggcagatcgcgcagctgcgcgactgcaagtacctgcccgaggcggaggtcaaggtgctctgcgagcaggccaaggccatcctcatggaggaatggaacgtgcagcccgtgcgctgccccgtcaccgtctgcggcgacatccacggccagttctatgacctcatcgagctcttccgcatcggcggcgactctcccgacaccaactacctcttcatgggcgactacgtcgatcgtggctattattcagttgaaacggtttctctgttagtggctttgaaagtccgttacagagatagaattacaatacttcgaggaaatcatgagagcagacaaatcactcaagtgtacggcttctatgatgaatgcttaagaaaatatggaaatgcaaatgtatggaagtattttacagacttgtttgattatttgcctctcacagctcttatagaaaatcaggtcttctgtcttcatggaggcctctctccgtcattggacacattggataacattcgttctcttgatcgcatacaggaggtacctcatgaaggacccatgtgtgatcttttgtggtctgacccagatgaccgatgtgggtggggaatttcacccagaggagcaggttacacatttgggcaagacattgcacagcagttcaaccatacaaatggtctctctctcatttcaagggcccatcaacttgtaatggaaggatttaattggtgccaggataagaatgtagtcacagtcttcagtgcgcctaattactgttaccgctgtggtaacatggctgctattcttgaaatcggggaaaacatggaccagaacttccttcaattcaaccccgcacctcggcaaattgagccagacacaactcgcaaaaccccagactactttctgtaattgtggtggtgaccttaactttctggtgtttgatgctcctctcttccgcagcatcagggtatgtagatcttgtccttagatatgggtcccatgtgcccggccttaacgtctccctattcttttgtttggagattttgtttctgcttctcgatcttgatacaagatgttagaagttgaatgccagtgtatttttttcttcctgctgtacgtcgactttgtattatttgtagacagggaatggaggacgcagtaggaacgcccctgctatgcttttgctcatcacatcatccgcgtggctgaataaattgcgtccagatgcgaaggttttggtttgcagcttccccacccgtcgtgcct

SEQ ID NO: 5178 - DNA, 1470 bp, Zea mays
attgggaccccgagggacagatctcgcattcgcaaagcagacaaaacagcgtccccctccctctactaaaaaaaaaatggaggcatgagctccgcctcctcctcgtctctcgccgatctccccaaaccctagccccgacctgaccgccggcgggcccgccggccggagaaggagtcgctcccacccacccaacttctgcggcggaaggggagcgggcggcggacgagatgccgtcgcacggggatctggaccggcagatcgcgcagctgcgcgactgcaagtacctgcccgaggcggaggtcaaggcgctctgcgagcaggccaaggccatccttatggaggagtggaacgtgcagcccgtgcgctgtcctgtcaccgtctgtggcgacatccacggccagttctatgacctcatcgagctcttccgcatcggcggcgacgctcccgacaccaactacctcttcatgggcgactacgtcgatcgtggctactattcagtcgaaacagtttctctgttagtggctttgaaagtccgttacagagatagaattacaatacttagaggaaatcatgagagcagacaaatcactcaagtatatggcttctatgatgaatgcttaagaaaatatggaaatgcaaatgtctggaagtattttacagacttgtttgattttttgcctctcacagctcttatagaaaatcaggtcttctgtcttcatggtggcctctctccgtcattggacacgttggataatattcgttctcttgatcgcgtacaggaggttcctcatgaaggacccatgtgtgatcttttgtggtctgacccagatgaccgatgtggatggggaatttcaccaagaggagcaggttacacatttgggcaagacattgcgcagcagttcaaccatacaaatggtctttctctcatttcaagggcccatcaacttgtaatggaaggatttaattggtgccaggataagaatgtagtcacagtcttcagtgcgcctaactattgttaccgctgtggtaacatggctgctattcttgaaatcggggaaaacatggaccagaacttccttcaattcgacccggcacctcggcaaattgagccagacacaactcggaaaaccccagactactttttgtaattgtggtggtgacattaacttactggtgttgatgctcctcttttccgcagcatcagggtctgtagatcatctgtccttagatatgggttccatgagcccgacctgtacgtctcccaattcttttgtttggagattttgttgccgcttaacgatctttatacaatatgttaaaaagttaaatgccattggatttttcttctttctgttgtacgtcgactttgtattatttgtagacggtgaatggaagtcgcagcaggaaagccagcccctgctatggttttgttctgaaaaaaaaaaaaaaaaaactcgagagtcttctaga

SEQ ID NO: 5179 - DNA, 2339 bp, Zea mays
gttcagaagtattcttcataagacttaaattaaattatatctccatagagatcatacaaaataaataatcataaaacattgagttccgcccgttccttcggttgggcgttcaacatatctcttggaaattaaagttctttgtgtaggtgcaacacacttgtattatttggaatacaatagttaatgtaaaatataataagaataagtatatattgcactcataccgagatttttggttgttgcatttagaccagaatttgaaactctgatttgaattcaaatttggaatatgaaactctaaatagaaaagaaaacaggaaaataaaaatagaaaggaaaagaaaaaagaaatgagaaatgaaggaaagaaaaatatacactatggaaaggaaaataatattgatgcaaatattagatgttatatcttcatgtgggatgagttttatatttggggatttgaaacttggatttgaaatacaatttgaggatatacaaatctaaatagaaaataacaaaaggaaagaataaaggaaagaaacctactacctcggtttgggacaaaattaaccaggccgtcccactacccttttccctcgcccatgaatctgcgcccgcgcatggtctcactgcctaggcgggcccttctcgtgggcccctcacttcaaccacgcgtgtgcgccacatcttgcctaactgccgaccggtgggcctttcgctgtcagtcgctccttccccaactgaacaccgaaccccttgccgcggatcgcgcctgggagctcgccatgactggtcccttgctggcggactcgatctccaactgaatcgcgcgagcctcggtccgcaggcatccctcggtctataaagtgcgtgattcgtttccctgggacccgatcgcttggcaccaacgccgaggaagagaaaaaaccgagagaagtgccgccgcaagctattttggtcggcgccattgctgagtccttggtcggggtctggggagctccgcctggtccccaggaagaagttcatggccacatcgggcgcgattgggtagcatcgatgcaggaattcctcatcggagtatgggcgcggccgtaaatccaccctacgccatggccgggctactctggtgctcctcgcgtgtaagtaatcttcccatctgattcgccatgagtagggcaacgtgtgggagctatcggagtggtgtgtcgcgtacctgggcgttgaatcggctgcacgccggtgggactccgccgtggggaggtcatggcgccgcctcgggccggtgagggaagggggaaagtgcactggtcctcccttccgtgattaacggatgggattgaatcagctaggtgagctattcgacgattgaaatccgggcgttggtctgttgatctgcggccgagagcggggcatgctattttaaatcaagatcgtggatcttagatctaacggctattggcacataccggttcgtgaagcttgggatctaatccgggcagttagatcttgatcggacggtcctagtcgaggggtaccccttcggcttggaaattttacaaagggacccctacctttctatgttatgaacccgcagtacacacgttgtgtaatgtaattacgcagagacccagaattttacagagtgcaccctgcacttctcaggaattctgtgcgcagtccagtcactgaaaaataggacaaataatttagaaaatggatttctagtaccaaaataattccagaatttatataattcatagaaaattcatcttagctcatttttaatccattccagtgccattaattttgttttaatattgtctatcatctagtaacactgtttagccatgaaacttagattaaaattattcacttgaattaatctatacgaggcattaaataactccagaaaatcataactagagaacattgactccgatttgatccgttcgagtcgcgtttactttgtataaatatttactacacaatagcaacgttgattatatgatattccatactattataattaggtaactaatttgattaatctatgttatctagattagcttattctaatattaatatagtatcatgactatgattatctttggcctaaaagatgatttataattaagtaatgacttagattaaagttgagttagttatttataagatatcctctcttatgatgtatactaatcaatttataatatagtttaacatttaatcacatagatcttcagaaaatcgtatctttataatcgtaactccgattttagtgattctcgagggggggcccggtacccaatcgcgccttatagtgagtcgtttacaatttcctg

SEQ ID NO: 5180 - DNA, 905 bp, Zea mays
  misc_feature (7)..(7): n is a, c, g, or t
  misc_feature (565)..(565): n is a, c, g, or t
  misc_feature (579)..(579): n is a, c, g, or t
  misc_feature (639)..(640): n is a, c, g, or t
  misc_feature (710)..(710): n is a, c, g, or t
  misc_feature (724)..(724): n is a, c, g, or t
  misc_feature (739)..(739): n is a, c, g, or t
  misc_feature (756)..(756): n is a, c, g, or t
  misc_feature (793)..(794): n is a, c, g, or t
  misc_feature (796)..(796): n is a, c, g, or t
  misc_feature (804)..(804): n is a, c, g, or t
  misc_feature (814)..(814): n is a, c, g, or t
  misc_feature (828)..(828): n is a, c, g, or t
  misc_feature (831)..(831): n is a, c, g, or t
  misc_feature (834)..(834): n is a, c, g, or t
  misc_feature (837)..(837): n is a, c, g, or t
  misc_feature (839)..(839): n is a, c, g, or t
  misc_feature (856)..(856): n is a, c, g, or t
  misc_feature (863)..(863): n is a, c, g, or t
  misc_feature (871)..(871): n is a, c, g, or t
  misc_feature (873)..(873): n is a, c, g, or t
  misc_feature (879)..(879): n is a, c, g, or t
  misc_feature (881)..(881): n is a, c, g, or t
  misc_feature (883)..(885): n is a, c, g, or t
  misc_feature (888)..(888): n is a, c, g, or t
  misc_feature (903)..(903): n is a, c, g, or t
ccaaggngaaaaaaaaaaagaaaaaactcacttagtcccccccccccgttcagaagtattcttcataagacttaaattaaattatatctccatagagatcatacaaaataaataatcataaaacattgagttttgaataatattttggttggacaaacaatatatctcttggaaattaaagttctttgtgtaggtgcaacacacttgtattatttggaatacaatagttaatgtaaaatataataagaataagtatatattgcactcataccgagatttttggttgttgcatttagaccagaatttgaaactctgatttgaattcaaatttggaatatgaaactctaaatagaaaagaaaacaggaaaataaaaatagaaaggaaaagaaaaaagaaatgagaaatgaaggaaagaaaaatatacactatggaaaggaaaataatattgatgcaaatattagatgttatatcttcatgtgggatgagttttatatttggggatttgaaacttggatttgaaatacaatttgaggatatacaaatctaaatagaaaataacaaaanggaagaataagganagaaacctcctccctcgtttgggcaaaattaccaagccggcccactacccttttccctcnnccatgaatctgcccccgcgcatggtctcactgcctagcgggccctctcgtgggcccctcacttcaccacncgtgtgcccacatnttgcctaactgccgnccggtggccttcgctgncagccctccttcccactgacaccgacccctgcccggnncnccctgganctcgccttgntgttccttgctggncgnccnacncnactgatccccgaccccngtcccangcatcctngncttaangngnnntcnttccctggacccacnct

SEQ ID NO: 5181 - DNA, 2138 bp, Zea mays
gatccaaaaccagtaaaccaatttcatagcttgttgattgttctgcctagggtttatggctagggtcacactcccataccagacatctagcgtgcatagactatcaactttgaccggcaggttatgccgaatgttttataagattttacaacataaaagtaaagttaccgaatttatcataacttaaactaccataatatataattcttttggtttaaaataatttaatcttataaaggttaaatagtttgacttatacacagacaaacgggctataggtgataacgcggtgccagtttccaccatttcacgatgaaaacgaagtaaaacacctgctattatctttcacgaaaatgctatacgtatggcccgagctgactctcgtccgaccagacaacatgttataacgatgtgatctaattaaacaatggttagcagtgatcagttcctaacaccggcatggacagacgtacggaagtcggacgagagtggtcgtcgtgcgtaacagcagggttctatctttaacgacctaacggacaatctcaattcgatatctccgatcatcagtggataagtagtatcatcaggatttgatcagatcatcgagaaagctcaaacttcatttgtacatggacggttggacataacagatcatcgtcgcacgacgtttaactcccaagcaaagagggcggcccgaaaaaaggcccacaaggcaaaagaggaaaacggcccaggtcaccatcacacacacacacacacgggcgaggtgcggcgaaacgacgatctccagtctcacactcgccgccgccgccgccgcctgcttactggatatacagagacgtctgcacaacactcatcgggggagtacacacccaccggactgctacgatgatactcgatcggttcaggtctcgttcgatatatggctgctcaggttggccgcaccagctctcggcctccgcctccgctctggatccacgggtgccctgcatttattttattttaagccgaggatgttagataagatgtcgggagggcagataacgcgcgtgatctgtgctcgcgtccaattggattaagattcaataaaataatctactagggaacaagacgaaatcgagataacgcatagtagatccgacggcttactgaggacttgctcggcggagaaccttcgcgagacgtcgcggcacatcatccgccgcatcagatccttcgccgccggcgagaccccggcgaacagagcgggcgggaacctgaggctgccgcgcagcacggccgcgaacacgtccgcggccgtctcgccgccgaagggcagcgcgccgccggagagcagcgcgtacatcaccaccccggcgctccagacgtccaccttctcgccgtactcgccgccggccaccacctcgggcgcgacgtagtgcggggtgcccacgagcccctcggcgcggccccgcgcgccctcgccgagccacgcggcggagccgaagtccgcgagccggacccgcgggggcgcctcgccggcggggtccacgtccaggagcacgttgtcgggcttgacgtcgcggtggacgacgccgcggcggtggcagcccgcgagcgcctcggccagctgcgcgacgacgcgcgcggcgtcgggctcgggcacgggcgcgccgcgccggaggcggatccagtccagcaggtcgggccccgtgcagaggtccatgaccgtgtgcgtccaggcgtcgtcctcgtagacggcgcgcacctgcaagacgcccgggttcccgtcgccctcgccccccgcgagccgcgccagcttcggctccagctccgccagcgcgcggtccaggtcgtcgccgaggagggaccggtccacggacttcacggcgaaggcgtcacccgtggcgcgggagacacagcgccggaccacgccgaaacgcccgcggccgatctcgtcgccgatgtcgtactcccggttcagttgttcagtcatggatttggtttggcgttccgtttcgtgatcccccccctcgtggggcccccgagtatttaaagcaggccttccagcatattcggatctcgactctagtactccctccctaaaaaatacatgtcttgttaagaaattattttttccataggtttaactagattat

SEQ ID NO: 5182 - DNA, 1295 bp, Zea mays
aagtagtatcatcaggatttgatcagatcatcgagaaagctcaaacttcatttgtacatggacggttggacataacagatcatcgtcgcacgacgtttaactcccaagcaaagagggcggcccgaaaaaaggcccacaaggcaaaagaggaaaacggcccaggtcaccatcacacacacacacacacgggcgaggtgcggcgaaacgacgatctccagtctcacactcgccgccgccgccgccgcctgcttactggatatacagagacgtctgcacaacactcatcgggggagtacacacccaccggactgctacgatgatactcgatcggttcaggtctcgttcgatatatggctgctcaggttggccgcaccagctctcggcctccgcctccgctctggatccacgggtgcctgaggacttgctcggcggagaaccttcgcgagacgtcgcggcacatcatccgccgcatcagatccttcgccgccggcgagaccccggcgaacagagcgggcgggaacctgaggctgccgcgtagcacggccgcgaacacgtccgcggccgtctcgccgccgaagggcagcgcgccgccggagagcagcgcgtacatcaccaccccggcgctccagacgtccaccttctcgccgtactcgccgccggccaccaccttcgggcggcgacgtagttgccggggtgccccacgagccccccggcgcggccccgcgcgccctcgccgagccacgcggcggagccgaagtccgcgagccggacccgcgggggcgcctcgccggcggggtccacgtccaggagcacgttgtcgggcttgacgtcgcggtggacgacgccgcggcggtggcagcccgcgagcgcctcggccagctgcgcgacgacgcgcgcggcgtcgggctcgggcacgggcgcgccgcgccggaggcggatccagtccagcaggtcgggccccgtgcagaggtccatgaccgtgtgcgtccaggcgtcgtcctcgtagacggcgcgcacctgcaagacgcccgggttcccgtcgccctcgccccccgcgagccgcgccagcttcggctccagctccgccagcgcgcggtccaggtcgtcgccgaggagggaccggtccacggacttcacggcgaaggcgtcacccgtggcgcgggagacacagcgccggaccacgccgaaacgcccgcggccgatctcgtcgccgatgtcgtactcccggttcagttgttcagtcatggatttggtttggcgttccgtttcgtcccccccggcctcgaggtacccaa

SEQ ID NO: 5183 - DNA, 4226 bp, Zea mays
cttctttgccaagtgtccgaaaaaacattcggtaaattatttagcacttgtcaaagagtcgaattccggtattgaccgtttagagtagaaattagagcctattaccacccccacagtcctacttatgtgctgtcacgtaaataaagagaagtgatatacgacagtccatcgtttgagcgttcagtttttatctcttccttttcttttcctctctcctttttattttttctcatttttttttatcttggatgggtttagaagaacttgtaactcgtaggttagaggacaagatggtagagacgacaacacgcggaggagaccgcactgataccgccggacaaaaggaaaggaggaggtggtcatagacaactcttttgccgtcttggtacactaatcaatcaatcatatttccggtgactggtgcgacgtcctatctgtgcagttgtagtgataactgacactgcaatcttcattggcgaatctctgtagatcaagtgcggggtcatctcgtttgatgcttttggacgctacttctctcccatttattttctcctgagcacgtttacgttgggcgatttattctaatctgttctagtatctaaaaaatggccaaaagaaagaagaaaaaaacttgattgttgctcttggtttcatcaaaatgtgatgttagtactcaatccttgaataacaaattgattcatggagttatcttatataaaacttttatgtattttccagaatttatatgaaaagacatatgcgtttacgacacaactggagatttatggagtttatgcaatggtactattttggttttataagtgttagccctcatttaaatcaaaaaagtaacctccctagcttggacaggtacctctattttccgcgccaatttgataacaaaaggtcagcatatgtaccaacaaattgtttgtctttatagtcatacaaaattgtactaaatagctgtaagcgtttataatacttcaaaatagtatttgttttagctcttaatttttatatttatattgaactagatgatgatgatgataaatatagacatgtatatagctcttaatttatatattcatattcaactagagattttaacggaaaaatagcatccaacagcctttttaattggatatgcaaacataaacaccctctatttcggatatctcgctagccaaatatgaagaacgaggatagctctctagactacacgcaatatatagaaaaactgttgaaggatacaaagatataaaaagccatctttactaaaatggctcttgatttagggaatatattttagaaaggtttttagagatacactgagtattgtataaatctaataaagaacaatttttattttagtacagaggtagtacaagttatacgaattttattttagtgtagagttagtataagttatcagttgagtcagtgctgcgatgggactgaaagctccgcttcaacaggtaggggcgtagggtatccggctaccgctcgtcctcgtgcacgcggctgttaaacacagtgaccccctcgttagctctccgtccatcccctcttccatcaggatcaggtctctccctctccgactctatctctccctgccaatactcatctacaaaaagagagattatatccatcctctccggccgcggatttaattctgatccttcttttcgtttgttcttatgccattgtttggccaccagcggtggggtatcgatctgctctagttggacggcggcatccctgattctaccctgatcgatcccatggatgcccaagacggcgatgagagaccgctgatcatccatcgcctgccactactccaggtgatccatctcctttgccacatagcaagtgcgacatagttcctgtcaagatacttgttgttgttcctgttcctctagctatagctatcaatcctacgcgaagccaggatgtagaatataatttttgcataacagacctctttccgttcaggatgaaagtacttccgaattcactagcgacgggacggttgatcttcgcaatcagcctgctcggaagcagagaactgggaagtggaaagcatgcttcttcatcttaggtgccgagtttgctgaatgtgtggccttcttcgcgatctcgaagaacctggtgacgtacctcacgggcgttctgcacgagagcaacgtggacgccgcgacgactgtgtccacctggatcgggacctcgttcttcacgccgctcgtcggcgcgttcttggccgacacattctgggggcgatactggacgatactggccttcctctccgtgtacgtcacggggatgacggtcctgactgcttcagctcttctcccgctgctcatgggcgcgtcctacagccgtagcgcccaccgcctctccgcgtacctgggcctctacctcgccgctctcggcaccggcggaatcaagccgtgcgtctgcgcgctcggtgccgaccagttcgacgcgtctgaccccgtggagcggcgggccaagggctccttcttcaactggtactacttctccatcaacatcggctccctgctgtccgcgacggtggtcgtctgggtgcaggacaacgttgggtggggagtcgggttcgcgatcccgaccctgctcatgctgtcgggactcgtgctgttcgtcgccggtaggaaggtttacaggtaccagagagtgggagggagccctctgacaagagcctcgcaggtggtggttgctgctgtcaggaactaccgtttggtgctgcctgagcctgacgacagctcggcggccctgctgcatcaggcgcctcccggaacgacggaaggaaattattccacgatgcagcatacgagtcaattcaggtattcgtacatcatccaatccaattccaaatacgtcaggataccccctccaaatacgtacacatcttgagattctttgatccaggtgccgcggcatgcctgccattgcagcgccatcctccggcgagaaaggagcgacggcaagcccatggcggctctgcacggtctcccaggtcgaggagctgaagacggtgctgcggatgttccccgtgtgggtgtcgatggtgctcttcttcgcggccaccgcgcagatgtcgtccaccttcatcgagcaaggcgagaccatggacaaccgcgtggggccgttcaccgtgccgccggcgtccctctccaccttcgacgtcatcagcgtcatggtctgcatacccatctacgacaaggcgctggtgccgctggcccggcgcgccacgggcaaggagcggggcctgtcgcagctgcagcggctgggcgtcggcctcgcgctgtccgtggccggcatggtgtacgcggcgctgctcgaggccaggcggctgtcgctcgcccgcgcagcggcggacgggcggccgccgatgtccatcatgtggcaggcgccggcgttcgcggtgctcggcgcgggggaggtgttcgcgaccatcggcatcctcgagttcttctacgaccagtcgcccgacggcatgaagagcctcggcacggcccttgcgcagctcgccgtcgcggcaggcaactacttcaactctgccgtgctcgccgccgtcgccgccgtcaccacgcgcaacggggaggcaggatggatccccgacgacctggacaagggccacctcgactatttcttctggttcatggctgttctcggcgtggtgaacctgctgcacttcctgcattgctccgtcaggtacagaggcagcagcaacaacagcacatactcttcttgagtcttcacacgatctgtgccaagtatatgacaaaatgtcaacaaagagagatgtgcatcgaatttgttcacgaggcacagcaggatgcccgcattctccatttggcgtctccacaataataatgtgtccctgtgacaaaaaaaaaaaaaaaattgcgttgttattgagccttttgctcgtggtcacacccacacggcactacaaatacatacatcgacatcctagaaatccacatcggttgcaactagtgctgcaagttgggccgtgccgtgccggcccggcacgagcccgtcgtgcttcgggcctcagttagtcgggcctagccagcacgaaatagagtcgggccgtgccttaccgggcctgacgaatagaagtaaggcccagcacggccctaaagcacgacgggcttccgtcgggccgtgctggcccaagcacggcacgcctcagttcc

SEQ ID NO: 5184 - DNA, 2160 bp, Zea mays
gccggccgggtcggggtcatcccctcttcctcaggatcaggtctctccctctccgactctctctctccctgccaatactcatctacaaaaagaggcacgagaccattacctagaacatcctcatcgatttaattatgatccttcttttcgtttgttcttatgccattgtttggccacaagcggtggggtatcgatctgaaatagttggacggcatccctgattccaccctgatcgatcccatggatgcccaagacgacgatgagaggccgctgatcatccatcgcctgccactactccaggatgaaagtacttccggattcactagcgacgggacggttgatcttcgcaatcagcctgcccggaagcagagaactgggaactggagagcatgcttcttcatcttaggtgccgagttcgctgaatgtgtggccttcttcgcgatctcaaagaacctggtgacgtacctcacgggcgttctgcacgagagcaacgttgacgccgcgacgactgtgtccacctggatcgggacctcgttcttcacgccgctcgtcggcgcgttcttggccgacacattctgggggcgatactggacgatactggccttcctctccgtgtacgtcacggggatgacggtcctgactgcttcagctcttctcccgctgctcatgggcgcgtcctacagccgtagcgcccaccgcctctccgcgtacctgggcctctacctcgccgctctcggcaccggcggaatcaagccgtgcgtctgcgcgctcggtgccgaccagttcgacgcgtctgaccccgtggagcggcgggccaagggctccttcttcaactggtactacttctccatcaacatcggctccctgctgtccgcgacggtggtcgtctgggtgcaggacaacgttgggtggggagtcgggttcgcgatcccgaccctgctcatgctgtcgggactcgtgctgttcgtcgccggtaggaaggtttacaggtaccagagagtgggagggagccctctgacaagagcctcgcaggtggtggttgctgctgtcaggaactaccgtttggtgctgcctgagcctgacgacagctcggccctgctgcatcaggcgcctcccggaacgacggaaggaaattattccacgatgcagcatacgagtcaattcaggttccttgacaaggctgccattgtagcgccatcctccggcgagaaaggagcgacggcaagcccatggcggctctgcacggtctcccaggtcgaggagctgaagacggtgctgcggatgttccccgtgtgggtgtcgatggtgctcttcttcgcggccaccgcgcagatgtcgtccaccttcatcgagcaaggcgagaccatggacaaccgcgtggggccgttcaccgtgccgccggcgtccctctccaccttcgacgtcatcagcgtcatggtctgcatacccatctacgacaaagcgctggtgccgctggcccggcgcgccacgggcaaggagcggggcctgtcgcagctgcagcggctgggcgtcggcctcgcgctgtccgtggccggcatggtgtacgcggcgctgctcgaggccaggcggctgtcgctcgcccgcgcagcggcggacgggcggccgccgatgtccatcatgtggcaggcgccggcgttcgcggtgctcggcgcgggggaggtgttcgcgaccatcggcatcctcgagttcttctacgaccagtcgcccgacggcatgaagagcctcggcacggcccttgcgcagctcgccgtcgcggcaggcaactacttcaactctgccgtgctcgccgccgtcgccgccgtcaccacgcgcaacggggaggcaggatggatccccgacgacctggacaagggccacctcgactatttcttctggttcatggctgttctcggcgtggtgaacctgctgcacttcctgcattgctccgtcaggtacagaggcagcagcaacaacagcacatactcttcttgagtcttcacacgatctgtgccaagtatatgacaaaatgtcaacaaagagagatgtgcatcgaatttgttcacgaggcacagcaggatgcccgcattctccatttggcgtctccacaataataatgtgtccctgaaaaaaaaaaaaaaaaaaaaaagtcgacgcggccgc

SEQ ID NO: 5185 - DNA, 1046 bp, Zea mays
ccggccgggccccctttcttccttcctttctttgttgtactactactacttaagctcgccgcttccgccctccccccatgtgattgattctctcctgctccttctttcttccatctctcctgtctctcttctctctctctctctgtctgtctgtctggcaaagggcactgacggccgcggcggtgtcgatggagtggtggcagaaggcggtggtggtgccggtgaagcgcgcgtggatcgccgccgccgcccggctgacgacgcgacataagaaagaagacggcggccacggcgtcctggtgaagctccacgacgacgtccagacgtgcgcgtacgaggacgtgcaggtgatgtgggagatgctgcagcgggccgagacggagaggctggcacgcgagccctcgacaaagggcgcccgcgcgctcgtctggctgcgccgccaccacaagatggacccgcgccggcgctgctgaggaggaggacgacgacgacaccctgatgcttttccttcctcctgctgccttcggctttgcttgccagctgccgtgccaccctgtgcagccttgccctgtgatgcgagagccgctcatctgcggctgtgtgtacatattacatgctacatacagggtacagccctgctgctgtgcctttcgtttccttcgcccggatgtaaatattcacagtttcatctttccaaggaagagaagagagatagagagaccacaaaaaaaaaaaaaatgtactttgctcggtgccgccgcaaccaatcaatcacctcgcgggatacagttccatttctgaaggtattgggcgagggttctcatgtccaagcagcagggcaacccacctgatctttcatacataaacctgccactcagtctgcaaagcacaagcaaaactttcgtgatcaatatatgttcacaagactggtatatatacaccttagcgaccgttaatgagacagcaaggaaatttatggatgaacaaggtgttaccactggcagtacacggtctgaattggggttcaaactcggacagggggatcc

SEQ ID NO: 5186 - DNA, 800 bp, Zea mays
  misc_feature (784)..(784): n is a, c, g, or t
actcctaagggagaattgtttagcccggccggggtccaggagaaggcccccgacgggattattctttctccccgcgtgctctctatctctcccctctttctctccctctgcccgacgactaggccgccgccgccacggccccgccgccgccgccgtgcccaggtctttgtcggtccttgtccggcaacgagcaccctacagatggctgggaggcacaccattattctgatgcagccatctcaaaatagggcttctagaacatttatggattacaattcgattaatcatgcattggatggaatctgtgggctttatgaaaggaaaattagggatatcaacccaatgatcccaaacataacttatgacatcagcgacctctataacttcattgatggcctagccgacattagtgcgctggtttatgatcactcgattcaggcattcctgccatatgatcgacagtggataaagcaaaagttgtttcaacacctgaagaaattggctcagcggtagcacaactgttgtttgttcttgatgccttttatccaacaagcaagcatgcgtgacaataggtgtccaatcagtggtattgggagttgtttcttgtaaactttgtaatgttacatgacagatttgctcccttgtattctggatgtttgactcggatttcattggtggcttgcttgtggttgtggtatgctaaacttgttttgtttcgcagtgctgggaatcagataacccttttgcctgttgtaaaaaaaaaaaaaacctgtattgtaagcgntagaattttgttaaaa

SEQ ID NO: 5187 - DNA, 1088 bp, Zea mays
ccggccgggatggcgaccccgagaactgcttcgccgtcctcgtgccctgctaccgccggccgccaagagcagcagcccgggaggcacgagggccggtggcttccccccggcccccccgccaatggtggattctctgatggaaagaattttgtagagcagtggctttcttctctccagaactaataccgtccgacctgtcctagctaccctgtaaatagtatcactctgttttgttctactacgtttgtcctagtcgcagaatgtatcgatgaaggaagacatggaaaagccctaaaaaaagaaggaaatctaaaaagaaaaatgaggagcagtgggattctgaagcggcaccaaatgggtatgtccttcctgaggtgttcccagaatcccaggctattctactcttgcaaagcaatgcgaaagctgaactacacaaactgcacgccatcaaaaatgattttgccgtcctgatatgtgcggagtgctaacctgatgattgataacacgtagagatgaactgctattccattgttaatttgtcccacttgctcgtggacctcgaattctactgcatgtacattctgttcttgcagtgtatatatatatagtcttgcccagagctgcagtggcgtgattgttcagtctgcctgtatatagtgttcttgcagtgtatatagccttgcgcagagctgcagttgcgtgatttagtgtgtggtgcgtgtgtcctattcttgtacatgggaattgtattctgatgaatgaatctatgaatgaatctatctatctgctgtaaaaaaaaaaaaaaaaagcggcgcaaaaaaaagagaacgactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggccccctagggccgggcccccttaaaaaaaaggggcccccccgggggggggaatttcaatttaaattttttcaaaccccccccccccgggggggggcccggacccaaattccccctaaagggggccgatttcccccgcccccc

SEQ ID NO: 5188 - DNA, 1758 bp, Zea mays
aaaaaaactagttcccatccattggtgtggacgtgtggtggttgcgttgcgttgcttcgagttggaggttggttggagttggagtgggccgcgtgccgcgtgcgagatgatctgagtggagaggccatggagtggtgtgattagcggttgctgggtcaggagaaggcggcgtgtgttttgatcctactcgcgtttgaggggccccgatttcgagcgggtgttcaattttggtgccggatttttaaggaggatccaatttaggaagaattttggttttggggacaatggttttggactgcctgatattcgattcataggttggtcaaacgcttaggagtagagaatttttttttcccggaaaacaagagccatttttctagttgtgctactcgtcaatcaatccatggaagctgaactctggaagaagaaactttcctaattagacccggtatttcgtggttggccgttggcgtctaaagcgcgttttagtttaaatatgaacacattttcctgtttactccgcccaaaatctttccgctggatctacttgtgaatcgggtttgtttgttttttacctgagctattcttgtcgatttaggatttcaagtcggcagatccaagggaacgccgaattttgcctgatttcttcgcaatttttggtccgaccaagaggttcctagcctatttttttcctcgcgagaagcaagggctctcccttttcttctttcgccatgtccatggcgttgagccgcttcacgcaatggctgtggccggggggcgccgcggcgcgggtggacacccacgagcaccccagcggggggctaacgagctcctccttccctgacttcccctccgggttccgggagcccgacaccgtcacgttctacaccggccgccagcgcgcgcgcccgaggagggtcaggaatcgtcgccgcagccgcggggaggcccgtgtcgaccgggagtacgacatggtcatcgtcccgtccgacggcggtggctgcctgtctggctccgactccgacgactccgactggtccatcggctggctcgagccacaggcgccggagcttcagacggacggcgaccccgagaactgcttcgccgtcctcgtgccgtgttaccgccacggccgccaagagcagcagccccggaggcaggagggcaggtttcttggcgccggcgccctcaccgatggtggtccctctgatggaaagaattttgtagagcagtggctttcttctttccagaactaatatcgtcagacctcgcctaagctaccctgtaaatagtatcactctgttttagttctactacgtttgtcctagtcgcacaacgtatcgatgaaggaagacatgaaaaagaaatctaaaaaaaaaaaaaaaaaaaaagaaaaatgaggagcagtgggattctgaagcggcaccaaatgggtatgtccttcctgaggtgttcccaggccattctactcttgcaaagcaatgcgaaagctgaactacacaaactgcacgccatcaaaaatgattttgccgtcctgatatgtgcggagtgctaacctgatgattgataacacgtagagatgaactgctattccattgttaatttgtcccacttgctcgtggacctcgaattctactgcatgtacattatgttcttgcagtgtatatatatagtcttgcccagagctgcagtggcgtgattgttcagtctgcctgtatatagtgttcttgcagtgtatataagccttgcgcagagctg

SEQ ID NO: 5189 - DNA, 1240 bp, Zea mays
cattgggtacctcgaggccggcaaccactgaaaagtccccacgaacttttactctagccctcccagggtctctcttcggcggcggcgatgtctctcgccccggacccggcggacggcggcgccggcaccggcaccggcgacgactggttcctcgactgcggcatcctcgacgacctcccggccgcggcctgcggggccttcccgtgggacgcgtccccgtcttcttccaaccccagtgtggaagtgggcagctatgtgaataccaatgatgttttcaaggagcccaatgatgtcttcaaggagcctggcagcaataagcgtttgaggtcaggatgcaatgatgtgcatgtgccaacatctaaagcttctagggaaaaaatgaggaggaacaagctgaatgacaggtttcttgaattggggtctacattagaaccagggaagccagtaaaagctgacaaagctgctatcctaagtgatgctactcgcatggttattcagcttcgttcagaagcacagcagctgaaggaaactaatggtagtcttgaagaaaagatcaaagaactcaaggccgagaaggatgaacttcgtgatgagaagcagaagctgaaattggagaaggagagtttagaacaccagatgaagctgatgacatcgactccaacctacatgcctcatccgaccctgatgccggcgcctttccctcaggcacccctagcgccgttccatgcccaggggcaagctgcagggcagaagctgatgatgccctttgtcagctatccggggtacccaatgtggcagttcatgccgccttcagaggtcgacacctcgaaggacagtgaagcgtgccctcctgttgcataatcgcttcgattggcggctggtcgtgctcacaccatgcgaattagtcgcaactgaagcccccccccccccccccctagctgtcgattcattgattggctataactgctgttgttaaatttgtagttcgttggtgaccaagtaagctgctgatatctgtggcggggcgccctactatagaggctactgataccccttcaatggctgtacatttttttttactgttattctttttgcggagaaaagaagaatgttcgttcttgttctccacagcaacaatgtcacataccctattattctatatatatatcgtgcgtgttttttatatttaacaaaaaaaaaaaaaaaaaaaaaaagggaaaaaaaaaaaaaaaaaaaaaaa

SEQ ID NO: 5190 - DNA, 1649 bp, Zea mays
gcacgaggaacttttactctagccctcccacgcggtagggtctctcttcggcggcggcgatgtctctccccccggacccggcgggcggcggcgccggcaccggcaccggcgacgactggttcctcgactgcggcatcctcgacgacctcccggccgcggcctgcggggccttcccgtgggacgcgtccccgtcttcttccaaccccagtgtggaagtgggcagctatgtgaacaccaatgatgttttcaaggagcccaatgatgtcttcaaggagcctggcagcaataagcgtttgaggtcaggatccaatgatgtgcatgtgccaacatctaaagcttctagggaaaaaatgaggaggaacaagctgaatgacaggttccttgaattggggtctacattagaaccagggaagccagtaaaagctgacaaagctgctatcctaagtgatgctactcgcatggttattcagcttcgttcagaagcacagcagctgaaggaaactaatggtagtcttgaagaaaagatcaaagaactcaaggccgagaaggatgaacttcgtgatgagaagcagaagctgaaattggagaaggagagtttagaacaccagatgaagctgatgacatcgactccaacctacatgcctcatccgaccctgatgccggcgcctttccctcaggcacccctagcgccgttccatgcccaggggcaagctgcagggcagaagctgatgatgccctttgtcagctatccggggtacccaatgtggcagttcatgccgccttcagaggtcgacacctcgaaggacagtgaagcgtgccctcctgttgcataatcgcttcgattggcggctggtcgtgctcacaccatgcgaattagtcgcaactgaagccccccctagctgtcgattcattgattggctataactgctgttgttatatttgtagttcgttggtgaccaagtaagctgctgatatctgtggcggggcgccctactatagaggctactgataccccttcaatggctgtacatttttttactgttattctttttgcggagaaaagaagaatgtttgttcttgttctccacagcaacaatgtcacataccctattattctatatatatgtcgtgtattttatatttaacaaaaaaaaataaaaactcggggccgtgacaagcaaattgtctgtcatgaataattagcagttattatttgttcaaatgtacgtaatgctgcatggatagatgtaatggatgaatgtaacagtgagctaggcaatggtgagttcgtcctgtacatacgctggccactggtgtgttgaatttggatacgatcgggaaccaacaggataacaattttagagagttctgatcagtggacaatactctgtgaatacaaatatgaagaagattataagctcgtattctaaaattgatcatcacgaactcttagctctctcaattctccttatctcctgtttttgttatgaggggaggtttagggggaacctggacttgagccaacatgaggcagtttggagaggttcagactataatgtgtgctttgactgataattctgcttctgttaatgtgaaatggtgcgtccagcgagtcaccgtatgtgcttgtttcagttgtttctttagtc

SEQ ID NO: 5191 - DNA, 1944 bp, Zea mays
  misc_feature (83)..(83): n is a, c, g, or t
gggaccctcgaggccggccgggccgggactcttctcatcttctcctgtcatgtatgcgctgatgctgctatgatattaatttntgagagtaatttgcagtgatcttgttgtttgacctttttttttcttgctttactgaaagcggtccactccatatgctcagaattcaatgccttacatgtagctagttgtctgattactttcgtccatgaatggtttccagttaattggttgagaacaggtactagccaaatacgaaaaaaaagttcatgtccagttggagctgctaatcacccttatatttcacagtgtggaagtgggcagctatgtaaacgccaatgatgcattcaaggagcccaatgatgtcttcaaggagcctggcagcagtaaacgtttacggtcaggatccagtgatatgccaacatctaaagcttgcagggaaagaatgaggaggaacaagctgaatgacaggtttcttgaactggggtctgcattagaacctgggaagccagtgaaagctgacaaagctgccatcctaagcgatgctactcgcatggttattcagctccgttcagaatcacagcaactgaaggagactaatggcagcctcgaagaaaagattaaagaactaaaggccgagaaggacgagcttcgcgacgagaagcagaaactgaaactggagaaggagagtctagagcaccagatgaagctgatggcatcggctccagcctacatgccccatccgaccctgatgccggcgcctttcgcccaggcgcccctagctccattccatgcccagggccaagctgcagggcagaagctgatgatgcccttcgtcggctacccagggtacccaatgtggcagttcatgccgccttcagaggtcgacacctcgaaggacagcgaggcgtgccctcctgtcgcatgatcaccttgatggggctggtcctgctcacaccatgtggattagccgcaactagttgtcgttgtcgatccattgatggggtataactgatgttcttaggctatctccagcagcctctctatcctattctctatcttactccctattttaaattttactctgtaaacagtacagtctatagtgtaagacaatgttttgcatgtttatatccacgctttgctggagatgggcatggtagtctgttggtgaccaaggaagctgtgatatctgtggcgaggtgccctgctagaggctcctttaatgggtgtacaattttcgtggtggaaagaagaatgttcgttcttgttctcccatagcaacagtgtcatattatctatctatgccatatatattttatatttgacatgtttgtgatacaagcaaaatttatatttagaacagagacattattatttccacagtaactagttatgagatgctgtacacggttgaatgaaatgaaacagtgagctatgcaatggtgaggctgaggccgaggccaaggccaaggccaagcaccctacaaaaatgacaagatattgttttgctaaattcacccatgtgtctaaaactgacaagtgtagcaatatgtttaaagcacaaaagtcttgtaacatactctctgtgtctaaaaatgcatatcgttctcactttttgaagagtcagctattgtgaaatttgaccaaatatatatataaatatattagtatttatagtacataattagtatcattagatagatatttgatatacttttatagtaaaattatttgagacaaattgtcatggtttcggaaaccggtagacaataaaatttttgtttggtgggatgctagcgcaaactcactacgaatgctgaatcgctaggacttgaacaatggacttgagacaccgggtttatactgattcgagttcgcacccactccagtgtagtaatgattgtagtattccaatgaaaagtgttacaacttgtgcgctta

SEQ ID NO: 5192 - DNA, 1313 bp, Zea mays
  misc_feature (1)..(6): n is a, c, g, or t
  misc_feature (9)..(21): n is a, c, g, or t
nnnnnnttnnnnnnnnnnnnnaaaaaaaaaaaaaaaaaaacattgggtacctcgaggccggccggggagccaccaagagatccacgaatatacccatcccattccccacaaggctccgtcccttcggcggcggcggcgatgtctctcccccctggcccggcggacagtggcgccggcaccggagacgactggttcctcgactgcggcatcctcgacgacctgcccgccgcggcctgcggggccttcccgtgggacgcgtccccgtcgtcttccaaccccagtgtggaagtgggcagctatgtaaacgccaatgatgcattcaaggagcccaatgatgtcttcaaggagcctggcagcagtaaacgtttacggtcaggatccagtgatatgccaacatctaaagcttgcagggaaagaatgaggaggaacaagctgaatgacaggtttcttgaactggggtctgcattagaacctgggaagccagtgaaagctgacaaagctgccatcctaagcgatgctactcgcatggttattcagctccgttcagaatcacagcaactgaaggagactaatggcagcctcgaagaaaagattaaagaactaaaggccgagaaggacgagcttcgcgacgagaagcagaaactgaaactggagaaggagagtctagagcaccagatgaagctgatggcatcggctccagcctacatgccccatccgaccctgatgccggcgcctttcgcccaggcgcccctagctccattccatgcccagggccaagctgcagggcagaagctgatgatgcccttcgtcggctacccagggtacccaatgtggcagttcatgccgccttcagaggtcgacacctcgaaggacagcgaggcgtgccctcctgtcgcatgatcaccttgatggggctggtcctgctcacaccatgtggattagccgcaactagttgtcgttgtcgatccattgatggggtataactgatgttcttaggctatctccagcagcctctctatcctattctctatcttactccctattttaaattttactctgtaaacagtacagtctatagtgtaagacaatgttttgcatgtttatatccacgctttggctggagaaaaaaataaaaaactgttgaaaaccaaggaagctgtgatatctgtggcgaggtgccctgctagaggctcctttaatgggtgtacaattttcgtggtggaaagaagaatgttcgttcttgttctcccatagcaacagtgtcatattatctatctatgccatatatattttataaaaaaaaaaaaaaaaaa

SEQ ID NO: 5193 - DNA, 1232 bp, Zea mays
  misc_feature (1221)..(1231): n is a, c, g, or t
cattgggtaccgcccggccggccccggaaaagaccccacgaacttttactctagccatccccgtctctcttcggcggcggcgatgtctctccccccggacccggcggacggcggcgccggcaccggcgacgactggttcctcgactgcggcatcctcgacgacctcccggccgcggcctgcgggtccttcccgtgggacgcgtccccgtcttcttccaaccccagtgtggaagtgggcagctatgtgaacaccaatgatgttttcaaggagcccaatgatgtcttcaaggagcctggcagcaataagcgtttgaggtcaggatccaatgatgtgcatgtgccaacatctaaagcttctagggaaaaaatgaggaggaacaagctgaatgacaggttccttgaattggggtctacattagaaccagggaagccagtaaaagctgacaaagctgctatcctaagtgatgctactcgcatggttattcagcttcgttcagaagcacaacagctgaaggaaactaatggtagtcttgaagaaaagatcaaagaactcaaggccgagaaggatgagcttcgtgatgagaagcagaagctgaaattggagaaggagagtttagaacaccagatgaagctgatgacatcgactccaacctacatgcctcatccgaccctgatgccggcgcctttccctcaggcacccctagcgccgttccatgcccaggggcaagctgcagggcagaagctgatgatgccctttgtcagctatccggggtacccaatgtggcagttcatgccgccttcagaggtcgacacctcgaaggacagtgaagcgtgccctcctgttgcataatagcttcgattggcggctggtcgtgctcacaccatgcgaattagtcgcaactgaagccccccccccccccctagctgtcgattcattgattggctataactgctgttgttatatttgtagttcgttggtgaccaagtaagctgctgatatctgtggcggggcgccctactatagaggctactgataccccttcaatggctgtacatttttttactgttattctttttgcggagaaaagaagaatgtttgttcttgttctccacagcaacaatgtcacataccctattattctatatatatgtcgtgtattttatatttaacaaaaaaaaaaaaaaaaaaaggggcggccaaaaaaaaaaaaaaaaaaaaannnnnnnnnnng

SEQ ID NO: 5194 - DNA, 1289 bp, Zea mays
attcacagcatatatgctgcacgccaaaagctagccacgccacgctgctgtcgcttgctccactagtccactccacattgccatgtcgtcgaccacctcgccagcgtccggtgtctccggcgaggctcctcctccgcgcatcgtggaggactgcctcgggctcgtccagctcatgagcgacggcaccgtcaagcgcgcgccggcctgcttggcctctgccgacgatgcggcaccggtccgatgcaaggacgtcgtctacgacgaggcccgcaacctgagcctccgcatgtacgtgccatcctccagggcggggaacggcggcgccgagaagctcccggtgctggtctacttccacggcggcggcttcatcgtcggcagcttcgcgtcgccggagttccacgccgcgtgcgcccgcctcgccgccgcgctcccggccgtggtgctctccgccgactaccgcctggccccggagcaccggctccccgcggcgctcgaggacgccgacgccatcttctcctggctcggcgcgcaggagcagcaggcagacccgtggctcgccgacgcggcggacctgggccgcgtgttcgtgtcgggcgactcggccggcgccaacatcgcgcaccacgcagccgcggcgccggggcgccgcctcgccgggtgcgtgctgctgtggcccttcttcggcggcgagcggaggacgcggtcggaggcggcctacctgggagacgcgttcctgacgctcccgctgtacgaccagatgtggcgcctggcgctgccggcgggggcgacgcgggaccacccggccgcgaacccggaggcgggcgagctcccgccgctgctcgtcgcggccggcgaccgcgacatgctgatcgaccgcatcagggagtacgtggcgcgggcgcgggcccgggccgccgccgcgggcaacaggcgcgtcgacctcgtcgagttcccgggcgcggggcacgggttcgccatcctcgagcccgatggcgaggctgcgggtgagctagtccgcgtcgtgcggcggttcgtgcatggcggggatgccgccggcccgccgccgctcagcggccgcggatgagacagggagtcgttgggatttgtccggacacctttctcgtcacgcttccaggtgccagcacttgaaacgtttaggtatccggcgcgtgacatggttgtatctctctcgtgatcttgtccaagtgcaatgtgcatgcacaccacaataattatcgtaataaatctgcacacaacaatagtatcttttattaaaaaaaaaaaaaaaa

SEQ ID NO: 5195 - DNA, 2019 bp, Zea mays
catgggtacctcgaggcccggcgggaaatccccacgcggccgtcgtttgccccctccctccccacctgcaccaccaccaacaccaaccaacaggtggcgagagcgagagcgagagcaaagagctgagcgggacggagcagctagcgctagggataacgcacacccaccaccatggcgacgcccggagagcagccggcggaggtcgtgtccgtcgagatgcccgcacccgacgggtggaccaagaagtttactcccttgagaggggggagatctgagattgtttttgtttcaccaactggcgaggaaattaagaacaagaggcaattaagtcagtacctaaaggcacaccctggaggccctgctgtttcagagtttgattggggaactggtgataccccaaggcgttctgctcgtattagcgagaaagtcaaggtatttgatagcccagagggcgagaagatcccgaagcgcagcaggaactccagtggtaggaagggtaagcaggggaagaaggaaacccctgagaccgaagaagccaaagatgctgaaactggcaaggaggcagaggaggccccaagcgaagatgccgcaaaggagactgatgtggagatgaagcctgctgaagaggtgaagggggcctctgctgaaacagaagatgctgacatggctgatgctcctgcaccagcaccaatggaagaagataagaaacaaactgaagaactggcagaagctattgcagctcctcctgtgccatcggaggagaagaaagatgtcaagccagctgagcctgaagctgcagcaagcaacccaactgaggattcggcccctgctcctgctgaacctgctgatgttgctgctccagctgctgagcccaaatcagacgccaaacctgctgctgttgctgctccagtgcctgagaccaaatcagacgccgagcctgctgctgttgctgctccagcgcctgagaccaaatcagacgctgagcctgctgctgttgctgctccagctcctgagaccaaatcagtagccgagcctgctgctgttgctgctccagcgcctgagaccaaatcagatgccgagcctgctgctgttgctgctccagtgcctgagaccaaatcagatgccgagcctgctgctgttgctgctccagtgcctgaaacgaaatcagatgctgagcctgctgctgatgctgctccagttcctgagatgaaatcagagtccgagcctgctgctgttgctgctccagcgtctgaaaccaaatcagacgccgagcctgctgccgttgctgctccagcgcctgagaccaaatcagatgccgagcctgctgctgctgctgctccagtgcctggaaccaactcagatgctgctgctactgatccagcacctggaaccaaggccactgccgccgatccagcacctggagctccagcagagaactccaccgacaaagacggaagccaggagagccagcccgtgaacaatggacagctgccgcactcgacggtgaagtgcacctgaagccgcaacgccggaaaaacctgaaccccttccggcgccgtgtatctcatttaggaacaaacattcgcattcgcattcacattgttatcagttaaaaagtctatggaacggtaagcatgttaattagtcagtctgacgctgctgggtgacaggttggtaattaggctctgcatttagctgttttgtatggctgctgtcgccgccatacatgtatcatcttcttgtggttgtatggtacctaaccgcgtaaacatgttaaccttaggccatgtattaattactccgctctaatgtttgtatgtgtattgtcaaacttgcagaaccagttgcatgcatgaaaaataataagtgtctgggtatctatgggtgcggggtacccatctccgcaccagcgcacccagccagaaacagcagtttgtttggatccaatcaaaaaaaaaaaatatttgctggccgtgatgctgatgcctctctgaattcgtgtggctgctcgcggctgga

SEQ ID NO: 5196 - DNA, 1901 bp, Zea mays
ggccggccgggccggggctatggagcagttttttagtgtttcgctgcacggaagtgactctgctagcccctaatcatatgagagtgattttgagtgtgccaaacgccccctattgaaattcccacgcgcccgtcgtttgccaccttccccaccagcaccaagcggcgagagcgggacggggcagagcaagagctagggataaccctcgcccaccatggcgacgcccggcgagcagcaggcaccggctgcggcggagtaggtcgtgtccgtcgagatgcctgcacccgacgggtggaccaagaagtttactccccagagagggggaagatccgagattgtttttgtttcgccaactggcgaggaaattaagaacaagaggcaactaagccaatacctaaaggcacaccctggaggccctgctgcttcagattttgattggggaactggtgataccccaaggcgttctgctcgcattagcgagaaagtcaaggtttttgatagcccagagggcgagaagatcccgaaacgcagcaggaactccagtggtaggaagggtaggcagggaaagaaggaagcccctgaaactgaagaagccaaagatgctgaaaccggccaggacgccccaagtgaagatggcacaaaggagactgacgtggagatgaagcctgctgaagaggcgaaggaagctcctactgaaactgatgacgctgagaaggctgcagacaaggcggacgatactcctgctccggcgccaatggaagaagatgagaaagaaactgagaaaccagctgaagctgttgtagctcctcttgcgcaatcggaggagaagaaagaagatgccaagccagatgagcctgaagctgtggctccagctccagtaagcaacccaactgagaactcagcccctgctcctgccgagcctgctgctgttcctgccccagtgcctgagaccgaatcagttgccgagcctgctgctgttctcgccccagcgcctgaaaccaaaccagatgccaagcctgctgctgttcctgccccagcgcctgaaaacaaaccagatgccgagcctgctgctgctgctgctccagtgcctgacaccaaatcagttgctgagcctgctgctgctccagcgcctgacaccaaatcagttgctgaacctgctgctgctgctccagtgcccgagaccaaactagttgctgaatctgctgctgatgctgttgctgctccggcgcctgaaaccaaatcagatgccgagcctgctgctgctccagtgcccgagaccaaaccagttgctgaatctgctgctgatgctgttgctgctccagcgcctgaaaccaaatcagatgccgagcctgctgctgccgctgatccagcacctgaaatcaaatcagatgctgccgccgctgatccagcacccgggaccaaggcagatgctgccgccactgatgccgcgcctggagccgagccagacgccgctccactagagaacaccgctgccgacaaaggcggaagcgaggagagcagccagcccgtgaacaacgtgaacaacgggcactcaacgtgaagtgcatctgaggccggaacggaacaccccttccagcaccgtgtatctcatgtaggaacaaacatttgcattcgcattgtaatctgatggatcggtaagcatgttgattagtcagtctgacgctgctgggtgacatgttggtaattaggctctgcatttgagctctttttttttgtatggctgctgtcgccgccgtacatgtatcctgtatccaccaccatcatcatccccttggactattggttgtgttgtacctaactgcgtaagcatattattatcaatgttaggccatgtatactccgctctaaaaaaaaaaaaaaaaaaaacggcaaaaaaaaaa

SEQ ID NO: 5197 - DNA, 1071 bp, Zea mays
ggcgattgggttcctcgaggccggccgggaagttatgtcagaaggtgcatatatgcttttctacatgaggtctttcccccgaccacccggcacgcggcgagaaggggccgactgttccatccgcgaagcgccacacatcaaagtattccaagggctctaaacacgagcgcgagcagacagagttactcctctcggcgaacgatccagcatacggtgtttatgactttagacccgatggcgagggctacacgcaagatcagcaagcagagttgagatccagggatttccatcgcgccgacgatgccttcgcagactcggtcagcgcggacttctcggaggccacgtcaagcgaatggtcgctgtttaccagctcggacgagtcctcattcaccaccgagagcacaagggactcgttcagcgttgtggactacggcgacaacgctggcctggacccaatctcctcgatatttgggccaagctatgctccggagcatcatcccggtccacctggcagtttcgccgcgtgcacgaggctctcgccttccaacccacagacgaggtacttctcggagagcacagggttcgtctcggactactcttccagcggcattgtacatagaggaagggatccaggtagggcatacacctgttcagcggaaccgctcggttcggcggctgcggcgcaccagcaccagcggtacgcacttagcggccgagacggtttggtccagacatctgggttctgccaaatgtaaccggctttacgatttcgtagctatagctgtagctggtgctcgggcagctgcggtttagcactgccactgatgctgctgcctctatgttctttttatttcagatgaggcgtattaaattttggctgcatgtcattcctaggctagctcgattcaatgtagcgagagagagagaggaacaaatttagattgtgtctatatgcaggtgaaattttagagcgcggtggagctgctccggttgaagccatcccccgaggcccgaaccagttaattacgccgaatccggcagtcgtatggccctgcacaccagtgctttgtg

SEQ ID NO: 5198 - DNA, 1461 bp, Zea mays
attgtgaattataactcgattggcgaatatctgaagaaaaacccaaaatacaaagtagcgccgccgtgctcgtgctccagcgacctcgatggccatgcatcccgttgccggcgccggcgcgccccccgcgtcgtcggtccacggcaacgttgagtacgacgacttccactgggacgacgcggccgaggcggagcttcaggccttcgaggccgcctacgcctcggcttccgcctccgcaaagcgccgccgcttacccgactggacctctccatccccttccccctcctaccgcctccatcacagccaaaacccagtgtccagtggatccacgccatcgtggaccctcacgccccacacaccccaagacaatgtgagggcaagacgccaacaaatatcattcagcggtaagatagtttactgcaggacacctacagaggcggagaaagctgcaactgacatcttactcaaaattgagaggatgaaaaccccaggccaggtttctcttggatttgatctcgagtggaggccctttccaagaagaggagaaccaccttgtaaggttgctgtaatgcaactatgcatggagaaaactctgtgctatgtcctgcatattgctcactctggggtaccgcctatactgaaaactcttttggaggatagttcgtccattaaagttggaatatgcatagacaatgatgcaaggaaaatgtttaatgactatgatgtctgtgtacaaccactaatggatttgtcgaccttggcaaatgtcaagttagcttctcccaaaagatggagccttgcttctttaaccgaaatgatcacatgcaaagagttgccaaagccgagcaacataagaatggggaactgggaggctgatgtcctctccaaacaacaacttcaatatgctgctacagatgcttatatctcatggtacttgtatgaggccctgcagactcttccagattacacgattgaagctgagtctgtaaaggcacaataacttcaagtggattctattgggaactgttgtgttagtctattatcttcacatctcaatcaggtgcgagtagacgtgcaagctgcatacaaacgcgattgtgtaggactccatgagtatgaataagtgtccaaggcagggggttgagtaggaactgggaagctcctttgtcgcaacaaatggatggtgaattccgtgtgagtatgtgtgttgtgcacttccagtttgcacttgtaaatttattctcctcgtatgtgaagggcgtgtctgttttttttttatttaaagaacttgactgttgtatgagttcgcaccccatttttttttgttaatacaacaatgatatgcagctctcttgcgtatcgagagggaaaaaaaagagatggttagttcctttgtcattgcttaaggtaaaaaacatgaattggactattggtattggactggaaaaaaaaaaaaaaaaa

SEQ ID NO: 5199 - DNA, 917 bp, Zea mays
  misc_feature (892)..(892): n is a, c, g, or t
  misc_feature (908)..(908): n is a, c, g, or t
gcacgagaccattacctagaacatcctaatcaaaaaaaaccctagctcatttctgttctcctccccagccgccagaatagtatccagccgccaggaagcatggccgacggcgcccttctcatcctttctctgtttctgttcttgcactgccaggccgtgccctttcccactggtgatggcgagtagctcaactggcccttaccgccaacgagtgcgtccccatgtgagggtgcgcggtcgtcggtcggtggccggtgagagctcggctagcccaaaaaaaaacaaaaatatgtcggccatcgccttttgaaccttgcccgacgaccaaaaccggccgcctctcctctctgttcatgctctttctaatctctgtttctaagttccagaccgctcacccaagaaccggtcgccaggagcttgggccgaccgagctatccttttctccctgctccttttggccgttcgccccttctccttctttgtttctgttttttttatttctttctagcatctagccgctagttactctctctatttctgttttttttatttcttgttcttgaatctggcgctatttccctcgccttgcgcgggcaggtcttttccttcaccagagttggtcggccgattatggggcgccgtctttaacctttcgaaactcggatctagtccccgtttactcgaatcccttattgtgtgtgaatgaatgtatgagatggatctaatgtaatattcgggatcgagttatgagctgataaaacgtagatccgagaccttgcgttatttctgttattttctgtgatgattttctgtaccatttctaatctgttctgtcatctaggccacggatttaaaataccccgagccactgtgatctaaaaaaacccagatntaacacagattatggntaggttatt

SEQ ID NO: 5200 - DNA, 1914 bp, Zea mays
gatcaagtacattacacttgggtcttttctaattgaccttatggatgttgcattgcgccatcttaaggtcatcctaaggtgagcctactgtaggcttactgggtttctcaaaccacagtgaggaatctatttcatccactgtagttatcatttcaatcttttcacgccataagtggcaataaataccacatagcggtttaatctgtcttgtctgaccaactagtagccagaatatgcacttttgcaaagtaaaacagaaaatatttaggacgtctgaagtaaatactgaaacataaaacttgcatgaattaaatattcgacgttggtcaaataataatcatgtctgatctacaaattttcttgttctaaaattctaaaccatcgttggatgatctagaaaacttaattcttgtataaaatgtggcaacaatattcgacgttggtcaaaatattcaatcaccacaaaaaaatctgaatttctatgcacttaaagagaattaatccacgtaggcttcataataaacaataatgcatagaaaaacaaataataatctggttctaaaattctaaaatcatcgttggatgatctaaaatatgtatacttctgttcaaaatgtggtaacaatatctaacgttggttaaaatattcaattaccacaaattttctgaattctatgcaattcaaataataattattccacgttggtttcataatcaactcagaattgcataaaaaatatataaataaaagtaccaaagtacgcagcggaataaaatagtccataaatatgtctgtaattttctataactgaaaaatttatatttatgaaattttctgttttttttctgtactatttttttcttttactgtttctgatttctggaaatagaaaaaaaaatccagaaaaaaattggagccatttcggccctggtcggcctgtgaggctcagcccacatggcctttcggcctgcttagacgggcggccgcgcgcccaggccgcaacctaggcctgggccgcgcatctggctcagccacggcgagtccctttccacccgccgagatcctggccgtcgagccgatctgaaggtccagatccacccgtgtactgtagcaaggtctataaatgccatggagcccgccgccgccgaaaaccctagtgctcatttcttctcacctccccagccgccacaaaacaaacgagccgcattgctcctgaccgaccgctcttacttcccttctctctctgtttcttcatttctactccacctgccccacagctactcggctgccagggagaaccagccgttagcttctctactccctctcttgtttcacgttccttcagcgcgttctggtggccagcgcatcgcagccaccgcgctcaactgtaaggcacgcgctagcggcttttcggtcgtctctatgcacagtgaaacgggcaccgcagacctcgccggcagcgagctcatcccttcgggcgggtgagctgctgtcggccgggaactgaccgcagtccgagcacgacaggttgggtgtctgtctcttgactgtctttaacttttaaaacttggatctagtcctcatttactcgaatcccttactgtgtatgaatgaatgtatgagatggatctaatgtaatattcgggatcgagttatgagttgataaaacgtagatccgagaccttgcgttatttctgttattttctgtgatgatgttctgtacctttgactgaaaaaaaccagtccaaggattatattgatagtgctctgtacacttaatctgtacgcggtttcttattgactgtttcttggccgtgaattaaaaaaaaaaaaaaaaaagccctctctgttgacctagtttaaaactgatttggggttaggtaattaaaccctaaccctaaacatcgatcttg

SEQ ID NO: 5201 - DNA, 1000 bp, Zea mays
ccgcccggccaaaccctaacttcttttctattctcctccccagccgccattcacatccggccgccaggaagcaccggcgcctggccgacggcgagcctcccttttcccttctctgtcttctgttttcgttctatcagctgcgcagaacttcagccgccaaggaactctggttcttggccgaccgcgcgctgcttcttcctctctgttttttttctttgccgcgctcgtccggccgcaaggaggctcctggctgaccgcgacgtggttatcctgaccgagcggttccctggctgaccgagtgatctctctctgttcttctttttcttgtatgttctctatatccggttttcttgtccgtctgttgagaacatgtgcacccggatctagccccagcctcgatccctctatgtgttgaatgcatgtaagaaatgtcatattctgtaatatgggatcgagtttacggggtttcttatgcgtggatctgggccttcacacattttctgtgatctttttttttgtgcgctagagtaatccggtcctcaaacttcacgagaaatgcactatgcacttaaatctgagccggatttgtggggaaaatagttggtgtctgtaaaccctaacccgatctatgtttctgtactctttctaactgtttccttggccgtggattcagaaatcccgagccatttcggtctatgttgactcgatttccagtggattctgttatttactcgtggatccggtcataaataaacagtgtactgtgcactttgaccgatctggtttttggggctaagtcggtttgggttaaagaaccctaacccgatcctcgtttctgtttttcttgactatttcttggtcgggcatcgttggatcccgagccactattatctctgttgattagtttttaaaaccttttaggattaggttattaaaccctaaccctaaaatgtcgatctgtctttatttactatcagagttctaaaattctttctattct

SEQ ID NO: 5202 - DNA, 1356 bp, Zea mays
ctgtaattttctataactgaaaagatatttctgaattttctttacaatttttctgattttcttgtactgtttctgatttctggaaatagaaaaacaaattccagagaaaaaaaaaattggaccatttcggccctgatcggcctgtgtggctcagtccacatggcctgcttagaaggcggcccagttggcgctggcagtctggccgcggggggaggcgcgcccagccgcgtgggttggcggcccagccggccttgccgtgagaggggaaggtgcgcccaggccgcaacctgggcctgggccgctgttctggcccatgcgggcgctcccttcccttcacttgatctcagccgtcgaatctgatccgacgatccagcttcttgcgcgcaggctataaagggcggggccctcggcagaggccgccaaccctaacttcttttctattctcctccccagccgccattcacatccggccgccaggaagcaccggcgcctggacgacggcgagcctctcttttcccttctctgtcttctgttttcgttctatcagctgcgcagaacttcagccgccaaggaactctggttcttggccgaccgcgcgctgcttcttcctctctgtttttttttctttgccgcgctcgtccggccgcaaggaggctcctagctgaccgcgacgtggttatcctgaccgagcggttccctggctgaccgagtgatctctctctgcttctttttcttaaaaaaatgagcatggccgaccgcacttgttgctctaattatgtcttttctttctttccctgtctttgtttttgtgcgttctctagcatctggccactagttcactggagcacatgcagttcattcgttacaccactggccatacagccatatgcctcacggtcccttttttttttttgcatcacttgaactcagccgaaaaataccgtggtgctcatggccgtttctggttacacttatactcatatccagcctcatgtattcgatccctctcttctgtgtgaatgtatgtatgagatgtgttataatttatgggatcgagtacggaggtctaaaacgtggatgtagttcactttgcgttttttttcctctgataacgcgtggatccagtcactcgatcaaacgaacagtgctctgcgccctttgactgatccggatttagggttaatttaattagggttgagccctaactggatctgtgtttctgttacttgactttgtttgttggctgtggatcgttggatcctgagccttgtgcaccgtctggttcaactgattagggttaggttattaaaccctaaccctgaaataacggtgcgttttgctctcggtttccatggg

SEQ ID NO: 5203 - DNA, 870 bp, Zea mays
tcgggccccgcccgcccggggattcaccctaaccattctacttctttccccagccgccacaaaaaaatctggccggccgccaggatctattggccgacggcgcctatcctcctctctctgtattctattttctctctcagccgcgcagaacttcagccgccatgaaattctggttcctgaccgaccaatcccttcagctgggctgtgcgccacagagagatttttgcttctcactgttctttttatttcttctggccgcactagtactcggccgccagggagaaccggtcaatggcactgtgcatttgaactcgaccggcactgtcttctctctctgttcttgccttcagctcaccgtctattcatttttttaaggcgttctgttcagccgtcggcaagctatcccttctctctctgttattgtgcaccgagctgctctctgtttttatttaattattccgagcagctcgtgctagtgacctcagccgctggccctatggagacttgaggaccggaccccgcagaccttgccgctggtgagctcatccccgcgggcgggtgagccgctgtcggctgggagctgacgatggtccaaaacgtcgggtcgaaaaaattgagtcggttttataaccgtctttaacctttgaactcggatctagtcctcatttactcgaatcctccactgtgaatgaatgtaagaaatggatctaatgtaatattcgggatcgagttatgagttgataaaacgtagatccgagatcttgcgttatttctggtatttttttttctgggatgatattctgtaccttttctaatctgttctatcatctaggccgtggatgtaaaagatcccgagccactgggatctat

SEQ ID NO: 5204 - DNA, 1419 bp, Zea mays
tatacttctgttcaaatgtggtaacaatatctaacgttggttaaaatatttcgttaccacaaattttctgaattctatgcaattcaaaacaataattaatccacgttggtttcataatcaactgagaattgcataaaatatatataaataaaagtaccaaagtacgtagcggaataaaatagtccataaatatgtctgtaattttctataactaaaaaaagataattctgaattttctgcactatttttcttatttcttttctggttttctaattccaggaattaaaaaaaaaccatgaaaaaaatttggaggccatttcggcctgggcggccttaaggcccagcctaggcggcccactcaagcgccagcaggggagcggccgcgcgcctaggccacaacctgggcctgggccgcgcttttggcccatgcggggcgctctttaccacccgccgagattctggccgttcagctagatcaacggctcagattcttgcgcatgctggttatatattgcggtaaaatcggaccctagggaaaaaccctaaccattctacttctttccccagccgccacaaaaaaatctggccggccgccaggatctattggccgacggcgcctctcctcctctctctgtattctattttctctctcagccgcgcagaacttcagccgccatgaaattctggttcctggccgaccaatcccttcagctgggctgtgcgccacagagagatttttgcttctcactgttctttttatttcttctggccgcactagtactcggccgccagggagaaccggtcaatggcactgtgcatttgaactcgaccagcactgtcttttctctctgttcttgccttcagctcaccgtctattcattttttttaaggcgttctgttcagccgtcggcaagctatcccttctctctctgttattgtgcaccgagctgctctctgtttttatttaattattccgagcagctcgtgctagtgacctcagccgctggccctatggagacttgaggaccggaccccgcagaccttgccgctggtgagctcatccccgcgcatccccgcgggcgggtgagccgctgtcggctgggagctgacgatggtccaaaacgtcgggtcgaaaaaattgagtcggttttataaccgtcttcaacctttgaactcggatctagtcctcatttactcgaatcctccactgtgaatgaatgtaagaaatggatctaatgtaatattcgggatcgagttatgagttgataaaacgtagatccgagatcttgcgttatttctgttatttttttctgtgatgattttctgtaccttttctaatctgttctgccatctaggccgtggatgtaaaagatcccgagccactgtgatctctgttgacccagatttaaaactgattag

SEQ ID NO: 5205 - DNA, 1082 bp, Zea mays
gtcttcccccgcagccctcccggggtctttcctcgacgagattcccaaaccgctccgccgccgccgctcgtcagcctccgttctaaccgccgcgccggcgacatgccgcccaaagagctgccggggttctactacgacccagagaagaatcgctacttccccatcaggggccccatcccgggcgctgccgcccgccgcggcacgccagcgccacctccggctgtggacacaacggggtgcagcaggaaaagggctaggcggccggagctgctcaacgccagggagatgtacggcggcggagtcatgttctccaataaagccgccaggtccacgttcaagcagcagtgccactacgcgcaggcgtatcagcccatggtctggaagtaccaagccaccacctctgtggctgataaggcgctcgaacaattggacgccatggttcagacaccgcaagggttgaaagagtccaggctgctagtctccggcagcatgaacggttccattcggttatacggattagggactgctctgagtaactttgagaatgaggcagagtttttgccccaacctgcttgtactcttgtgggaaagcacaagccaggaccactccccagcatttggtcacctggaacaggcttcatagctttctcatccagtatctcatgcataaagaagctcggacgtcatgtccctgatgcatcgaacaccaattcaccagttcagcgagcattggtggctactcttggatctggagaatctcatgcctctttatatattatggatctttctgaagctgttgacttggcaatcggaccatggactacctacagagttcattcacttgatcgaacaatgtggacagctgattgtagttctgatggcacacatgcagctttcggttcggaccttggtgctggtctgatcgatttggaaacaaggggatcatcgtgggtatgtcgttctaaaagcgacattctttccctgaaatttgtgcactcgggaaaagttgtgctatgtgggctacggaatgggagtatagcccctggtgatgtacggcaaaaacagcataatcagcctactgg

SEQ ID NO: 5206 - DNA, 2252 bp, Zea mays
agcctgatgacattatccaccaggaaaaggagaagagcccgtggccgtggcctggccccagctcccagccccagccaacaaaagagaagcccggcccgaactctccttccatcggccgtcgaccgatccgtctccactccaggttcacttcgcctctccctcgccctctctctctcccttgcttctacccctctcccctccaggctccaggtgccctaccgccggaccggcgcccgcctcatgaaggccaaggcatccgccgccgccgccgaggatgacgccgaacccaagaagatccggtcctcacgcagtaagcaccgccgacgccgtcacagccgctcctcctctaggtccgaatctccgccccgcaagcgctccaagaagaacagcaagaggattcctgacaagaagagcaagaggagcaagggcagccgcggcggcagccttagacgtcggcaccatagtcttagccatagccgtagccttagtagcagcccttcctcagtagcccgacgcagcagctcctcatgtagcagcagcagcgcctctgagaggtcggtgagcccgccacccaggagcaggtccagagatgtaaggaggaaaaagggcagagggaggggcagggagagggatcgtaaggggagaaagttgcggagatcggcaagttcatctagcatctcagcaagcagtggcagtagcaggagcaagagcaggaagcggatgactgttggtggcactaaggatcgcgctacaactacaagggataagatggaaaagggctacactgatcgccgttcttgtcggtctgtcatgaacgtggacgagcacgttgatggggatgaagacaggctcgccattgccaaggtggtggacaatgatattgacaggcacaagaagaatttggaatcggagagctcaccttccaagaatgccaatacaacagaagagaaagtacctgcaagtggtggaaattcagatgcccaggatctggagctgattcttaggcagaaagctcttgaaaacttcagaaagttcagggcagcagcgaccatgggaggcaaaacagacagtggagctgcagggaaggaagcatcaatagacgatagcgtacacaatgctggcatggaggttgctgatgccacacattctcagagtcaggaaaccagtcttggagcgaggtattctgctggatcacctagatcacagaattttgggaatggtgcgaatcgttcttggaagcaggacaacggtgctggcatgagttgtggtggatcacccggattacttgagcctgctgagactggtggcccgactcaactgaagggaagagcagaagaatcaactcgtttggcttctcagtttttgtcaccacgggatgccaggaatggccgcagtgtaatgcaaaggctggcgccccctccaggtagttctgctagtgtaaaccaaatgttaggaagcagtgcagggctgaatcatgtcgatggagctccaagggttagatcagttgtgagcatacccgctagggaaaggcttgatggtagcacacatactacaccccttaggcccagtgaggattcttcccctgttgaaagcagcggcaaagttggactccctctgaatgacactaacaaggctgaaggaaccaatggagagaacagaaaaacaagtgaagcttcagcctctgacggttccgtattgtcacctaccgaagacaagagccaggctagtattgagggtaaagatagttttcagaagaggactttctctagaatgcatgatggagagacggtggaggtcagctacaaagtctacatacccaagaggaccccagcccttgcaaggaggaaactgcagcgctgaaaacgccaaacgccaagaatagacaattcatcgtcggtcttactatctgcaaaaactataggttttggctggatatacctattctgtgaaccacgagtgcccagcatacatgccttgtggaatctggatatctgttgctcaactaaataaacagttttcctacagcaaatgtattaattgtctgggattgggtgattgagtcgttgtaatcagcaaacatgccgtccaatactgatgaaactgtcacctgcacaaaaaaaaaaaaaaaaagtagtcttttagacatgcagtagctaccttgctgcaagcggacgttggacttggacagacactgcagaatgcagatgtgcctgactgtactctctagtctgagatttttaagcctgaagttc

SEQ ID NO: 5207 - DNA, 3194 bp, Zea mays
  misc_feature (55)..(55): n is a, c, g, or t
ctactgtgtgcgtgcggctgctgcagcagcaggtcttgccgcgcgagtcgcttcnagtggaaagccgctagactagggtagtagctagcagttctcggtgctgtttcccacttccgcaccgaaagaggaatgctttcttgcttgcttgcatgcatgattgtccgtcctgccgctaccgggctggctggctcactgagcattaggctgactccagcagtaatcctatctcatcctctatcttaaacttaccataatttacaggatatctactatgctaccagcattattttcatcgaccgatcaacgcacggcctaaccgacaccggcagccggcagacggctgttgaatttgctacaagcaccgttcactcacatgttacaaggtgccttgcctttagtaagctacgtggattattccatcatgtcatgtgtagtgggcggcttttgaggtgtcgtgtcagatctcgacagggcacatgaccagtcgctgccaaggtctctagaaatatcattaggatacttgccaagttttagacttctgaattttagcttcattttacactataattatatatatatatatatataattacaattacggtttatgtgttatagtttatgtaactataatatgtgattctgagttctcaaagcaaaaaatatatatttgttagacaaaatcgtaatcccaataaaatctaatctatcgatacaaaaaataatcaacaattatgtatatagtcagacagtgataaaaaataacaatatattatgatagaaatataatccatgtcaacgagtacgtcgtagtgtggtactaataaaatctgtatgtatacgattaattatatatctctgcatgtcaacgagttattgtggaaggcccttgatcgagtcgagcccacggcgtggttaatcgaacacattggcacacgagccacatgctctcgacgatcgatgatctgcatgcatttaccttaataactaggtacaacaaccgcgttcgtttcagaatctaaccacatggccggcggcgtcgggttactacgcaccacgaacgacgatcgctagcttgctcgttgacctctagtttgcatgctttgttattaatcggtgaattagtttctactacaccctattattgagtgattttattagatccttaataagaaatgggatgaaagcgggtaaaagtggattctctactaatcttgactaaaatacagatcgagtgaaggagagagcaaggtgaaggaggggattttttttaatttcctaccctaaaccctaatcccacctacctcgtgatatgaaagtctgtaacaatgcccttgacttgcatggtggtctgttagcccgatcggacactggactctggagcacgccttaacagctcgtcctaatcaattggacagcgctcccaggccccatctcgagcacagtacagctggtagtagactgcgtgaccaccaccggcgtgtccccgtcatcacatgcatgcatgctcgcatccgtcgcctaaacgacccttgtattactggaccatatatatgcacacacgccacacgcatcttttcattaatttcactgtgcacgcatggtggtatggatacatgctgcatagtactcctactactggagtagtggtatttgtttgatacataaattacaggacaggaggagggtgtgtgttgtactctcctggatcggagtcggagtgctacgtggcagcaccagacaggcagggagacagttaagtactccaaatttttaatttaattaattagcctgacatgccagctcctttccactgacatactgccttgttatttcgggcggtcggtttctcttccacgccacgcgtgcccaattcactggttctctcgtgcatgcatgtctgactatatactaattggatggatcctaatctatatcgatctcccagacatttttacgtcctctgttaaagcagcgaaaatcaagtcggtatattcttatgagtaggaaaggcattattgcagtggacggacggacaacgcacctctttcttgccggttgttgccgccgcgggcttgttgctaccgccggagccatcatctttgcgcgagctggacgtcgaggtgacgctgacgaccgccgggggcacgggcacggcgaggggcgtggcgggcgcggaccggtggcggcgctgctggtcgcgggcgacgcagagctgcatgatcctctcggcggcgtcggcggcgtcgcggctgtcgtcgacgaggcgctggacgtcggccttggggaggcgcacgcgcaggcgcagggcgccgccgtcgccgacggacgacgacgccgccacgtcggacgccgaccgccgcgccagcatcaggctctccagccgctccccggccccggccacgccgccgtagtggagcgcgccggaccacgtgcgctgcggcgcccggggcccggcgatggtggtgggcggccgacgacggcggaggcagctccaccaggaagtagagcttcccgggcttgagcggcgcgtccgggtccagcggccgcgcgcgcaggcccagtcgccgcacctcctccgactccagcaggtggttgcccttgcccgggtgctcgcgcagcgcgtccccggccgccgcgggggcgcggtacttgtacgtggtgccgtccaccgtcatcaccctcgccctccgccgcttcccgcccatggagttgcccatatggtgattgttgtcggtccccgcactgcactgcacgtagacgtagcgatcgagcgagattggtttggcgttggcgaacgtctctgtgaggcgaggaggcagcgcggagagagatataaagaccgcatgcatgtgaatatgtgacgactggacggatatatgagctgagcaagtcaatcctgacagcccgattattctaatctccgttttcgaatatttataagtttcgaattaaaacacgataaataaaaataaatagggagtagtgtatatagcgatgggtgcggttgggtaaacgtggcatgttccaacgtggggggattgcgaattattgcgttcgcgatcgataaacatgcagtggggacaagctagacaaacagtgtccggggcggaaatttttttgcaaggccatgtgagggtcggagggcgatcttttgtcggccatacgcatgtgaccttttctagagcgggcaggca

SEQ ID NO: 5208 - DNA, 1444 bp, Zea mays
acacacatacactcactcgtacgccgtcgcttcctgcggtacgtactctctgtccgcagcgttcctccagctagtagcagtagcagctagctagctagctagcaactggccatcggggctgctagcagcgtacgtacgtggcgcgatggctcctccagctcatgataggctccgccgcctggtgctgctcctcgtcgttgccaccgccgcggcggctttgcttctggcgccgacgacggcggatgctgcgctgccgcgggtgcagcacacgcccaccaaggccgacgggtcgctcgccatcctcgtcgtcggcgactggggccgccgtggacagttcaaccagaccttggttgcccagcagatgggcgtggtggggcagaagctggacatcgacttcgtcatctccaccggcgacaacatctacgacgacggcatcgccaacactagcgaccccctcttcaaggaatcgttctccaatatctacactgccaacagccttcagaagccttggtacctggtccttggtaaccatgactacacgggaaacgcgctcgcgcagctcgaccctgccattcgcaaagtggatagccggtacaccgccattgccaagtccttcattgtcaactcaggggttgcggattttttcctcgtcgacacaacgccgttcattgtccactactggaacaacaccaagttcgattggagaggcgtcgctcctcgagacacctacatcgcgaatctcctcaaggacttgaagtgtgcactgacagcgtccaaggctccctggaagatcgtcgtgggtcaccaccccatcagcagcgcctgcgggcatgggaacaacactgagctggaggagttgcttctcccggtcctcaggacacacggggttgacatgtacttgaatggccatgaccactgcctgcagcgcgtcagcagcagagacagtcgtcttcagctactaaccagcggcggcgggtccaaggcatgggctggcaagttcaagcccaccctcgacaaggtggagttcctctacgacggccaggggttcatgtcgatgcgcctgagcaggacggaggcccgcctcgcgttcttcgacgtcgctggcagcgtcctgcactgctggaccatgcatgcccaaaaattaaagacgacgacgacgacgactgctgctgctgctgcagccgggcactaaagctttgctggatcggagttattaatgttcgttgctgcctcgcggcggtacgatgagttgatgatgcaattaattatttggttttgtcgtcttttcgtgcgtgagagggaagcaataataattatttgctgctgcttccgttgtgtgcacatgcatgtgagggtgtcaagtatgttcagcctcttgcaagataaaatctctcgtcttctatggaataaactgggaaaagagttttttttggtaaaaaaaaaa

SEQ ID NO: 5209 - DNA, 788 bp, Zea mays
gctggagctcggccgcggcgcgtgtttttttttttttttttgatgcccaatttttttttaattcctctcaatggccatgagacgtaaggccttaaaaccgttgtagatgccagtcgaagtggctagagtacagcacgtatgtgtcaagcggtcatgaaaccaagtccgcacctctaatcatcctcacatccaacgccagttcagacatttactgctcggtctggaagtagttcaggaggatagatcgctcctgagactcctcaccccagtccttgacaacgacgcaagagcagttgacgaccttgcgagcgttaccctcacggtcgagaacgcagagaccggcccactcgccgagctgcttgccgtcggggatctggatgagagggatgttgtgctcgttgcagagagcgacaacaagcttcttgtaggcctcctcctcacagttctcgttcaggacacacatgtgagcctggcgacggtcaagagccttggaagcctcacggagaccacgggcaagaccatcgtgcatgagagagagcttcaggacacccttgagagcatcgagaatggacatctggcccttgggggcatcgccggaaacctcgacaacgtcggcgacctcgggggtgttgtcttctacgtccgacatcttgaatatttttttctcgtcgggcgatcctcgaagatttctatgtgtatcaaggagaagttggaaggggggttgagtcgtgatctggaaatcgcccccgtgcccccccggcccctataggtcttcgtttccaggccgg

SEQ ID NO: 5210 - DNA, 1129 bp, Zea mays
attgggacctcgacccggcgggtgacggccccttcggaggtcaaaccagagcagcaggcagcagcatcgctgcctataaatagtctcgctccgctggccggccgccgggaccagcaccgaggcaggagcggcgatccattccacacaaccaccactgctcttgccccagcccgccgcaggagttgccagatctgctccggtcacaggagctccgactccgagccctctccaatggcggttaaggtctacgtcgtgtactattccatgtatggacatgttggcaaactagctgaagagatccagaaaggtgcctcgtctgttgaaggtgttgaagctaaaacatggcaggtccctgaaaccctccctgaggaagtgcttggaaagatgggcgcaccccctaagcctgacgtgccagtcatcacgccgcaagaactcgcagaggccgacggaatcctcttcgggttcccaacgaggttcggaatgatggcagcgcagatgaaggcgttcttcgatgccactggtgggctctggagggagcagagccttgccggcaagcctgccggcgtcttcttctgcactggatcccagggtggtggccaggagacgacagcgttgacagcgatcacccagttgacgcaccacggcatggtgttcgtgcctgtgggctacaccttcggcgccaagctgttcggcatggaccaggttcagggcggcagcccctacggcgccggcacgttcgccgccgacggctcgaggtggccgagcgaggtggagctggagcacgccttccaccaggggaagtacttcgcaggcatcgccaagaagctcaagggttcagcctgatctacacatatacccttgtcggatatcataaaaaacacttattacagattcgtcttacccatcaatagatcggtctgttctctcgtggtgtctggatgttgtgtggctcagtggaactttcatgctacggtgactttgttgtaatctggagttggaatatcgttgtttcgcataaatttcgatgatttgctcaagtaaacggtttgtttggttcagaacaagataaaaaaaaaaaaacaaaaaaaaaagctgtgaaaaaaaagtactctgcgttgttaccactgct

SEQ ID NO: 5211 - DNA, 1022 bp, Zea mays
ccttggggtcccccgggcccgcccggccgaccaccaccaccaagccagcaggcgctgcgatacattccacacaacaacaccccagctctgccccagcccgccacaggagttcccgcatctccctctggtctggtcacaggagctccgagacctctccaatggcggttaagatctacgttgtgtactattccatgtatgggcatgttggcaaactagctgaagagatcaagaaaggtgccttatctgttgaaggtgttgaggctaaaatatggcaggtccctgaaattctctctgaagaagtgcttggaaagatgggcgcgccccctaagcccgacgtgccagtcatcacaccgcaggaacttgcagaggctgacggtatcctctttgggtttccgacaaggttcggaatgatggcagctcagatgaaggcgttcttcgatgccaccggtgggctctggagggagcagagcctcgctggcaagcctgccggcatgttcttcagcactggaacccagggtggtggccaagagactacaccgctgacggcgattacccagttgacgcaccacggcatggtgtttgtgcccgtgggctacaccttcggcgccaagctgttcggcatggaccaggtccagggtggcagcccctacggcgccggcacgttcgccgccgacggctcgaggtggccgagcgaggtggagctggagcacgccttccaccaggggaaatacttcgcgggcatcgccaagaagctcaagggctctgcttgatctgcacatacccctctgtcagatatcataaaacatttacagattcgtcatacccgtcaccgtcaatagattggtctgtgttctctcgtggtgcctcgatgctatgtagttcattggtactgctgccgtatgaatttcgatgattgctctggtgacttggtttgtaatttggagttggactatcgttgtttctgccgcataaatttcgatgatttggtcaaaaaaaaaaaaaaaataaaaaaaaaaaaaaaa

SEQ ID NO: 5212 - DNA, 1030 bp, Zea mays
ctcctatagggcgattggttcacaacaagccggccgggaccaccacctgcaagccagcaggcgctgcgatacattccacacaacaacaaccccagctctgccccagcccgccccacaggagttcccgcatctccctctctggtctggtcacaggagctccgagacctctccaatggcggttaagatctacgttgtgtactattccatgtatgggcatgttggcaaactagctgacgagatcaagaaaggtgccttatctgttgaaggtgttgaggctaaaatatggcaggtccctgaaattctctctgaagaagtgcttggaaagatgggcgcgccccctaagcccgacgtgccagtcatcacaccgcaggaacttgcagaggctgacggtatcctctttgggtttccgacaaggttcggaatgatggcagctcagatgaaggcgttcttcgatgccaccggtgggctctggagggagcagagcctcgctggcaagcctgccggcatgttcttcagcactggaacccagggtggtggccaagagactacaccgctgacggcgattacccagttgacgcaccacggcatggtgtttgtgcccgtgggctacaccttcggcgccaagctgttcggcatggaccaggtccagggtggcagcccctacggcgccggcacgttcgccgccgacgggtcgaggtggccgagcgaggtggagctggagcacgccttccaccaggggaaatacttcgcgggcatcgccaagaagctcaagggctctgcttgatctgcacataccccttatcataaaacatttacagattcgtcatacccgtcaatagattggtctgtgttctctcgtggtgcctggatgctatgtagttcattggtactgctgccgtatgaatttcgatgattgctctggtgacttggtttgtaatctggagttggactatcgttgtttctgccgcataaatttcgatgattgctcaagtaaacgatttggttaaaaaaaaaaaaaaaaaaaaaaaaa

SEQ ID NO: 5213 - DNA, 997 bp, Zea mays
  misc_feature (23)..(23): n is a, c, g, or t
ccctatagccagcaggcgcctcnatacatgtgggacacagggggcccccagctctgccccagcccgcccacaggagttcccgcatctccctctctggtctggtcacaggagctccgagacctctccaatggcgggtaagatctacgttgtgtactattccatgtatgggcatgttggcaaactgggtgggagatcaagaaaggtgccttatctgttgaaggtgttgaggctaagatatggcaggtccctgaaattctctctgaagaagtgctgggatcggcacgagcgccccctaagcccgacgtgccagtcatcacaccgcaggaacttgcagaggctgacggtatcctctttgggtttccgacaaggttcggaatgatggcagctcagatgaaggcgttcttcgatgccaccggtgggctctggagggagcagagcctcgctggcaagcctgccggcatgttcttcagcactggaacccagggtggtggccaagagactacaccgctgacggcgattacccagttgacgcaccacggcatggtgtttgtgcccgtgggctacaccttcggcgccaagttgttcggcatggaccaggtccagggtggcagcccctacggcgccggcacgttcgccgccgacgggtcgaggtggccgagcgaggtggagctggagcacgccttccaccaggggaaatactttgcgggcatcgccaagaagctcaagggctctgcttgatctgcacatacccttctgtcagatatcataaaacatttacagattcgtcatacccgtcaatagattggtctgtgctctctcgtggtgcctggatgctatgtagttcattggtactgctgccgtatgaatttcgatgattgctctggtgacttggtttgtaatctggagttggactatcgttgtttctgccgcataaatttcgatgattgctcaagtaaacgatttggttgaaatgaaaaaaaaaaaaaaaaaagcggcc

SEQ ID NO: 5214 - DNA, 1421 bp, Zea mays
  misc_feature (1397)..(1397): n is a, c, g, or t
tccacgtttccgggaccgcgagggttttaagaggaggcggcggcccggcgcgcgagggtttttcctgatctcgcctcctcctacttcccgagccacacacgctgccgccgtgagccgccgcccacaaggcttagcaccaaccatggccttcggagctctcgtcacgtcgaggctggtcaggtccggccacacccttgcatctgccgttgcccagggtcccgttgcccagcggatagcacctcctctgctctccaggcttggagcagtagctcgtcttctcagcacaaagccagccgcaacagatgtcatcggtatcgatctaggcacaacgaattcctgcgtctccgtcatggaaggaaagacaccacgggtgattgaaaatgcagaaggcgcgaggacgacaccctccattgttgccaagaatcagaatggtgacctgttgattggtatcacagcgagccggcaggcagtaaccaatgcccagaacacaatccgtgggtcaaagcgtctgatcggtaggacttttgatgacccacagacccagaaggagatgaagatggtgccttacaagattgtcaaggcgccgaatggtgatgcctgggtcgagatgggtggccagcagtactcccctagtcagattggtgcatttgttctcactaagatgaaggaaactgcagaggcttaccttggcaagacagtctctaaggctgttattactgtcccagcttattttaatgatgctcaacgccaggctaccaaggatgctggtaggattgctggactggaagttatgaggattatcaatgagcccactgctgcagctttgtcttatggaatgaacaacaaggagggccttattgcagtgtttgacctgggtggtggcacatttgatgtgtcaatccttgagatatcaaatggggttttcgaggtcaaggcaaccaatggtgatactttccttggtggtgaggattttgatggtgcactgcttgagtatctggttagcgagttcaagaagtcagacaacattgatctgagcaaggacaagttagcactgcaaaggctcagggaagctgctgagaaggccaaggttgagctttcgtccactatgcagactgaaatcaacctcccatttatcactgctgatgcatctggtgcaaagcacttcaacattaccttgaccagatctaagtttgagtctcttgtgagcaatctcattgagaggactcgcatcccttgtgtgaactgcctcaaggatgctggcatctctgctaaggagattgatgaggtcctactggttggtggtatgactagagtacctcggccgcggccacgctatctcagatattcaacaagccactaagcaagggtgtcaatccttgatgaggctgttgccatgngagctgcaatccagggtggcattt

SEQ ID NO: 5215 - DNA, 859 bp, Zea mays
cattgggtacctcccgcccggccggcctcccagccgtgccgcggaccgcgagggttttaagagaaggcggcggcgccgttcactaggggtttttcctgatctcgcctcccgagccacacacgttgccgccgtgagccgccgcccacaaggctaagcaccaaccatggccttcggagctctcgtcacgtcgaggctggccaggtccggccgcacccttgcatctgccgttgcccagggtcccgttgcccagcggatagcacctcctctgctctccaggcttggagcagtagctcgtcttctcagcacaaagccagccgcaacagatgtcatcggtatcgatctaggcactacgaattcctgcgtctccgtcatggaaggaaagacaccacgggtgattgaaaatgcagaaggcgcgaggacgacaccctccattgttgccaagaatcagaatggtgacctgttgattggtatcacagcgagccggcaggcagtaaccaatgcccagaacacaatccgtgggtcaaagcgtcttatcggtaggacttttgatgacccacagacccagaaggagatgaagatggtgccttacaagattgtcaaggcgccgaatggtgatgcctgggtcgagatgggtggccagcagtactcccctagtcagattggcgcatttgttctcactaagatgaaggaaactgcagaggcttaccttggcaagacagtctcgaaggctgttattactgtcccagcttattttaatgatgctcaacgccaggctaccaaggatgctggtaggattgctggactgggaagttatgaggattatcaatgagcccactgctgcagctttgtcctatgggat

SEQ ID NO: 5216 - DNA, 6620 bp, Zea mays
ctacattttatttgatggatagcaatgtgtacccctttattattagctaaaatctgctctatatgctgcaaatttcgaaaatggatgtcgtcgtcttcaattgaaatatacaaataagaatttcgaagttctcatacgttagtagccatcgcaactactccctcccattccaagttataactcattctgatttttctagatgcgtagtttttgctacacgcctgtatatgaattacgtctagatatataataaaagctactaactttagtttaaattacaagacattttagatcttttggatatacagcttttgtcatacagttaaaatgttaaatacacactatatttcaatagtaaaaatgtatctaaaatgtaaataacttacaacttaaaatgaagagaacaagtcaatttgaaaagagggagtatttatatgatgagatgaccttcaggtcgcatcttctgaactcctcaagtgttgtaatctgttggaatggacggatgctgattgctgaccaatcgcgcaagcagtttttgagctttactttcaaaaagaattcgcttgcttttgaaatacgcccagaccccagaataagggaagccgccgttgccatttgggctttggccccgcggtcgttatcgatggttcatggaaaggtcaaaggtgacgcaggcaggcttgctttcatatcagtctcatatgatttcagaacacggtactatttccgaacaatatgatgaatattgtagcatttttttttgttgttgttgtaactgaagctgaagggaagacgtgtttggtgaaaaggtgtatagatttgcaaccaaagtaattccggcacaagaacgtgaaattggatcaaaaaagagtggaggccagaagcaatcacataaaagtatgcatatatttgccatcactcatattctcaggaacctttgcgaaagtgatctgtcatttagctagcgcgctcccaactgtgttggtttgcttcgtccttaaaaaaacaaaaaactgtgcaagtttgctggtgaaattggcttgtctgcaacagggacgtggccatggtgatacagcacctccctagtcgtcacagatgcttcagtcaatcagtatgcacaaaagtttttttttctctttttttttagggaagacttcacaaaagatggtagccttacacatttagggcttgttcggttagctctcaatccatgtggattgagtgggattggatgggtttgaatcccaaataagtcaaacttcttctcaattttttccaatctcatccaatccatgtgtattgggaataaccgaacaagcccttactgggctacgggaaaaaggtgcccgtatgtttcaatgggctgaggtgaatggggccctataagcggctgaggaaaaagcacgtccagatttttggtccgttattgggcgagtgacggtttcaacactgctctgtcttattttttttattctccgcctccttttgatcgggtctgtctcgcctctccttttagtttgaatttagaaaataaatctttatcttagcgcgatcactgttaacgctgaggctacacgtctaaacgctaatatagatagcaccaagatctcagccccaaaggctgttgtgacgtctacgtggtagggtcggcgtcgtaattattgacgcctaggcgcgcactttcgctaaatggcctcgcggctaggctctagtgtgttgtgtgcgtccgttacgcatttgacgggtgctacggtgctaccatgggtgaaatataatgcgacgaaaaaaatggcagggattgtactcgttgggcaatcattgccatctggcccaacatttacggcatattttgatgtgcaagcacctaaagcatctacgtacgtctagaaaatataatttacgctctggtgattccggcaggccagtaagtaaggtcgtcaccggcgaactatggctccatctttctccttccccttgaccgcagctgcatccttcgcagcgggtagtgaatgcatggcccgtgtaggtgtagaggctcggaagctgaaccactgttgataactgggcttggcaagcccgtgtagctgtagaggctcggcccagggagtggaattgtattgttgtcggtgacggcaggtgaacgaatggtaacggataatacaggggtatgaaatctcaaccttctctcgctgctcttctccctctctgttcttgttgctgttctccaactcttcccaaattccgctcaactctaccctataaatccattcaagttcgtgacaagtgtctctggtccgttcgctttgaattaaaaccactgctgtaataactgtaaattataaagataaaaatactgagtatgagtagaaatctgtacggattaaaccaagcaaacagaaaagaaacttctccgctcgcagcgacccgcagatgcggccgggcgcccgggacagctggtgcgcctctcgcgctttgctgcggctgcacggctcggctggcctggcacacgcacaccacacactgccgctcgcacctcgcggctcgcctgctccagcgcacgcgcgccagccagttgcgacgcgatgcgtccaatcgccgcggcgatttttattgggagccagccagccagccgatggacaaaaacctctggtagtacgagtacgagccacatcaagccaacgtgggccccggcccgtagctgtgcccagcctggacggatggacgccggcgtaaaagcagaacagcgcacgcctcttgtcctgcgtactcgctggcttgtggggtcacaggcttagccaggcccacgggccacgcaagacagttgcggcttgcgcggggtctctgtgggccagctggttgatcggcgaccggattagttaatggaaaccgggcaatggaatgatgaggcgttcatgattgagatggtttgatggatacgtgctgcaggccgccgccgtgcagctgcggctgctggacagcgaagcatcggagcagtttacaacaatttttttcacagcagatagcatgtgaggtagattgagcatagtcccccccccccccccaaatcacagttgctcaacagttatatcatagcacaggtgctcacaatggcttttctaaatgccacaacttatatctgattttttccttaaaaaatcactgccaaaccagacccacccttctaaccttttcctcctccctcgttacatcaagaataaattacatttctttcagatcagggagatgagtcatcgccatgcagtgacccggtgttctcccgccgagtccgccgcacgcgtgcgtccgtttccttttaaacaaaaatccttgtccactgcggcggctgtcacatgacagatccggccctcggccacccaggattacctagctcgtgtgttgaaaaatgggattatgagggcaccagccgagaatgcgctgacctgccacgctagcgcattggattcttcaaaacattcgcgcacctgatcaccacgctggctggctatcctgcactgcacatgacagctccaccggggctgggctcgctgcgttcctgccgtgctgcttctcgctcgcccgcccgaaacgacagtccactgtccacggcacctgaggacaccccacgtgcggcgcctgcaaacaaaggtactgctgctacgctacgcacgcagcacgccaacaaattaccagtcctcctgctgctgctgctgcatgcgcatttacagtggtactccactcgccctgatcgcttatcccgtgattcgtgaatttatttcttttttgaagcgttttcgtgtcctgttcgcgacaagatagcttttggtattaacagagcagcagtggtggtgccagcaaacattcacaaaattcccgcatatccctgatgccataatcatggtttttgcagtaaacagttgctagtaatagccaggcttctggaccaccatacacacagctagtcaaaaattccgttcttcgccacggtaaaagtgaaaccattattactagcggcatcaggtgccaagtgccagcaaccacaaaagttacgcccgattatacgccgcccgccgtgcaggtggaggtggtgaaacctatgaccgttactaaacggaaaaactacagcgaaacagcactcgcctcgtctctgatctctgcgcagtagagtgtccagtaacactgttcctgtgggccctactctctcattggtcgtgccgtacgtactagtaggtagagcagctatgtgcctcttttctatttcctaattcctatagaaaccaatatttaaaattttaataccgttattttttatgacatacaatatttgaagtgtttgtagtattttttatttttagatattaattggttcagtatttaaaaattttcttcaagaatatgtatacgcatattatttatatgcgtatttgatgaatgtgggtacgttgtgcaatgtatagttctaatagaaaaaaactagctccaaccaaaaaggaagccgcaacctaccgagaccccgtctgtctggccgcctcgtcctggcagcaggccacagcgaagcgcgcccccgccgctgcgcgtttggatccgtctcggctccagctcgtgtccccacggccaccctcgcgcccatcctgaagcccacactccgtcactgacatccaggccacggaacccgggcccgactgggcgactggggcgtgtgcgtttggtgtctcagtcatagccacagccacggtacaccaggatccagcctggctcctactccacgggctccgccgttcctcacatataccaactcgtcccctcttatctccgtccaccacgcatcatcgcccctcgctcgctccgcaattccgcatcgcctcctatccttcgcccgccaacctcggcgggtcagggcgtgtttcgcgcgggggctgtggcaggaggagcagcagcagcagcgcgccatggacccgtgcccgttcgtgcgggtgctggtcggcaacctcgcgctcagaatgccggtggcgccgcccgccgccggggccggcgcgggcgtccacccgtccacgtcggcgtgctactgcaagatccggctcgggaagatgccggtccagaccgtcccggcgccgctcgtggtctccgacggcggcgagcagacgccggcgtccggggccctcgccgccgcgttccacctgtccaaggctgacctggagtggttcgacgggaagccctcgctcttctcgtcgcggcgcggggcaggggaggctaccctgaaggtgtcggtctacgccggccggaaggggagtgctgcggcgtcagctccgggcggctgctcgggaaggctacggtcccgctcgacctcaagggcgccgaggccaagcccgccgtgctgcacagcggctggatctccatcgggaagcgggccgggaagggcagcccggcggcggcggcggagctctgcctcaccgtgcgcgcggagccggacccgcggttcgtcttcgagttcgacggcgagccggagtgcagcccgcaggtgctgcaggtgcgcggcagcatgaggcagcccatgttcacatgcaagttcgggtgccgcagcaacagcgacctgcgcaggcccgggatgcggcgggagcgcgacgccaaggagcgcaaggggtggtcggtgacggtgcacgacctgaaggggtcccccgtggcgatggcgtccatggtgacgccgttcgtgccgtcgccgggcacggaccgcgtgagccggtccaacccgggcgcgtggctcatcctccggcccgcggccgacggcgcctgggagccctgggcgcgcctcgagtgctggcgcgaccgccgcggcgccggcgcgtccgacagcctgggctaccgcttcgacctcctcgtccccggcgtggaccacgccgccgtcgccctcgccgactcctccatcccctcgtccaagggcggcaagttcgccatcgacctgaccgccgcgcagccgctcagccggggcggcacgccggggtgcagcccgagaggcagcggcgacctgagcaagtggcccctggggaactaccgcggcttcgtcatgtccgcacgcggtccagggcgagggccggtgcagcaagccgacggtggaggtcggggtggcgcacgtcgggtgcgccgaggacgcggcggccttcgtcgccctcgccgcggccgtcgacctgagcatggacgcgtgcaggctcttctcccaccggctgaggaaggagctctcgcacccgcaggccgacctactccggtgacccaccggaccggcggcaacccacgaatcacgagcgaattgtacataggtagttgaggtagatgtgtgctttattagcgtgcgtttgtttgctggagtagttcggttccgctgatcggctagttgatggtggtcgcctttttttttcgtgagcgctgagttcctgagtgcggtgtggtgtgatttttttggctggttgcttcgctttagccatatgtagggtggttcttttttggatctccgtaacttaaggcaatttgtgatcatatggactatgcttccaggtttttttgaattcaaattgaatgggcaacgaaaaaaaaaaaaaaaaaaaagctgctaggctggtgcctgcactgca

SEQ ID NO: 5217 - DNA, 4312 bp, Zea mays
ggcgtggtcgctactcggctgatagggtatttcagacttcagtattaaattattaaatatagacatatagtctagtttacaattccaatttcagacttcgtaagtcatttttctttttttcagattttattcgctatatggcatttgattgtaaatagattataatcaaaatgactattaaataaggtatttttcaacatctattacttattttgtagtaacaagttattttaaactgtcataaattttattttttgttgcattagcaacacctaaattttctggcgtcctccgccactgctgaggagggtacatttagtcttgtgggtgcataaatttttttctaggaatacacatatggtgaaattttaactaaatctataggattggtattttgtgggggtgcatttgcatccacagtgttgaacctagcttcgcccttggccaactgtgacagaagttggcgccagattattcgccatgcaggtgaaacctatgaccgttacaaaacggaaaaaaaaactagtatacgaaactgcagccgcctcgtctgtgatcactccacgtagtaggcccacgcacccagagagtcagagctccaacgtaattcccgacagctacagcctctgattgacatatgggtccagtaacacagttccagtgggcccctctatcattggacgtgccgtacgtaactacgtacgagtagcaggagctgctagctagctccaaccagaaaggaatggaattggcccgtttagcttctgattaaagccattcgctggctccagcttttaactgttctcttctctgtgatgcactataggctaaagcggctgcagcttaggcctgtttgagtttctaaacagcttcttagcgtgaatagatagaagattaaataaacaactagttaatacgtaccggcttctactgattctataaagcttttgtctctatggattataactgaagtagtccaaacagtcggctttaattcaaagcgaacagttattgaaatgccataagctaatttatatagaaagtagaaaaatctgacattgttggctttctttagtagagcctagaaaccgataaaatcgcgagactcaaaagattaacaatagttctttttgaaaagttgttttgggcttttaatcatgagaacttaataatagcttcttcataattttactaggaagccaaaaaaatccataaaactagacttttcaattcgtatataagcctagtttggtgcgaaagctaaacaaaaaacatttgtttatttaaacttcttacttttcatactgataaaagcttaaacaaacgaactttagactgtcttcaacatcattctctatattcatcttttatatctattatttacagtttactctgacagatttttttctctctatctcctgcctctctagcgacatcctttatatatcgtcatctatatatctatatgtaaatggctatattagagacatattttacttttaacaatcatacactcaaatatattgtacacatgttagttttgctaaatctattgtttaaagtgttgaaatagataggaaagtgaagtgctaaactgtttatatttagattttagttacatgacgatacattggagacgtcttaggctagatccatacgaagcgaacaacccagacccgacgccacgccctggccacagcccacagcgcagcgcgcccgcgccgaacccgttcggatccgtctcggctccagctcgcgtccccacgggccacggccaccaccgcgcctaacatgaagcccacgcgccgtcactgacatccgggcctcggaacccgggcccgcgggcgagtgacgggatacccgagccaaggcgcaaccgcgcaagtgggtgcgggattggtgtctcacagccacggcacaccaggatccagcctggctcctccaattccacggctccgtcgttctcgttcctcacccgattcttataccaactcgtcccctccttatctccgtcgtcacgcatcgccctcgctcgctccgcattgcccgcatcgcctccaatctcagcagaccaggtcgagtttcgcgcggattttcagtgtgggaggggagtggaggtgtgacgggagcagcagaggaagcgcgccatggacccgtgcccgttcgtgcgggtgctggtcggcaacctcgcgctcagaatgccggtggcgccgccggccgccggtgctggcgcgggcgtccacccgtccacgtcgccgtgctactgcaagatccggctggggaagatgccggtccagagcgtcccggcgccgctcgtggtctccgacggcggcgagcagacgccggcgtccggggccctcgccgccgcgttccatctgtccaaggctgacctggagtggttcaacgggaagccgtcgctcttctcgtcgcgcggggaggccagcctgaaggtgtcggtctacgctggccggaaggggagtgcctgcggcgtcagctccgggcggctgcttgggaaggctacgatcgcgctcgacctcaagggcgccgaggccaagcccgccgtgctgcacagcggctggatctccatcgggaagcgatccgggaagggcagcaccgcggcgacggagctcagcctcaccgtccgcgcggagccggacccgcgattcgttttcgagttcgacggcgagccggagtgcagcccgcaggtgctgcaggtgcgcggcagcatgaagcagcccatgttcacctgcaagttcggatgccgcagcaacagcgacctgcgcaggccggggatgcagccggagcgcgacgccgcgtcggccaaggagcgcaaggggtggtcggtgacggtgcacgacctgaagggctccgccgtggcgatggcgtccatggtcacgcccttcgtgccctcgccgggcacggaccgcgtgagccggtccaacccgggcgcgtggctcatcctccgccccgcgggcgacggcgcctgggagccctgggcgcggctcgagtgctggcgcgagcgcggcggcgccggcgcgtccgacagcctgggctaccacttcgccctcctcgtccccggcgcggaccacgccgtcgccctcgccgactcctccatcccctcgtccaacggcggcaagttcgccatcgacctgaccgccgcgcagccgctgagccggggcggcacgccggggtgcagcccgagaggcagcggcgacctgagcaactggcccctggggaactaccgcggcttcgtcatgtccgccgcggtccagggcgagggccggtgcagcaagccgacggtggaggtcggggtggcgcacatcgggtgcgccgaggacgcggcggcgttcgtagccctcgcggcggccgtggacctgagcatggacgcgtgcaggctcttctcccaccggctgaggaaggagctctcgcacctgcaggccgacctactccggtgacccaccggaccggcggcaaccgcgaatcacgagcgaattgtacagaagtagttgaggcagacgtgtgctttgttgtagtagttcgattccggtgatcaactagttgatcgtggtcaccttttcttgtgagcgctgagtgcctttgtgtggtgtgatttttttggttggtcgcttcgctttagccatgtagggtgtccgcttttacggatctccgtaatttagagaattttttttttgtgatcgtatgaactatgcttcccagttcttgttattcaaattgaatgagcaacgagtagaccgacatgactgtgaccagcgtcactgttcgcttctataggacagcgtcactgtgtcgtatgaactatgcaatcagcaggctcatttttgtttcgctctctaatcaggctgttttgcacatccgattagaccgacagtgcctttgcaaacaggttgttagtattagatggagttgtggatcaacagagattttcaaaaggagaacaaaaggaacgtgaaaggcagggcaaatgacagtaggagcagtgcggaggcatgggcgcatcgcatgggacggcaggcgagcagagagagggggaggtgggtggtggtgggggagcacggcgggtcggcttgcccctccggcgcgggctgggcagcagtgggcgcgcccgacgcccaccactcactctgcgttggtttgcaggccgtggggccgcccgaggcgggagtggagtgcgggcagcggcaggcgccagtagtgatgactagtccagtcctgctgctggggagtttgttgggattggcgcccagctatgcctgcccgctcctttttcgtttggctgcctgcccgctgcaag

SEQ ID NO: 5218 - DNA, 5451 bp, Zea mays
  misc_feature (3575)..(3575): n is a, c, g, or t
taataataataaaacactgagcatcagtattcccacaacctctatataaataaatagttatgtagtgtactgatccatcgaactatatcctactagcgtaggtctactactaccctcccgtttgacactaagaacccaaagagagccatggatccctacaaggatatcgaatcaatagacaacgagccctttgtttctccgttgcatgaagcgctgagaggcactgtagcaatgccgcccttcgtaggttcaacactgcacaaccaacctagtagtactactgtccacacaccacaagaacctacaaatttcgtctacccataccaagcggttgaaccgacatcgtcgctgccattagcctataaccatactacggccgctactagcgagaacccaatcatctccgccgccggcccatttcattccatgctctcggcaagcagctcatcaacaagcagcaaccatcagaacacactgttgtttccagagccaaatttcgtgacgacgccagtaagcgactacctcagcttatctgattccatgaggatcaggtctatggatccaccaccacccatcacactcttgctccaaggtaaccccctcgcggttctccatgcgcactttaataccgtcgatgaggtaggcgacctcggcccggtcttcgagcgacctgcgcagcagcaggtggtgcagagaatgccgccgcgcaccgcactggagaataatggtagaggaggagggcgacatgaatacgtgtgcaagatctgctccacgaggttcttctcggcgcaagcattcggcggccacatgagccaccacagcaaagtcaaggcgaaggaagctaaattcatatagcttaaaccggtgcggtgcggagagattatatgagggactaaagtgttgcggttgtttcggtaccgattacgagtgggtttttttttttaatttcacaagccaataatctgatgtgcggtggcatatggaacgatttatctgtggttttttgcggtgatgtgtggtgcttcatgtttttggtaataatacattattatgtatcctgttcaaatcatgtattttaatctagtgattttatcagtggaagattgtctcttaccaagttagttcgattctcgttgcatcgatctgcttgtctagccacgtactccagctttagtatgtgtaggacacgacctcccctcccctgcaggctcaccggcaccgtgagcccacgaactgcggcttccgtcgctgagagagtactccctcgctgccgtcgccgccgtcaagtgaattgagggagaagaaccggagaaagtgggcacgtgtgcgggatccaggctggccgtggcctatgatccctcgtcaccactccttcccttggtccccaccatcgcgaaactgaaaacgcaccacaccaccagccagccagccagcctttcctctccctctctggccattgcctcgccatcgcgtcggacgggaccgaggaggaggcctgccgtgccgtgccgcgggcgatggacccgtgcccgttcgtgcgggtgctggtcggcaacctggcgctgaagatgccagcatcggcgtcgccggcgaccccgcgcgcgtccggctccggcgtgcacccgaccgcggcgcgctgccactgccgcatccgcctcaacaagatgccctaccagacggcgtccgcgccgctgctgccggccacggaggacggcccggcgtcgtgcacggccgccttcgccgccgccttccacgtctccaaggccgacctggaccgggccgccgccaggccggccgcggcgctgctcctcgccgcgcgccgccgccgcaccgcgcgcctcaaggtggccgtgtacgccggccgcggcgggggcgtgagcgcgtcctgcggcggcggcggcgccacgtcgggtaggctgctcggcaaggtcgtcctcccgctcgacctcagggctgccatggccaagcccgtcgtattccacagcggctgggtcgccgtcggcagccgccgcggcaaggcggcggcggcggcctcctcctccgcgcgcgcgcagctcagcatcaccgtccgcgccgagcctgaccccaggttcgtgttccagttcgacggcgagcccgagtgcagcccgcaggtgctccaggtgaagggcagcatgaagcagcccatgttcacgtgcaggttctcctgccgcagcagcagcgacctgcgctcgcggtcagtcagtatagcaatccccactgcatgcatccatttcttcatcgatatgatatgatcctatccatccatccatccatctaggtccgtgcagtctgatccgggcgcgcgcaactggctggcgaagctggggtcggagcgcgagcgcgcggggaaggagcgcaaggggtggtcggtgacggtgcacgacctgtcggggtcgccggtggcgctggcgtcgatggtgacgccgttcgtggcgtccccgggtacggaccacgtgagccggtccagcccgggcgcctggctcatcctgcgccccgcggacgggacctgggcgccgtggggccgcctcgagtgctggcgcgggcgcggcgacaccctcggctaccgcttcgagctggtgcccggccacgccacggggggcgccggcgtctgcgtcgccgaggccagcgtcccggcctcccgcggcgggcgcttcgccatcgacctcacggcggcggcgcagccgttctggtgcagcagcagcggcgacatgggccacggcatctggcccttcggcggcttcgtgatgtcggcggcggtccagggggaaggccgctgcagcaggcccaccgtggaggtgggcgtcgcgcacgtcgggtgcgccgaggacgccgcggccttcgtcgccctcgccgccgccgtcgacctcagcatggacgcgtgccgcctcccccccggccggctgcgcagggagctgtcgacggcgtcccgcgccgagtttctccggtgaccgggcttctaggtgctttttagagtctagaagcggtggaactcgggtttctgtgcctactgcggaaggattctcaagcgttctctggactctggtggaggagaaagaaacaccgctgatgtgaaccatgtgatgtcttcgtgttctgctcttgttttgttccttttgcgtggagcgaaggcttctgccggagctagctgctatatggaacgaagaagaggccggcatcctaatgtccgtccaccgtccatttcccggcccagcgtctcgttctcgacgacgaagggggagggggagtcagaaaagggtatggagagacggggtggagacccacaaagacagatcaaaatttacaaaataaccctttattaattcattttttttctatttgtatggaccagcagtaagagtatatgaggggctgtaaaaggtgggctttgcatccggtatgcaaagaattttttttcccacgtggggcccaaagccacatggggtgttggctgcctctgcagcccgccttgcccgtagaggatggcaggatgcaatgccatcgcccacataccctgtgggcctgtggtgtggcaaatgcagccatgcacggcgctncagggaacatggttcttgtttcccttatctttcgtgcaaaagcctggtcgtgaccagctgctctgtctgcttgacagtgccagcggcgtcgcgttctctgccagtgtagggtctagtgtgtactttgcggcggcggcggccgtggaggactgcaggtagcaagttccaatgttgctcgtttctaattaaatcccgttgtttaaactgatgctacagcaaaacattgtaaaaagcattaaaaatcggtacaaatccaaacgaacaagctgccctctggtttcctattaattattatttaggacaccgatacagtccccaaaatataacactgaccaatatttttagttaaatacgaattaaattttaatacattcatatttttataaaagtacttttaaagataaataaatagataaatataaacattatgttttaaaactaaaaaataaaacaattattcgtgtttaaaattttataagtttgactcaaaccttgtccaaaactataactaataggataccagagaaagtaattatttttaatctctatttttgtttctatttggcacatgtgtttattaatataataaacttagataagtataaaatatagtccaagctgcttttaaaatgtgtactataaaataagctttgttttttaagaacctgtagaaaagctaaaacatgttcagaatgctgaatcaaacacaacctaggcaatatgcaggtttgattggcagactttgcactccatagcaacttcacattaaggggcatgtacaacctagttcaagtacaagagatatctaagaaattgtatgatataataatgggtctctaaattataaatacaattaagacacagtacatgtagagaatcatgtaggtgccttaaatacactgagttcgttgtacatgccttaaacaccaaccccactagcaggcctagtatgtatgccagcatggaagagcagcgcccagaggagagtgacgagctctccaccacgggcgatggcctttctgtgtcctttgagattgttggatggcgccacgtacaggatcatctccgcccagaaccctgctaggattgcccacgctgtctcctcgccctcgaccagctccaccccctgccttccgagcctcgcgccattcttcactaccacatgactggacctctcgctaagcaacgccaccagatcctggtactcgtcgtcaggcatcatcaacggcggggccggggcggcgctggcggcacgggcggcgtcgaggacacgctcagcatcctccttgacagcctcatacaagctcttggtccatgcgacctcgtcagggagaagctccggggcccaggtcatgaggtacgcgcagtaccgtgacagatgagtggcggcgctcctatgctcgacgaccggaactactacccgcggggaagaagaaccctgctctgtatctgtatcctcccagcggcagcaagggtgcctcacctcgaagacgcaggtggcgatgtgccatgtaagcatcacgtcggctgtactcatcgtcctgccgttgcacgcccagaggaaaccctttccggcctggcttcgctgcagggacgccgcgccgccgcccacgcctacctggcgcgcggccgtcgtcgtggctcttgttagcgcgtccacgacgcaagccttcaccgctgctggcacctcgaccttcaccttctcgtctggcaggtgacggaacacgcgacgactgagacggccaaggaagttcgctcccgcggccgccgttgggcgaagcgccagcagtaccgagcactgccccatcttctcctcccagcaggggctcccggcccgctggcaccctgcacgcaggagaagcagagcaaaccatcg

SEQ ID NO: 5219 - DNA, 3184 bp, Zea mays
acaaattttaaaatttaaaacttgaccgtacatggagtcataaaaaaatcttgttgatggaacaaactaaggtagtgtttggttctatagtatgatggtatatagtatgatggtacgaagccacttcgttcttaatttgttgttattatttgggttggcataggacaactctaaaaatattatactcaaatgctgaataattgggctcctcaaaatattctggacggagctactctatggtacagagccgctctatctcaactttcttgggaaccaaacactatataatattagttggacggagcaaaactaaccaaacgtccttgtctaaatttgagggaagtgtaatttggacactttccaacattaaatgctgccatgtactctctttcaggcgatggtgtagtagtactataaaagctgatgtatacacgtcggtatttatcatctacctttccactatgatttgtggcctaaagtttaggccatccatcgtctagctactctataactaatgtctaataattattatctactcccgtaccccctggtagcacgtgcatgatgtccatctttaacaatctattaagaaatggtataggggtaataatgaacatggagaaccaaccgcaaggccgccgggcgccggccggtggctaatgcgacagtgatggatgccgctgttgacttgacgaccaccgggccgggtcgtctcttgaggcgagagctgatgtccactagtgaaccacctgcactgaaattgagcatcgcgtcgcgcctgaccaccagagcgtgctcgctacgctaggacgacgaggaggaaatggcgcaaggggccgccggcgtagtagacacgaggaggcatggcggcaagccgcacgcggtggtggtggcgtacccgctgcagggccacgtcatccccgtggtgcacctggcgctgcggctcgcggcgcggggcttcgccgtcaccttcgttagcacggaggccgtgcacgaccagacggcgcgcgcgctgggcgtggacccggacgggtacgaccccttcgcggccgcgcgcgctcgggcgcaggaggaggggccgccgccgccgccgctgggcgacgtgtcatacgcgctggtgagcgacggcctccccgtgggcttcgaccggtcgctcaaccacgacgacttcatgggcgctctgttccacgcgctgcccgcgcacgtcgagcagctgctccgccgcgtcgtcgtcgaacccagagccacgttcctcgtcgccgacaccttcttcgtgtggcccgccactctggccaggcgcctcggcatcgcgtatgtgtcgttctggaccgagccggcgctcatcttcaacctctactaccacatcgacttgctcacccagaacggacactttagatgcaacggtaaccacacacacacaaacagcgtcgtgcatatgccatcttggtcgatcgtggcaaaacaggccatgtttgtttcgctgatgtccgtcccaattccatgcatcatcgatgtgcagagcctcgcaaggacacgatcacctacatcccgggcgtggcggccatcgagccgagcgagctcatgtcgtacctgcaggagacggacaccacctccatcgtccaccgcatcatcttcaaggcgttcgacgaggcccgcggcgccgactacgtgctctgcaacaccgtggaggagctggagccgtcgaccatcgcggcgctgcgcgcctacaggcccttctacgccgtggggcccatcctcccggcgggcttcgcgcgcagcgccgtggccacgtccatgtgggcggagtccgactgctcccggtggctggacgcgcagccggtcgggtccgtgctctacatctccttcggcagctacgcgcacgtgaccaagcaggagctgcgcgagatcgcgggcggcgtgctggccagcggcgcccggttcctgtgggtgatgcgcccggacatcgtgagctccgacgacccggacccgctgcccgaggggttcgccgaggccgcggcggggcgcggcctggtggtccagtggtgctgccaggtggaggtgctctcccacgccgccgtcggcgccttcctcacgcactgcggctggaactccgtcctcgagagcgtgtgggcgggcgtgcccatgctgtgcttcccgctgctcacggaccagctcaccaaccgccgcctcgtcgcgcgggagtggcgtgccggcgtgtccgtcggagaccgcggcgcggtgcgcgccgacgaggtgagggcgcggattgaagcggtcatgggcggggaagacggcctcaagctcagggagcaggtgaagaagctcaggggcacactcgaggctgccgtggcgtccggtggttcgtcgcggcgcaacttcgacgagttcgtcgaggagctgaagcgccggtgcggaggccgctgatccgaaagctcgaggacggcagctgaggtagccccagaatacgtgtgcgatgtacgccttgtatcgtgtgcgtcacataaaaaactgtcttcaatcttgatcgaagcgtgtatgccgtgtacggtgggcattattgttgtgcagggttgatgtgatgtctacctttggcccctttggctgaagtgtatacttgtatctgctccaagcctccaaggttaacaatttcaacaagattggaaatccagtaatagaccgaaaaagaaattccgagcgaaatatgccaaaattggaaattttgatagaattcggggaaaaccaccaaaatttggttaaaaagcaccaaaatccaaccggaaaacattttttcgttttttgaatttttgaatagtaaaccgagtttttcgaaatatgtaccgaaacctatttccgtaggggtctgaaaacgaaaaaaacactgaaattcggcgaatttcgtttaaaatttctaaccctgatctgctctatggcgggctgccagaaatctttccgggcaatcaatgctactactgaaggccaatagtttcttgcttagttgctctcgcagaggatccatccgaaggcgaatctatacctgtaccgtacgtctggttgtgccaactaagggggtgtttggttgctcctgctaaagtttagctcgggtcacatcaagcgtttgacttttaaataggagtatgaaatatagacccaaccaactggactagattcgtctcgtcttttaatc

SEQ ID NO: 5220 - DNA, 1264 bp, Zea mays
  misc_feature (1177)..(1177): n is a, c, g, or t
  misc_feature (1209)..(1210): n is a, c, g, or t
gacacttgacagccaccacacactagagagagagaaggagaacgcgcgtcgtatatgggtcaagaagaggccgtggcagcgaacggcaccggcaccggcgtcggccgcggcaggccgcacgccgtggtgatgccgtacccgctgcagggccacgtgatcccggcggtgcacctggcgctgcggctggccgagcgcgggttcgcggtcaccttcatcaacacggagtccgtgcaccaccagatcggcgccggcggcgacatcttcgccggcgtgcgcgcgcgggggggagggacgacgacggaggagctggacgtgcggtacgagctggtgagcgacggcttcccgctgggcttcgaccggtcgctgaaccacgaccagttcatggagggcgtcctgcacgtgctcccggcccacgtcgaggacctcctccgccgccgcgtcgtcgtggacccggccaccacgtgcctcgtcgtcgacaccttcgtcgtgtggccggccacgctggcccggaagctgggcgtcccgtacgtgtccttctggacggagcccgcgctcatcttcaacctctactaccacatggacctgctcaccaagcacggccacttcaaatgcaaagatcctcgcaaggacacgatcacctacatcccgggcgtggcgtccatcgagccgagcgagctcatgtcgtaccttcaggatacggacaccacctccgtcgtccaccgcatcatcttcagggcgttcgacgaggcccgccgcgccgactacgtcctgtgcaacaccgtggaggagctggagccgtcgaccatcgccgcgctgcgcgccgacaggcccttctacgccgtgggccccatcttcccggcgggcttcgcgcgcagcgccgtggccacgtccatgtggcccgagtccgacgactgctcgcggtggctgggcgcgcagccgcccggctccgtgctctacatctccttcggaagctacgcgcacgtgaccaagcaggagctgcgcgagatcgcgggcggcgtgctggccagcggcgcccggttcctgtgggtcatgcgcccggacatcgtcagctccgacgacccgcgcccgctgcccgagggcttcgccgaggccgcggcctgcccaggtggaggtgctctcccaccccgccgtcgccgccttcctcacgcactgcggntggaactccgtcctggagagcgtcctgggcgnnggtgcccatgctctgcttcccgctgctcacggaccagctcaccaaccgccgcct

SEQ ID NO: 5221 - DNA, 869 bp, Zea mays
aaacgaacggataattcacaaaacttttcttgccaaataagcagagtagattaacaaattttggttggggctttactattagagctttttttttgttagtatcctaaattttataaaatgcatctatttcgagtacgcaaccagattccattctctcccccatcttctcccccaagttcatcctcttgtgcagttgtgctaacacgcggcgccccaggccctccggcgccgcccacctccaccgcctggaatccaggacatccggcgccgcccacctccgtcccctgtctgctgcctcgactcaactgttttgctgcgatggggttattcaggggcagcttcactctcttggtgggaatgggatgtggtgtctatatagctcagaactacaacgttccgaacgtcaagaagctattcaacacatatgtttttctggcaaagcacatcgaggaaacctaccgtaagccgaagaagaaagacgatgattgatcctttcacatttggtatctctgttatgccctggagcatgtggaaatgtgcatttttgaaattgtgaaggcaattttggttatggacaagttttttaactccagtggaaaatgttagctgtgaaatttccagttgctgtaatagtttttggtcgtattggaccatgggcttctagagcgtcccctttttgctcgtgttcctgtgccttggaaatgcactggactttgtagttgaagtgcggcgatggataatctagcatcatcagtgtgtttttcatgttaacataaggatggggtgatatgtttatttgaacctagatttgccgaaatatatatattgacacaggttcttctgaacgcatgtcaaaaaaagaaaaaaaa

SEQ ID NO: 5222 - DNA, 3736 bp, Zea mays
  misc_feature (1570)..(1570): n is a, c, g, or t
  misc_feature (1680)..(1680): n is a, c, g, or t
  misc_feature (1718)..(1718): n is a, c, g, or t
  misc_feature (2762)..(2762): n is a, c, g, or t
  misc_feature (3148)..(3148): n is a, c, g, or t
gccttcgcggccggccatcttcttcttctgccccggccttctcccttaaggcctcaaccaagcaaaggtttgattttacataccagagtaacggacccagcgccagctggaacaacgaccagagactccggcatccagtcgaccaacgtacaatgggtttcatccaaggaaggacctccaagcagacgagcagggttaagacccttctatggcttgccttgtcccgccttgccgctgcccgccgtccccgcctcgctcgcaagtcgatttcccgcagcgatgttggacagctactagcactcggacacattgatcgtgctctccaccgtgcagagcagctcatagaggaggacaacatgctggaggcgttcaacataatagagctacactgcaatcgcctcattgagtgcgcaaagcagctagacaagccccatgaatgcggtgatgacattcgggaggcagccgccgggatcatgtttgcagctaggaggtgcggcgacctgccggagctgacgtttgcacgaaccatactgacaaacaagtttggaggcgagttcgcagagatggctaaggaagggcgctggcgtcgtcgaccccatgttggtatggaagctaactggcaacaaaggagacatggagctcaagaaaaaggtggtgaaagaggttgctgctgagaacaatgtgctagtggacttctttgggccccaagaggttgagcatggcggcagcggcaacgttccgcaccatcacaaggtcagccatgaaggcatataccaaacggacatggatggaacttcagagccatcgcacgacgaggatccatgtgatacttccaactctgatggagcaagcaatgggcatccgaaacaagagaacacaagaacttcggtgcacacaagaagatgaactttcagagcatcccagctcagatgcaacaatccagaatgaggaagtgctatgtttagcttccaaacttaccaagttatgggtgtgcacatgctaaatctgtaactgtaaagcaactaacaatgtccaattaattgagttagcaaaactttgcgtttcttcgtgaacagacacagcagcagccaccagcaattatgatctacatgatcgctaaaaagagaagcccaccttgccacgtaatttacatacaacctaatacaggttcttgaccatagtgcctgttaaaatatgtgaaagatccccgcttcatgtggtttttaagctttgaaaattctgtgtgtggcatatatttgtaaaatctactttcttatgatgtacatgtacttgatggatcaatatgagatcgctacaaatgatattgacaggtttattatgcaccgagaaaatcacatgccactaaaccatgtgatttaaacttaatgtgttttaaaatgaatgacataaataaatgtctaaggtgtcctacccaaaattaaaggtactacataggtaatcagtaatctagtccgaagaaagccataagctatctaggctggttttagatgtacaaattaaatatagatcattaatttgcgccaccgaatggtgatcatggagggcgacnaggtcaccacatctcaccctcgtcaacgacacacaaagggtaatgtaaggtcacgatctaccacaccaccatagacatactcgtcgtcgctcacacacaccaactaacancagtggggcgatgttaatgcaagtgaacttgaaggcgncacgatggtggtacaacgtcgagctaagagaaggacaagaagaccgtctaccaccaccgattgtctagcgctcgccacaatcctacgctctgtgacgcccgacatgttggttggtcatcgagagaggagaacatcaataacacggactatggttaagcagatctgcatcgagttctagcctgtgagcgaggccaatacagaatagctccatcatgactttagcgccttgttatggaaggaggcagagaacactaagatttcacggaccgcatcatccagcgacgccaacatcaagaagcacagtggtcgtgggcgaggccgtcgagagcgttggctccacatcacgcgaaggctacaagggctagtatggtgatggataggctcccaaccatagtcgtgctggatccagtaaaacagataccacgtgattggttacctgtacagagacaaccagactctctgcatgctttgactgaacataagatcgtgattggtttcatgtatatgagaatgccggcctgcatacactcatgcagcctaggccttttttctaccatctgcttgcacgtgtagagaagtggcgagcgggcatcactggtgagccaggcgcgcgggaggccggcgcgctggtgactggcaaccaaacacgcgaatagtgaaaaatctagcaaaaggcagagaaaacgagctggtaacacagaaatatcagacaacttagagatagcaagacaatttgtttgcgcgtgctccatttgctctctggcaaatatattgcacgtgtacggtgcctctattaacttttcttttccacgattaccacagttcctttctttaggcatggggtgcaaccgagctgtgaccttgcaaacgcaaaaggagtgcgtttaaaccgaactgacagcatgttacatacaccaaaattggagttcccagacaagaggaacggcagtataaaaacctttgccccctccgacagacttcttcatcagtccacgagcaagccatcttcttcttcttcttcttccccgtccttctcactcaacngagcaaaggtttgattttacataccagagtaatgaatccagcgccagctgaaacaacgaccaaagactccggcatccagtcgatcaacatacaatgggtttcatccaagggaggacctccaagcagacgagcagggttaagacccttctacggctcgccttgtcccgtcttgccgctgcccgccgtccccgcctcgctcgcaagtcgatttcccgcagcgatgttggacagctactagcactcggacacattgatcgtgctctccaccgtgtacgaccccaccctatcatcgtctctaacctcccggcccgtcaaatggaggttcgtatagtctggcttaccaatgctgcaccgtctctattatctccatgcaggcagagcagctnatagaggaggacaacatgctggaggcgttcaacataatagagctacactgtaatcgcctcatcgagtgcgcaaagcagctagacaagccccaatacacatctttctctacaccctgacatctgagttcatcttgttctcacattttggcactgttgtttgacaccacttttttttcttctgtttgcgtgactattttgttcaaatctaatctggtgtgcagtgaatgcggtgatgacattcgggaggcagccgccgggatcatgtttgcagctgggaggtgcggcgacctgccggagctgacgtttgcacgaaccatactggcaaccaagtttggaggcgagttcgcggcgatggcgaaggagggcgctggcgtcgtcgaccccatggtaactagaacaacatcctatgttcattcatggccccatcacatccataccagaaacgtcgagagctggaatttacacggttgggtttgtgctaccctttcagttggtatggaagctaactggcaacaaaggagacatggagctcaagaaaaaggtggtgaaagaggttgctgctgagaacaatgtgctagtggacttctc

SEQ ID NO: 5223 - DNA, 842 bp, Zea mays
gacgtatatcggatggctgacttcgcggacacgggcacacggcaacagaaggtcttcgccggactctacgcccactgaacacgcccttgagggctgaggccttgacccactgaacacgcccttggcgaccgccgccgctctactcccagttgccctgttcttcgccggacccttcgccggcgacaagcactaaccaacgaccaacacgttttgttgcgatggggttattcaggggcagcttcactctcttggtgggaatgggatgtggtgtctatatagctcagaactacaatgtgccgaacgtcaagaagctattcaacacatatgtttttctggcaaagcacattgaggaaacctaccgtaagccgaagaaagacgatgattgatccttttacatttgttttccatgttatgccctgggaaagcaagtacagctgacgtaatacagaaaggtgcttttttgaaatggtgaaggcatttttgtttatggtctagtttgaactccagtggtaaatgttagttgtggaattcagttgctgtgatagtttttggtcgcatgggcttctagatcatccccttttggcctttgctcgtgttcctgtgcctgagaaatgcactgaactttgtagttgaactgttgaagtgcggccatggataatctagcacatattagtgtgtttgtcaagttaacttaggatgggatgatgtgtttagttgaatctagatttatctttgtttctttaaattgtttgttcttcgatttaccacgatggatgatgacatttgtatttgcaaccagatagtggggatgtgcctttcaccacccaaaaaaaaaaaaaaaa

SEQ ID NO: 5224 - DNA, 6364 bp, Zea mays
  misc_feature (3817)..(3817): n is a, c, g, or t
aaccatggtttaaaatacagagtttttagatgtgcttccaaacatcttttagtctaaaataccatgttatactcaaataccatgatattgtcttgggactaagaaaatatgatgttcccaaataggcctttagttgtgaaaactgagaaaaaaaaacacaactaagcatacaaacgaggaatgtgataaactaagggtacaaatataaatagccccattttaaattccgtacaaccgctgccatattacaaacaaaccctcccacctctctctgctgccatttggattatcacatatggcccctagtcgcccctagctgtgtactgctcttacgctcaaacactcctccgggatcaggacaccctctgcctcatcagacgatgccagcttctcatggccatggcgaacccagctccccacaaggttcatctgcttacctgcataataagatcactggcaaggagatgtcgaatggcagtctttctcctaagaactcgccaacaaagagatctgacacagctgaggaaaaaccagaatgcaatgggagctcaaacggtggtggcggctctgctgatgagaagttagctgtaggtatggagtagcagaatggtagtctgaacaatgttgggagcagcgaggtccagccacatggacatgccacgtagagggggagttctagtacatagacaacagagaactggaggtatgacagcttaattttttttcgggccgtgaatttgcggtagcgcgcagagcttagcacagtgcacaggtcttcgctggcaactctcttcgttgacaagaaacctcgttgcttgtgactgaatatggtgtcctaaattttgtagctgctctgttgcaaatctggatttatcacattgccttaagttatcatctgctaccataaccgagttgtgggcagtgaaaaccatttctgatgtatatgttgcacaaatcttatcttacctggtacatccgaaatggaaaaatgcggtcgaaacttgttgcatgaatgctgcgcttaatctggaatgagaacgcgagatggctaatgagccaagttatcgttgtacgctgaatttatggattatgaactgatcacatctttgggacatgaactatctgattttgcgataggacgtgggcaaatcatatggatttgtggcgtgcaatgccatacggctccatctacgggttaaccaacaaattgcgctgaacttggatggctgcagcagcggtgcgagtcgaggcgacgaggtttataatcagttgaagtgtggaactccggttactgtcaccctacaatggtagcgctaatcaagaaccctaatcatatatcagatgacatcacatcacagtcgacacgggcacacggcacacacacacacaccagcgctgccggtggatcagacggcaaagtcggcgccgcggcgcatccggctgcgcctaccgtgcctatgcaacgccgcccgcgcgtcccctgacgggaggaacgccgcggcctccgcgcagacgctgcactccggcagcggcgcggggtaccggaggcggtcgtagcagtagccgtacgtcatgtagcgcgcccggaacgcctccatcgccgaacgccgcgcgggcggcatcgcggcagcggcgtggccgtacgcgtcgtcgccgccaggcgtcgcgcacgccgcggcggggccggccgcgcagccgcggagcgcgaggtcggcgaactcggcgacgtagggcgcgtacttgtagtccaccttgtagcggccccccgaggtggcccagctggagccgtcccagatggtggcgtacagcgacatgggcttggacgggaactgcgcgcccatggactccgtccgcaccatctccctgatcggcgtgtcgtcgatgtagaatctgcaggatgcacgggcagagggttgttggattttttgaaatctattttgggtttttggaaatctattgaaccccatcctttctgattggaaatattagtggcgagtgcgtataacagtaaaagaagatgatctgagagttctgaggtttgcattccgacgtaggcacaagtagtgccatgatttaagacttaccagtcgtctatctactgacatatgttcagtttttaagaactggagatcggcagacattgtcaaagctatagactttgggactgtacggccaccagtgacagtaggatgagtgcgtgaacctgaaaacaggagaggggctcgtggcaaaatgcacggtgagactgaaaagtaggtggcggattgacagtagagaggcctttttgcttctccatgtccatgctaccaagaaatcaaagggttccctgtgagttcttcagagcacaggtgtaaaagcaggtgtcgaacgcaatcatgccggggaaggcagcacgcgagtattggtggggggatcagagataagaagctcatgcacatgctgtgatggacggatgtccagggtggtgggcattgcagcagtaaatatttgaataccccttgtggtaatcccatgtccagtcgattttggggactcggcagggcttcttacatgattaaagtgacaacatgcaaaagaatctacaagctgtaaagacgaaggaaggggccagtatctctcaatcatgattcatgagagccaaaagtgaaaagaaaagagggggaaaaaggttgagatgggaaagaatcaaacaaaaagtacttgaagctaaggatgaaggctgtaagttgctccagtaaaccgtagtagagatatacagagagagagagagagagagagagagagagagattggccgcaaccagaaccagacaagccattatgcagcactattcagcatcgtactaataataagcaccggaagaagaaaacaggtgaaatgctgacaccatgccatcaaggcctcaatcaaagagagtagaaaaacctctatatggatgtatcacctaatcatcataggtcgagccttttcttctggttaattaatatatactccctcccatgaccggtccagacatttcagagaccctaagcgaaaatctatgtaaagggcctataaaaaagtttgagtctgatattttttcaacttttaaatgatatccaaaaaataaaagaagttgatgatttatacaattttattcaaaataatatgaccggagacactgttacaatattttacgagtcgtaaaattatacagattatgtaatataactctgcatttgttcgaccattttacttttaatttgtcaaactatcctaatccttaaatgcacagtaaaccaaatttaaatatattagagcaatttttaaaaaaaagaaagttcagcaaactaaacaatgattaagcaacgtaggttattagagtcagacctccggtagcctaaaattaagcaactcaacagacaacaggtgtacaacaccttccgtccttcccgcgtcagtattcgtcatcagacagactgttgcgcgatctcgaagagatgattgccagaaaattaaagagacgcaaataaaggaacaagaatagcgatttatttgtaacatatatgtatttgtatataatctggacaaacaggggccctaaagttaataaatccatacaatatttgatgtatgtgttttgtctaggttcattgttatcaatatgtaatatggacaagaaaataagggcctaagacgactagtacattgtacggagggatataaaactgtatatgttgcagccgtacaccctgctacaagctactagtatgtagaaaaccgcatgtgtcaagtgctgtattgacgggtgaggagggtaaggagacgagggcggtcngttcatcttacatgatcctgtcgcgggtccagtggatggcgtagcggtggaagtcctccgtggggtcgaaccagaggccgtagcgctcctcccggccggccgccgtgctgccgttgccgtacacgttggtctgcacgcgccactccttgccgcgcacgttcccgaggaactcgaagtcaagctcgtcgtgcgtccgctcgtacacgtccccgttggacatctgcgttttttttgttggggttcgtcataaaacaaaaaaaacgcagcattggtggttgggttggttggttggtcacgtacgtagaaggcgacgacgacgccggcggtgtggtcggcgggcagcttgacgcgggcgctgaagtgcccgtggaggtacgcggcctgcgacgcgaacccggcgcctgcacacagcggagcagagcagagcagagcaagcgacgatgaggttcgcgaacagagagcaggaaacacggagcacgagttggcattgactgggcgtcgatcgggcggggaacgagcatgaagccgccgagcctacacgcagctgttcggcgcctgtccgctcgtcgagggagatgtgcaccctcttgcccccgccgtggagcgcgaggttggagtcgccgaacagctgcgtgtagccgtccccgaaggagaggggcgtctccgacgacgaggggaggaggtcgcccgtggcggcggccgcagcggacagacacgccaatgtcgccgccgccgccgccgccaatacgaaggagcaaaccatcgggctgcgcagaactgctccccgctgcttgctctgctccgcctgcctccgcgcgctcgcactgagccacgcgctccctgttctccgctcgctctgtgtgtgtccctagctagctagctttaaatgggctagaaaggagtgcagcctttcatgcgcagggtgtgaatcggagcttggggcgaggaggacatgtatgagcagctgtatagctctttattgggagccgcgcaacttgcgctggcagtgtagcgttgtagtactagtgtgcacgtacggcgggtgcgcagccgcagcgcagaggtctcttcctagccccactgtccacacaggcacagccccagacgcccagtaccagtatgcgctgcgccgcgcatcagagaaatgctgtatgtttttttttctttcttctcgtacagtacaaagcacatctgagttctgctgtacagtatgtacccaactgcactgctccaacgtctcgctccaccggttcacatcttcgggctctctctcacgccttctccactccactgaagaaaaactgcttggttgccatgccaggatatctattctagcgccatcaggttacccgattcggggcgcttcgcttggtgtgccattctcggatggtatagactggaacttttttttaattattattgtcttgaaaaaaaaaagttccattcccttgcatcaaacagtgacagcacagtacatgcgctttggcattcgggagcgagcgaggtcttcttctttatccacgcatgcagcgtctgcgtctctctctcgcgcgcgcgcagtaacaactgtacagacctggcccggtccatgtctccatggccatggccacagcgccagcatacgtacgcaactgataaggtaggtgcgtgtgcagcctcagcctgtgcggattcagttggatgctattgagtgaccgggacgccatgcgatgcgtgggaagaagcggtgatgatgatgatggctcgtggcgaacaacaggcaaccaaccgccacagcgctcctgcgttgggtaacgcccgcgcttcaatgcgggattgattgccgagagccggccgttgaggcaacggaacgaacgggcgggcgagacaccttctcactctttcctcctcccgtccttcgtccttccaatgcctgcctgcctatcctttttttcaccgtggtccatggatggtaaaaaaaaacaacaaaggggacatggcgttggtaatggccggtcagcggcgtgaatgcggtgtctgggcctggggacagcgacgagccacacgccgccaatgtaacggccgccaggccgtggaggagaggacggcccggccacagcgcagcggcgccacacaacggttcgttctcttccccgccctcccgcgcttttggaccatctgcgctgatcccggggccggggcagcacagccagcgactctgggcgccgtgccgttccattattattgcccttgccctcccgtcccgctcctgcttttcctcgtcgtcgtcgctggtcgctacggatgcaggccttttggtggcgtgctgagctggaggccttgtccgcgcgtggagctttttgcccatggccgtttctccctttcgactactggtgctgcctgatgcctcctgtcacggtcactcagccttgttcgctagcggctgccgctatccgagccactgttttccgctgtctacaaagcttagcaccaacgtgcaaacgaatatatacgactcatactctttgaacagatccagctcatcctaaatcatccgtacagaactcg

SEQ ID NO: 5225 - DNA, 3152 bp, Zea mays
  misc_feature (2081)..(2081): n is a, c, g, or t
  misc_feature (2305)..(2305): n is a, c, g, or t
  misc_feature (2582)..(2582): n is a, c, g, or t
cgatgcagaagcgccaagaattatctgccttcttaaccaataggactggatcggagaaggctgatgtactatgtcggattgttccctgtttcagcattgctgcacactgcgcctccagttcgcctgcctgcagctgagggtatctataaggacgtaccgccactggtgctgtgcctggcatcaggtggatgcggtggtcacatggtcgtgctggagggagacccgttggggatgagaaaacatcatcaaattgctggactagggagtccatcattggtgtcgggtttgatgttgaaacacgtgctgaaagtggcctgtgcatcatgctgcgagtagaattcaaccctttccacaaaacttggtaaccattcttccagaacgccatgctcatgttggctaagtcccaaaggatgggaccaagagtgcgcaggaactgaacccctaagatgatgtcaaaggaatccagtggaatagcataagcatccatggtgaaaatatctggacccacacatagtctgagactgttggcaagaccatgacagtcgatcttgtcgccatttgctacagctacccgacctcggcttgagcagactttcaattgcaatgacaaggctgtgttgaggttgacaaaattgtgtgtggagcctgtatccagtaatgcagtgagcaatttatcatttatttttacttgaatctgcatggtgtcctctgatctgatgcctgtcagagcatgtagagagataactggttctggctcctcatcaacttcctctgtggcagtatcctcttcgaagtcagctacttccaaatagaataaccgggggcaccgatggccgcgaacatattgttcatcacagttgtaacaaagccctagctttcggcgttctgccatctctccagttgtgagcttcttgaatggtcgctgctgcgctgcattgcctgtggctggcactgttggttgtgttgctgggattggaactgatggtcgttggggcggtctcattggcttggtgggtgctgctatgacgttgccatcaagcacttgagaacgccgttcatatgcgcgcgccaagcttaatgcgtgattaaggtcccctggtgccatcaactcgacatcaattttgatgcgttctgggaggcctgcagggaatagctggactttttgttcctgggtgaggggcgccgtgtgggcaagaaggtcccaaaacctttcctggtagtcgtctacggttgtccggaagggaagccgggccaattcaccgagagggttgctgcgcagcggaggaccaaaccgttgctggcaggactgcttgaaagaattccatgacaatggtggctcgtcgcgctggagttgacagtaccaagtccgagcgactcccgtcatgtgatatgaggcaagccacaccttctcttcttccagcgtacgctgtccttcaaagaattgctcgcatctgttgatccatccaatggggtcttctttaccatcaaacaatgaaaactccagtcgatgaaagcgaggaacactcgtcgctggttgcgagaatggtgctcctgaatattccggtggtggtgggggaatgatggtagtggtgatggggaatgaggaaggggtagacgatggattggaaggggggctgtgggggtaggatgtgtcgtgaccggcaaaggattggtgttcaccggtaccttggggatgccgccgtatcccggcaggccatagggaatgtcctgctgcggggtggctggcgtggatgcagatggacatgcctcgacggccgcaacacgggaggagatggaggacatctgctgggcaaagtcgcagagctggcgttggacttcacctagggtcgcggcgatggacgccagggacggctggagggcagtggctgccgtgctatcttcctcatcgtgacctgacatatctgataccagattgtaatgatctcgacttctgaggttgtatgagtgggtagtagggcgaggccttgaggattgagggcgagagggagccgtgctggcacacggctgagacagaatgtggcgaggagcaatactcttcttagattgatctttgctaatcntcctaggtacaaactaaggactttatatagtccagtacaggcgcacataaactgctgccgcccctatttattctctaacaaactcctactatttctcctttgatatctaatctaaacaaacttatccttatccctttaatcttgatctcatggcgtggcctggcctatgggctgcttgggccgcctttcatatgttttacccaccataacagaaagcatctgtnttaaagtcatagcatgtaattcttttatcaggattacaaatcacggatatttatggactttgatgctgctcatttaggattccaacatttgaaatcaaactccaccatgatcggtagtttccatctgtttcacatttatccatggtgacagtagatgaactgtgagctaagtaaagaagatttatttagtcacaaatatgtgctgcatctcaatctctattcctggataccccattatcaagctctgcttggtagtctctaatcactttatcttcanatgtgctgccgaaaagcattctgtgccctttcaggcttccaacatagcaccacctcaaactcttcttcatccattgattggctcagcaaggctggagattcattcgtagtgctttcttttgctggaaacaagccttaactaataggatttgtgtcactttggtttaatttcttctgggcatttactgtgagcaatggagcccttttcacgctcaatgcaaaaagtgtgtcacttattggaagggatattctttttagtcatggatggattcatttacagtcaatccacttttgaaatccatccatttgatttggtcaccaccatcatgttttcttttcttttgatgtctgatggggttcatcactgttattttacttctgtaatccaaagtgtttatgggttggatgtcctatttttgtagagctagtatgatgcttcctttccatgataagtttcagtacctgtaatccagctccagtgtttcttcatcattttgttgctatagaaagttgtgaacctcctggatattctctcaacaaataatataagcagacttacagctgtaatttg

SEQ ID NO: 5226 - DNA, 1436 bp, Zea mays
cttctctgtcactttattttccttttttttctttttggagcagtggtgccggccgcggcctcctggttttttttcggttgaagtgtggaactccggttactgtcaccctacaatggtagcgctaatcaagaaccctaatcatatatcagatcacatcacatcacagtcgacactcgacacgggcacacacacaccagcgctgccgatggatcagacggcaaagtcggcgccgcggcgcatccggttgcgcctaccgtgcctatgcaacgccgcccgcgcgtcccccgacgggaggaacgccgcggcctccgcgccgacgctgcactccggcagcggcgcggggtaccggaggcggtcgtagcagtagccgtacgtcatgtagcgcgcccggaacgcctccatcgccgaacgccgcgcgggcggcatcgcggcagcagcgtggccgtacgcgtcgtcgtcgccgccagacgtcgcgcacgccgcggcggggccggccgcgcagccccggagcgcgaggtcggcgaactcggcgacgtagggcgcgtacttgtagtccaccttgtagcggccccccgaggtggcccagctggagccgtcccagatggtggcgtacagcgacatgggcttggacgggaactgcgcgcccatggactccgtccgcaccatctccctgatcggcgtgtcgtcgatgtagaatatgatcctgtcgcgggtccagtggatggcgtagcggtggaagtcctccgtggggtcgaaccagaggccgtagcgctcctcccggccggccgccgtgctgccgttgccgtacacgttggtctgcacgcgccactccttgccgcgcacgttcccgaggaactcgaagtccagctcgtcgtgcgtccgctcgtacacgtccccgttggacatgtagaaggcgacgacgacgccggcggtgtggtcggcgggcagcttgacgcgggcgctgaagtgcccgtggaggtacgcggcctgcgacgcgaacccggcgcctgtccgctcgtcgagggagatgtgcaccctcttgcccccgccgtggagcgcgaggttggagtcgccgaacagctgcgtgtagccgtccccgaaggagaggggcgtctccgacgacgaggggaggaggtcgcccgtggcggcggccgcagcggacagacacgccaatgtcgccgccgccgccgccgccaatacgatggagcaaaccatcgggctgcgcaggcagaactgctccccgctgcttgctctgctccgcctgcctccgcgcgctcgcactgagccacgcgctccctgttctccgctcgctctgtgtgtgtccctagctagctagcttttaatgggatagaaaggagtgcagcctttcatgcgcagggtgtgaatcgaagcttgcgtgccagtagcagtggaggacgcagaacatgttttgcagg

SEQ ID NO: 5227 - DNA, 1128 bp, Zea mays
cctcgaggccggcccgcccggccgcccgggccgggcttgctatttcgtcatcaagcacgcccgcccgcagctcgcatcgtctaccctgcgcggctgcgcctagggtttaaccactcacagcagccgccgtgactctcgaaccatgtcagcgccgccgtcgctcaagcccccagcaacctccgcagcggcctatccgcgggcgtccgccgccccgagagccaccgggattcgcggcgcctgtgctcttccaactcggcgcctccaatgctcagcctccgccgccgtcgccggagcttccactgagatggctgatgccccgctggactgggctggaaggtcgctggaggagttgcgcagcttgccggaccacgacacgttctgcctgatggcgctctcgccgctggacgggcggtacgaccgcttcgttaaagagctgatgcctttcttcagcgagttcggcctaatcagataccgcgttctcatcgagatcaagtggttattgaaactttctcaaattcctgagatcactgaggtgcctcagttcagcaaggaagcccaagccttcttgattgctattattgagaatttttgcattgatgatgcaaaagaaataaagaaaatcgagaaagtaaccaaccatgatgtgaaagccgtcgagtactttctgaagcaaaggtgcagctccaatccagagattgctaaggtgtcggagttcttccattttggctgtacctctgaagatatcaacaatttgtcacatgcattggctctgaaagagggggtaaatagaggtatgttccctgccatgattgacatatgcacagcattgtgttccttggcgacacaaaattcaggctaccctatgttggctcgaactcatgggcagccagcatcaccaacaactgtgggaaaggagatggcaaacttcgcggccagattatctgatataggaaagagtttctcagaggtgaagatactagggaaatttgctggcgctgttggcaattacaatgctgatgtggttgcatatcctgaagttgactgcctaaggtggcagagagtttgttaggtccttggtttgcagctaatccctatgtactcagatcgagcctcatgttacatataaag

SEQ ID NO: 5228 - DNA, 1975 bp, Zea mays
ggtgtccatttgtggtttttatgcccagccatctccgcccactccccgcactcccaccgtatcctcccctgcgtagggtttaaccactcgcagcagccgccgtgactcgagaatcatgtcagcgccgccgtcgctcaagaccccggcaaccgccgtagcggtctctcggcgctcggtcgccaccccgagagccaccgggcttcgcggcgcctgtgctcccccgactcggcgcctccggtgctcagcctccgccgccgtggccggggcttccaccgagatggctgatgctccgctggactgggcagagaggtcgctggaggagttacgcagcttgccggaccacgacacgttctgcttgatggcgctctcgccgctggacgggcggtacgatcgcttcgtcaaggagctgatgccctttttcagcgagttcggcctaatcagataccgcgttctcatcgagatcaagtggctactgaaactttctcaaattcctgagatcactgaggtgcctcagttcagcaaggaagcgcagtccttgttgaatgccattattgagaatttttgcatagatgatgcaaaagaagttaagaaaatcgagaaagtaaccaaccatgacgtgaaagccgtggagtactttctgaagcaaaggtgcagctcaaatccagagattgcaaaggtgtcggaattcttccattttggttgtacctctgaagatattaacaatctatcacatgcattggctttgaaagagggggtaaataaagttatgttccctgccatgatcgatctatgcagagcaatgtgttccttggcaacacaaaattcaggctaccctatgttggctcgaactcatgggcagccagcatcaccaacaactgtgggaaaggagatggcaaacttcgcggccagattatctgatataggaaagagtttctcagaggtgaagatactagggaaatttgctggcgctgttggcaattacaatgctgatgtggttgcatatcctgaagttgactggcctaaggtggcagaagagtttgttagatccttgggtttgcagtttaatccctatgttactcagattgagcctcatgactacatatcaaagctcttcaatctattcacccagtttaacaatgtgttgactgattttgatagagacatgtggtcctatatatcattaggctacttcaagcagataccaaaggctggtgaagttggttcttccactatgcctcataaaatcaaccccattgattttgaaaatagtgatggcaatttatgtcaagcgaattctatattgtctggtataagcatgaaactaccaatatcccggttgcagcgtgacctaacagactcgactgttttgagaaacctgggtatgggattaggtcattctctattggcttacaaagctaccatgcgtggaatcagcaaggttcagttgaatgaatcacgtttagctgaagacctggagcaaacttgggaggtccttgctgagccaatacagacagtgatgcgaagatatgggatacctgaaccttatgagaagctgaaggaactgacgagaggccaagctgtcaccaaggacagcatgcagcaattcattaatggtctagacataccggaggaggttcgatcgaagctttcgaagctaaccccgcattcctacactgggctagcggaggatttggccagagacatcgagaagtgggttgatcttgaatctggatttcagatcaagtgagctcccatttgacaacaatggagaaaataaataacagacgggaaccctaggaaacgagaatccaatgctggaaccaaggtgccgtttggttcacaaatttgtaacgtaatgggtaacgaataacgttaaatcatgtttgttttagtccaactgtaatcgaatactacactaaaaattgataccagcctattcaaatttgttaccgccagtaaaaaaaaatcgaggaaa

SEQ ID NO: 5229 - DNA, 1415 bp, Zea mays
ccacgcgtccgcaactatgacgtgaaagccgtggagtactttctgaagcaaaggtgcagctcaaatccagagattgcaaaggtgtcggaattcttccattttggttgtacctctgaagatattaacaatctatcacatgcattggctttgaaagagggggtaaataaagttatgttccctgccatgatcgatctatgcagagcaatgtgttccttggcaacacaaaattcaggctaccctatgttggctcgaactcatgggcagccagcatcaccaacaactgtgggaaaggagatggcaaacttcgcggccagattatctgatataggaaagagtttctcagaggtgaagatactagggaaatttgctggcgctgttggcaattacaatcctgatgtggttgcatatcctgaagttgactggcctaaggtggcagaagagtttgttagatccttgggtttgcagtttaatccctatgttactcagattgagcctcatgattacatatcaaagctcttcaatctattcacccagttcaacaatgtgttgactgattttgatagagacatgtggtcctatatatcattaggctacttcaagcagataccaaaggctggtgaagttggttcttccaccatgcctcataaaatcaaccccattgattttgaaaatagtgatggtaatttatgtctggcgaattctgtattatctggtataagcatgaaactgccaatatcccggatgcagcgtgacctgacagactcaactgttttgagaaacttgggtatgggattgggtcattctctattggcttacaaggccaccatacgtggaatcagcaaggttcaggtgaatgaagcgcgtttagctgaagacttggagcaaacttgggaggtccttgctgagccaatacagacagtgatgcgaagatatggaatacctgaaccttatgagaagctgaaggaacttacgagaggccaagctgtcaccaaggacagcatgcagcaattcattgatggtctagacataccggaggaggttcgagcaaagctttcgaagctaacccctcattcttatactgggctagcggaggatttggccagatacatcgagaagtgggttgatcttgaatctggatttcaaatcaagtgaccttccattttaaaatgataatcttctccacattttttttctttttgacaacgacggagaaaaaaataacagacgcgtgcgtcgtggcctctaattgtcgaccaagatgatttacgtggttctcattaatgatatttttggcacatgtaaaatgcgcctcaaggaattatgctaactgtatgttggcggaaaattaacgagctaaaaaaagttacttgctgggtttcttaagaggaaaaaaaaaaaaaatccgagggggggcc

SEQ ID NO: 5230 - DNA, 1496 bp, Zea mays
cattgggtacctcgaggccggccgggccgcgttctcatcgagatcagtggctactgaaactttctcaattcctgagatcactgaggtgcctcagttcagcaaggaagcgcagtccttgttgaatgccattattgagaatttttgcatggatgatgcaaaagaagttaagaaaatcgagaaagtaaccaaccatgacgtgaaagccgtggagtactttctgaagcaaaggtgcagctcaaatccagagattgcaaaggtgtcggaattcttccattttggttgtacctctgaagatattaacaatctatcacatgcattggctttgaaagagggggtaaataaagttatgttccctgccatgatcgatctatgcagagcaatgtgttccttggcaacacaaaattcaggctaccctatgttggctcgaactcatgggcagccagcatcaccaacaactgtgggaaaggagatggcaaacttcgcggccagattatctgatataggaaagagtttctcagaggtgaagttgagcctccccacgccttcgcaaagctcttcaatctattcacccagtttaacaatgtgttgactgattttgatagagacatgtggtcctatatatcattaggctacttcaagcagataccaaaggctggtgaagttggttcttccactatgcctcataaaatcaaccccattgattttgaaaatagtgatggcaatttatgtcaggcgaattctatattgtctggtataagcatgaaactaccaatatcccggttgcagcgtgacctaacagactcgactgttttgagaaacctgggtatgggattaggtcattctctattggcttacaaagctaccatgcgtggaatcagcaaggttcaggtgaatgaatcacgtttagctgaagacctggagcaaacttgggaggtccttgctgagccaatacagacagtgatgcgaagatatgggatacctgaaccttacgagaagctgaaggaactgacgagaggccaagctgtcaccaaggacagcatgcagcaattcattaatggtctagacataccggaggaggttcgatcgaagctttcgaagctaaccccgcattcctacaccgggctagcggaggatttggccagagacatcgagaagtgggttgatcttgaatctggatttcagatcaagtgagctcccatttaaaaatggatgatgctctccacagtttttctttttgacaacgatggagaaaataaataacagacgggaaccctaggaaacgagaatccaatgcgccgtggcctctgacctgtctctaccgagatattttacgtgctcaacatttatataattctggcacatgtaaaatgcgcctcaaggaattatgcaagctgtatcttgactggaaaattatcgagctgaaaaagttgaccgctcgattttataaaaaaaaaaaaaaggcgccgttagaggtccaagctacgacgcggctggac

SEQ ID NO: 5231 - DNA, 2572 bp, Zea mays
  misc_feature (1397)..(1397): n is a, c, g, or t
ccaccgagcatcatgacgaagattcctgatagttccaatggcagacacatctgattgagtcacacctgacaagtcaaaaaaaggcgcaaggacaaaattctatcccagatgcttcaccctctattttttctatctggattgataaaccatgctggatggggccaagaggaatgttttttttccagtaaacactcgagaatgcacccccagcaggcagcagcacaagacagcgagaggtgtgaatgcagtagggacatggatgtgaaagggtgctcatagccccatgtgatgcaaggagtcaagcattggggcaagctttgtccctatctccacgtttcagtgctgctaatcctagcttcaacatggtacagccttgtgtgggggtcattccatgtggcctactgtcgtgatttgtattgtatgtacccctccttgtaggtagtgtctatatctcctgccttgcagcttttgcagtgagctaccatgtccacgatgggcttcttccaggacacccgcgtcgtcggtggtggcagcagccggacggccaggtttctccagtaccagaggctggagtgctgggaggacgccggagtcgctcccagtcccaggtcccggtggcggtggccgtggctgccgacggagaatggtaagatggctcccccctgtttgttcaatgtcaagaggctgaagtggagcaagatcacctcggctctgatactaccaaggaaggttgctgagctctccgcaaagatccgtcacgccagcgccaggaccgaggccgccgccaccatctgcccggccgtcgtcttcgtgtcaccgtgggggcttcctgtgctctcccggccactcttggtcggccacaagagcaggtaccagtatcaccatggaaaggacacctgatgatgagctgagcaggtagtacccaatctgtattcctggcgatgattatatatgcggcgagctagttgatcttgtagtatgtgtagtaatcctcattttgattcccctgcgatgcttgtgtcatgcttgattgggccccttgctacggcatgcatgtcatgttgtgccctctatcaacatccgtaccaagcaaagcaattgctatattccatcactaccattcgcccatgtggatttggatatctcgtaggaattcaccgttcttcatgagcgaaaaaaaaaaaaaaaataattgcatatatggcctggaaaaacatctaggatttggtgttctttttttttctatttaggccatgattggcagatctccggctcctctacaggagcagctcattcataagagccatttttttttttttgcaaatcgttgcaaaatggctcctcctatacgattttattttgtgtatgtgtaaaatacccgcagtctttggttaganatttgcatgaacatctcgtgcgcgtattgtacgaagcgcccgccagaaacattcgcacaagccccaaaatggatcctgctctcggtgtggagccgttttcgacgcactgtttgggagtgactccggtaaggagctggagccgaacggggccaaatctttgccaaatatattacctcatgttagttggaacgagcaagacgtgttatttcttagctagcttacctcaggctatgcgttggcaagttttgtcttggtgaggcgagctagccaaatcggctcactttaattggcaaggtttcgtttgactagccatgctaggcgaggctagattgctgggaaatcaaggacatgtttggaggtcttgccctattgtgtccctggcttggctcgacaaagtcatagatgttcgtttggctttaatccaaaacggattctaccgtttctacagtgttttgtctctatggattgcaactgcagcagtctgaataactggctttaatctaaagcaaatagaccagcaaaatagaaaccttgaaaacacaaaaaatcgagatagattggaaagaaaccaaacgaatgtggacttcgctcagccatgcgaaacaaggcacgcctcaaacggactgcggaccctaactgggcctagcattcttcatcttagacccacgattgtactctctctattctaaattaaaattcattttagctttttattggattcatacaataattactgtgtgttttgtatatatgtctagatttattaccatttatttgaatatagacataaaaagcaagcgataaaacgaagtctattgtggatggagggagtacttgcttatcaatttatattatgacaaaaagtatatgtattgaaggaacacatgaagtctaagatagggtaaattagaccatataatttttgtctaaactatgatctctagttttcttcttgtcaaaacctacgcgataaataaactatcttatgtgcaactagaaatttgtctaagtattgttattcacaaccgtaaagagttatacaatctaggtttcaattctatccattagcctataactaagttcgaaagataaaacatataatcaacgtaacattatacaaatgcataagcttaaatccgttagagtacaaacatttgttgatgtgtcaagcgcgc

SEQ ID NO: 5232 - DNA, 1011 bp, Zea mays
tgaaaatgttgaggttagacagaaagtcatgaatgttgatcctaaggagcaagaagacttcgatcgagagctcaaagcccttcttcaggagagcttggagtctcgtaaatcagaggcccgttcaaggctccctttgaatatgatggtgccgatgaacgtcctcgagggttcaaaagactcaagggccacagaatctgagagtggagaagaaacagtagacgaagagggtggcaatgctgggggtagcagcaaggtgcgtgtgaaggtgctaatgaagaaaggacacaagcaacagacaagacaaatgttaattccggccgatagttcaattgtgcaaagcacgaagcagcaggaagctgctgagcttgaggagaagcagagcatcaagcggaggatccttgagtacaatgagagggaggaagaactgaatggagcatcccaaatggggaactggggccaaggagctaccagtaccagcagtatcagatcaggtggccggggcagctgggatgtttcagcacggggaggtggtcgacaacggcaccacataacgggttctggtggtttctaccacagttatggcaggagaagataagttcgctgtgtgagctatttcgccctgagccttttggcagggcaatgcttctctctattaaccgcctaacagatgagattagcgtttaacacagcttgatggacaattgcctctagcaccctagtctgaaaataagacaattctaccactggtcatgggagatagcaatgccttgagaaggagctgcaaatctgatggtcctaatggcttgagttgctacggtgtttggtaaagctggttgtgatggctgtacccggatacatgcgcatactgtttcgacgccatgtagggggtatctgatcaaagttcgctgtctgatgcatgttctaatttagtggagtattactggcaatgtggtacaagcatcttgtcttgaaaatccaaaactgaaaaaaaaatgtgcgccattttttgtc

SEQ ID NO: 5233 - DNA, 3235 bp, Zea mays
actccgacaatgatctcagaaaagacactcgcgagatgctggtccatctgtgaatggtgaaagcgctgcaaatggaactgaggaaaatggcaaggctcatgaagtagcagatagtgagagctattcaggtacgggcagcattgatggacgggaagaagaggaggatatattatctgaggataagtcaaatgatggctcagataacgaaggcgacgatgaagatgatggcattcctgttgtttctgatgaagatgaaaatgttgaggttagacagaaagtcatgaatgttgatcctaaggagcaagaagacttcgatcgagagctcaaagcccttcttcaggagagcttggagtctcgtaaatcagaggcccgttcaaggctccctttgaatatgatggtgccgatgaacgtcctcgagggttcaaaagactcaagggccacagaatctgagagtggagaagaaacagtagacgaagagggtggcaatgctgggggtagcagcaaggtgcgtgtgaaggtgctaatgaagaaaggacacaagcaacagacaagacaaatgttaattccggccgatagttcaattgtgcaaagcacgaagcagcaggaagctgctgagcttgaggagaagcagagcatcaagcggaggatccttgagtacaatgagagggaggaagaactgaatggagcatcccaaatggggaactggggccaaggagctaccagtaccagcagtatcagatcaggtggccggggcagctgggatgtttcagcacggggaggtggtcgacaacggcaccacataacgggttctggtggtttctaccacagttatggcaggagaagataagttcgcctgtgtgagctatttcgccctgagccttttggcaggtagaaagcatcctagtctgacaaattgcctctagcaaatgagattagcgtttaacacagcttgatggacaattgcctctagcaccctagtctgaaaataagacaattctaccactggtcatgggagatagcaatgccttgagaaggagctgcaaatctgatggtcctaatggcttgagttgctacggtgtttggtaaagctggttgtgatggctgtacccggatacatgcgcatactgtttcgacgccatgtagggggtatctggtcaaagttcgctgtctgatgcctgttctaatttagtggagtattactggcaatgtggtacaagcatcttgtcttgaaaatcgaaaactgcacggtatgtgtgcgccattttttgtctgatgaggtgtgttccatgcgtgtatttcatatgtagctacaccaatcgcgtgtccaccgaacgatgctaacttgctatgccgatggagcatgctttctacccgcatcgcaacccgcaaatccttgtccagtcgtttgtcttccatccaggaatgataccgagttctcatgtcacgcttgacgcttctttccgtcctgctaaagaaaaatgattgctcgtcctgtgcccgtgcgaaggagcgggggaggggcggccgaatgaccagcaccggcacgcacgaggaacgatccatttgggcaaaaattacgaagctactggagctagcagcgtcgcgtcaaacgtcatctgaaactgaagcaggcgcacgaaagaaaggcgcatggtcgcgtcgcactggtgggcaccggcaggcgagcacaccaccccctatctcttctcctggtccatcaatcgtcccgccatgtgatgcgagcgggcaactcaactgcagcggaagcaatcccgtcgcgatcggcgcgatttacccggcttttctttctttctgtctgtcttccagtcacgatcgggacgaccatgggacgatccaccatccgtgttccgtgcagcgcatggaatgcaacgcaatgcaagaggtgtcgtctgtaacaatgattgtaaagcctgtaacccctgatcacatgacagaaagaatggatgtccgagcaaccaaggctagattagacagcgactgtgctccagaattgtactacatgatatactatatctaagcataactatatttttaagggatttctattttcgtaagaaaaaatgaactatttttcctttgaaaaatgaaaaatgggattcctaaactagcattaaaatttagataattcaatactagttttaaattttgagcattatgttgtatatatacatacatcaaattacagtctgaagaacgacgcgtgcaacagtattagagtatctgctgatcagcggcgcttggacgaatctctccgactccgaggcgagtggatcccgtcgtcgtgtcgacctccaagtgtggccgcccggaggaatctatctgtcgtgggtcgttgccgtgtgccggacgcggcagtggcctagattccactgcaccgcattgccggaccgggccggctggctgccatgatatcggtaccctccttttcgggtctctctcgcgtcagtgtgaacgccaatcaaagcgggctgccttctctatgactatgcgtgccatgcttactgcttctgctacacctcctagagtgttctttaggctaatcttcgtcacctcttctgttctattcactacctcacctcttattacgaacttccctctacaaacaaactcaaataacctggtttccgttatgttcccaggtggtggaaaaagacgcatttcttcgggtgcaatgcaatgcacagattaccatccccgctcggtaagcggcggtttccgattaaaaaaaaattcttcaaggtgcagcatagaaggcggcctcatatatgagctgtgtctagtttcacaattggtacgattcgttcttttttacctttttttttgttaacaaatttacgtacacacacaaagaagggtcacaatttcctttttttttaaaattataaaaggaataagcttggccatcgtagatagcagtgcattagatacgtactatatatgtgggtgttaacctacttactaactttatcaatttagttgtgaaaacacaaaaacccactttgaagcaagtacctccaaagctaaagttgttgaggtgggcagcccgagtgcccagtgcccaccatgctttctggatgacgtcacctccagcgcagcaccgaagaaagaacagaatctacagaacgtacctcgcccgaaggacgcgaatctggatgtgtgcaaaaagcaagacacactgcacatgagtgcgtggttctttggcactagaggtagg

SEQ ID NO: 5234 - DNA, 1967 bp, Zea mays
gcctgaacgacgatggctttccgctgaagtcctcaattgaacatctggcgagcgtgattgacgagttaagactgttggcgaacgcaggagcagggataggttcggcatttgttaggaaaggagctcgacaccaggtctcatgacgagctgctgggtgaggtctcatgacgagctgctgggtgaaagacgacgactagggctgaggcgaagcttgacgacgagatcgaacaggggatgacgatcgacggtattgacgtgtcagcacgacgattcccacatgacgaaaaagacggagtagccactcccgaattaggctttttggtcgagcgtctgacgagtatcgcacgaacatcatcatcaccgtccactaatttctcggaattccttccccaaaattcatagcaccaattccacactaaatgaatgcacgaactatacggttttgctttcttctttatcaactctgtttttccacttcgagcgcttgcgatcacaagcaaggaactgcaaggatgcacgaccagcgagcacgacgaggcgaggacatagatgcttgtgacctgggcgaactcggctgggcgcagcaaggaatttctatggcttcggccaacacggaggagagaggtccgaggaattccacgggcatggtggtgtgcccgccaagcagacccgacccagtagtgagaacaaacagagggggtgagctggagcataggacagagccgagcaagggcatcagcaacagaactgctcccaggtagatcgagactgatatccattatctcatcagtctcgttagattctcccttgcactcaaggcacttcacttgacgcagtaatgccccgccaaatgtctccctcataaccagacaaaccccctgcccccggacatcctcaccacagtttccactggcagctgctgcacgtaaccgcttgtgcatgcggaggtcagcagtgagacaggcatctacgacatagcggaggaactcgtatgcatcctcctggcgcccccacctgaagtgctcggcaaataggggcatgcagcggataacttttgctggggaatcgagcgccccagcatctgcccgaagcagccgagcaatctggagcaggagccgagctcgacgcagggagttccatggcgagcaggggaagcagagaagggagaaggaaggggagcaagcagcggcgtggctgctggcgctagcaggcagagggcgctcggcgagctgcacgggaggagcacgcagggagcagctgggcgcgagcagaaggagatccggcgagcgcagggcacgccatggagaggagcgaaggagattggggccgtgtgcagcagagaagctccagcagcggccgcgacagagggagatgaagaggtgatgcggctgcttccaggagataaagctggtgcttgaaaaaatctgcgtatggcaaaagggaagggcggctgagcggcgttgggataagggcaggctgagatctttttttattttctttttctttttctttgtttttttgtttatcagaattcgaagatattttggatcgatggattgttcgttaatcaaaaaaaaaaaaaaaaatgtgacacggtctgattcgattcaaaacctgttaaattttatctatagtctgagcatctgattccacagtcatagataacagagaaaatgaggtcgcgtgcacgcgaggaacagggagatgaacgttgtgcggtgtaggccgatgaaaatatcccagagagataagcgccgagaggagataagatcggctggattttttttacggacgagcggtggctgaaaaatcagaggagttgggcggcaacttaattaaagcttcaatcacaaaacattcggatgattagaagttgccgtaattttgaatccaaatttttaatcaaacttacattggtttgaattcaacttacattttttaaattcaatttgaatccaatacacgtc

SEQ ID NO: 5235 - DNA, 1098 bp, Zea mays
attgctattattggtctcttgtcgggcgggcgtgccattgccatgactggtctcttgttgagcagatgtaggcatagcattgccgttactgatctcaccaaaatactgtgaatgatgaattgactggccatttccatttgcatcctgtattctttctgactgttggcctctctctccacaagaaatagtattatcagcattatttttactgggtcccacaaattgtccagtcttgcatctgtttgattctgatgatttagcagttccattaacctctggattgttttttgaagtgaggtttactttgccatttgacataaccttttctgctgcactgttcttaaagtgaatcggcttgataagtggacctgatgcagtcttgccattcctcaagggcatcagtacattacctttggcaagacgtaggccatcctgttttaccaaaggtatcttcgaggtctcactaggtgaggtgcttgatatgtcaattacattggtgctgaaaggtttagctgcagtaaaagagtaaccatttgtactagacttttgagtttttgaattcagtatataaaataggatgtagaccttctcagacaaaacattctgagaacttgatagggagacatgagaatcgttacaacaaaaccattgaccactagaatccttaacatatgcatagtagtgaccagactctggggagagccctgagtggacgatgcaaccaaaaaggttatatactggttgcggatcctggcttttattgtacatgcaatcagaaagaccaagtgtctccttgaattctatattcctgttgatctttccaccatttatcccctcaaacctcttgagttgtatgacaagcaccttaggtgccctcagcataaacatttgcttctgcgctgaggtgagcgttttacatctttcacaactatatttgtttgcaccttccaatatctccggcttaaagaagcgggcaagggcatcagcaacagaactgctcccaggcagatcgagactgatgtccattatctcatcagtcttgttagactctctcttgcacacaaggcatttcacttgactcagcaatgccccaccaaa

SEQ ID NO: 5236 - DNA, 1485 bp, Zea mays
attcggctcgaggtttttttgttgtgctaaatactgaacataatttgggtgtgttaatattttatttattgtctgcacatggtttgcgttcttctgatgatggctcatggatcctgtaaaatatgtgttaggatttggatatccatgcgggcactaccacagtccacagggtgctcatctcttgtgttcttggctcttgcaagcattaggtcgtttctaaaaccacattggcaaaatgaactctatggtgtttgaggttgctgaattggatggagcaacaatgatttgtcgcactaacaataaaagaaaaggttacttgttggttttaaatgttagtaattactacgaagtacaataatttgtatggagcgcatccagtttagcaactattccatattttaatctatcttttttataagtttgagttcatgtgacttattttagaaacttgaactcacaaacttcctcttatttggtctctatatggtggaattatgtcattctataatctctgttcgtttattcagtcgttgtgaactctcttctaattgctccctgtcattggttgtgctgtactaatacatattggatgaagtaaacagccatatcagttaagtcaattaaaaaaatattatgtggagagcgaagacaatcaataaaaaaccttgagatctttttggtggatagtttacgtgggtattgttgtgagccgtcgcaacgcacgggcaaccgactagtaaatatataagccatgtgtttcattagtaaaaataaggataattatttgtttaattatctttccacataaaatccgtttaggctattatctcagtttttcataaataaacatttaatagtgtgtcttataaccttattattccatagtcttaaatattccacatatatcctttctaaaaaggtttaaatggttcaccaaatgtttatatatttatagttaagatattttcacgcttatatcttgttttataaaatacagaacaaacctttttgttgggggccttcctctttctaaggtcctcaaaaacatgactaaccatttgtttctagcataatagtgactattacagggagcttcggttcgcgatggaagtcttcctctctgtagaaggtcttcaagacgaagacatagctcgagggtgataacaatgaacgccgaagctatagccaaagaattacagcttcggcttaaaatggtgacgaaggccaaaatgatgctgagctcaagaggaaaagactagctagtccctaatgatttatattacagttatgaacaaatgttatggtcataaatgtatttttactcgggctgcgtctcgtgcctataaatagatgaacagtaccactgtactgttcatgctgaattgtaatcgctctcgcatcaacacctttgaacaagccgaaggtatcaatataatataaattctgctcaaaaaaaaaaaaaaaaactcgagggggggcccggta

SEQ ID NO: 5237 - DNA, 2951 bp, Zea mays
  misc_feature (1479)..(1479): n is a, c, g, or t
  misc_feature (2071)..(2071): n is a, c, g, or t
cccacggcagctgagcacgtcgagctgcctcgttgtttctgtccgccatggtccgcccagccaaggtcttgcccagctcgcctggctgctgcgcagcaccctcggctccatctcccagctcgccaatttcctgccggagctcgctctgctctcttccatgacgcgcgccggtgcccagctcggcctccgcttcttcctgctcgcgctcggtatccagcgcgtccagccccagcgccgtcggccatccccagcttgcttggccgccacctctcatggccggctgctgctccctgatgcagctcgcccagctcggattgtgctcgactcccagcgccggtcgcacctctctgcgctcttctctagcgcgcgcctccctgtgtgcgcagccgcgaactcccctgtctcccatggccaagcgtccagctccctcgctccttgctgctcgccgtggccggctccctgctgcgctcgtcctggtcgccgccgccgagtttcctcgccgagtccaaatatcccagctcgttcttatggtcgtgagtttttccctgtgcgcgcgcgagctcgccagccgtcgttgtcctatccgcatcagcacgtgtccgtcaagttcgccaacgccctgttgccagttcaaatatcgtcgctactgcgtgcctcgttgcatgctcgtcggatgtcgtctgttgtaccccagcactcgtgattgcctctagctcgcgttagcgctcgcgcttctgctcgttgtcactgcagcgtatcactcttcatccatcgggcttcgtgcgtgctcgtgtttgccgtcgagctgttggacccgtccttccttgctcgtgacttcgtcgtcgctagagccctcactggattcgtgtcctcgccagctcgctccaaattcgatctcgtcgtcttccgtgcgtcatcaagaaatcccaagaatcaggtgaagacgaagctagcagcgtgatgttcaccaagtgctcaacaaaaagctcgaacaagtcgtcgatcgtcatcctcgtctacgccaaaaacccgagaagattaggcgcagaagaaaataaatcagtacgcggtcagagaatttttgtatggagcgcatccagtttttattgatgtctgactttagcaaccacttcatattttgatctatctttttataagtttgagttcatgtacttattttagaaacttgagctcacaaacttcctcttatttggtctctgtatggtggaattatgtcattctataatatatgttcgtccagtcggtcaaaaaaaaaaaaaaaataatcgctcacttaattaatcatgttgtatcaagacatattggatagagtaaacaacaatattagttagctaaataaaaaaaatatcgaacagtagagataattattaaaaaatcttgagattttttttggataatttacgttgaaatgcacaggcgactagtacaggccaccaatctggctcttccgtcaaagcnctaccagaaccctacctcccgccgccggccgccccctcccgcggctaggaatgaccggcgccgccgcgctccggcaatcttctcgccggattttccggcacctcgccgctgcccccgcgttctctcgcagtgggctccaacatcccgagcgcctcctatcgtcgcagtcgtcgccggagcacggcgcgcgcggcgcggtgtccgggtcggagctggcgctgtacccgccggagcgggttcggaacttctcgatcatcgcgcacgtagaccacggcaagtcgacgctggctgaccggctgctggagctcaccggcaccatccagaagggccatgggcagccccagtacctcgacaaactgcaagtgcggtgctaattcttcccgctcactctccttgttcgataacttagagaaacaagcaaatgttggcccttaccgatcaactatcagatggtgagaggtgatcagtcagttaggccatcatttccgtattatgttttcatgatcagattccggaactgcattgatgtctgcattagttttataaatagttgttacattttggcattttgagcttttaccattgcactgcnagtttcaaggtctatttgtgggcacaatgttacgctaattccatatcagttgatgactatactgctactagtttcatgactgaaacttctacaatttgtatccacattctatgagtttgtatcttgtagttactgtatttatcttacctacaatataaactcttactacttccagtcaaagaaattattgtttagaacaagattggtcaaatatttaaaaccgcaaacatcaattactattacattatttagtgtggaagtgtgcaagttaaatgccagatatcttctacatttgacaagatttggtcaacttgtttccgaaatagttggcaaaatctcttctattgcaggattttaggagtatattctataagaatttaggggtcaaagatacacattgaagagtgaagaccatgaaaagtcaaatgtgtcaagtatttatgacccgagggagtataacagttgttatgagaagccactagctgccagatcatctgagggttaccaggtcccaaaaatgaatagatctattttttttttcattccaaaggatgcaaatagagttgctgtattcattttctttcagaatttgagatagtacaacttcttggggtgtaatattatgtgattcaactacatttaattaagagtgtttattttcacaacctcaactccttttccttataccctgatttgggaattactttcagaaaactgctttgatattggatcagtctttgatgtttagtttgatattgtgtgtcttctgttgtaacatttatctatgtggggaccaggttgagagagaaagggggattactgtcaaagcacaaacagcaaccatgttctacaggcacattactgcatctcaggactcaga

SEQ ID NO: 5238 - DNA, 1390 bp, Zea mays
agctcgggctgtggccatatcacgatggaatggaatgaacgagaacaaggaacgccgaaagaaaaagcgtgtccacatactcctccattcaccgcctctgccgctcacacgtctacacctgacgaagtgaacgcggcacacagatttggctttgctgaagaatccggctcctttcatttgttagaaggatcccagatctagatgcagcagcgcgatctgaaaccgtgttgtcggccagccaagctgcggagtacttagtatttgtttagtcaaatttgacggtggaaaccgaagctgccattgccagtaccgctgctgctagaggctatctgctgcctgccgactgccgggcctacctggtcaaacttcgcgagcagggggaagaagacgaagccgcgcccgtgcgccgagcctggggtgtggggtcgcgtcgcatcgcgtccgcccttcgccgcagccgtcggtccgggtccggccctccctagcgcggcgatggatacggaggcggtcccggcgctggcggtggtggacgcgcggttctgcgcggcgggcgcggccacgctggccgtggccaaggcgctgagcatgtccggcagcgacttcgccgtcacggacgcggccacgggcgcgcccgtgctgcgcgtcgacggcgtgctcttcagcctgcgccggcgctgcgtgctcgtcgacgccgaccgccgccccgtcctcaccgtccaagaatcggcgctgatgctgaacacgcggtggaaggtgttccggggcgacagcacccgccggcgggacctcatgttcagcgtcgtgaagccgtccgtgatccagctgcggggccccaccaaggtcagcgtcttcctcgccagcaacgacgccgagcaggcctgcgacttcaggatcaccggcagctaccacgacggcgcctgcgccgtctccctcggcgactccgacaccgtcatcgccaagatcgaccggcggttcagcgtggtcagcgcgctgctggggaagaactcgtacagcgtcaccgtcaacccggggatcgactacgccttcgtcgtcgcgctcgtcgtcatcctcgacgagatccattaccagcgatgacacgcacgcttcagttttggttccaagccgcgcgccttcccttctgctgttggctgttgcgtggaataaggctcgccccgttctcgaatgtttgtcgcgagagactacttaatttccatacgaggatcttaaccttcctaggcacttggcagttccatctggctgtgtactcgacacggacgttctctatttgttaaatacctatgctatttattgtacacttaaatattctacatattttacttttaattaatttattgtctaaagtataaaatctacaaaaaaaaaaaaaaaa

SEQ ID NO: 5239 - DNA, 1462 bp, Zea mays
  misc_feature (983)..(983): n is a, c, g, or t
  misc_feature (1060)..(1060): n is a, c, g, or t
  misc_feature (1089)..(1089): n is a, c, g, or t
  misc_feature (1324)..(1324): n is a, c, g, or t
  misc_feature (1385)..(1385): n is a, c, g, or t
  misc_feature (1390)..(1390): n is a, c, g, or t
  misc_feature (1412)..(1412): n is a, c, g, or t
  misc_feature (1415)..(1415): n is a, c, g, or t
  misc_feature (1427)..(1427): n is a, c, g, or t
  misc_feature (1462)..(1462): n is a, c, g, or t
aacccataggaaattttggtccccatattgcagctttcccaaccaaccatgaactcacccgcaccacgccgttaacgggtccagaacctcgcttccaatctgccctcccgtgtccccctccctgtccgattccccacagtagcgcctcgccctcgtcctcctcctccagtccggatcgccatttcccaccgatccgtcccggcatcggcatggctgcgcccaagccaaaggcgccggcgcccagtgcttcggcagcctagcgtttgtttgcctccgaggatttccgcctatcgcgttaccggatcttcggtgggccggcgaccctctacgccactatgagctccgacgggcgcctccgccgcgcgctggccgcgttcggcggcgacgtgtgggacctcgtggacgcggcgctcgccgccgccgcgcgggacagccccggcgacctgcgcgcgcgccgcgacggcatcgtccagcgcctctacgcaggggcagcccgctgccgcaactgcgacgccgacgcaaccccggcgcctgctcagccgaggaaggcgaatgacgccgtcgctgctgctgcttctcctgcggcggcggcgtcggcgtttccggcctcgcctgaacaggaggtcgacgcggacggcctcgacgacgtcgacgacgcggccgacgctggcatggagagcaagattctggcgatcagggatttcctggaggacccggaccagtctgaggacgacatagtgagcctactgcagaacctagcagacatggatatcacttacaaggctctccaggacacggacatcggccgccatgtgaatggcctgcgtaagcacccatccagcgaggtccggcaactggtgaagctgctcgttaggaaatggaaggaaatagtggatgattgggtgaggctgcacaactcatgtggtgatggtagtggctccatcataagcgatggtgactcacctgacaaagttcaatccaangtaccatcaaaaatactcatgcttcagactttcaagtatccccccagcccacagaggcataatgttttgagctcagnagagatctagcaaccacaatttggtgggngtcaccaatggagaagcgtagaacgagccctgctcctgcatacaataacaccaagcagaacaacagcaacaactattccagtatttcatcgtcagcaccagctagagcaatacgggagcaaaagaacactcttttggattctgagaagctagactcagctaggaagaggcttcaggaaaactaccaggaagcgcaaaacgcgaaaaagcagaggacgatacaagtgatggatatncacgacataccgaagccgaagaacaggaacaccttcgtgcgcaagaacggcagcagcgccngattnccggcaaagcaccggtgatctntgnctgaccaccatnggatctgtagcggactcagcgtatttatttctgtn

SEQ ID NO: 5240 - DNA, 993 bp, Zea mays
gccggccgggccgggccgcccttccttcgcctggccgcgaccacccacccccaggcctcctgccgcccggcccgcgccgcgccatggaagagccgccgccggggagcagcaaggccgccgcggcgcgcgcgccccgggtggtgggcgtgctggcggggctgctggagcgcgcggcggagcgcggcgacacggcgacgccgacgccggcgggctcggcgttccggggccgcgcgctgccggggatccccgtgcggcggtacgcggagcggatataccggtacgccgggtgcagcccggcctgcttcgtcgtcgcctacgtctacctcgaccgcctcgcgcggggccgccgcgacgccggcgccggcgaggacgaggacgaggacgaggcggcggttgtcggcatcgactcgtacaccgtccaccgcctcctcatcacctccgtcttggtcgccgccaagttcatggacgacaggcaccacaacaacgcctacttcgcgcgggtgggcggcgtggaggtggcggagatgaacgcgctggagctgcgcctcctcttcgccctgcgcttccgcctcaacgtcgcccccgacaccttcgcgcggtactgcgccgcgctcgagtgccacgtcgacacgcccgacgccggcggccccgtgccgcggatgccgccctcctcccacgtcgacggcgaggaggcagtgaccagcagcaaggacaaggttgccgccgccggtggcggttccgtcgtcgtccagcgtagtcaccgtcagcggagagccgtggtacagatcatgacgacggcccaatgacgacgacggacggcctaggtcgacgtacgggagattgtttcatttgttcttttttaatatacgctccataagcttttgtacgcacctgctatatacactccataagcttttgtacacccaaaaaaaaaaaaatatcggcccccccagcggttgattggttgtctatacgagcacgcgcgttgcttcc

SEQ ID NO: 5241 - DNA, 2948 bp, Zea mays
  misc_feature (403)..(403): n is a, c, g, or t
aaaaaattgataatagatggtgaataggtatgaaaaataatattttatgattatagtggggtataggggaaggatttaggggaaaccgctgtaagggggagatatagggggaagagaacgctgatgtgacacgtgagtggaatatacgtggagaaatttaggggtaaccgctgaacacaatctaaggtgtatattagtttagtttacacccaatccacctaaatacatgtaaattggaatgaatactagagtacccaaactatccattaagatagattaagatataaattagcttaatttacacccaatccatctaaataaatgtggattgagatgaatactagagtacccaaacaagctataaggccgagtttaggagccacaaaatcagaagagattgaangagctaaaattctcttcttattcaaagagaattctagcttctctggttttatcgctcacaaactagaactaatggtttgtacggttgcaatgaaattgttgaggatccatttctattcaattttaactagaaaaaattaattaattccctcgaaaccttccctaaccgaaaagccctaacaagcaactcttcgtcaaacgcacggagaacgaatcacgatattgcttccaactttccaagacccaatactccaacatgaaaacgaatggcaagttggcaaccaacgttttttttttttttttacaaccatggaacaaccaaccaacacgaagaagtcaaacagtccgtcaatcaacaacagctacaaatcagaaggaacaggagttagcaagcgaataagccaagctgccgattaacttatcttctacatctacaccacggagatggaagagtaacgcgggcgcttgcgtgctcacatcaaagacttgagcgaccgcgccttcacaggcttcctccaccgcttccagggggccttcctcctcacctcaccgatgctagcctggggatcagcagctccatccacgttgcagccaccgagaccaatcccatcgtagtcaccatcgctgctctcttcgtcgacgcccgcgatccctgcaatgtcgtcgtcacaactcgacacgtcatcttgagatgcagcctgattggtgaatccagcaactttggcttctttttcttcttctttctgtatgatgagaagcatattcaggtgtttcctcctcctcttcttgctttgcaggcagaggctcgttcgtgccgccgcttctacactgcctcttggtccggaacgggccaaagccagcgtagtagtagaagccctcggtcgcactgaagtcgtttccaggcttcttcttcttccgtggcttgttgctggtggacaacttggagctagctgcatgcaccggcgctggcgctggcgctgccccctccagttctgccgtggagtggaactcgaaaccggggttcaagtaggagcgcttctgcacgaaatggtactcacagagggtgttaggttggctcactggccggttgcagtgccaccgtctgccatcgttcttcttgcacttccagacctgcgctgctgctgctgctgccccatcctgctgcacctcttctttcttcaccttcgccttcttcttagtctcgccctcctccctattcgttgcagtttttttcgcggcctcacgcctcagctgcgtgctatcctcgtagactgcagcaggcagcttcttcttcttcttggtggatgtggtggctgacacggtggatgaaaagagccagctcgcccgggtcgtgacatgcacaaagtacttgtccacgagttcgtcctccacctaatcgaatgaaacaggtgaattggtcgagaacagcattatagcgacagttacaggcgcttccccaagcccgttccagcgccagaatggggctgcggatctagggttccacccagccgccgttccggcgacccaaattaccacgacggaacgctagctaatgcaaggtatagctcagtcaggcggtcctctccgtccggcgctgcctgctggccgcccattcggacccgccgaccaaccctagagacatgcacgaaacatacccgccagtagcaggaacccgaggagacctcatggaagcagcgagcttgcggagcatggaactcacagagccaccacgagtcccgagaggggcagagaggagagagagagagggtaggaagggaggggcggcgatggggagctgaccttttgggcggagagggaggggccggcgatgaggtcccatggggaacggctgagctcacagggctccgcagtggagacagaggggctcgagaaggcggacccgccgcaggattcgggtgcggagcacggcgcggggtgcggcggcggcagcaggtcgagccgaggcgccgcatcaacggtcggggcggcggaggcggagtacgcagagcctaggaggcgagaggcactcttgcggatccgcatggtgcgttcgtctctgaaggggtgaaggtggggggagggatctgagcctggaggtctagggtttgggattttggtagagtcgggaggtggacttgtggaggaggcgaggaagatggcgcaaaatgaacgagagagggtgacggggtggtgcgtccgattccgtaggctccgttttctttgggtctggccttttccgctggtgcgcagcgcagtgcgctagctttgtcgctacggtcacatgcttggcatgcctgttccttcgcgtgcgtgggcaccaatctctaacgtattcttcgtttcagaagttatttttaataaaagatcacttttcacatctgatcctagtgaattccactaaccagtgaacattcactagattctaatccaacaaacgagaagactaaccaaaagtttttcttttctagaaaaagtattgtctctgcaattttctattatagaaagtgatatacttatatcttttgtgtataatattttactgcaca

SEQ ID NO: 5242 - DNA, 1690 bp, Zea mays
ccgtcactctccacagattagatatctaactcgccaagctatccggtgctctaaattaattctctcactagctaaatttggttagccaaactagataaatagtcggtctgagtgagatgttacatatatagtgtaatctttataaaaaggtaaatagagagtcaaataaagattaaaaaataaggagtcttttggagatgctctaagctttgtttgacaccttacctcataactcttattaggtaaagagagtacaacagtaagactttatattaattcacgtccgaatttttagatgattttagacaacagcggtgtctaaccaaatcatacaagtaaattactatattttataatttatctttgtataataataaatcaaaatcttgtgtttgtctaattataaaaaattataaattataaactatttttgtgccaactaagattatattttgtcgaatttgtaattttgtctaaagagttcttttattctcgtaactaaaaaaatatattttatacctatataagttgtaacgtgttgaatctataaatatagtataaaatatatgcaataagtgtcgtttgaataaaaaactaaaattcagatatctgagttttaggaaatctcgtactaattacctcttgagttgaaggaccaagacaagagctgggtgcgactcgacgtgattgccggtggccgccgaaaacccgatggtggcatactgtggcactccagcggctttaaggtcgaccgacgtttcgaggtcatgaacatctccgttggccagccggaggctaacggataaaaccttggagctgccatcgtagttgacgcctgccgacatggtaccagagagcgggtttgggaaatcttgtcccagcgacttgtaaacgacgatggaggtgatgttgttgacgtcgatgccaaaatggtcaatggcgtcctggggatcccatgtgttcctgtttgtgtcgaactctacgccgacagtcgacagctgcggtggagtgatgttgctgatgagcccgagaaaaccaccgcctgagtctagcggcacggctgagcggaaggacccgatgaagaaggccatgccatccgcacggttgtaggtacgctcgccgctgatggcgaacgagaagttggtggtgaagctcgctctcctgccggtgcggtgatcccacaggcgcaccggctgcgggtaggccacaccgccggtgctccaggtgtcattcatatttgtaaggttaatgattccgtcgccggcggtagagttgccgaggtacgtgagatttgctcggtcgaggtcgcccgggttggagaagtcgtagctgaaagacagcgcgatggtgtggggagccatgagcaacaggtagtagacgggctggtagatgaggaacaggagatagcaggctcttgctggatagtagcagtaggccatgcctgcacctcacttctagctgcaggtatgtgtagtaatgtttcccgcgccgtcgtggtgcccgccgtgtatttatggaggacgtacaggaggaagaactggtcttggaggaggaattgttcttgatggaatcatggaacagaaagagatttccaacctctagcatttaataccggtactatttttctatactatacttaaagcactaatttcaacggtcatcccgtgtcatctttttacaaataatctct

SEQ ID NO: 5243 - DNA, 3318 bp, Zea mays
  misc_feature (291)..(291): n is a, c, g, or t
ccgtttgaactccgcgtgccaaaagcagattatcaatacgagtagtagattatgccgttttgactttactaactagggaaattcgtgcgcagagacgacttctcaactggttcttgctggattacgtacgaaagcgagcgagcgcgtgcgcgtatatatccatgaaccaataggagcgaacagactggcaatgtgatgtgcatgtaggagcggcctgccgactacgcccggccggccggcgcaaaagtcgaacacgaagctgatacttatttgaagttggacgcgacagcncagatgacatcgacgttttcgttactttagttgataaactatgtactccctccgttttttatcatagtttaattaaaaacaaactaactgatgacaaataatcgagaacaggatagtatatatcaacagcttacaaccggtagtgtagtcttgctctcagtaagttctcctgcttgattcttttaaatatatgtttagacataaatatatgaaaataaataaatattacacaccttgaaacctatattatcatgaacaaacacaagctaaggttttaggtctagactatagtttggccctgaatgcgattaggacgccatggataattccgcacccaaatccgactagtaaacgttatacagcacaagtcttatttcgtgaaaaaaacagacttgctggatgtttcagaaaaaagagaaaaaaaatccaaatccaagctggaacaggcttggcccatttatttgcacctttgtcagcccaacaaagcaccacgtttgttttacacagtgctggcattcagaactgtcccatgcccaatccaacggaaacgacgtcctagagccgaagagtttagtcccacctcggcaccgcaactaggtactggcaagctacacggctatataagaatgccccgggcccgcccggttttcgacttacctggacggggtcgatgggcgatcatgaaggcccatgacctggatcagtggtccacattgcacttggtggacacgctggtctaccatctccccaagtgggagagtggacgtcataatttgtgctagagggggtacgcgttcgcgcggcccctaccagttttaaacatttacttttgggaccttggcgggtttattatgttatgtgggacttactcatctagtgcaaaaaaataaaattaaggtctcgttaaataaaatctagtctgggcgactattaaaccataaatttaaatattgattgttcagttgtaagattaattaatataaaaatagaaaaaacttaggagataatcgtactaatgtttaaattaattatgttcgttttataatttatgtaaatatttttaaaattagactatatttgatttttaagtaagttacaatatatataattggttgtatatttgtactatgtttaatatttccaaattatagtccggtgacaaacacgaccttaataaagagatcctttttatttaaggcttcccctgtgttgccctagtggttcgccctggatgagaacgaagaggaccatggtcttgggcctaatcggagaggggcttcgatgaaaaggtagaaccacggtcgtgggcctaattggagaatggataagggcctggataaaaagttagcgcccgcagactcacagttcgtcagttacggagttaccgtcgccagcagtctccgcgccacacctgtcagccacaacctatccgatttccgggctcatcccgacgtacagcgtcacatcggcgtcgccgcgatgctactcctcccggggcgtccagtgctctcgccggcgctgcagtactccccctcgccgtcaccatcccgtctccgccccctcccttgcaccagcaacgcccccacatctgcttccaccgccgcagacgctgccacgccctcgtccttctccgtcgaagactacctcgtgaacaggtgcaacctctacgccaacgtggccgcgcgcgtggcgccggagctctccgccatcaggtctccctcgaagcccgacgccgtgctcgccttcctcgccaacacgctcgagctctccccgccgctcattgccgtggcagtggcccgcgacccgacgatactcacctgcagcgtgccaaggacgctcgcgccgcgcgcggaagagctccgcgccctcggtttcaccgcgtttcagatgggccttatcgtcgcgcgttgcggcgcggccgcattccgctcacgcgcgctcgtccccagtgtccagttctggctcccgtatctgcgtggtcgcgtcgacaagctcgtcgccgcgctcaagggcaacccgggcctcctcaccgccgacctccggacggtcaagtccaccgtcgcgctgctccaagaggaaggcaccctcaccgatggcgacgtcggctggttcgccatctcatactgctccaagctgcttgtcgcgagcccggacgaggtcgactccgtcctagcccgcgccgacgagttcggcgtgccgcgcaagacgcgggcgttcaaggacgcgatcatcgcggcgttcagcgtcactccggagcggctcgcatggaaggtcgcgttcttcagggacgagctcgggtggacggaggcgcaggtgaagacggcagctgcgaagatgccgacgctgatgacggtctccgcggagcggatccggaggaactgggagttcctgaccacagaggtcgggatggacgcggagcgcgtggccagcttcccggcgctgctgaggtacgacctggaggggcggctggtgccgcggttccaggtgatgagggtgctgcaggcgcggcggctgtggcgcggcagggacttcaacaacatcgctgccatcacggaggaggatttcgtggccaagttcatcaggccatttctggtcaaagtcccaagcttggccaagatctacgaggccgctgtcatcgagaaggaagaacagtagcgggatagtgtatcatcagtgggatgctggacaaccggagagctgatgatccctgtagatagccaggcatatgcaactccgttgtagattttagttttgataaatggattacatgcctttaatgcaaagattagattcaacatgaaactgttgaactgtgtaaagtgacaaacaacttttgaacacaggagtccggagcttctattgtgaaggcgtggtataattgccatttttttctatagaattgtctgcgccacaatttttatttttcagttacgccatttgatctgatcgcatcaaactttacttatttcagtcgatgtcaggtcgaaccctgagaaggtttaatattgcaatatgactttgattagt

SEQ ID NO: 5244 - DNA, 1687 bp, Zea mays
catcgggccccgccgggcccggccgggaatcacgcgcaaacccaatcgcggagacaaagcacacaagcaaaagcaaccccgcgggccgcgctagcagtagtagccgaacgaggaggagcctcgaatccagccaggccaggctcctcccattcctcctctcccacgagctctcaccgctcctcgcggcggcaaaaacccccttgaattccctacgcgcccgcctccaatcccgccagtccggcggcgacccagggatccatggagaggtacgaactgctcaaggacatcggttccggcaacttcggggtggcgcggctgatgcggaacaaggacaccaaggagctcgtcgctatgaagtacatcccgagggggctcaagattgacgagaatgtggcgagggagatcataaaccaccgctcgttgcggcaccccaacatcatccgcttcaaggaggtcgtgctcacgcccacgcacctcgctatcgtcatggagtacgccgccggcggcgagcttttcgacaggatctgcagcgccgggaggttcagcgaggacgaggcgaggtatttcttccagcagcttatctgcggtgtcagctactgccacttcatgcaaatttgtcaccgggacttgaagctggagaacacgctgttggatggcagcccggcgccgcgcctaaagatctgcgactttggctactctaagtcatcgctgctgcactcaaagcctaaatccacggttggaactccggcgtacattgctccggaggtactctctcgccgggaatacgacggcaagatggcagacgtttggtcttgtggagtgactctttacgtgatgctggttggtgcatacccttttgaggaccccgatgatcccaagaatttcagaaaaacgattgggagaatagtgtcaattcaataccagataccagagtatgtccacatatcccaggattgcagacagctccttgctaggatcttcgtcgcaaatcctgcaaagagaataacaattagggagattaggaatcacccctggttcctgaagaatttgcccagagagcttacagaagctgcgcaagcgaagtactacaagaaggacaacggtgcccccaccttctctgatcaaacagtcgaagagatcatgaagatcgtagaggaggcccgcacgccgccccagtcgcctgctccagtggctggttttggttgggcagaggaagaagagcaggaagatgggaagaaacctgaggatgacgagcaggatggggaggatgagcaatacgacggcgaggacgagtatgacaaacaggtgaagcaagtacatgccagcggggactttcgacacctaataaaatgaagctcctagcaagaccgagttctcaactgatgagatactgtctggttttgctgtagtttgtggtgctaagatgatgcaccctcggtgcttacgtagtatacttctgtctggattcacctttttttcgcatattgtgttaatactctgtaaattatcaaactggcttcctcaatgctcgtgtaattaaatgaaccgttgagtgattaagctagaaggcaagatatactttctatggagtaaattctgaaagtatcaatatgtgttgaactagactaatttaaattttattttcgcaaccattacatactattgaatagtctatttcattctgtgt

SEQ ID NO: 5245 - DNA, 1324 bp, Zea mays
agcgaattccccacgcgcccgcccccaatcccgccagctcggcggcggcccagggatccatggagaagtacgagctgctcaaggacatcggctccggcaacttcggcgtggcgcggctcatgcggaacaaggacaccaaggagctcgtcgccatgaagtacatcccgagggggctcaagattgacgagaatgtggcgagggagatcataaaccaccgctcgctgcggcaccacaacatcatccgcttcaaggaggtcgtgctcacgcccacgcacctcgccatcgtcatggagtacgccgccggcggcgagctcttcgaccggatctgcagcgccggcaggttcagcgaggacgaggcgaggtatttcttccagcagctcatctgcggtgtcagctactgccacttcatgcaaatttgtcaccgggacttgaagctggagaacacgctattggatggcagcccggcgccgcggctaaagatctgcgactttggctactctaagatggcagacgtttggtcttgtggagtgactctttacgtgatgctggtcggtgcgtacccttttgaggaccccgatgatccaaagaatttcagaaaaacgattgggagaatagtgtcaattcagtaccagataccagagtatgtccacatatcccaagactgcagacagctcctggctcggatcttcgtcgcaaatcctgcaaagagaatcacaatcagggagattaggaatcacccctggttcctgaagaatttgcccagagagcttacagaagctgcgcaagcgaagtactacaagaaggacaacagtgcccccaccttctccgatcaaaccgttgaagagatcatgaagattgtagaggaggcccgcacgccaccccagtcatctactccggtggctggttttggttgggctgaggaagaagagcaggaagatggcaagaggtctgatgatgacgagcagtatggggaggatgaggactacgatggcgaggacgagtatgataaacaggtgaagcatgtacatgccagcggcgattttcaacacctcctaaaatgaagctcctggcagcgatcaagtccgcaactggtgagatactgtctggatttgttgtagtttgtggtgctgagatgctgcaccctcggcgcgtacttgtagtttccttctgtctggatccaccttttttttcgcatattgtgtgctatactctgtaaattatcaaactggcttcctcaatgcctatgtaatgaaccgttgagtgattaaagatagaaggcgaaatataatttctatggaacatacttcaatcttaaaaagcggcc

SEQ ID NO: 5246 - DNA, 1595 bp, Zea mays
tcgagccgccgggttagacattgggtacctcgagccggcgagtctccagtctccacccaccgttccctcccctcccctcccctcctctcccctcccctgtcgagtccggctgtccccacgacccccacgccacgcgctctctcccgctcctcgcaacggcaaaaccccagcgaattccccacgcgcccgccagctcggcggcggcccagggatccatggagaagtacgagctgctcaaggacatcggctccggcaacttcggcgtggcgcggctcatgcggaacaaggacaccaaggagctcgtcgccatgaagtacatcccgagggggctcaagattgacgagaatgtggcgagggagatcataaaccaccgctcgctgcggcaccacaacatcatccgcttcaaggaggtcgtgctcacgcccacgcacctcgccatcgtcatggagtacgccgccggcggcgagctcttcgaccggatctgcagcgccggcaggttcagcgaggacgaggcgaggtatttcttccagcagctcatctgcggtgtcagctactgccacttcatgcaaatttgtcaccgggacttgaagctggagaacacgctattggatggcagcccggcgccgcggctaaagatctgcgactttggctactctaagtcatcgctgctgcattcaaagcctaaatccaccgttggaactccggcgtacatagctccggaggtgctctcccgccgggaatatgacggcaagatggcagacgtttggtcttgtggagtgactctttacgtgatgctggtcggtgcgtacccttttgaggaccccgatgatcccaagaatttcagaaaaacgattgggagaatagtgtcaattcagtaccagataccagagtatgtccacatatcccaagactgcagacagctcctggctcggatcttcgtcgcaaatcctgcaaagagaatcacaattagggagattaggaatcacccctggttcctgaagaatttgcccagagagcttacagaagctgcgcaagcgaagtactacaagaaggacaacagtgcccccaccttctccgatcaaaccgttgaagagatcatgaagattgtagaggaggcccgcacgccaccccagtcatctactccggtggctggttttggttgggctgaggaagaagagcaggaagatggcaagaggtctgatgatgacgagcagtatggggaggatgaggactacgatggcgaggacgagtatgataaacaggtgaagcatgtacatgccagcggcgattttcaaccccccctaaaatgaagctcctggcagcgatcaagtccgcaactggtgagatcctgtctggatttgttgtagtttgtggtgctgagatgctgccccctcggcggggacttgtagtttccttctgtcgggacccccctttttttccgcatattgtgggctatactctgtaaattatcaaacgggcttccccaatgcctatgtaatgacccgttgagtgattaagatagaaggcgaaatataatttctaaaaaaaaaaaaaaaaaaaaaaaaaaaaaaaaaaaaaaaaaaaacccccacccc

SEQ ID NO: 5247 - DNA, 638 bp, Zea mays
cgctgctgcactcaagcctaaatccacggttggaactccggcgtacatgctccggggtactctctcgccgggaatacgacggcaagatggcagacgtttggtcttgtggagtgactctttacgtgatgctggttggtgcatacccttttgaggaccccgatgatcccaagaatttcagaaaaacgattgggataccagagtatgtccacatatcccaggattgcagacagctccttgctaggatcttcgtcgcaaatcctgcaaagagaataacaattagggagattaggaatcacccctggttcctgaagaatttgcccagagagcttacagaagctgcacaagcgaagtactacaagaaggacaacggtgcccccaccttctctgatcaaacagtcgaagagatcatgaagatcgtagaggaggcccgcacgccgccccagtcgcctgctccagtggctggttttggttgggcagaggaagaagagcaggaagatgggaagaaacctgaggatgacgagcaggatggggaggatgagcaatacgacggcgaggacgagtatgacaaacaggtgaagcaagtacatgccagcggggactttcgacacctaataaaatgaagctcctagcaagaccga

SEQ ID NO: 5248 - DNA, 610 bp, Zea mays
  misc_feature (609)..(609): n is a, c, g, or t
actacataggtgccggactcgtcccagcgaagaaccggacgagcgagcaagaggcctcctcctcaagcttcgaatcctccccttccgcgctttccctccccctcctcctcctcccctttccagtccccaccccagcgaagcttccaaagccgccccaaccccaacggccgcccggcctgatcgagcagacagctgccgcggccctccccgccccgcacgcgacctcggagccatggagaagtacgagctgctgaaggacatcggcgccggcaacttcggcgtggcgcggctcatgcggaacaaggagaccaaggagctggtcgccatgaagtacatcccccggggccaaaagatcgacgagaatgtggcgagggagatcatcaaccaccgctcgctgcgccaccccaacatcatccggttcaaggaggtggtgctgacgccgacgcacctggcgatcgtgatggagtacgccgccggcggcgagctgttcgaccggatctgcaacgccgggaggttcagcgaggacgaggcgaggtacttcttccagcagctgatttgtggcgtcagctactgccactccatgcaaatctgccaccgagacttgaagcng

SEQ ID NO: 5249 - DNA, 915 bp, Zea mays
  misc_feature (857)..(858): n is a, c, g, or t
  misc_feature (866)..(866): n is a, c, g, or t
  misc_feature (868)..(868): n is a, c, g, or t
  misc_feature (878)..(878): n is a, c, g, or t
  misc_feature (885)..(891): n is a, c, g, or t
ctgcgtgctgcgcgtcggccgtcgtccctgcaggagcctcttccatggcgcctagtcttctccccatggcgagctcgtccagccactcgcctccactacatgtgctgttccccccctcctccccttttctcaagtttggtcctcggcgcccaagcttttgtgtccctgcagcacgtcgggcctgcgcagccccggcagtggcgtcgtccatcccgttcggagcgctctgggtgttcgatggaatggttgtatggagctttgtgttgtgtgcagccccatctgcgacactgtcgaaccccggtgagaacccattgtttttcttgtatttattcctcgctagtacatgtactcagcgtcgattaagtagaggctaaccatgtgtgtgattgtgtatgcttgcgaggagagaaacccctaggttccgacggtaaagaaccgaagcccgtgggacgcttattaagtgttcggtagaaggaccgaaccccaaaaccttcgccgtgttcgcgaacgtcgcttcgagtttagtcatggtacgctagttgatcacgtgatgcggaaatcgagctgagtcggccatgaaatgttgttaagcgtgggcttcttcgcaaggatatactgatgataaacctgaagatggataatctgaacgagtgccaacacaaaaggatggtcaccaagtgatcgtcatctaacagcactcacttagtctttatcccaggcaagccccggtgcatttgccaccttccttgtattacaaaattttatcacttatatgctgcattaggtaataggagttgaatgattaaacacttgatgcattaccatccttgaaagattgattatcataccttgttacnngttttatngnaactagtaangcttagnnnnnnntatagactaaaaaaaaaaaaaaaa

SEQ ID NO: 5250 - DNA, 1463 bp, Zea mays
atggaccagcaccgccggtatcccgttcccaattccacagatttccgctccccactccgcactcccagtacttaaaccacctaaaaaccaagcaaaatcccacctcccgaaccctggactcatagacaaggaattgggagattcgatttctgctattcagcccacgcccactggttcaaccggtttcttcaaatctcaggcttcaaggccgcaacttttcccccgttggggttggacttggacagctgccgtgcttgggaggcattgccggcaacgggaggtccaatcatcgatccttcgatagattgtatataaggaccacggttcagattactgtcaagcatgtctctactttcaaagttgcgcttgatcaccgtggatgttactggtacactgattgcttacaaaggacaccttggggattactactgtatggcagcaaagtctgctgggatgccatgtcctgactataaccgcatgcatgagggcttcaagcttgcatacactgagatggcaagacagtacccttgctttggatttgcagctaagatgccgaacatcgaatggtggaggacatgtgttaagaattcattcgttaaggctggctatgattatgatgaagagacatttgagaaagtcttcaggcgcatttattctgcatttggctcctctgcgccatactcggcgtttcctgattcgcagcccttcctaaggtgggcacgcgaaaagggactcactgttggcatcgtcagcaatgcagaataccgctacaaagatgtaatcctgccagctttaggattgaatcagagctccgaatgggactttggggtgttctcaggtgtcgttggcgttgagaagccagacccaagaatttacaagatagcgctggagatggcaggaaacgtcgctccggaagaagcgctccacataggtgacagcatgcggaaggactacaccccagctaggagcatcgggatgcatgcgctgctcctggaccggttcaagactgccgacgctgagagctggaggcagtcaggcgccacggtgctcccggaccttgtcgccactcaagagtggctcaccaaggatcagaatgacgaacaggaggaaacagtggcagcacgagtgctgaagagaatgtccgaaaagctatagatgggggctttaaccatgcattaattctacgagtgttcctttatattatctagctatggactgaaggtccaaaagcaacttatgctgatgagaggttggtgacgattcttggctactggctactgtaattagcttgagctactattctggttgcagcatctgtggctgaacacgagtaccatatctgagtgtcataagtcatgttgcgaagaacatgagtagcatatttcaggtgccgtttggttcatatatttgtaatgtaatgggtaacggataacgttaaatcaaaaaagtaataaaactcgtgc

SEQ ID NO: 5251 - DNA, 8218 bp, Zea mays
ctctgggaatttataatcctatgacaatatagtggcatgggacctgtctcgtattgagtagcggatcatgaggccaatggccctgtcaacgggtctcgatccatggatccgacatgtcaacgggtctcgatccatgggtccgactgctgggttacttagtacatggtcacatgtaacatgcaagagttacgggttacccacaattctttttttttgagttactatacagtatagtgtaatattcactctgtatacttatagtgctatcttgaattgtagatacgtatcaatacgccggcggcaactcctgctaggctgctaccctaccacgcctgacaccacgattcacaacgaaaacgcctgtttgctgtagcgtagcagcatcttcattccgccacacgcacagcgatcgcgcggacggtccgatcgcagctgcgctgaggttttcgacactgaccgcctgaccgagcgggccggacgccggagcagctgcagctctcgccagttggctcggcctcacgcagctgttcgatcaggtgcatgacgcatcaaccaacagtgccatcccgctcggtacccctgcggctgcgagcgaccgcggcgggacgggacgacccggggtttcccagattccaccacgggtgacccggccccgcggcagccggcgcgctgcctacctacgcccgctcgtaccgacgcgtgcaccacccgtcttttccccgtatccccagccggtctcgtcggctccctttgcatccaggaggggcgggcaggggccagggcgctaggccatggccatgtctccgcacggctacctgctctccgttgcacgaggaggacgacgagcccggcgttttctcgggtctcgcgacggtggtgtcactgtcgcctaggcttctcgcacccgcgacgtgacggcgcgccttcgggcagtagtgttcccgaacatggccgggcgccgtcggtcacggcggcgtgcaggctgggcgtggggtgaacgaacggggccagcgcgggcgtgagacgggagactaatggcgaccggtgcctttcgggctccagcgcagcagagatggcaaatgccaaatgggcagttaagtcaacaggactagctagtatgtgtgtgtgtgtgtctgcagtgtgcactcgaccaagttgatgagggtccgcgtccgtccaaccggagctcggtagcgttaattggcagctaagcgggcatggatggtatctcatcgctcgtcccctcaaatccggggcaaaaagccttcaggaccgggattgccacgagacctgcagcctagtgtagtgagggcctcagtccctcttgcgttgcgagctttgggttacccgtcggcgatggcaggtgcgcgtacttggctttctcaatcggggaactcttgcaggggcaggagtcctggttcccatcccgactgagtggtgctgtgacgcagtgactgtgcagaacgcatgcgtcgttctcgttcagcgatcggtggggcgagggcatgccatgaggcatgagctgcccatgttcggtctcttgcgactgcaccacgcttaactgttgttggccagagtcatcctgctatgctaggatgctctggtcaagcccgactagcgcaaaacaatcaaggcagcatttgaaaaatacggatccgtataggagacacgtagtggctccagagcggatatgtgtcgtttgcctccactgaccgccccggcgccccgccctcgcgttccagggtccatgccccccgtggcagaccgggtcgttgtctccattgctcatccatgttattccacaacccctttttaaagggccacttcgtcactcctcttcctcctcctcctcctcctcctcctccatgtccacggccatcgtggcgagggcaaccaagctgagcgctactcgcagtcgcagttgttgcctgcccagcatgcagctctaactcaccccgtgcagcagacgccgagtcgtggcaggtagctaggaaggagggcaggagggaagggcaggccatggcgctggaagccgtggtgttcccgaaggagcacctagcgggcactgccaaggcgcgctcggcgtcgtcactggcctgcggcttccgcaccgaggaggtcgaggacaacggcggtgtggttctgcaaggagaggccagcgatgcgcccggtgccggcgcggccaccacgtgggagtgctgggacgcggcgctctgcccgtgctccactccacctgctggtgccgtggaggagtgctgggacgacgtgcggcaccggctctccgcgtcccctccgctgccgccggcgccctccgccgccgtcgcagcgccatcgtccgggcacggcaaggcagctgccgcggcgcggcggagacggcggcaacgcccgaaggcggtgaagaacacggaggaggtggagagccagcggcgcaaccacattgccgtggagcgcaaccggcggcggcagatgaacgagtacctctccgtgctccgctccgccttgccgccctcctacccgcagcgggtacgtacgcacgcacacgatctcctccatggctgccgctccccggcagtatcctagccgcaagagctttgcaggtcatgtcaccaatgccatgcatgtgcacgaacggcttggcattccaccgtgctgctgattgccgctgccggccccgcccagcttttactgtaacggatgtcaaatcttgctgcccccctccctctggcccctggccatccgctggagctgcctcgccgcgctttggtggcacatgtcacggaatctctagggatcgtgtgtactgcactgcaggcatcatcatcgttcatcaaaagccgcgcaccttcttgagcgccgagcccttggtcgcgaccgaccgaatggcatgttccctttgcaacgtgcgtgctccctacagtctcctacgcgaccgatcgagcgctgatgtggttggttggtgcagggtgaccaggcgtcgatcgtggccggtgccatcaacttcgtcaaggagctggagcacctgctgcagtcgctggaggcgcagaagcggcggcgccaggggtgcaccgagccaccggcgccggcgccgttcgccggcttgttcacgttccctcagtactccaccgccgcgacgggtgtcgtcgctggctctggtgacggtgctggctccggcggcggcgcctgcgcggcgggggcgcggcggggcgtggccgacatcgaggtggccgtggcggagagccacgcgagcgtgaaggtggtcacgccgcggcggcccaggcagctgctgaggatggtggtggcgctgcagtgcctcggcctcaccgtgctccacctcaacgtgaccaccaccgccgaccagctggtcttgtactctctcagcctcaaggtaactaacagctagtataacaacagactaccggcaacactgcaacgatggactccagtctccagctgatgagctgagcagccagtaacactaacacattctcgatcctcgtggtccttgctgctgcatgcagatggaggaccagtgccggctgtcgtcggtcgacgacatcgccgccgcggtgaacgacatactcggcaagatctccgacgagcgcgccagccgtcacctactagccgcgtagcgtagcggcaagtctgttttagcaggtgtcatgtattgttgttgcaacaccaccaattcgatcctaatattggaaaacgcactggcaagtcgcaattggcgccactgtcacgcggtgctaccacgcgctccatacgtcgtttgcgtgcaattaaacatgtatcggttggaccagctcagtctcttgcaattaaacatgttttagtagtactgtattattcgtgtgtatctacccagaattcagattcattcgcatctattcccgcgtcagcgccaattattagcaccgatcggtcgagatcgagacgacgcctgctgcgtgcgcagcgcacacgggtgacctgttcgaggtccgtgaactcgtggacgaccagcgcttttttgcttcaggaatctgttttgtctgaccagtctgcacgctttcgccagacaagaattagtagcatggattattcagccagcccctgtcgcgttttaaggctgcagtcgtcttcgtccttctcatgttgcgcaacgatcttgcgtgtgctcttacggctccaggcatcgagtttacgcttcaactattgaagaagggtatgagaggtgaaaacgacctgaaaaagggtggcccatgtttactgtgactgaaaaagaatgttactaggacgacgtgccaatggatccgggttgaaattgaacgcgggctattgttttttttttcttcctttctcttgtagggtcgatggatccgtggaaaggggcgtggaggtaaaagcaagcgagcaaatggacgacggtactgtgtctactgtgactgaaaaagaatgtcacactaggacgtgcatgcctacgaaacgaaactggtgcagctggcaactagtaagggctttcgtaagtacgtgcatgcatgcatatgccagcctttgtgtgtttgctatgctcgcctctcgatgctacaggctacggctcgtagctttgtttcacgtcgtcctaccctgtgctcacccaccccctgttccttcgatttgtagccctgacgctcgctgtacaaacaaaacctggccacatgcgctgattcagaggaagtgcggctgtggaaccagcgtatacgtgtcgcccttgaaccgttcttctagtggatttcctttcggggtttagagtggcaaataaaactgcatggttattctcgaaatgttacgaacgtcgtattttaattccagagtgatgactgatgactactgacgagcatgcacatcatgcaactgctgcatgacagccgagaactcaatcccaccatcttaccctatatatattaaagacgtatcttaccctatatttttaacaaaccctcaaatattttatacatattttagtcttgcttactctattatttaaactgttaaaatagatagaagagggaatctatatatacggaggatagatgattgtcttctatatttagagagaggggagtgaatattcaattggagtcggtctcaatcaaggcacattttcctgcttacttctaaaatccgacaacaagatgcgtcgccttcggagcaaaaaattgaaaaaaaaaatcgtaaagcggccctcctaaggttgcctaactgttggagaaatactccaacttgccttaataaacttaactgtatggatgagcctgaatgaagtagaagttgcagagcaagacaaggtctgtgcctctggatcttgtcctgaactggcaacgccattatacattccctcgtccagaggcaagccgcaagctacaaggagcacgcacatgcggctgtgcacacaaattatgggaagagcaacagaagcactgaactactgctaccagtaccagtgtactaccacgcaacaccacagattagatcagacagccggagtagaacacttggggtgtctgaaaggaaccgttgatctccagtggtccatcgagcttccagtcgaggagcatgccaatggcgccaccgtcagaaggattcccggcatcagatcatcgatggaggggctgcagtacgtgcagtcaccgtgtaaaaaaagaaaggggggggggggggggggtcaagtatcagaagaacgtaggctcagctcctgatagctagacgaaggtgaaaattggaactaaatgtttgcagacatcggatgcgggtgctctgaactcttctgaatcgagacaaagaccagctgaatccagacaaataagcaccattcaggcaatacgtcttacctaccacccgatacccctccaccctcttgtctctttggatcatccagctataatacatacagacgctattattttcgctcaaaattctatctgtgtgatgcatatgcatcgagcgacaagcaggcaggggaaacaggtcacctcctcctcctgctgctgctgccccgctgcgcgcggcatcaaattaagacctgtcaggggatcgatacccttcccccgcgcggcggtaaagctacccggcccggcctggcccccgtcaatcggttcctgtgctgcactgcgtcgccccatcttgtgaaaaatcattgcagaaattgagaagcgacaatggggacggactgctgtggctggctggaaagaaaggtctgacttggtggatcgtcaggctcgtgcaacagtagtagcctagtaggctacgagaaagtgagagcaaattcagctcgtaaagagacgtgcgactgttgtccattgaagcggccggatggatgggaatagttggactggacggcgcgggtgtgccgcgccatgtcaagtctagtttgagtatccacccacatgtcagtgtaagctaaactaatctacgcatcaatccactttaacacatgtggattgaaatcaatattaaaaagtaccgaaataaagccttaggccttgttcgtttacgtcggattgcacccggaatcgttccagttaatcaaagtttatataaattagagaagcaatccggttaagaaactaatccgacccatcaatccagcacaaacgaacaagaccttaagtggatttaatcctttctaatcccttttaatagacctctaaccaaacaagcattgcataaagccgccatgaccgccgttcttttttttttcccgaaggctgctgtacacttggacggtgtcagcatgtgtgggcaggctagggcggcaagtgactgaatggcatgtaacactaaaatcattagaaaaaataagaaacgaagaaaaattaggttagtcagagatactgtttcacttcccaacgctggatttctttgtttgtcacgacacgagcgctctggtgcattcgtgccacattaccgttcactcgagtcatgactcaccacatcgttcagagtttaggtgtctggaagacaggaacggaaccaaagccgttggtgtgtgttggacgaccagcaggccaggccggactctaaagtaataccctcgaataccgcatggttagacgggcccaataatccacaacaggggagctggcccagtcaaaagtgtaccgagtttatagaggacgaggcatgagaaagccacggatgcacagcccacgtaccacgggcggtggcagatgggccaacagcctcgtgggtagagatggcaatggggatccgatccccgattccccgcggggaattcctctattaggggatggggatggggaaatttcttcccccacggggatgtaaatacggaagatttctcccccgacgggtaaacggggacggggatggggaagcattccccatccccgttccccgcggggacccgttaaacttatatatgacgatgtttttagataatagttaataatataaataaataattatcttgacaaaagattactagttgtacaaatgtgttcattttaatgtacacataataatttttacatctaacaatatgtataagtgacaatgttttacattaataaaaaatgaagtatgatctaattataatttaagcgggtacggggatccccgatggggatttatccccgcgggtaacggggatggggaagaaatgtcccccgtaaacgttcatggggatccccgcggggaaaatttttcgtcgcggggacgaagatagggagctaaaacccgacggggaattccccgttgccatgcctactcgtggggcggcgcatgcgggatattactgtgatagagagcctgttgggctgccccgcgctggagcccaccggctaatacgaccagagtttgcagtgaccaaagcaaaagcagtgaatggcgctcagttcatacctcgatgagcagagttgttttgattagggcgtctgggagggctctcaaattagctccggctctgactcttcgaggagcccttccaaacggtttaaaaaaataaccctcaacaaagagcactgagggtgaagctatttttatagaaagaaaccggagccaaaaaatagctcccaacggctcctctcgcgttaacgttaagagaagccgttttgttaaaaaacacttgatcctatagaaatgatgttcttaagagaaaccagagtcggagtcattttagaggagacggagccgtgtcaaacaggcccttagtctgaccagagcagcacaccactaggcc

SEQ ID NO: 5252 - DNA, 1986 bp, Zea mays
  misc_feature (164)..(164): n is a, c, g, or t
  misc_feature (208)..(208): n is a, c, g, or t
ctgataatttgatgataaactataagaaaatgtagaaaaactataagagaatacaaatgctcagaaagcgttttttactaaaataactctttacatgataatttaattaaatggtaatttgatgaataaattttagaaaatctctttgaacatgctcttacatnccttccataccgaagtgtgcacgtgccacccacgcagttcgctngataagaaaagctgaaagcctgaaacaacatcatcctcgcttttttttttttttttgcacgacaagaagatcctgacgttatccatcggtccgtcacagtcaacagccagtcaacagtagaatcagcactgatactgctggagtcacagctcacgagtgacaagtgtagcttgaatctaccaaaatatcacaaactaaccgagtactactagtctgcagctgctgctagtgctaggttcattgattctaaacaaaattcatttaaagatgaactaccagtaggctaaaattccgtccactaattgctagatgaatcccataattttgcaaaatgcactaagatcatgggcgatagcgtaacccgtcggttcctcgcctacaacgtaatccgcgagaaatgctgcccgaggctgggctcccggcggtgcctcgtcgtcgttggctttccgatgcggcgtcggatcctagacatcgccaatgccaccgtctgggcgcgacgcgagcgagggaacgccgccggcggcggctcacgaggtgcggaagagaccctgccgaagccggacgggggccaccggtgcgaccgcatccacaccaggggccgccgcttcggcggctgcaccgcgtcgtcctcgccacgcgacgtcgagccgccgccgcacgcgcgcttcctcttggcgccgggcgaggggaggagggccgcgacggagcccgcgcacccgctcccctcccgtcggtggcgagcgccgggtgccgggcgcccgtcgacgtccatgtcctcctgcgtggcggcggtccgggcggcgtccaggctgaggaccctgacgaacatgtcgaggtcgccgccgggccccgccaggcgctcgagctcctcgacggcctccgtgaggcggtccacctcgtcgctgcagacgaagagcgccctgaagcccgcgaggaagcggcgggcggagctcgcgacggccgcggcgcggcccgcggcgtcgagcacctcctgcccccgcagcgcctcggatcggagcacctgcagccaggccgagaacgactcgtcccgcacggccgcccccgcattgccctcggcggcgtccaccaccatgcgcaccttcgagaccagctggcgcaggcggcgccggcgctggtccacccgcgagtgcgctgaccagttccccttgatgaagccgatgaactcgcccaacagggtcgattcgaggatctccatcttcctcctcaaatcgacctgaagcagcgctagcggcaactgttcttattcaatgctcaatgaggagtcccaatgaggcggcgggggcagtatccgtgccgtggtggaaatgaacagaatttttcgattaggatgttctaggtaatggtctcgtgccgatacattgttttttatattacatattttcttttgaatacgaacaagacactaatacaaatacggttggtcttggtcacatatacaactaaatttataatcaaattagataaaataatcgtgtgcttgcaccataaaataaaaggttccataccataggtaaggacatggattatctctagcaccagtttctttcgatcttcatcgcgcgtcgctcgaatcgcatataaacgcgagattaaagacggtccaacagcaagctccgtgtatcgctctggcgtccagagagcaaacctatagctactgagtttaactgaacaacaaaaaagattaacaaattttatccaattcaaaagagagataaaaaaatgataagataactaagggcggtcaaccgacagtataa

SEQ ID NO: 5253 - DNA, 1378 bp, Zea mays
cacggccatcgtggcgagggcaaccaagctgagcgctactcgcagtcgcagttgttgcctgcccagcatgcagctctaactcaccccgtgcagcagacgccgagtcgtggcaggtagctaggaaggagggccggagggaagggaagggcaggccatggcgctggaagccgtggtgttcccgaaggagcacctagcgggcactgccaaggcgcgctcggcgtcgtcactggcctgcggcttccgcaccgaggaggtcgaggacaacggcggtgtggttctgcaaggagaggccggcgcggccaccacgtgggagtactgggacgcggcgctctgcccgtgctccactgcacctgctggtgccgtggaggagtgctgggacgtgcggcaccggctctccgcgtccccaccgccgccggcgccctccgccgccgtcgcagcgccatcgtccgggcacggcaaggcagctgccgcggcgcggcggagacggcggcaacgcccgaaggcggtgaagaacacggaggaggtggagagccagcggcgcaaccacattgccgtggagcgcaaccggcggcggcagatgaacgagtacctctccgtgctccgctccgccttgccgccctcctacccgcagcggggtgaccaggcgtcgatcgtggccggtgccatcaacttcgtcaaggagctggagcacctgctgcagtcgctggaggcgcagaagcggcggcgccaggggtgcaccgagccaccggcgccggcgccgttcgccggcttgttcacgttccctcagtactccaccgccgcgacgggtgtcgtcgctggctctggtgacggtgctggctgcggcgcagcgggggcgcggcgtggcgtggccgacatcgaggtggccgtggcggagagccacgcgagcgtgaaggtggtcacgccgcggcggcccaggcagctgctgaggatggtggtggcgctgcagtgcctcggcctcaccgtgctccacctcaacgtgaccaccaccgccgaccagctggtcttgtactctctcagcctcaagatggaggacgagtgccggctgtcgtcggtcgacgacatcgccgccgcggtgaacgacatactcgccaagatctccgacgagcgcgccagccgtcacctagtagccgcgtagtgtagcggcaactctgttttagcaggtgtcatgtattgttgttgcaacaccaccaattcgatcctagtacatggaaaacgcactggcaagtcgcaattggcgccactgtcacgcggtgctaccacgcgctccatacgtcgtttgcgtgaaattaaacatgtatcggttggaccagctcagtctcttgcagcgcaacatgttttagcaaaaaaaaaaaaaaaa

SEQ ID NO: 5254 - DNA, 3565 bp, Zea mays
ccggccggggcacactccgccttgcttcacactcgtcacccttttcccgtttcgaggacccggagcgctgcgcttttgtgccctcggttgggatttctgctcgcagggagtcggaaggaggacgagcttctgtcggtggacggagtaggttctgcagggccgagatggtggtgcatctggtgcttgcttgagttgctgcctcgtgaggttcgatcgggttttgctggtgtctgctagtaagtataggagcttaatcggaaggaagcaatactggaggagacgatgagcttcggtgccgtggacatggaggaggagagcggcgccgcggcggcggccgcagcggtggaggagatccggcggctgcggccgaggtgaactgggagatgctggacaagtcgcggttcttcgttctcggcgctgcgctcttctcgggcgtgtctgcggcgctgtacccggccgtggtggtcaagacgcacctgcaggtggcgccgccgccgcaggcggccacggcgacggctgccgccatcctccggcgggacggcctccgggggttctaccgcgggttcggcgcgtcgctggccggcacggtgcccgcgcgcgcgctctacatggcggcgctggaggccaccaagagctccgtcgggtcggccgccgtccggctgggcgtctcggagcccgcggcgtcggccgccgcctccgccgcggccggcgtgtccgcggccgtcgcggcgcaggtggtgtggacccccgtggacgtcatcagccagcggctcatggtccagaccccggacgcctgccgctaccgcggcggcgcggacgccttccggaagatcctcctcgcggacggcgtccgcggcctgtaccgcgggtttggcctgtccatcctcacctacgcgccgtcgaacgcggtgtggtggtccacctacgccgtggcgcagcggtgcctgtggcgcgccgtggggaccgagcgctccgagagctgcgcctgcctgatggccgtgcagggcgcgagcgcggccctggccgggggcaccgcggcgctggtgacgatgccgctggacaccgtgaagacgcggctgcaggtgatggaggccgacgcggcggcgcggcccacgctggccagcaccgtgcgcgggctgctcaaggagggcggctgggcggcgtgctaccgtgggctggggcccaggtgggggtccatgtcgctgtccgcggccaccatggtgaccacctacgagttcctcaagcggctctccgccaaggagggctccttgggctagatccttccttggccgtcctcaagcgactctacggtatcgcccgcgcgtctccgccgtcctcgaagtcgaagatcgacgcgatcgatcgatccatggggatgaagttaatgataattaggatcctcttctctcttgtacatattgctcatcaggtttatttcccgtcgttcttgtttccttagatccggcgctatagagggtgggcaggaagaagaactagaaggggttttaggatgcagaattttgctggcctttgctgtggccctgctgccgatgccgatgatgatgatgaaaacctgcgtgaaatgcagaacttgtatccaaagcttgcgtcgatttccctgtccagtacagtactccgatgtcttgcatctgccagtggacagctctcagtggtggtagctctagccgcgtcaatgtcatggcgttgcttcatggaatggaagacccgatgcgcttctgctgtcgcgtcgcttcgtcttttcgccattttcttcgcttcgttgtacacgcagtacccgggggtggagtggagagcttggcccgggacagcgagggcgaagaagaattgtaccactggacttttttattaatccatcggcttgctgtagcctgcaccgcgcgtccgcccgtcgatgaacctctttcaggattcccggaacctgggaagaaaaaggaaaaaaaagagagcatggagacgcgagaagggttatttgagaatcattggtgaatcaagtggcgaacggttcgaattcggttacttgagaagacttggaggattaaaaagctctagggatttggtgaaaaagggtctagaaattcctgagcacaacacaaggcgggcaggtggtgacgtttgctaggctgcatgtgataagccgtgctccccagttctgtctcacacatacacgccggcgcttgtttgactcgtttgatatacatcaaccggacaaaccttcgagaaaccaggccgccatctaaactctcattagcgactgcagatcaccgtagagtgccagccagtacggtaaataggcaggtgcgccgcgggccaagataataactgccgtctcggtgcagtccagcgggccacagtccggtccggtccttcccctccgaaccaggcgtccacgatcgggcccgggtccggcggggtgggtgcggcagggccccccgggggcggggacagcttggccgtggcaggcagagtggctcggttctctcgatggatttcgcgctgtctcgacctcgactcgattgatgataggctacgaactctagtaggtaacgacggatcagttgtcgcgtgctagtacgaatcaggaggtggctggcttctggtccctcctgcctaatgatctcatccacatatggatggcctccatggcaccttggatctggattagctgccggatggtttcttattattattattatttgacacgacatcaggtcgtcgcatcagcattcctatctaattagactaaatttataatctttttgtagtttaagtggggactctttggagtgtagctacacgaggaaaggaagttggtagatatcaaagagaccttaaacatatgtacggccttgtttgaggctaaattaatctcacaaaattacaaatacatttagataagtcattctgtttctttgtttagatttaaaatattttcaaagcctcttaaatttatgttataaactataactccaagctgaagttggaatctagatgtaatacccaaatagtgagggtaataaaatgtacaagataagagaaatataaaagggtgatttgaccattgatgttgttattttcatttttgtacatttcaaatcatgaggttaaccctgactaccaataaaaaataatattaaataaaagaatgtgcatcatgctcggttttacttgattacgcatttgtggataataaaaaaataaataaatgtgtcattaacaagatgttaatggacacataaagttttacttctacatttgaaaacaaaactctaaagaaaagaggaggaatataaaataaagatagaaacatgaaaacataaatatatccttaaagtgttacatttattttgtgcacatgacctgtgaaatctgcaaatcaatttggaaatcaaatagtatgtttgaagttagaaaaagggaattcaaaaataaaaaggaaaaatagagaaggaattctaacctacatgggctggccgcctcacttctggcccagcaaaccattccagacgcgcggcccatatcccattccaccacgcgtgcgcgacca

SEQ ID NO: 5255 - DNA, 1924 bp, Zea mays
ccggccgggaaaaaggcaagcctacagtggtttatctcaatcaattcgaatcctattcgttgggctcgctttcttcagttgcattacttggcccacacaaactcttcccaataaattacgacccccagccaagctttggagtgcggttcccaaccatggcggcctcccccacttcctccctcgccccgccggtggtgcctatggagcttcacgccggcaaccgcgaccgcctcgtcgccgcgctccgcggccacatctccgcctccgcgcgcccgctccacggcctcgtcctccttcagggcggggaggagaagacacggtactgcaccgatcacctcgagctcttcaggcaggagagctacttcgcctatctctttggagtgcaggaaccagggttctacggcgcaattgacatcgcctctggacagtcaattttgttcgctccaagattgccagctgactatgctgtttggatgggtgaaataaaacctttgtcgtacttcagggatacatacaaggttgatatggtcttctatgttgatgagattgcaagggttgtgcaagatcatttcgggaaccatggaaagcctcttctgtttctgctacatgggaggaatactgactctggaaatttctcaaagcctgctagttttgaggggatggagaagtttgatactgatttaattacacttcatccaattttaaccgaatgtcgtgtgattaaatctgatctggagcttgctctcatccggtatgctaatgatgtcagttctgaagctcacattgaggttatgagacgagcaaggccaggcatgaaggaatatcaattagaaagtatcttccttcaccatgtttatatgtatggaggttgccgacattgctcttatacatgtatatgtgctactggagataatagtgctgttctacattatggacatgcggcagctccaaatgaccggactttgaatgatggagacatggcactaatggatatgggagctgaataccatttctatggatctgatatcacatgctcataccctataaatgggaaattcaacagaagtcagacaataatatacaatgctgtgcttaaggctcataatgctgttatatcagacatgcggcctggagttaattggatggatatgcacaaattagcagaacgggcaatacttgaatctctcaggaaggaacaaattgtacaaggggatgttgatgatatgatggctcaaaggttaggggctgttttcatgcctcatggtcttggccacttacttggtattgacacccatgatccaggaggctaccctgagggattggagaggcccaaggatccaggactgaactccttgcggaccacaagagaactgaaagaaggaatggttatcacagtggagccaggctgctatttcattgatgctttgctaactaaaacaagggatgatccaatttcctcaaagttcttcaactggcaagaggttgaaaagtataaaagctttggtggcgttcgcattgaaagtgatgtgtatgtgacggctcaaggatgccggaacctcacaaactgcccgagagagacctgggagatcgaggctgtaatggctggcgcaccatggcctctgccggcttcaagttctatggtggtagcagcagagaatagcaatgacatatctaaagcgtcgtaattttctctatgctcaatccatatcccgagttgaaacaaattcgacctggattcttatattcaataaatagtgaggctgaggcgcaaaacattgttggattgatggctggaaaacatttcatacgctcacttaatttgtaagctttctgttatgtgtttgagatcgatggggaaacgtttagctaaaaaaaaaaaaaaaaaaaaaaaaaaaaaaaaaagggcggccgccaccgcggtgga

SEQ ID NO: 5256 - DNA, 2493 bp, Zea mays
  misc_feature (828)..(828): n is a, c, g, or t
cctgaaccagcccaaacgaaagtgcaggtgttcttgcctctgctcccacaaaatcagcgcttgaactaacgcacacagtaatgcatgcgtgatgcgtctcatcttccggagcccacgcccaccacgggacaggacaggatgcatttcaggttcccccaccagggccgcatcgcgatgcgcattatttctgtcatcagggcgacgaaactgccacagtgacgcggcacatttggttccatcattttagccatgcgaaaagacccccataatgccatgtctgtctgtctgccagaaaagcggacggaccgaatgcacagaaacgggcgagatgaaagctggcaagtggcaaggcaggagaaagagcgaccatgccgacgcggacggcgcgcgcccgtttccagttcgggcggcaggtcaaaaaggatgtgcaagttggagcatgtcccatggatcgatggtgcggctacgcggcctcgccggcgagccgagacgtggcggaggggccgacacggtcacgtgccccccgagcgcgggtcggcggggccacggcggcaccgccgccgccgaacgctttatgattcacggaagctgggcctgccttccgcagtgccgccgctaactgctgctttcgagcactccaactcgtcggtcaggtcaggtcagatcaagctttgctcgcttgcagccttcgtgagcccgtggtccaccaagtgtttcgggggtgaacatgcacggaagaactgtcaacttgtaaaaggcgaagaacgtaactagagtacgtacgtatatcgaatcgaatgaccacgaatctagcaaggaggaatgcangcaattttttttttttttttggaacaaacatcaagtgctatctttcttctctttaaatctgctgtccactcatctacaataattactacggcatggaaagctccaaccgcccgccgtgcgagcaaccaccgccaccaccacacccgcaagcgcaaggcgatctctgaaccgagctaaggaacgcggagcagagcaccgtcaccgccagggccaccaccttcccggcgaccaggccgacgaggacgatggcgaccagaactagagcaggagaccggatccctgcctgctcctcctcctcctcctcgattaggtcgtccaccgacgcatcgatttccacgtgcccagcatctacttctacgcattggctgccgcgagaacccctcgaagaatccgcctctttcgcagcggcttcgtccgcggcggcaccgatttcgctgggcgcgccacggcgggagcccgacgaatcggccgcctttgcattgccgccgccgcgcgccgtgtcatcaccctctcggctgccgtcgccgtcgccgtcgcagcctgacgaacccgcctccttactcctccgtcctctgtgcagcttcttggagctggcgagcagcttcttccaggacttcttcttcgccttcggcctcaggttgcttgattcgtccaggacgccgccgctttcttcgacgagcagcatgcggccgtcgctttccctgtcggaatccgagcagcagctcggccgcgacggctcggtcgccgcgtcaacctcccggatcggcgagacgcgcccgcggccgtccagggcaagccgcctctcggtcaccaccgcccggggccgccgcctggggagcgaggacgacctcacggactcgagcaggtagagtgagaaggaggccacggtaacggccgcaaccaccttgctccagatcacgaggagtgcgagggacgccaccacgccgctgaccgccaggaagcccaggcccaggcccaggcccgggccaaagccactgcctttgccgcggcgtgggggctgggccggcggaaggtcgggcctgggccgatccgacggtgagactgcgtcggcggtcgtcggtggaggcggagactcagccggcgggaacagcgatggcgaggtgggggtggatggggaaggcaaaggcgaaggcgaaggcgaagcggcggcgccgcgcttggaggacggggagggatgcttcttgaggcgaccatggttcttgacgacgaggtcggcgagagaggtgggaaagccggtctggacggggaggggcccggcgcgggaggggcggagcgcggcgaggaggcggataagacggccggatgggcgttccttcggcaggactgagcgtcggcggcccttcccgtcgccggcgacggcgagcataggaggacgccggcgcgcgggccgggggtgttggcttttcggtgcggtttggtgctctctctctgggttcgttgccttgggtcgattaggatgttctaggtaatggtctcgtgctttgccatttgggacgtgcagagaccgtgggagagtaggaaggagcacgtcgcgcgagcgcgagcgcgagtgggtttttattttctttccaacttttctttgtttcattattactttccttttttttaatcggacaacaaatattcaaaaatagacgaagcaca

SEQ ID NO: 5257 - DNA, 1174 bp, Zea mays
actcctcagggcgattggggccctcggcgccgcccggcaaccttctagccttcaccaaccctgccccctcgtccctcgacgtagccgacgccgacgccggcgccggcgcctctccgaaccgacgccatgccccccgtcaaatggttgatgcactggcatccgagtcccggggcgacgctcaacagccagatcctggcggaggcgtgtggctgcgccgagtccctaggcggctccaaggacgggcggtggaagacctccatcttcttctaccgcgccatgacccgggacggcgcgggaggccccgcggtgcagcagcaccccgacttgcctagggagctcctcggcgtcgcgctccacgagcgcccgggtctctacttctccatcgtccgcgcccagcgcctcgttctccaggccgatgcggcgttcccccaggtcatggagaagctccagtcatacagaatccgcgtcgccctcaacttcgaggggtttcagtatcaactgggtgatttctgcctgaggataggaaaatgtgttcccaataattctgaagcactgagaggaatcatgatggaggtagagtattatcccctaacttccattgaaaaatccaaggcagtcatggaggacttctttgacatatggcaggaaacagttgcgaagaagtcattacctggtcaattcattcatgtagactcaaacttttcagaatatggtctttcagatcaatattcttttcaacatactgcagttcaatatgcaacttgcttgcagcagctcatggctgcagtaacagtaaggggttagctctagagagattctcaaaaccactctataacgtcgtaggttgattgtggcagcattcacaatgcctggatatatgttgtgtaattgacatacaatttacaaatgggttcccttcctcatgttcttttaagatgcccactacaggtaattggcaaattgcaatggtcacattctgcgtacgtggtggggttgcaggctgagcctccagcctttctaaaagcactattttgtgcttgaaatggtgcacatactagtcaatctgacaaagttaccgctgtctccattacatccaaattaatgatcgttttgcccttttttaggtacatacaaggttgtcaaattctcaattgtagattctaagggggtgtgg

SEQ ID NO: 5258 - DNA, 751 bp, Zea mays
cctcgaggccggccgggccgggacgagcatcagctgagcctcctgagaacacacaaattaaagccttctcctactcctacatacgttcatcaatggctctcctgcgtgtcgtcagcacggccgtactgcctgccgcctgctgcgtcgtcctcctcctcctgtccaccacggctccggtggccatggccggctcgttgcgggatgactgccgcgcgttctgccgcccaaggtgcgagggctacggtgcggatttgtgccatgccctcgtcaacggtttcccgttactgcagaacgtcctcgaggcgacgtgcgcagagcgcttctacgaagtgtgtcaacccatctgcatgaacatctgcacggccaacaccctcactccggcagcggggccgggaactgccccgccgccgccgccgccgccgccaccatgcggcaagcaatactagctggctagctagttgatgcctccgtacgtacgtgttgttttatttgctgttaactcttaagtgtgtatgtttccgtacgttattatttaagttttaatttgtgttctccggtacggttcgtttcgcaatgtatgtgtctgtccatgtatgcaatcaaagcagctatgccgtgtaatttcgttcccctttggttgttccggctgtgttttttctgttcatgtatgcaatcaaagcgctattaatttattaaatatttctgaatctatttatgttgtaaaaaaaaaaaaaaaaggcccctaggggcc

SEQ ID NO: 5259 - DNA, 1967 bp, Zea mays
ggatttgtgaggctagcacgtgaaagacttgttccttgtactgaaaaaccctacgacatcactcttttcaaatattccatagagtgtaaatcatcacttgcagttgaagtgcgttccgcgccgaccggaccaatgcctgccaccaatgcgatattccatgtggaacttgtgacgttagattaagatggaaacaatttacaattgttgccagcaacggagggcgtaaattcccagcactactaacgactgggcctataaattgggtacctcgaggccggccgggatgctcggcaaacaagcttctcttgtcactcatcagcacggttagcatagctagcaccatgaaggtagagcgcgatctccacatgagccggggcgacggcgaggacagctacgcctccaactcaaggcttcaggagaagtccatactgaagacgaggccggtgctgcacaaggccgtggcggcggcgcacgccttgtcgctctcctcaggaggacccggcggcggcgccatggtcgtcgcggacctcggctgctcgtcggggcccaacacactgctcgtcgtctcggaggtgctagcagcggtggcgatggtggccggcggcagcgcccaaccgcagcacgtgcagttcttcctgaacgacctccccgggaacgactttaacctcgtcttccggtcgctggacttgttgaagaacaagaagctggccgccaaggacaggcgggaggagtcgctgctaccgccgtactacgtggccgggctgccgggctccttctacacccggctgttcccggaccactgcgtccacctcttccactcctcctactgcctcatgtggcgctccaaggtccccgacgagcttgccggtggcgcggtcctcaacgagggccacatgtacatctgggaaaccacgccgccggcggtggtggccctgtacaggaggcagttccaggaggacatgtcgctgttcctcaggctgcgccacagggagctcgtgcccggtggccacatggtgctggcgttcctgggcaggaagaagagcaaggacgtgcttcgtggcgaggtcagctacacgtgggggctcctcgcgcaggctctccagtccctcgtcaaacaggtcccttctcttaatttctcttgtgcatgcatgcaagtgcaacatcatgtcagcttgcttcttgatgcattgcattgcgtttgcgttgcattgcatgcatatgtatggcatgcagggccgtgtgaagaaggataagctggactccttcaacctgccgttctacgcaccttcgatggacgaggtgagggacgtgatcacgcggagccaggcgttcgacatcacccacatccagctcttcgagtccaactgggatccacacgacgacgacgacgtggagatgaagatggaagaagacgtcgccgccgtccagagcggcgtcaacgtcgccaggtccatcagggccgtgatcgggcccctcatcgcccgccactttggcgagcacatactcgacgatctcttcgagctgcatgccaaaaatgtcgcagtgcacctgcagaaagtgaagaccaagtaccctgtcatcgtcgtttccctccaggcgaaatgagccgcgcgccaaataaaggaccaagctagctgatgcaaaatctggcgtcaagttagctattagtaccgctactattatatgcatgcagaataattagtcaaacaatcagaaaaataaagtgcctcagagactgttagtggcagatccaatgtttcgttaattatatgtagtgtaatggtaatggtaatggtaatggtagtcgtcagggttcaccgtccatataatatagggtgggcagatcatgggctctggctttttcttttaaaaagctagagaagtggtaaacattgattttaaaatgacttcccatgaaaagctagagcagtggtaaaaatcctctatgctggactagagcaagtccc

SEQ ID NO: 5260 - DNA, 4775 bp, Zea mays
  misc_feature (295)..(295): n is a, c, g, or t
  misc_feature (307)..(307): n is a, c, g, or t
  misc_feature (4696)..(4696): n is a, c, g, or t
ccaaaacccgattggaaaataaatcaactcacggtccacacaaatctggcctggttggcctctaaactcgatgaggccggcttcaacggtttccaaagttgcgggggtaggaactcggttttatcgattttacttcgatctacggttactccctctgtctcatatcctgaggtaacaaagggttgtcttgagtcagaagtttttttaaaacttcattgcctcacgacatgagacagaaggagtagtcggtaacactctaggtgacgagaatcaagcacgacagtcgaacgcgagnggacatgctctnacgtgtaccagtactagtgagtgatggtatgtaaactttgtcgcacgcgcgcgcttgtcgcacggacactcgagtacggaccgactgatctgtggatgtttctttcgttcctctgcagcatccaacggtgaccgctcgagtctccatcgacgaatgtgcgtgcatgtccgagtgcttcatcgatcctgacacggacagcacctcctcgtcatcacagagtcaggtggtctagaaggccagcccagcgcgtatacgtacatatgtactgtacgcatgagcatgagtgcatgactaggaaaaaaaaggccgaaacaggcaaacagctccaccaacaccggcagcagcagcagcagcagcaataatgcgccgcgtagaacaaaccgagcatgtgagccagagcctggactggagccagttcccgcgttccatgacgcgcctgcccccagcagcctgcatgtggcgcgcagctgcccccgcgccgctcgcctcgcactcgcacgtcgcgcacgcgccggcggcggttggtgcggcgcgagtgggctgtccgtccggccccactcgcccgtccacgtccaatcccgcgcgcccacgctggctccgccgctgacaccgtggccccgcacgcgcgtatccccggatcccggatggccggatcccccttcgggcgggcgggcgggtgggcgggcatgtggctattaaaaggctccgcggccggcaacgggcggccctgcccgcgctcttcttcttgtgttgcctgtcgcctcggggcggttgaaaattaaccgaagcggacaccgcgacgaggccgcggcggacacacagccggaccggacaccagcgccagcgtagcggcagcggcacgcccgaggaagcaagcaagccactacgcccctgcgtcgtcgcgtcggtgcccaaggggcagccgccgggagggagggaggggcatcgaagcggaggccacggcggtcgggatggtggtggcgagaaaaccgcagcagcagcccgcaggcgtcgcccgccggcgcggtggcggcgtcagggtggggcccgcgaggctcgagggcctccccgcggcgtgggcgggcgccgccgccgccgccgtcaaggtcaagtggcccgcgcccgggggcgcgctgtcgcagatgctgacggggcggtgggcgcgcggggtgaccgccgtcgaggccgtcggcgccggcgggaccgtccgctgggagccgcgcgacggcaaccggttcaggctcgacgacgtcgtcggccccgccggccggccggagcgcggggtcttcttctccgtcctctatgtaaggcgccctcctccctcctccctcctccctcctccctcctcccgctcttgatgatcagtttcttgagcggaaccagatcgcctagcttagtacctaccggtgttgttacactgatttgccgtaccaaatcagtcgagactctgctagatcttctgttacactgatttgaaccctacgaacatgactgggtacgtcaccttctgcaagcataatttaatatgcccggggttttctattcagttttttaaatcagcctgtcattgatatttcgtcggcgcatcgcggcatcggtggtaagctggaggcttgcgaccgcagcttcggtgtggagtgctcgaggtcaatgcacagctttcttcaagtgttgggccgagcatcataatgcatacactatagcttagtgttgagctcatgaaagaaaagtattcatcattgctgtgtgggagcatttgtctaaagttttttcgtgtgcgtggtttgaaatcgtgtacagggagaggaggggggccaggtcggcagggccacgtggtccgctctgattggcccgtgtagtttgactttagttatttaggttgcgagatctatgtcatggtgttaatttttgagggttatgtaccaacagtgtgccccctctcgctttcatgacagctttttggaagaaggtgtttgttgtgcccccaaattatacgtggttttgtcagttttttcttgtgacatttctgtttcattcattttttttatttgtagctaccatatttttaaaaccctttttggagtggataaaagtaaaattcaattactagaatagcttatattgcaacctcccatgaaatagatccaccagaccaaagtaggcatcaaataaagatcatgttagcttccttccaaagcagtaatcttgagcaccagtagcaagcaacgtttattctttttgctattttggggatgaatccaccttctagtagctagctacgcccgccccttctttgggcggatgcgtcgtaggctctgtagccatcgttgcgctggcagtaacaattgctttgcgacgacgcagggattccaagaacaaggccggggcaacaaggagctggtgaggctggaggagatcgggacagccatgataagcctggaggagtgctgctgggagatgcagctgcagcagcacgaccaccagctggtggctgtccccgtcagggtcaggaaggacggatgggcaagcgatgccatgctttatgtaagcgcgatctttcaactgcattgccggccatttgcagttttagtggcactgctttggattaggataataatagacgtggatggcaaatgtttgatggaaatgacatgtgtaactgatagaattgggtgtggttaactgttcaggtggacgtggagctcgtggacgcgaacacacgcccggacgtcgatagggcagtctcgttcagggagaagccgagaacgtacatggcgcctccgccgccgccgacaatgcgaggtagccgcaagagcttggagtcagcgacgtgccatgatgtccttgacctgaagcagctgcttgatctggctgagaaggaaggccgggtggccgtgtatggcaacataaggagctccgacaccagcagcgtgagcagcactagcagcagcagcagcacgattagcgtcagcagtgctagcaccagcggcggcgcgagcccggaaccggcctcgacgtcgaagcgccggttcctgccatggacgaggaggagcagggacttcgacaagaggaccgccgagtcgctctcccaagaactgcccacaaagtgcacggtgagcctcctcctggcacgtgatggaaatgaaatgctacgttcctcgtcatgtgcaccggcgctgatcttgtcacggcgggcgacgaaccctgcgcaggacgacggtccgggtccggccggcggctgggagacgcgcgagttcacgagcagggacgccgagacgaggctgaggacgccggtgttcttcgcgtccatcgaccagcgcgacggcagcgctgggggggagggcgcgtgcgcggcgctcgccgccgtcctcgcggcggcgctccacgccggccacccggcgatgcccacccgcccggagctggacgcgctcatccgggacggctcgtcggagtggaggcggctctgcgacgacgaggcgcgcgcggcgcggttccccaaccggcacctcgacctggacaccgtgctggcgtcccgggcgtggcccatcgcggtgcggcacgacagggccttcgtcggcttcttccagccggagagcttcgcgtcgctgtccggcgccatgtcgttcgacgacatctggcgcgagatcgccggcggcggcggacgtgggcgcgggccgggcggccgcgcggacgtgtacatcgtcagctggaacgaccacttcttcgcgctcaaggtggagagcgactgctactacgtcgtcgacacgctcggcgagaggctgcacgagggctgcgacaaggcctacatgctgaggttcgacggctcgtcggagatgcgggccgaaggcaccgaggaggtggtcgtcgccgggaaggaatgctgcagggagttcatcaagaggttcctggccgccatcccgctgagggaggagctggagatcgagaaaaagggcggcagcagcatcgacggtggcggcgcgccgcaccggcggctgcagatcgagttccacttcacagcctttacaagacgacaatagatgatgagttggcgatccgacagcagttgggggatgttccttcctcctccctgatcacagcatcatactaaccttgtgtaaattcgtctgtatatctgtatacagtttacaagataaaaatttacagggtaggatttggttctcgtttcacaattttagataggaaacaaaacatgaagaggaataccattttgtaagcgagctcagtattacatgattttgcttctgttgaaaaaaaaaaaaaaaaaacctcgtgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanggggggggggcctttttaaaagaaacaaattttatttgccggggattgcaaaagaaaaatttttgttttggggccccca

SEQ ID NO: 5261 - DNA, 2255 bp, Zea mays
  misc_feature (100)..(100): n is a, c, g, or t
agtaaaatgtaattaccagcttagttataccgcatggagcgccaaatgttgcaacctcacgtggaacagaaccaaagcaggcagcatatctaacctcctnccaaagcagtaatgatgaagagcagtagaagcagttaggtactagcaagcaatggcattccattgccgtttcggggtaatcttgagactgacactgggacggatcatcctagggtaccaatcaaagcatccaccttgtggctagctagctagctaggcccctttttgtgtgggatgcgtaggcttgtagccatcgaggctggcaataagaattgcttggcgacgcagggattccaaggacaaggccggggcaaggagctggtgaggctggaggaggtcggcacagccatgataagcctggcccggggctgctcggaggtccacctgcagcagcgacaccagcagctggtggttgtccccgtcagggtcaggaaggacggatgggcaagtgatgccatgctttatgtaagcgcgaccttcgcctacttcccccccttccccttcaattgccatttgcagttttagtggaattcctttttggatttggataatagcagacatgaatgacaagtatttgatggaaatgacatgtttagttattgacagaagtgtgtgtggttaattgttcaggtgaacgtggagctcgtgggcgtggacacgcgaccggacatcgaaagggcagtctcgtttggggagaagccgaggacgagcatggcgccgccgccgctgccgacgacgcgagatggccggaagagcttggaggcagcgacgtaccatgatgtccttgacctgaagcagctgcttgatctggctgacaaggaaggccgggtggccgtgtatgggaacaagaggaactccgacaccagcagcgtgagtagcgtcagtagcagcagtagcggcagcataaccagcaccagcagcgctagcaccagcggtggcgcgagcccagagccggcctcgacgtcgaaacgccggttcctgccatggatgaggaggagcagggacttcgacaagaggagcaccgacaccgagtcgctctcccaagaactgcctaccaagtccacggtgagctcctgtcctggcacagtgtcacgtgaacgaaaaatgaaatgttcgtcatgtatgtgtaccggcgtcgggggacggtagcacgtactaatcgtgtcacggcgcgacgacgaatctcgtgtaggatgacgatgcggccggcggctgggggacgcgcgagttcacgagcagggacgccgagacgaggctcaggacgccggtgttcttcgcgtccatcgaccagcgcgacgacagcgccggtggggagagcgcatgcacggcgctcgtcgccgtcctcgcggcggcgctccacgccggccacccggcgatgcccacccggccggagctggacgcgctcatccgggccggctcgtcggagtggaggaagctctgcgacgacgaggcgcacatggcgcggttccccaaccgccacttcgacctggacaccgtgctcgcggcccggacgcggcccatcgcggtgcggcacgacagggccttcgtcggcttcttccagccggagagcttcgcgtcgctgtccggcgccatgtcgttcgacgacatctggcgcgagatcggcggcggcgacggcgaacgcgagcccggccgcgccgacgtgtacatagtcagctggaacgaccacttcttcgtgctcaaggtggagagcgactgctactacatcatcgacacgctcggcgagaggctctacgagggctgcgacaaggcctacatgctgaggttcgacggctcgtcccagatgcaggccgagggcacggacgaggtcatcgccaccgggaaggagtgctgcagggagttcatcaagagattcttggccgccatcccgctcagggaggagctggagatcgagagaaggggcgccggcggcgtcgacggtggcggcgcgccgcaccggcggctgcagatcgagttccacttcaccgtcctacaagacgacaacagatgaccagttggtgacccgacagcggcttggggatgttccttgcttcctccctgattgcagcactgtactaacataatgtaaattcatctgtatatctgtatacagtttaaaaggaaaaaaaagtacgggataactaatggcccccctaataccatcttaaggactactttaggaatctcaaatcctcttcgggatcgaagagattgaggtg

SEQ ID NO: 5262 - DNA, 3252 bp, Zea mays
  misc_feature (1750)..(1750): n is a, c, g, or t
  misc_feature (1757)..(1757): n is a, c, g, or t
  misc_feature (1773)..(1773): n is a, c, g, or t
  misc_feature (1907)..(1907): n is a, c, g, or t
  misc_feature (1918)..(1918): n is a, c, g, or t
  misc_feature (1925)..(1925): n is a, c, g, or t
  misc_feature (2012)..(2013): n is a, c, g, or t
  misc_feature (2083)..(2083): n is a, c, g, or t
tttagccgcatatgtgcctcccctaccgcgcccttccatccatagcgtgatccccgccaccccatcccctgctcgcctcgcggtccccgcccctccagccaccgcctgatgcgccttcgtttgtccgccacgctcaccctcctcacctctgttccccctcggctccagtgtcgcgaccgccgcgcaaaccccaccccgctccctaggtaggcgtgtaacccctggagccagaggtcttctccttcaccgagctgatccgtgttgtggtcccgtgatccccgcgcgacatactcccgtgatgcccgccccgtatcctcgccctgctacctccgcgtcccctcaggaccatcctcttccacatcttcagcggcatctgtgtcaaggacctccacctccgccacgttgccctcccgccgccggctccctcaacacctctccccacccccacatcctgcgtcggcactgctcctcccgctagcacacgccactgcggatctggattcgacgccggctgtgcgggattagtcggggtgcgtgcttggcagcgtctgccgatggatgtagaatggtggatcaaggagaccgacgatgtactgctggatcccgcgctgctcaatgggcagcagtaccggccagtcgggtcaaacgacgacgccgtgatccagatgacttccatggagactagatcctcgtctgtcaccatcgatgtcgtcatgacttccagtcgccaaggtgatgctgacttcattcacatttgcaggtttagttttgtttacagaggcactacgtgctagcagatctgggaccatgtacaagatcgagctagcagcggcgagctggtagcggtgaagaagttgtgggtgtcgtcgtcgaagtggctgctgtgtgggacgagcaacaggcagattgactagatggcggctgccgtggtgaccaccaccaccaacagtagcagcagcagagacagtgacatcggtggcggtggctcgacgatcgtgaggtccacatggaggtggatacgctggtcagcatccggcacaagaacatcgtgaagctctagatctactgctgctactccagcgtggactgcaacctgctagtatacgagtacatgcccaacaaaactatctctgtctgattaaaaaaactatctatatgacctaaatggaagggctaccagaaagtttttgatctgcttcctgctcacttgtcaaaatatgattgacactaaaatatgatggacggtttttgttgtatgtcgatattgtcagattgggagtgagttccttagttgctgtaggcttaaagataataaagcttccgagttactcctgaaaggaaaacgaatacctaggttccccagtttgtaggtcaggatatataccactaactggttcaaatattattaggcttgggttcagaaatggaaagtacatagttcatcttaggtatttttgaaataaaaaatgtaaacctcaaagcgtgtcttttcgaaaatacatttttcatgcagtttacaaaaggacataggaacatggcttctatctatcatactgtagctgtttaatgactcatgatgtgttgattgttgagtgggggtctctgactttatagcattttgcctggcccctgaggttctactcaacaatgttttggttgaatacaaggtccattgatatgctacagaatgaaaccacatccaaggacagttagctgggtcatccagattgatttgagttattgacatgcncattctntttattaatttgggtntgctgctctattgtagaatcttgtggttgaacttccatcattttatgccatccatccatcacgacgagtaaccaggagattcacatatgttttctataaaagctttccatgtctccacattttcagttcattanatgcttttttnggtaggnaagggaaatatatgttttggattttgttgtatgttaacctgtatcatgatccaacattatttagttcatgtcatgctttgttccttnngacagaattgcacatgatgggctgacttatattgcaattttcagaacaccttttacaaggacttaagcgngtttcatgggaaaaggtggatgttagtttccacaacagtaaagtaagatctgcagcacatagtgtgattcaggtattgcctttgcctccgggtggcgttctctcatattcagaagtaaaatttgcttcaccaccaagtgctgactctttccctgtcaacgatttagccacaccagcacataaatgtttgtgaaagatatactgaggttgaagcctgttttgtaatgaaattttaacaggtaaaagatcctgtgatgcatagcgaaggtgccgacgtcatacagcatatgattgaccaatttattctatagtaaaagccctggtctttggaaacagacctggaccaggatacgtcatttgctaactgcgggctgagtcaccagcctggtgagcacgtttatggaaatcccaggtataagacttagtctctgaatggtggatcaggtatatagttatagagggtggaaacacgtgcgcatgcctgttggttcatttagtcatatgtgatcatatacatgttgtacggtgcatgtaactttagtactatccttgtcattgtaaatgttcatttatttatagtattggtcttctacaccgtaattttgtgagaatattataagaaaaaaccgggtgctttaatggagttccacccagattttcagaatgtaattaattttttacaccgtaattaatttttttacttccgagtgagcaagtgtccagcatgtcatccattttcagaagctactttagcagttttggacagacgaacaacaagcacattgaatcacactgaactgaaatcaactgaaaatgaaattaattgacatgtgacctagagctcatggagatgctcttggatcatttgcagcttggttcaaagttcaattgtaaccatggcagaagcatgcttcaagaagaatttagactcaaaacactatggaataactcacttttaatcagaactactatctagaaacgaagtgaacaaaaaaatcaacaacccagactaacatgaagacaaattgatacatgatcttatcggctaactacctgtcgtccacctgcaggtcccctgtactggatcgaaacatccatccaggattcagaagcatatggttcacactaattgaaacagagcatgtacaccatttctggacagatgaacaa

SEQ ID NO: 5263 - DNA, 1635 bp, Zea mays
  misc_feature (1596)..(1596): n is a, c, g, or t
cccacccggccgtttcctcctcccgttgtcagcttcgcttcgcctccggagtctggcatccgcgtcgcgagtcgccaaaccaaacccaccgcccttataaagacaccttcccctttcccgtcgccctcctctgccctgctcgagctccccttccgcgctccctacccacaagcctttccgcaggtgcgccgcctctgcgaggtggggtgactccgtgaatgggtgacctgggaggaggagactggcgggaggcggtggccgagaaggggttggcggaagccgacggcgggcccgaccatctggtgatcatggtccacgggatcgtcgggagcacagcagattggaagtttggagctgagcagtttggtaaactgctctcagacaaagttatagttcattgtagcaaccgcaacatgcacaagctcactttagatggtgttgatgtgatgggtgaacgattggcacaagaggttattgaagaaatcaacagaagaccgtatatcaaaaagatatcttttgttgcacactctgttggaggattggttgctagatatgctattggaagactttataaaccacctaaacgaacatcagaaaatactccacaaactctggatgacaacaatataggtaccatacatggacttgaggcagtgaactttataacagttgcgtcaccgcatcttggttccagaggaaataagcaggttcctttcctttttggagttactgcaattgaaaattttgcatgctacatcattcatttgatatttggaagaactggcaaacacctctttcttactgacaatgatgatggaaagcctccattgctacaacggatggtggacaattggggtgacctgcaattcatgtctgctttgcaagcatttaggcggcgtgttgcatactccaatgttggtcatgatcatattgttgggtggagaacatcatctatcagaaaagattctgaactacccaagtgggttgattcaaccaacaagatttacccgcatattgtatatgaggaactatccaaagcagaagctcctgatcaatgtgctgacacagataactgcacactagaagaacaccttttacaaggacttaagcgcgtttcatgggaaaaggtggatgttagtttccacaatagtaaagtaagatctgcagcacatagtgtgattcaggtaaaagatcctgtgatgcatagcgaaggtgccgacgtcatacagcatatgattgaccaatttattctatagtaaaagccctggtctttggaaacagacctggaccaggatacgtcatttgctaactgcgggctgagtcaccagcctggtgagcacgtttatggaaatcccaggtataagacttagtctctgaatggtggatcaggtatatagttatagagggtggaaacacgtgtgcatgcctgttggttcatttagtcatatgtgatcatatacatgttgtacggtgcatgtaactttagtactatccttgtcattgtaaatgttcatttatttatagtattggtcttctacaccgtaattttgtgagaatattataagaaaaaaccggttgctttaaaaaaaaaaaaanaaaaaaaaaaaaagggactctggcgttgttaccactgct

SEQ ID NO: 5264 - DNA, 1064 bp, Zea mays
  misc_feature (2)..(2): n is a, c, g, or t
  misc_feature (19)..(19): n is a, c, g, or t
anaggtaggagcacgagtnatgaagtagcactgtcgcatcaggccgacagccgttcgtacaacctaaaagaagggaagcagagcaatgccaacgcggcgggggcggaccaggaagggcgaacgccggatcgacgcggccatcgaccacttcgtcgtcatgggctacgacgcacgcgacattagcgccgtcgttgctgatctcctcaaggtgtacgggggccctgatgcgtggcccttactggaggaaggctcctacgaggttgtgcaaaacaggctcttcgagattgaggacgaggagaagcagaagcaggaccagcagctgctgctggagcaccacgaccagcagctgctgctggagcaccacgaccaccagctgctgctggagcaccacgaccagcagcagcttgattgccagcaagtggaggatgagcgtcctcagcaccaagaaccagcagcagacgagggagtggaagtccctatgttcattgaaccacaagataacatatcaatttcaaaggtaccagcagagactaagtcagcagatgacgaagtggaaggccctatgtccattgaaccacctgtttgtgaagctgtattgccacttaatgtagctataaggactcgcccaaggcgaccctgctatggatggcttagtgagtcagaagatgaggaagaggaacaacctactggtcaaaaacatgaggtgcatgttctaagtcggggagagcgagcccagtagatgggtggctgataccaacctgacatggtccatgatgctccactaagatgcagaagtccagtgctgtatttttggtgtcgctgaaaccaaaaactaactttcagaagccttttttgtgttttgacaagtctagcagtctagcagaactgcagaagtatataacaatatagaacgtgcgcttgatgagcgtaagtagagcatgttccgctaatttaaataagagcctttgactgaagcggtgacataatttttggaaactgagaaaagaagagcttaacttcgattgaagcagtgacgtaattttagaataaaaaaaaaaaaaaaa

SEQ ID NO: 5265 - DNA, 988 bp, Zea mays
  misc_feature (856)..(856): n is a, c, g, or t
  misc_feature (886)..(886): n is a, c, g, or t
  misc_feature (906)..(906): n is a, c, g, or t
  misc_feature (915)..(915): n is a, c, g, or t
  misc_feature (931)..(931): n is a, c, g, or t
  misc_feature (933)..(934): n is a, c, g, or t
  misc_feature (962)..(962): n is a, c, g, or t
  misc_feature (983)..(984): n is a, c, g, or t
  misc_feature (988)..(988): n is a, c, g, or t
cggggaaaaaaaaaaaaaaagccaaggccgggagccactacccaattttacgcaagcgacgacgttctcctccccgtacacaacacgcacgccatctctctcgaagcttccgcttcctccagccgccaccgacccgaacccaccccggacgcggcgcctcccccgcaccctatattgttccccgagctccagccgccaaggattggcgaaaggagccgggcagatattgaaactcgtttcagatcggatccgaggactcgagaaattgcagggaaggaatttgaggatggatttcgagctgcggcaggcgcgggagaagctggagcgcgagcagcgggagcggatgcagcgcgccaaggccaaagcggagcgcgagagcctggccaaggcagaggcggcgcgccgccaggaagcgctcgaggcgtcccaccgcgagcgacgactcgatgccgcacgggcccaggaagaggctgaccggacaatggaagaggtgatgcagctggggaaggggatttcattctcgcacatgtttgaggcacttcgatatgatggccctggggataagatcaagttgccaccatcttcgtttaaggagttgtctgatgaaggagctctcgataaaggtcccatgtacttcaggttgtcgaaggttagggacacagtcccaggtgctgctatggaacaagatgctgggacaacctgttgtggtgttcttgaattcacggcaagggaaggctctgctgaactcccgctgcatgtttggaacaacctgtttgggagtgacaccccagaggtccctctaattgaagtcaaatataccagtttgctcaaaggaacatatgcaaagttgaagccngaaggaggtgggttttcagatctcccctanccatagagcaagtccttcgnaaacagcgnttccgcaatccatgcnanncctatttggaaaaatgataacttgttgntggttaaactaatgggacagnntggn

SEQ ID NO: 5266 - DNA, 2288 bp, Zea mays
  misc_feature (2256)..(2256): n is a, c, g, or t
caaaatataagggattctaggtgtacaaactcgataaaaggtaacattcacatgcatacctaccaggctaccgttaatgtccatcacctaccctcgcgcgctccgcgaggagggttacatgtgtcatttgttttactatataatatgtcctaaaattgcttagataccttatttcaggatggagggaggatgtctgcatcccccagaggagaaaaagggtatatggattacacttagggatgcaagtccgacatgttttgggttattgggtcgaccttaggcttgttaaaatgaactagaatgccatgccacctaattaatttagggagagaaatgaactaggctagctgacccacaagacacccttgagtactcacctgcgcccttaactacactcgatatttgtaagaacgtactgatgaagatgcttacttgttttcatgttgcttctggcttgaaaacatctgcttaagcactgcatgtgcttataaatatggatattatgatatgattttttttagcttggattgacctgtcatggaacatggaagcttgggtgtctgatagatacttttgcctatggtctccatttctgctacactaggctgggagtctcattgtgcatgttgagcagtgcatgacccagtgcttttgtcttattggtcttctgtagtacctcggccgcggccccgcatttagcagttcacatagcattgtatgtactaaactatgatttatcatttaacttttacatcatgcacttgcatgtttatattatgtgtccattgcaattttggtattaaatattctcccaatctttcaggagttggtaatatcttgtaaaattacatgtgctgtttgatgttttctgtacctgcaaaagtgcaaatagtcttggaatcacttgcaactgtggttgctttactcatgctggagaaaatatcacattcttcaatgttttcttttcccccagacacatccaacacagtcctgcttcctttcttccgttgacctccacaaccattattcttatcaggtaatgctggcagactggatctcacaatatgtttctgcttatttgatggtgcagatctctggttatatcacagcaatcagtccctcagcacttgatcttatttgattcataactattctttttattgttcaaatgtggaaaaactcactgaattgtagctattgtgtagatgttctcttttactaatacatgtccttaatgcattttcatagttctcgattgaatgatccatggagtagctcaatgagattgggtccatctactattttttcaataaaataagctcaatgactggtcaccgttgctgtcgccgttgctgtcgctcttatggaatactaatccatacccaaagtttagatttggtaaagtgttttctagtaattaaactttggtattcgcttcttatgtgtgtgcaatagttagtgtgtccttccccatctactattcttcaatagatcgagctcaatgactggtcacagtaggtttatctatgcctaatcctcttctggaatactaatccatacccaaaaaaaaatattttggtatctgcttctcatgtgtgcaacagttaatgtgctcttccccatttactattcttcaatagaatgacctcgatgactggtcacagtaggtttaacaatgctggattatcttctggaatactaatccatacccaaagattagattttggcgcccgacagcaacggaattcgagtcatcctgctaatttgcttactattcactggtctatcaattgaaaatacttaatgttttaatctggttatgtggtttgccttttctttttgctgataggtcatgctgcctgaagcaattgcaatagttatggcacctactgacacaacaagaaaacatggtatatttcatctcacggatccaggtggtatgggcgtgatccatgattgtcaagagagaggtttccatcctcataaggcacctcttgatggttcgccaatctacaagcaatgctcccatgtgtacatggacaccgacataaagtttgatatgattgatctccgagaacgatgagagcctaacttttttgggtttattttggagcccatactgtagttaaatcaagttgctgcctttttcttagtcgtgctgaagatttgtggattcttatgtatgctgttgtacatagctattgtattgtatagagaaaacaattgagtgaatgatatcagtcattgctgctttgntgcgatttaaaaaaaaaaaaaaagcggccctc

SEQ ID NO: 5267 - DNA, 1915 bp, Zea mays
gcagtccaatgtgacgacatcacgagttcacgacatacggcccccccgaggtcgccccccgcaaaactaccgaagtctacttccattccttcctttctcctttcatatacccgcgtcgcccacgagcccgccgtgccgacagaggtgtggacctcgccggagcagaggctatggggccaccgcagccagccaggcccggcgtcatcaacatcgaggcctgcgcgcggccgatcgccgtcgaccaccgcatcagccttccctactacttccgcatcgcgggcagcctcctccgacaggctaatatatatcggaacgagagtaacttcctcgacctatatgtcatccttctgagatactcgagcttgctgtgtgaaacaattccgaggcatcgtgattaccatgccttcaagttaagagaaaaggcattttttgataaacttgttgatgttatcaaagaacttgagacattgaagccagttgtgcagcggcagattgccgatcataacagaggaggtactgtggaatctaatatgaatagtctaaatggagacaatggtacaactcataggatagagcagcatactccaagctcttatactccacagccatttgtaggtagcactaatggagcatcgcaaaaatccttccatgctgggagacaagtggcatcattactgagtgtccagaaacaatatatgaatctaccatatccaaaagaagaaacactagctagacactccatattaggacctaacggtcttaatggtcgatggaatgggcctgttactggaattaaggttcagtatccaagcaattttgaattaacacaaaacgatataacaagtttagtgccatccatcttgaaccaagatgatccgcaaggtcccagtactgcacctccacctccagatagcccctccaatgacaatgacgatatgaaatctgttctctctcttgatgatggtcgatggtctgtatcagcagacgaacacacttcatttacttctgctaatttggaagaagagttgttacagttgaatatcaaacaaccttctcctccaccagttctggcagaggtacaaagaccaatttctccatcaagagttgctgatccaacaccaggacttccgacctcgggaactgcccgttttcagaacttgcatgttccgatcaagttgatggattgttttctaagggttgccgagtcaaacaccaaaagaagcttagaaacctgtggggttcttgctggtaccctgaaaaatagaactttttatgtgacaaccttaattatcccaaagcagaaatcgacatctgttacgtgtgaagctacaaatgaagaagaactatttgaagttcaggacatgggctcactgttcactcttggttggattcatacacatccaacacagtcctgcttcctttcttccgttgacctccacaaccattattcttatcaggtcatgctgcctgaagcaattgcaatagttatggcacctactgacacaacaagaaaacatggtatatttcatctcacggatccaggtggtatgggcgtgatccatgattgtcaagagagaggtttccatcctcataaggcacctcttgatggttcgccaatctacaagcaatgctcccatgtgtacatggacaccgacataaagtttgatatgattgatctccgagaacgatgagagcctaacttttttgggtttattttggagcccatactgtagttaaatcaagttgctgcctttttcttagtcgtgctgaagatttgtggattcttatgtatgctgttgtacatagctattgtattgtatagagaaaacaattgagtgaatgatatcagtcattgctgctttgttgcgattcatcaccatagcctcgcgaggcacgtttgtgtggccagatcatc

SEQ ID NO: 5268 - DNA, 2187 bp, Zea mays
ccggccgcccccggagtctacttccattcctctccttcctaaccccgcgtcgcccacgagctcgccgtgccggcagaggcgaggacctcgccgaagcagaggccatggggcgaccgcagccagccagggctggcgccatcaacatcgaggcgtgcgcgcggccgatcgccgtcgaccaccgtatcagtctcccgtactacttccgcatcgcgggcagcctcctccgacaggctaatatatatcggaacgagagtaacttgctcgacctgtatgtcatccttctgagatactcgagcttgctgtgcgagacgattccgaagcatcgtgattaccatgccttcaagttaagagaaaaggcattttttgataaacttattgatattatcaaagagcttgagacattgaagccagttgtgcagcggcaggttgttgagcataacagaggaagtactgtggaatttaatactaatagtctaaatggaaactatggtacaactcgtaggatagagcagtgtactccaagctcttatactccacagacatttgtaggcagcagtaatggagcattgcaaaaacccttccatgctgggagacaagtgacatcattatcgagtgtacagaaacaatttatgaatctaccatatccaaaagaagaaacactagctagacactccatattaggacctaatggtcttaatggccggtggaatgggcctgttactggaatcaaggttcaatatccaagcaattttgaattaacacaaaatgatataacaagtttagtgccatccatcttgaaccaagatgatttgcatggttccaatactgcacctgcacctccacctccaagtagctcctcaaatgacaatgacaatatgaaatctgttctctctcttgatgatggtcgatggtctgtaccagcagaagaacacactccacttccttctgctaatttggaagaggagttgttccaattgaatatcaaacaaccttctcctccaccagttcttgcagaggtacaaagaccaatttctccatcaagagttgccgatccaacaccaggacttccgacctcaggaactgcccgatttcagaacttgcatgttccgatcaagttgatggagtgttttctaagggttgctgagtcaaacaccaaaagaagcttagaaacctgtggggttcttgctggtaccctgaaaaatagaactttttatgtgacaaccttaattattccaaagcagaaatcgacatctgatacgtgtgaagctacaaatgaagaagaactatttgaagttcaggacacatactcattgttcactcttggttggattcatacacatccaacacagtcctgcttcctttcttccattgacgtccacaatcattattcttatcaggtcatgctacctgaagcaattgcaatagttatggcacctactgacacaagaaaacatggtatatttcatctcacggatccaggtggcatgggcgtgatccatgattgtcaagagagaggtttccatcctcacaaggcaccacttgatgggtcgccaatatatgagcagtgctcccatgtgtacatggacaccgatataaagttcgatatgattgatctgcgacaaagatgacgaagctcacctttgggtttattttgcaacctatacttctcgcagttaaatcaattgctgccttatttttttcttagctcaagatttgtgaattcttatgtacgctgttgtacatagctattgcgttgtatagggaaaaccattgaggtaataatgtcattggtaatgcttcgttgtaattcattccttcaacctcgcaaggcacgtttgtgcggcaagatgaggaagtggtgtctggattttatgccatgccaaatatttgacttaaaagggcatcaaatatcacaaattgttaaaggtctcgtttcttagactatcttcagtagtcctgcttcagtagacttcttatcccactctttattttaaacttcactctgcaaatagtgtaatctacagtacaaattttgcacggccgtttatatgacctgctagagatggacttagagacttatgatgcgtttggtttgttgagtcatcatttatttcatgagttgatgtatcataagtttatcctataaatcttggtctcatttgtcatgtatatattaattattaggtt

SEQ ID NO: 5269 - DNA, 1473 bp, Zea mays
gcacgagaccattacctagaacatcctaatcgaaaaaggcaattgcaagcagcacaaggctccaaagatgcaccgctccttcctcctcgtctctgcactcgtagccaccgcgctttccaccgacaccaccgttgccgctgcccagagccagaggcagaggtcatgggccgaactcagcgggcgggacaactgggacgggctcctggacccgctcgacggcgacctccggcgcgccgtcatccggtacgggaagctggcgcaggcgacgtcggacgcgttcatcggcgacccggcgtcgccgtacgcgggcgcgtcgcggtacgcccccggcgcgttcctccgcagggcgcaggcgcccgacccggacgcgtacaacgtgacgaggttcctgtacgcgacgtcgagcgcgcgcgtccccggccagttcatcacgcggccggcgccgccgggggcgtggagcgccgagtccaactggatggggtacgtcgccgtggccacggacgccggcgtcgcgaggctggggaggcgggacatcgtggtggcgtggcgcgggaccaagcgcgccgtggagtgggccaacgacctggacatcacgctggtgccggcggcgggcgtcgtcgggcctggccccgggtggtcgcagccggcggtgcaccggggtttcttgtccgtgtacgcgtcgaggaactccacgtcgcggttcaacaagcaaagcgccagagagcaggtgttggcctagattagaaggctattggacgcgtacaagggcgagaactgcagcatcacgctaaccggccacagcctgggcgcggcgctctccacgctcaccgccatcgacatcgtcgccaacggcctcaacgtccggggccccaacaacgacacggtccccgtcgccgccatcgtcttcggcagcccccgcgtgggcgacgaccagttcaagaaggcgttcgactcggcgcccggcgcccggctgctccgggtccggaacgcgcccgacgtcgtgcccaccgtcctgcccaacgccttctacaaggacgtcggcgtggagctgctgctggacacgcgcaagtcgccgcacctcaagaggcccggcccgggccccgccgcctggcacaacctcgagtgctacctgcacggcgtcgcgggcacgcagggcgccggcgacgccgccgggttcagcctggaggtggaccgcgacgtcgcgctggtgaacaaggaggtggacgcgctcagcgacgactaccccgtgccggcggcctggtgggtggaggggaacaagggcatgaccagggacgccagcggacgctgggttttgcaggatcatgaggagggtaacctcgctatgtgatgattttgataacttcattaaagatggttattaatgaattaataatacgaaagcaagagttttctccaaaaaaaaaaaaaaaaaaaaaaaaaaaaaaaaaactcgagggggggccgcgggtaccc

SEQ ID NO: 5270 - DNA, 6715 bp, Zea mays
  misc_feature (3087)..(3087): n is a, c, g, or t
  misc_feature (6573)..(6573): n is a, c, g, or t
gttttattaaaaaaaggtctatccattatgcccaaaatgatgccaccccctctacccctcccgcaccaaaaaagaagaaagaaagatcacagtccacaaaggataaacaataatgacagtttttccatttcaacgcaattccatttcacgtaattaggaattgcattaacatgcactagaagacaatttgtacaagtgcactcactctatcacactcactcagcagcagcagcagccgatgcatcacactctgcttgagccagcctgcaagcatcacatacagtcacacacacacacacactgggagtcctccccttcgtgcccacaatgcagctagctagctagccttggctgcgcgggcgacgaagacggcctccaaatccgccggcacgcggaagaactcgtcgaccacgtcgccgccgtcgtagttgcaccggcggccgccggcggcggcgttgtctctgacgatgaacaccgccgtcctgggcttcttgggagcgggcgggcacgccaccgcctccgccggtatcctccacccttcccccctcggcgtcacgggctcttcctcctcctcgccgtcctcggtggccgccgcgtgccgtcggcggccggccttgacctcgacgcgtacgggcttgagctggtgcagcggcagggcggcgatcccggcgccggacaggcccagcacccaggcctcgctgccgtcttggtggtggtgcccgtgacgatcttcccctcgcgtgctatgcacgagccgcttcttcttcttctgcttcacctccggcagccccatgatcatctgcttcttcttcttctcctcctcctctcacctctctgcctgcttgttcttgcccaaccaagaatgcaggcaatggaaatggagtgtagggtgcgtgtgtgtatgagagtgagtgagagctttgttggagcacacaaagaaagaggggtgctactggaggctaaataagcgaggctttaggctttctgagctctgccttcttttgacaaagctcaaggggttactcttactctagtttgtgtgtgtgtgcgcgcatgtataatatatacatatataaaaaacgccgggaatttccgggccgggaggctggcaggcgtgctggctggcttgttgaaggcaagaaagaaaagagcagagaagattaattggacacacttacaaagacgcgcgcaatcattattttccgaggcatggaaaatgggccgttactagtgggcttgccagtgccaggcccacgatgctgctaatagcacggcccatcgcaaatctcacttgcgccaccaccattttttgtcctccctttttggcagtcagatcagtagtgctcacacacactgacacacacactgtagaccgtaccagcttctaaacgggaagacatgtgtgactgtggttgctgacagcgacacacacacctatactatacatgcatgaacgcatgatgcccgatgaccactatcctgtccatgtccatcacaaggtatccagacctagcagcctagcttacctgcatgcagccctgccctgcacacatcacacatgcatggacacttccaccgactgggcaaccacaccagcacagcacacactgaaatgaagctaggaactctcgtatttgatgatatgactggattctgattccttcctgtcatttgaagccaaagcgacaaaaccccttcgttgctgttgcggggtgagagtgtgagagagaccgacatgggagccagctcgatcctgctgcactgcatatggcagcatgtcaccgttgcactgcatggcacctacccaccgactggctggctctgccatttggcattataatatagctcccatctcttaatctagttcacctaatctggtagcaggtagagaggaggagaagtggagaacaaaggaaggaggaggaagatcttgtgtacctactgtcgtggcggggcccgcatgacgtacgcgccccatgcgcagggacagctcaaccacgagaacaggcccccacgctcccattctttctttttttctttcagaacgagaaggagatggttcctgcctgatctgccaaatccagcctatgtatgatccaccgaacattctgtcagaaatgactgtgtgtgttaatgagatggaactatgattaataaaataaagcgaaaaaggcgttgctgttgcttttgtttatatctctgtatctattcctgtgcggacgcaatcgagcaagcagtatgtgagcatgtgacagtgttcagtgtggctttctgaataaaagcatctgcacgccatttccagggcccacatgtcagacaagtgctggaatgcgggggcccgacggatccactctggagagccaggctctttcatctgctccgcgatttcccatcccatcgtcctggtaaaaaaaaaacaacaacaactaaaaaggctggctggttgctccctgtccctggggcctggaccaaaaacttgaccactggcctgcaagcgcacaaggttttcaccagaaagccttcgtctttgcgcccctcaccccctcttgcttcagcctttcacaccctactaccctagcttgcctgtttgggtgggccgcagtttctagtgatctgcaaatcgagatcagctagcatgtctgatgagtgatgacctggcaagggaagaaaatacagtatcgccttcatgtactgttcgctgccccccacccccccacccacaaaaggttagccttttcttcagtgaccactgaccagtacaagttccaagtcatatctactgcgtactcagaggaaaggaagaagaccaaaagggatagaatagtgaagtacaagtcaaggcacacacacacacattgttttccctttctaattaataatgaggaaaaaaagctgaaacgtatcaaagcagagagctatgtaacaggtttaagagcttttttttggggtgcatcacagagtgaggatggagcgaccaaggtgttttggtgcctttctttgcgtgaaggccaagaaccaacccttcacgtccggtcaccaccgtccgttgggatctactaggcaagaacagaacagaacagaacgcangacaaaccaatgcaccaaccaacttttcgtcagtaattgcatcgcatgccagtctcttgctacttcgatgccctctagatgatagccaaacgctagcatcaccatcatcggactggcagcacatccagctgggagggcggaaggagctacgagtcttagacgcgtgcacggcagcaccactgtctgcaagcctcgctgctcctccacatcctgacaactgtgcagaagccgtagcagcagcagctgctgtcaagacgtactacctgcaaaccacaggtttacacatattttcggcaagaatttcacgaggcgcaaaatggagctctctgtagaacataagaacaatcggaaaaaggttctagcggccggccgtacaccagtcgaattccatcctcacgaaattcctgcatttaattccactccacaataaaaagaagaagaggtgttaccgtatttcacgtgtggtctcgctctggcctccgaggtacgtacgcgcctcatcagcacgaggtgacacgctggataggaaaatgcgtccgtccaagcatccagatggagctggcaatgttggtccaagaaagatgctctcctcatctcaaacaatactactagactagtttgtttgtgtggcgtatggtatggctttggtatttctccttctttttttttgtctgtccgggtccggcgcacaccggcctcaaatattccagagggctggcagaaattgctcggattgacagccccatgtatgttacctgatgacgaaattagtcgggaaatccgtaggtggctatgactctggcggcataaaatgacaacatggctttagcatggccggtgcaggtgctggtgatagccatcagctcttgtattcaccgcagctgttgccttcatctacggataactgggcacctctcctctgccttttttagaagtggagatgtcctccttttcttttctgaattactctcgtcctttcctgcagcatcagatatgtcgaataatgtcattcacaaaaacgggaactgtgtatggacaggatgtcaggtcagaatttgtggtgacatgagagccagaattgctgaaggtttacggcgtcagaaaaaaaaggatttgtgttgattaaatcattgactctctgtgtgcttattgctcctgtgggacccgactgacggttcatattctaatccaaggagcgagagcaaacagttcccggaaaaaaaatcaatctccgagaggaggttttccaagagatgatagaatctacgtaccatgctgagtcaagcttgacagcgccaccccgggggcggctggaaacgaggatttgcaaagcagacatgtcatcctccaatggcgccataacatccctcctttcggcgcagctatatgcttaggataataacagcacaagcacagcttagcgttccctgcctcaagttttgataattccgtagcaggtgatggacggctggacttcttttccggctgcaagaagttggactgcgtgacgtggatccagcgtggcccttgggctggccaacttggtgttttcctttgtccagggcggtcgaacatgtggaactctcttgctgcgggtcaccgtccccccccccccccccccagcagccacttgactagattcagcattctggggcttcaattctacagccttttccctgtccttgtgcttcagtgatcttcagagcctcggctccatagctctgaacgctcgaacaatgggctgaacagaaaaggtagactgggttaggaggtcttggtcataaaccgcagcaatcagttcatttaggtttcaggactaactaagggcgtggaaagaatgacacatggcatgttggtaaacgaaattgaaacaaaccattatttgtaaagtgaaagcaaccttggatccaagtttaacaggacataacacaataattgtaccaaatgccaggttactttcatgctgtcctgcttttcacttgatttgatccaggtgaacttcctccaggctgcagaaaaaaaaatggccaaatccattcctcccttgcgccccaagtgcaacgtgaggtaggatgagcgcaaccatttcataaatagttgaaagtgactaaagccttacacggtaggaatttctgaagaccaatcatgttatctgatatctgaagccaagcaaaagaaaagaaaaggaagagcagataatagtatcttcacaccaaaaactagaattttcttttgagccgcaccttagagaagaaaaaaaagatgaaggatccaagaatggtactcactgatcaattatcgatccaataatgtcacacagaaaaggttctgtgggcccatccaagcaagaatgcagacacaatggtccagccaccacaaccatgtgcctcatcacgtaccagttgccattttggcacctaatgctgagtccccatgttcattgatctgccatttcagggataacttctcccgcttaatcacgattacacttaggcaagtgctaattctctgtcaagagcactgtcattcctagccgctgctcagcaatagaaaaacatattcacagaggggcagaggaaaggtcggtataaagaccaccagcttttcgagataccaccggcctttttcagggagaagccactccatctttctttttttcctttttccaactttcttcttcttcctcctccttctcattctgatctggaacaatggcgacagaagacgaagagcgagaagcagcagatgggacggtaagaaatgtctcctcttagcctcagaacttctgcatcacttgcttgcttctgttttcctgcatgcatacatactttgttaagatgtagagttaagtaaggagattcattgtcacagtaatcttatcatctatggcatcttcttctggttccacagttgctacgtgtttgctgttaacctcctttcagtatcatgaaggaagaaggattcttcttcatgtagtaaactgtgtagaaatggtgctgcacctgcactcatttctcagttgttaaacaaatgatctcaaaagcaaccaagtttacggaaaaaaaattaacacagatagggagaatcatcccatgataggtatcaccgagtgacatgctttcgctcttctctttcagttgcttctttttctcaatctggtattgctctcctgagcttgatagatggtatatgaattcacccaagtttgagaaaataatgttagttaaagaattacataacaacttttcctcctaggttcaacctatccagaaccaaaacaaaaaatgctaacgataaggataaacaagtttaacagttcggtcaactgctgtgacatgaatgacactatgacagggttaggtaaacatgcataagcatctaacattaatttacactgagtgtcaaccatccagtgtggcgatcaaataaaaggcatgaagagagcaaaagtctacttaaagcatgccaaaacaaatagttcagtantaacacgcttaataggaacattcaatattacaacccttcatgtaagaactaaacaaggtttttggagagacacaaactcatccagttaggatggcccctcgtgtactgccgtgtcagtgtgccgtttgactaaacagcatgt

SEQ ID NO: 5271 - DNA, 649 bp, Zea mays
  misc_feature (5)..(6): n is a, c, g, or t
  misc_feature (596)..(596): n is a, c, g, or t
  misc_feature (600)..(600): n is a, c, g, or t
  misc_feature (602)..(602): n is a, c, g, or t
  misc_feature (619)..(622): n is a, c, g, or t
  misc_feature (628)..(630): n is a, c, g, or t
  misc_feature (632)..(646): n is a, c, g, or t
cgggnnaaatccccacttaaagcggggagtgtcacacatagaccatacatctcacttcgccaaaaaaattccgtcaacagttgaagttatacccatggcaaaactactcttgggtttgctccttgcccttgctattctagggacaacatcggctgctggttgtgtacaagacgcggaagacatgaaacgagagtgcaagcagtttgagctattcccagcgaacccaaagttgccaccgtcggcagcatgttgtgctgtgtggaagagggcagatgttccatgcctatgcaaatatgttaacaaggaagtagagaaggtatggtgcatggagaaggttgtgtacgtcgccaactattgtaagaggccgtttcaacctggctacaagtgcgggagttatacagttcctcttagtatgtaaaaggagtggttgggacatgtggtactctctcctagaactttaatttgagatttgtaacatgtgagagactattgagaataatatgtatggagtaatatgcttccttcttttaaactgatctaattacttccttggttttgtgttttaaaaaaaaaaaaaaaaaaaaaaaaaaaaaaanaaananaaaaaaaaaaaaaaaannnnaaaaannnannnnnnnnnnnnnnnggg

SEQ ID NO: 5272 - DNA, 1814 bp, Zea mays
gggtcagaactatggataaaatactcatgaatttcccatcgagtgacaatatcttatcactctctaccaaggaacgaaaggtcatctgttttctggaatatgtatttctctagaatttcattgaactgtcttcagagattcaaagctatctaaatcagctgaaattaatacctttccttgctcaattcatcagatcatccctcttgtatagattcaatgatcctgtcgcaataaaagcaattcgatgtattcttgttgtgctatcacaaggaaagttctcagctgatgaaattcttgaacttatactgggtcactccaattttgtatcgacaataacatgcaatgaagtttctgagtatccatctgcttgtaacaccacaggggggatgctacagccagctccaagtattttgaaattagttgatttttctttcatggaagaaaataaggcagatatttctattgcagaaaagagaagagttgaaaccatcatattactaagggtattgtatgatattaagagcagacaacagaataatagccaattgagtggatcaagataattagttttcttgcttttgtctgtttatggtgcagcccttagtgaaacagatttggagatatttcaccttatgaatgagatagagtcacccgtgtgccaaaccattactgaagttgatcatctgtggggagcttctgctctgaaatttagagaagaactgaaactagatttttcaaaatcagatacgcgtaacacagagaatgctgaaattactgaaaagagaagggcgctctttcgggagaacatacctgttgattccaagctctgtgcaaagacatctttgctatattgctataaaagatctacaagggcttctgttttctcactggaacaacttcaacgggataactttgctgatagttttgaggtaatttctagaataatagtgtcaactgaagtttggatattgttctaggttttgtgctttcacagtaatgttatttaattttaccttgctgatctatcttcatctgattttggttggcaggtaacatctcaaaaaaatggcatccagcagctgccaagcacgtgaccccgtcgttcacctcagcctgctgctggatgccacctcgcctccctcggtgcgtcgttgcgcgtgcctcgaccatggcgacgtgcccaagcacgtgaccgaggccaacctactcgccttgttctacgaggtcgccaccgttgacgaggtcaccatcatcaaggacaaggccaccaaggtctcctgaagtgtagatctgcctggccccagatctgggctcgccgccctcccttccccacgcctgctcccgctcggttcgccgcaatgttgtgacctccactgctcgctccggggaagttttgctccgctcggggttgggtttgggagcaatgccgcccgccgggcggtcgcatcttagtcttttgggctagaaaattttgtagattttttgcttgtttttctctgcctgtgtggtatcgcttttgctgcaatgatgcagagggatctcgtgtcgagtcctctggttgcttgggtttcagcatggattccagtttttgtttttgctaggcatgaattgtggtagcttactaacttagtgtatgtatttgcttcattgtgtgttttgaatctctttctttatgttcctggattactgtttttataggagcaggacgatgcagtggggcagcatctctaatcatttaaggtctactcaaatgcactcaccaaattaatggagccaataacccaggcagcagttacatttcacctacaaaacac

SEQ ID NO: 5273 - DNA, 2144 bp, Zea mays
ggccgcttttttttttttttttttaggggtgaagtgtgtgtatttatcatgataaaaacaaatagaaattaaaattcttaaaagctgtaaaaagaattaaaaaaccaccccaaaaaatacaaaaaatataaacgagaaaacaaaagaaagaaaagaaaaagaaaaagaaaaagaaaaaaaaaaagagagggagaggaagcgagcggctgggcgccccaagccccacatggtgcagcgaggtccacgctaacaacttctcgaccttggcctcccacggctctgccgcattgccgcgcgccgccggccggcactcgccgtcctgacgcgagaaggaagatgctctaggaagttgggggcctggctagggacagcctgtgtcccgccgtgggatcggtgggagagggggaggcaggcatgtgtgatctggtggcccgcacgggccggcacctgcagcgctacgagaacggccgtcgccttgtggccgggtgcataccattcagatatagggatattaatgatggagcttctgatgatgaacaaaagaaacttgttgaagttctcatgatcagctcccaaagtggaccgggtcttctatttccaaagggaggctgggagaatgatgaaactgttgaagaggcagctgcaagggaagctatcgaagaagctggagtgcgaggagatttagtgcaactgctggggttctacgatttcaagagcaagcagcccgaagcaacgtgcagagccgcaatcttcgccctgcacgtgaaggaagagctagcctcctggccagaacagagcacccggcagaggagctggctcaccgttcccgaggcggcggagcggagccgctacccgtggatgcaggaggccctcgtgacaggcttctccgcctggctcgagaactggagaaacggtggtggcggcggcggcggctgcgtggaccgaactgagagatgacaccaccttaaagcatcaggggggcccccggcggagaagccatctgctagctatttcttggcgttgtatcttgcttggactagaattttcttccagaggctgactgcctggcatacatgcatgagggctctctgatgctcggtagcttttgtttactttgtcgctttattacaccgtcgtcttcaggatgacagtctcctcagctgatgatggcccgaggtttgttaaattgtaagcttgctgattctcgcggtcgccagctatatttaactgtcttgtattgagccttgagacaaagcaagctttgtgtaaaaaaaaaaaagtcgtcgtcgtggtgtactggtgtttgcctttttttgaagagttactggtgtttgccttgctatggaagtgcaacgggagtcctcttgttgtcacagtcgcaacttctctgcctttttaccctcggaaagatgctcttgcgaccatgtcatttgcaagtacacaagtcacaggagatggaaatgttaaaatttcaaacatgagatttctttgttgaaaaggtctgtttgaggattttattccggttcggatgcattccgttctcgtcaggaattgtatgtcgaatggatttaactgtatttgattttatatagagtttacgagaaaaaaaagaatttgagctcagatgcgcatcttgtcgtctctggaatcagacggctgtgatggacccaatcaatcacggatgagcgcagaaatctgtcatcgctctggggtgagagaggctcgaactctcgacctcaggatcactcgcatttttagctatgagacctacgcgctagccaactgcgccaccacccctttgttgtccaaaaccacacgagaagctatacatagcatctgcattccacaaacaaacagtacaacaatcaacaggcccacttaggcctgagcggtgctgttttgagagtttgaaatgttgcatgctatctgcgtcggtagaccagtgaaactaaccataaaatccctgaccgtttttttatttacgaaaaaatatgaaaacgggagatgatttatttcgtccgttttttgtagggcccgtttttattcggattgaacccgtatttattacgtatttgataaaatatgagacgagtataatatgcattagtatataaactaaagtctcgtgactttaggtaacaaat

SEQ ID NO: 5274 - DNA, 2553 bp, Zea mays
tgccaagagcttgcttcgctggaatggtattccgaactggtattatatgcttgtggagtttgctattttggtactatgttggtgatggtttgtctttgagattaatgtcgctcatggtttgtgcttcaacggtcggtagagctatccatcagttcacaggcagaacacaatctagtcatgtttaacacaaatgggtgagctgtcgcttctgtaagaaatgtaaacaatatagaatttgggtaaaaatctcgcacatttttttatacataaatggattataagactgtttataatctagcgttcggtgaaattcttatgcgtttccagtcgtcttaatttttttagaggtgccataggggtgaagtgtgtgtattcatatatttgtatcatgataaaaacatataaaaattgaaattcttaaaagctgtaaaaagaattaaaaaaccaccacacaaaatacaaaaaatataaacgagaaaacaaaggaaagaaagaaaaagaaaagagagggagaggaagcgagcggctgggcgccccaagccccacatggtgcagcgaggtccacgctaacaacttctcgaccttggcctcccacggctctgccgcattgccgcgcgccgccggccggcactcgccgtcctgacgcgagaaggaagatgctctaggaagttgggggcctggctagggacagcctgtgtcccgccgtgggatcggtgggagagggggaggcaggcatgtgtgatctggtggcccgcacgggccggcacctgcagcgctacgagaacggccgtcgccttgtggccgggtgcgtccgtaaggggagcccccccttccctacccccaaccaccacggctcttctccctctgccttctcgcatccacacaccaaagacatcaggcgtttttatctgccctcgattcgatctgattgggtttgtccggttgcggtgcttgcttggttgggcagcttaaaggttcgctatgctgggagcgtttgcttaccaactggaatggatgcatgtggccttgttgggctgcgactatcctgtgttttactgctgcttctgttgggagtagggtcgacctctctggctgattaattgtcctggattggtcataatcggtgaatagtagcctgtttctgtgtcattagtcattagtacattagtttcttcacctgacatgtaagggcccattcggcacttctttaccgttttattattcattagtcctgcactaaatttcatgtcatcacaagatactgtcagcgtaaaggacatctgttttgtccacaattgcgtcgttgtagaatgaatcgcctgtggactgatgggtctattagaatcagttgcgtagaagaggccatttggcattggataatgtaggcatatgttctctgtagcagattcttattctaggttggcgcaatccgattagttttatgcatgacataagcgcagtatgtcatgttccgtccttctagaccatttttatatcttatctaaaattatgcattaaattttaggaaggaatctcatttttaattcgttttgcgatgtacaaacactgttgaaagaaacggatagatttctagattaaaatatatagataggtgcacgacttgagccaaatggcagagattgtttagaccatggaaagaggtcaagttatcctgtagtctgttgggaattcctgttccaatgagtacagttaggtacttttattagaggttacataacatcgggtaaaacagctgatttgtcttcttgctgcttcattgtttgctgaccatcaatggcaaaatgtcactgttgtttgttacattaatgtttcctgttggtgatgtgagcattctttgtttttatacttttattctttcaagtggatatagacttaagcgtgcaaatattttgcagcactagtccaatattttaccaaggtgtctggaaaaccatcacttagtttactttctgcttgtactgaactctgtttaattttactccatacaaacataagttgatatgcagtctactgagcactgtaaacaaaggacttaagtttatagtttctactgctatgaagtaaccaatggcatcatcttctgcgctaagcatttgtttttgcttcagcaaatggttatgtgtacactgcaccaagaaatataccttgggggttttgccaataccttttagttgagtgtgatttgtgcatgtaattttgagtgctatggttgtagacacagtctcttgtaataatgtgaatcttgcaatgtgtttcacttgtctcattcttcttccttggttatatatagctgcataccattcagatatagggatattaatgatggagcttctgatgatgaacaaaagaaacttgttgaagttctcatgatcagctcccaaagtggaccgggtcttctatttccaaaggtatgattaatgtaaataaacaactaaccatatatcacatcattcacataattgtcacagtatgatgtatggaaaatcagaaatttgagcattttttctgtgatttagcttaacaaaataaaaa

SEQ ID NO: 5275 - DNA, 1091 bp, Zea mays
tttggtcaattggtcgatttttatcggttgttggtaaactgttaccggtgggtagcggttttcgcataggaaacggttttgtaaaccgtggatggagctgatgagagacaaaatacgttatacgtagaaacagcaagccgcagtttacacggtaccgtatcaggtttcccatttccatcactgacctgacttgaccggccgtcccatcctgcggctctatctttctcgcacgcacgctccggcgtcatgtcgtggatcgcgcgctccatcgcggccactctctcctcgccgcgcagctccgacgccgacgacgccgactacgaccctgcctccgcgcagagcggggcagggccggaggaggaggagtcccacggcagcagccctaacccgggccctgaggccggggaacccgagcagcccggcacaccgagccgcggcgtcaaggacgacatatccgagctcaccgaaacgctcactcgccgcctctggggcgtcgcatccttcctcgcaccgcccccgaccccgccggaggcctccaccccgcgcgccgcgactccggcacaaggggaagatgaggggattgaggatggggaggaggccgcggtgctgtccccccggactgcggggatccgcagcgatctagccgagataggcggaaggatgtggagcggtttctcgatgctgcagaacaacttggccgtggccgagatctccaagatcgcctcgtcgctcctgccgttcgggcaaggggaggcggacgagggggagtccgtgcccggcatcaccgaagaggtggtggtgttcgtcaggcacatctccacgcggcccgagacatggctcgattttcccctcttcatcagcgagcgctacgcggatggtatagctaaggctctccgcacatgtgtactctacttcagcatttggtcgttattaacgtggaagggaagtgattggaggggggcttggttcagaactaatgattgatttttgaaagataattaatgatcgttagattctttccactttattttaatgagggggattgctcctgccattactcataaataaataaataaaatttattggattgt

SEQ ID NO: 5276 - DNA, 2156 bp, Zea mays
gagtatagggcaaaaagagaacatactcacacccaccatacttgatggatataccaaccacccaaataaaatacctttggctatcaaaaattgtcatatccatctaatagggcttttatttatccatcggatatccgggttttggcccgttgccagcccttgtcagtccactactagtgtcttacaggccgttcaatcttgcggcccattcaatttatgggccttgtggctgtgttggcgtcttggcgaccggctcatgccgggcccctgggcctcgaggcagaacgccaccgggcagagcggaggggtgccggtgtccggactccggagagaatggcggccactcttctcccgaccttatcgccgcccgtttcgcgcgccgccgccgctttcctcctccgacgagccccactgaagccttcccattatgtgcacccaccttctactctccgccgtttactcatctcctcctatccagcaacccctgccatgtgcaccctctccaccatgtcgtccaccactgccgctcgcgccgtcccggtccgccgtgacctcctcatgctcggcatcgagaccagctgcgacgacactgcggctgctgtggtgagaggtgacggcgagatccttagtcaagtagtatcttcccaagcggatttgctcgcgaggtatggtggtgttgcccctaagatggccgaggaagcacacacccttgtgattgaccaggttgttcaaaaggctcttgacgatgcaaaattgtcagaaagtgatctttctgcagtcgctgtgaccattggaccaggacttagtctatgccttagagttggtgttcataaagctagacaggtagcaaaagcatttggcttgcctattgttggagttcatcatatggaagcacacgcattagtttccaggctagcgaataaggaccttgatttcccatttctggctcttctaatttccggaggacacaaccttcttgttctcgctcatggtcttgggcattacattcaactggggactactatagatgatgcgattggtgaggcatatgacaaatcagcaagatggttgggccttgatatgcggaaaggtggtggtcctgctcttgaagagcttgctctagaaggtgatccaaatgctgttaagttcagagttccaatgcgacagcataaagattgcaatttttcttatgctggactgaagactcaagttcgattggcaattgaatctaagaacttatgtacagaggatattccagtttcggctgcatcggaggaggacagacaattaagggcgaacattgctgcctcttttcagcgagttgctgtgttacatttggaagaaagatgtgagcgagcagtcgaatgggcattgaatatggaaccttccatcaaatactttgttgtttcaggaggtgtcgcatcaaacaagtatgttaggactcgcttgaatcatgttgctgggaataatggcctacaacttgtatctcctcctccaagtctttgtactgacaatggtgtcatgattgcttggactgggattgagcattttgttgccgggaggtttgaggacccacctgctgctgatgagtctgatgatatgcagtatgagctgcggccaagatggcctcttggtgaggaatattcagaaggaagaagtgttgcacgatcattgaagaccgctcgagtccatccatcactaacgtccatgatacagggctcccttcaaaagtagttgagttggaagttggaaactaattattggtctcaactgctttatgcagttgagtttcccgtcttctagttttgggttcacaaatcagctgctttatctgtattcgctgaattgaagtaacaaacctgcaaaagggccgaactagtttaatagtagatgaggctatatacaaattcagttcataccagtgtttttaaggcgttgcctaggtgatgcctaggcatctaggcgctcgaataattctaggcgccttgcttggctaggcgtccaggcggtggtctaacgtctcgtctcgccttaccatcttaagaacactggttcatacatcccagaagatgcttatactctatttgtatttaccatggacgctcgactgtatcaggcccacgcattttgaatgtagggtatatttcttgtttctc

SEQ ID NO: 5277 - DNA, 590 bp, Zea mays
gccggtccggaaaaggcaaaagctccccaacgaagtgcgagcgacccacgtccacacgacacgaaccaccaccaccaaccagcagccgcaccacgcacccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccggcgccgccatggcgggccccaagaacgggacccccgaggcgaagaagaagtacgcggccatctgcgtcaccatgcccaccgccaaggtctgccacaactgagcacgcccgcgttgcatgcagctgcagggccggggggtggtatataattaatgtacgtgccacggtgttgttgtccctattgttggttcgagctttagatgcatgcctgacgtgaggccgcttaattgctttctgacggcctcggagctgtaagaatatcaagtgcactgcaaaactgaattcggttgaaaccgttcttatttcatcaaaaaaaaaaaaaaaggccccta

SEQ ID NO: 5278 - DNA, 924 bp, Zea mays
acccttgtgggcaccgatagcgattgcaacaggtaacccaaatatcggctgcatctggtccgtccgttccttatcctctcccaccacacaccctcgcgttatccagcacccgcgccctcccctccgccacgtcacgccgcccggccacatggcagcggcccagtggccgctcaaccccaggcgggataaggcgtcctctccgacgtctccgttccggaccgcagcttaatacattgggtcggtcgcggccgggccggaaaaggcaaaagctccccaacgaagtgcgagcgacccacgtccacacgacacgaaccaccaccaccaaccagcagccgcaccacgcacccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgccgacggacgccgcgccgtcatgctcgcggctgctgcggcggccgtggcagccatcggcggcgccggcgccgccatggcgggccccaagaacgggacccccgaggcgaagaagaagtacgcggccatctgcgtcaccatgcccaccgccaaggtctgccacaactgagcacgcccgcgttgcatgcagctgcagggccggggggtggtatataattaatgtacgtgccacggtgttgttgtccctattgttggttcgagctttagatgcatgcctgacgtgaggccgcttaattgctttctgacggcctcggagctgtaagaatatcaagtgcactgcaaaactgaattcggttgaaaccgttcttattttatcattataaaaaaaaaaaaaaaaaacaacgggcgccccgagcccta

SEQ ID NO: 5279 - DNA, 1196 bp, Zea mays
  misc_feature (4)..(4): n is a, c, g, or t
cggncgcgtgggcttgcacacactctgcaactcaactgaaggtgccggactagtagctccgtgtcaccaaccagagccagagccatgggggccagcctgagcctggtgccggtgctcgactacttcgcccgccgcgagtgcctgcgcgccggcctccaccagaacgccgtcacgctcccgtaccccgacggcggcgccggggcgacctgcaccgtccagtactgggctccgcagggggagcctgagctcccgccgctcctgctggtccacggcttcgggccccgggccgactggcagtggcgctgccaggtggggccgctctcgcgccacttccacgtcatcatccccgacctcctgggcttcggcggcagcgcgtacccgtccgagacggcgccgccgccgacggaggcgacgcaggccgcggtgctggcggcgctgctgggcgcgctgcccgggatggagcgccggcgcgtggccgtggcgggcaccagctacggcgggttcgtggcgtactggctggcccgcgaggcggggcccgccagggtcggccccgtggtgatcgccagctccgacctgctcaagacggctgccgacgacagggcgttcctgaagcgcgccggcgaagggtggggcggcgtggacgagatcctcctccccgccgagcccgccgcgctgcggaagctcctggagctggcctcctgccgcccgccgccgcggctggtgacgccggacttcctgctccgtgacttcatccagaaactcttcacgcagaacagggagcggcttgtccatctgctgaaggggattacggtcgggacagagaagttccaagtgacgccaatatctcaggaagtgctgattgtatggggagaccacgaccagctgttcccggtggagaaggcgtttgcggttcagagggctctgaacgggaccgctaggctggaggtgataccgaagacaggccacgctcctcagctggaggatccggctcgcttcaacaaggtcatgctggacttcttgctggcttctcacaagcctgacccctcggttagtggtagcgcgcaataatttaccaaggtgcattggcgattggtcagtggtagccgactcgattgtttgtaataagatcgctggacaggttcagttcattccattaaatcaatggtaaatttcaaaaaggaaaaaaaaaaaaaaaa

SEQ ID NO: 5280 - DNA, 3539 bp, Zea mays
ttttttttttttttttttttttttttttttcaaaaaattttatcctttttttttttttctcgaacacgcaggagatctacgtatctttccattaatagatagaagaaggtacagcacaacacaacacacataactcaacccacacgacacaacttatctttaacacaaattttatccatatattgctgagtaaccctttgaatgtcagtcgtgaacagtagcagatattgctgagtaaccatgttttcagcagacccaaagtcctccaagagggtaatgactaacgacacgactccaaaataccatggaagttatggtgcgcgaccgtcaatacagagaccgtaaaacaagtgcaagcaactgaagtatcctccaaattggtatttttatttctgctcttcgggcaggtgtttaggttgtttgctgcacctcatactggtggcaaatcctcaacggcgtctcattagacaccggtctttcctctgaccagagctccatgttcacatcaccagttccccagtgcacaaagcatttgctaacctccctgggattaaaccggttcaccaagctcagcccgacacacttgtccactagcatccattctccgttgggtttgaggtctccctcgaatgttatttctcctgcctccggggagatctcttgctttgaaccattgatggccgtgaaagcaactactacctcagttgggtgcagcagggtgaatgtaggatgaactcgtaaacagaccaaccttgaaaacccaccagaaccagctcctacacttcttgcctgaatgctggagtcgatctgaacaatctttgggttgtccttcaaaatggatatctggcgctggagaaccagaccaccaccaatgtctccttccatacaaatagattcctcctctccagattgttcaaggtgcctcctgatgactttgtactcttctgtgcaaccagcagacctatattcagccccactgtattcttcataaccatttatctcaattctgctgtgaagccactgggaatcagaaggaatatgggccatcgatataatacggcctccaatccatggtacaatcttaaggaaccagtctccacttttcaaatcaacaggtatttttgatagctcagcaccttcctgccccgatggctcttctatatcaggtataggctgaatcatctccattcgtttcttgtgctcaaattcgctggttgcaactaagcttgacactacagattcagaaggcattgtaaggtgtattacttcaccatcaacaccatctgtacttatcatagcacctccaccaagcaatatatttattttcagatttcgttttggtctcttccatgacccttcagattttaagattttgacagtaaccactgatgagtggagttcagcaatataatatgtcaaaagatagtctccctgtgtgaatgcatatccatctcctgcatcttcaaagagaacaccttcagctttaccattttcattcaatgcgataattagtgacaggtcatcctccaaacttgcttcaccaacatgcttaataggaagacctacaggaagaattgctccaccttgtagatacagcaccggcagatcagggtgtgaatccgcaaaatcaaaagacaaccatatgcccttcggtagcttatgtgcatattcatgagctcctttattaggtaaagtgcttgcacaaactaagagtggtccaaggagaaaggaagtctcaactttcctcagttcaggatcttgtgtatcagcaaagaaaactggagtagcaactggaataccctttgtatgtgagtggtaaaaaagagtgtagatatgtggcagtagccggtaccgtcttagtagcgcaaggcgacagacttcctcacactctttaccaaaggaccatggttcgtggtcaatgcttccagtttctgtatggccacgtgaaaatggaaacaatgcacccacacccatccatcttccaaaaagttttggagtagcatttccagcaaaaccaccaatatcaggacctgacaatggttgaccactgagacccaactgaagaaccattggtagactcatgtgcagatgctcccaatttgaaagattatcaccagtccatgttgcagcataacgctgacttccaataaaaccagctcgtgtaagaacaaatggtcgtttagctgcattgcccatttccattcctttataagtagatcttgccattagcattccgtagacattgtgatagtatgaatgattttgaacaccaccaatatcagcatctcccctatgaatattgctttcaggcattgtcttcgtggtagttttgaaaacagcaggttcattcatatcattccatattccatcaacaccaatagagatgaagtcctttaccaaactagcccaccaagctcgtgttttttcagatgtatagtcagggaaaacacaatcaccaggccacacctccccaacgaatggactgccatctgccttttgaatccaaacatcgctttttgagccactatcataaacaaagtaaccctcctccttcttgatccctgggtcaagcatccagattgctttgcaaccaatggaatggagatcatctaccattgatatagtatcagggaatcggatactatcaaacgtgaagcacctaaaaccatccatatagtcaatatccatccagacaacatcacaaggaatgcctttctccctaaatgtcctaacaaccttgagtactttctcagaagaatcatagctccaacgacattgatgatagccaagtgaccattttggcggcatggacacagtaccaattgcatgcgacaaagatgtcatgacatcagctggagtattaaatggcccaaaagtgatgacagggtaggcagataaggcagagaactttatagttgattcttgtcgcaaatcaatctcacaacgccgagtggtatcagcaaggacacccaatgcttttccatcagggaggacagccaaaacccaagggtgtgactggtacaacgaagtggttcctggtccaaaaccccatgcatctgtattccatgtgaaaactcgtttcccagtccgttcaagtgggccactcgcttctccagtaccatagaaagatgtcccaggaggaagctttatcacgaccttctgggatccccccgccgcgacctcgcataccgggacaacggcgggcatgtccgccccgtcatgcggcgcctcccgccgccgcgggtccgcgaacgagaggctgggccccgcggcggcgcgcgccgcctccgacgcgtcgaaccggaacacgccatcctcaagcaccctcacccacaccatgtccgccgccgtcgccgcggccatcctcccctccgccgcccccgcggcagcagcaggggcagtcccaccgcagcacctgagagtacgtcggcgtgacccgccgccgcctcgtgactcttgggcacggtggaagctgaagcggaagtgcgagaagtgggggacgaggcggagtgatgcggtgctgcgcctcgtgcccaatt

SEQ ID NO: 5281 - DNA, 1445 bp, Zea mays
cccggccgcgagcctgctccttatcgccggctgccgtgccgccgcgtcctgctccccgctcccgcgttcatcgcccgaagcaccgccgggcgccgcggcctcgcgccagcgccaccgcccagaaaccatctttcccggccgcgccgctgagcccatagcccatatcggggcctcgttcggccgaagcgcgctgtgtcaaatttctgcgaccttgccgccgccgtcatcattctggagctcggattgatttcttcctttgctgtgctgtcattaccgaactaaaaacagtttctgagagcaagcgtcacaattgccatggaagctgggagaatggatcagccttgcatggcttctatcaatagccagcctttcgtggctgatactgagccagtgaagaaagccagtggggacatgcctgcggcgccgacaggaagcgggtgcttcgactgcaacatctgccttgattttgcagcagaaccagtggttaccctctgtggtcatctctactgctggccttgcatctacgagtggctgcgccctggggtagaggagtcaaccgccagcgacaacggcagttcggcaaggcggcaatgccctgtatgcaaggcaacactctcaccggacacccttgtgccgctatacggccgcggagggaactcaaagaagtcactggatggcatggccatcccgcgccgccccatggtacaccgggaggctgttgagcaacagaatgcacggagcaatgtcaatgaccagcactaccaccagagcacgggagacagccctcagcaccagccattgatgcaggcgcaccaccatcccgttccccctgggttcgacttcatctaccctccagcgccggtagggcgtggtttgatccactcgactgccggaggggtgctcggagggatggcagaggttgtgctcccgtgggtgctccgtggccagctgccagccagcttgcactacacgagcccataccatgttgcggcacagaacgtgaaccccaggctgaggcggcatcagatggaaatagagaggtccctgcaccagatctggttcttcctctttgtgtttgtgctgctgtgcctgctcttgttctgagacggaggactgttctatatgcctctttgtagatattgaagagggggagagagggatactaatggatgatgcgtatagtagacagggtaatggtctgtatcgacaagcatgtgtctaaagcatgctgatatagagttgtaatatgatgagacatgggaggtgaaatgtatatttcattcttctcgtcataacgtcagcggtttcctgatctatcactgttggcctgttaggtaggttgcctacctgacatgtcttcatgtcagggccttcgatttgctcatttgcatatgtaaatcgaaaatgatgttttggctaccaaaaaaaaaaaaaaaaaagcggcc

SEQ ID NO: 5282 - DNA, 941 bp, Zea mays
  misc_feature (912)..(912): n is a, c, g, or t
ccccgaggctggccgggaaataccccttggcccggccgccccccgaaatccgcctctctcctcatcatcggcctgccgcctgctcctcctgcccccattaacgccgccggctgccgtgccgccgcgtcctgctccccgccaccgcgttcctcgcccgaagcaccgccgcggcctcgcgccaccgcccagaaaccatctccgggcctcgttcgaccgaagcgccttgtgccatatttccgcgacctagccgccgccgccgctgccgtcgtcgtcgtcctcgctggcggtgctgtacctgcgtgcagcgcagatccatccgagctcggattgatttcttcctttgctgtactgtcataaccgaactaaaacagtttctgagaggaagcatcgcgattgccatggaagctgggagaatggatcagccatttatggctgctatcaatagccagcctttcgtggaggatattgagccagtgaagaaagccagtggggacatgcctgcgacaacaggaagcggatgcttcgaatgcaacatctgccttgattttgcatcagaaccagtggttactttctgtggtcatctctactgctggccttgtatctacgagtggctgcgccctggggtggagtcagctgccagcgacaacagcagttcggcaaggcggcaatgtcctgtatgcaaggcaacactctcaacggacacccttgtgccactatacggccgtggaggcaactcaaagaagtcacttgatggcatggccatcccacgccgccccatggtacaccgggagactgttgagcaacagaatgcacagagcaatgtcaatgaccagcactaccacccagagcatgggaagacaactctcagcgccagccattgctgcaagcgcaccaccatcccattcccactgngtttgacttcatctacccctcagcaacag

SEQ ID NO: 5283 - DNA, 902 bp, Zea mays
gttgttttctccctcccccatcgttatcattgggtacctcgaggccggccgggagcctgctccttatcgccggctgccgtgccgccgcgtcctgctccccgctcccgtgttcgtcgtccgaagcaccgccgagcgccgcggcctcgcgccagcgccaccgcccagaaaccatctttccctcccgcgccgctgagcccatagcccatatcggggcctcgttcgacttcgaccgaagcgcgctgtgtcaaatttctgcgaccttgccgccgccttcatcattctggagctcggattgatttcttcctttgctgtgctgtcattaccgaactaaagacagtttctgagagcaagcgtcacaatcgccatggaagctgggagaatggatcagccttgcatggcttctatcaatagccagcctttcgtggctgatactgagccagtgaagaaagccagtggggacatgcctgcggcgccgacaggaagcgggtgcttcgactgcaacatctgccttgattttgcggcggaaccagtggttaccctctgtggtcatctctactgctggccttgcatctacgagtggctgcgccctggggtggagtcaaccgccaacgacaacggcagttcggcaaggcggcaatgccctgtatgcaaggcaacactgtcaccggacacccttgtgccgctatacggccgcggagggaactcaaagaagtcactggatggcatggccatcccgcgccgccccatggtacaccgggaggctgttgagcaacagaatgcacggagccacgtcaatgaccagcactaccaccagagcacgggagacagccctcagcaccagccattgatgcaggcgcacccccatccccgttccccctggggttcgacttcatctaccctca

SEQ ID NO: 5284 - DNA, 4312 bp, Zea mays
gtgaccacaaacatatattggagattagggcgtacaccttgagcctatctcatactttcctttgttattcatatctgctcttttggtcttccccagccgtttgtctgaatataatttttttaaggatctgtggtaataactggtaatctgttcaggacctgccagcttgccgaatcccatgttttgcaagtttttttagaactcgaacagtattctattttcttcccgaggcaatttcgagctggcaataatagttctaaccttgaacaaggagccaagtcttggagtcaatattttatgctgccatgcacatttcatataaggtagtggttccatttccttgctgacataagtttccttatctctgatagctagattattggataacttgtcgatggcacaaaaagtagcacgcggataaccataacaaaggggacagaaacaaagcacaaaagttgtaggccccagtacaaaagggatagaatcaatgactgctgctgacgcacactacactactaggtactaaaatattagaatcatcactgctgactcggtctactaggaaagacgatggattcttgggtaaaagcgcaaccagcatagactctcatggacatttgcctattaacacgttttggagatttacctaacatctgcttcagttgtcacacttgttcaatgtattcggacagactctctaggaccgggatggtgtggtgtgcgcctaaaagctgcttactacgtggacccctctatttagttcgatcgttattgcctattgtctctactagcttcgtctctgcctcataaatcagcatatattaaaaagtagaaatgtggttggtgattcgcttcgttgcttccagtcttcttgagctctgctctggcatgttgctttatcaattgtatgtattcctactgacgtcctttgctttctccgtcttttgctgtactgtcataaccgaactaaaacagtttctgagaggaagcatcgcgattgccatggaagctgggagaatggatcagccatttatggctgctatcaatagccagcctttcgtggaggatattgagccagtgaagaaagccagtggggacatgcctgcgacaacaggaagcggatgcttcgaatgcaacatctgccttgattttgcatcagaaccagtggttactttctgtggtcatctctactgctggccttgtatctacgagtggctgcgccctggggtggagtcagctgccagcgacaacagcagttcggcaaggcggcaatgtcctgtatgcaaggcaacactctcaacggacacccttgtgccactatacggccgtggaggcaactcaaagaagtcacttgatggcatggccatcccgcgccgccccatggtacaccgggagactgttgaggagcaacagaatgcacagagcaatgtcaatgaccagcactaccaccagagcatggaagacaactctcagcgccagccattgctgcaagcgcaccaccatcccattcccactgggtttgacttcatctaccctccagcaccagtagggcgtggcttgatccactcaactgccggaggggtgctcggagggatggcagagattgtgcttcccttggcgctccgtggccagatgccagcgagcttgtactacacgaatccataccatgctgcgacgcagaacgtgaaccccaggctgaggcggcatcagatggaaatcgagaggtccctgcaccagatctggttcttcctctgtgtgtttgtggtgctgtgcctgctcttgttctgagacaagactattctatacacctctttgtagatattgaaagtgggagggggatactaatggatgatgcgtatagtaaacagggtaatggtctgtgtcgacaggcatgtgcttaagcatgctgatgtagagttgtaatatgatgagacacggaggtgaaatgcatatttcattcttctctatcactgtcggcctgttaggttgcctacctgacatcttcatgttaggtttagcatcatctgttgtgtattggttggtgtcactgccaagggccttttgatttgtatataaatagaaaatgatggtttgtctaccaaaaaccaaacaaaaaacccacgcgtccctgttccaagattgacacagcaattttgtccatgcatttgacgctgacgctgatcagagtcaatattgattgcttctgtatgtgatccatgcatctgacgatgatcgcccataattgcgtcaaagctaaggaccctttgtttgaaggatttttttaggattcactgagggccctttgtttgaaggattttttaaggattcattttctacaggaaaattcctgcgtgagtttttgaaacatatgattcaatcttattaaatcctttgaaatttctatggattgcttttttccattcaagctttggagaaaaataacaagaggtatagacccccctttgaaatacaggattagtaaaatgaaggaatagaaaaaacataggaatggagttgcatgacaattattacaatcctacatgaattaaaaatacagaaaaaaacttctaaatagagtgtttagatgcaatatcaggaattagaggagagagaaacacaaatgaaagtttctaagaggttggacctcttgttagaaatccttcaaaatatcactacaatgaataatcccgtaggaattttatagaatttgtaggaactcaatcatttattccaaaggtccataggaaaaaaaattctatatcattccagtcctctaaaattcctctaccttttctttgttccaagggggccctaacctcttggaaactttcctataactgttatctctctattcaaattcctgcacaccatccaaaggctaggtgattttttttccacattcttaattcctgtaagattgtaattcacagctaactctaattctttgtttttctgggccaacagggaagaacaaaaggaaatatcaacttgaatgcttaaggtactatggacgaccacgctgttcagaacccgagactggcaatgatctgatgcatgatcagtaatataaattgacgaccaagctatatgcataaaattgtgcatagaaacgtcgaaccatgtgtttgccgtctctacaagtgcttgcaagcttcgtacacggccctagtacagcgcccgtcacttctttattagcttgcacgccagaaataaaatcccagtatatttagatggacaactcattgatcagcatacttaaaacttttatctatcttcatctttatataaactttattctgcaaatagtgcagtctatagtttaaaataatgatttgtacgactatatgggtaagtttttggaggcggtccaacagacccacttcatatactaaataattcagttgttgtaccagtcgagaaaaagaacatagagaattagagagtgagaaaaaagaggaggggaaaggtatactgctgctgttgcgctagatcaaccaaacactggcaacctgtctcatcacatgcaaaacaggaacacaatccagtacaaactcctaccgtcttgatcgcggcatgaacggcgacttgcgcgatggcttccggacgatgaaagacgacacgcatgagcgcggccagttgggcctacatagcatagcataggcaaaccaacacgatgagtcaatgagcgtgaagaaccgatgacaattcgtgaggctatcactacgctaatcggctaatgacggggtgcggatggagaggctgcagccgaaactcgccaccgtgtatctatgggagagcgcggcgagtcggacggcctctttgaactgaagtcctccgtcctgttccgaactctcgccgtcgccgagggagcagctagtagcagcacgcggcatcctccggtcagatccacggatgctcttgagccggccagatgcgccaattgggacgcaaacgcaggggatcggcaggaggagccgactgctgcacttcggatcgacaacagccggtcgtcgtgtcatgtctgagccggatgcagcttctcaggatgtggatgggcaacactaagtgtgttagagtgggccgtaggccgtgtttagtattctaatctagtgtcatgggttcttttagagtctgtaatagcctgttaagcgaggggataaatacgttgtacttagccagttggcaggaattacgaacagaataatccacagaacagaatcgtaacaaacttaccctggttgttgcgttttgttggcactccgacgagctcacgtcccggcggtggcgcgccggcggccacgggtcgtctcag

SEQ ID NO: 5285 - DNA, 1503 bp, Zea mays
cccatgcgtccgcccacttgggcacctcgggccggcccgggatcgccttctctggtatcatcggcctgccgcctgcccgcctgctcctcctgccccattaacgccgccggctgccgtgccgccgcgtcctgctccccgccaccgcgttcctcgcccgaagcaccgccgcggcctcgcgccaccgcccagaaaccatctccgggcctcgttcgaccgaagcgccttgtgtcatatctccgcgacctagccgccgcccgccgccgacgctgccgtcgtcgtcatcctcgctggcggtgctgtacctgcgtgcagcgcagatccatccgagctcggattgatttcttcctttgctgtactgtcataaccgaactaaaacagtttctgagaggaagcatcgcgattgccatggaagctgggagaatggatcagccatttatggctgctatcaatagccagcctttcgtggaggatattgagccagtgaagaaagccagtggggacatgcctgcgacaacaggaagcggatgcttcgaatgcaacatctgccttgattttgcatcagaaccagtggttactttctgtggtcatctctactgctggccttgtatctacgagtggctgcgccctggggtggagtcagctgccagcgacaacagcagttcggcaaggcggcaatgtcctgtatgcaaggcaacactctcaacggacacccttgtgccactatacggccgtggaggcaactcaaagaagtcacttgatggcatggccatcccgcgccgccccatggtacaccgggagactgttgaggagcaacagaatgcacagagcaatgtcaatgaccagcactaccaccagagcatggaagacaactctcagcgccagccattgctgcaagcgcaccaccatcccattcccactgggtttgacttcatctaccctccagcaccagtagggcgtggcttgatccactcaactgccggaggggtgctcggagggatggcagagattgtgcttcccttggcgctccgtggccagatgccagcgagcttgtactacacgaatccataccatgctgcgacgcagaacgtgaaccccaggctgaggcggcatcagatggaaatcgagaggtccctgcaccagatctggttcttcctctgtgtgtttgtggtgctgtgcctgctcttgttctgagacaagactattctatacacctctttgtagatattgaaagtgggagggggatactaatggatgatgcgtatagtaaacagggtaatggtctgtgtcgacaggcatgtgcttaagcatgctgatgtagagttgtaatatgatgagacacggaggtgaaatgcatatttcattcttccctatcactgtcggcctgttaggttgcctacctgacatcttcatgttaggtttagcatcatctgttgtgtattggttggtgtcactgccaagggccttttgatttgtatataaatagaaaatgatggtttgtctacc

SEQ ID NO: 5286 - DNA, 1130 bp, Zea mays
actcctatgggcgattccggcccccgccgccatccttcaccactcccgcccatcccttcgctccaccacctctgagactcctccttcacaggccggcgtcgtcggtggtcggagagatggggcaacaacgcacgttggtgtatagcttcgtggcgcgaggcaccatcgtcctagcggaccatgctgaggtctccggcaactttgcctccgttgctgcacaatgcctacagaaactccccgccaacaacaatcgcttcaactacaattgtgatgggcacacattcaactaccacatttatgatggattcacgtactgcgtcgttgctaccgagtcagctggtcgccagcttccagttggatttattgagagagtcaaagaagatttttccaagaaatatagcggagggaaagccaaaaatgctagtgccaatggcctcaagcgagaatacgggcctaaactcaaggagcacatgaggtattgtgaccagcaccctgaggagatcgacaaacttgcaaaagtgaaggctcaagtcacagaggtcaaaggagtgatgatgcaaaacatcgagaaggtattagatcgtggcgaaaaaatcgagctccttgtggataaaacggaggatctccgatcacaggcacaagatttcaggcaacagggaacaaagatacgacggaagatgtggtgggaaaacatgaagatgaagctcatcgttttcggcatcgtggttgcgctgatcctcctcattgtcttgacagtttgcaaggacttgaattgctgattagaagcagacacacaggaaagaaaagaagaacgtggaaaagggaaggaaaaaaaaacatagaaggtgcattattggtatcacaccgcacggccaaaatccatctcgtctttgtgatgttgacattgatcacattattgttcttagtcatgtctagatcgttgggctcaaagctataacagggctctctcatattttaaataattgtagtggtggtttggataaatatcccgccgcttctgtattagtagaagagattgacggcaaaacgaacaaatttctcctgtaatccatctcaatctgcttccgtaacactttctgactgatgactagcggagaaaaaaaaatata

SEQ ID NO: 5287 - DNA, 5101 bp, Zea mays
tagtgacttaggaaacgatcctaagcaccagaaatttttaacaccaacaactttacttgtccacttgtgtgggtttacgcttcagcactacaaatatctattatccctggtttactgtagcatccgttacttatagattagctatattatcattagcactataataatcgggaaaaaaactgatggcatatcggcggtccatgaatgatgcgtcatcatcattaacgctataatatcagagctcattagctactactatggcgctaaaggctagttgccaaagattccggaaattttgcctgctccaccgcacctttccgttctcatgggttatgtggacactagctggcagtagtcaattaggtttgcattcattttatttgagctaatgcttctattaatcattgattgacgaccatggcctggtgtttgggttactgacgaaatcactgctcctttgtttcagctgcggcagatctttcggtccgatgtctggcgatcaacatcatgctggggcaagcgagccagcgcttcgcccccatgtgccttggtccgcgccggtggatgcggcggatgcacccagatcctgttcgctctgcagatgacaagtattcttgggatggaaatgggtcaaaatcggccgggttgatccattggatagttgacttagtcttggtgccaagggccaggtgggccaccttcccatcctcacctcgtcaaaaaaaccgtggggccttggggagttgggggtgtggcctgtctcttttgatagatcgagccccctggtatggtaggcgtctgtgtgcgcgctgcatttgagcactttgccgcgtgcaagttgttgcttgctagagacgccggtaatacatctactcgtactctctgttgtcgatccgatgcactacatgttacccaaggctggcatcgtactggggactcgcgaaatcgagattgccaacttgtttcgtgagagacgcgacacaagtttggccgaaagttaccagatttgatgagttgggacgtacggaattatgttttgaaatgaaagaacgcacaggctcaggaagcccatacattcacacatggaccgcaggtacgaaccccccagtgtagtgtgataggcgtgggttaatttgcagagatcgggtcgtgtaatcgtgttggttaaacttaaaccatctagccgatccgttgccacggccaccgctagcgatcaaatgaaagcaaggatacgacgacggggcagcggccatgaccaaccactggtccatccatccatgcaatgctcgcctcctctcctctcctcggtaggtgggcagggcaggcgaggaggtgttaaggcatgagctgtcccctccttcctcgttgtcgtcttcgcgtgcgcaaacagacacatacagggacgccgacgcgcagttgcccagccgcccgagctgtcagccagcctgctgcctgccacgctgttccgcaacgccgcagttgggaagctagctagccgggggcccgtgcgggcgtgcgggccaggttgctccgtccggcggtgaggacgggcggggcacctctaaattagggggctgctcaggggtcgtcggctccgcaccgctgcgcaacccaaccataaaggcgtctcctcggcagactccgaccgctgccctgccctggacatccatcatcagcccaccccacccccgccttctccttcctccccgcccgcccgcccgccgcgtgcgttctcctcccttccctcctctcgcctgagaggaaaaagggggaggggcgcacagagaggaggaggagctaccggaggtggtggaggaacaaccagcagggcccgggccggccgcctagtccgtccgtcgtccaatcctcctccaggcgcacacatcgtcatcgtcaacaacgacaacatggctgctgtaagtaacatctcccatagatcgcactcctcaattgtgtgggcatccacgcatccaaaacgatgcatggcattggcatgagctgggccggctgctccggcatgtgtttattgctccgggcatgaactgaactgggacggcctgcgtggcctgctgctgcaaatttcattattactcatccacatgtgccgtgacataaatgtgtttttattactactgctccgaagctagtagggtagtttatcgaagtactgcatgtgctccgctgcatgatgatcgcattgggattatcatgcatgcctccttccagccccggaaccgtgcccatgtgcccccacgttgaatatgatgattgctgtgcattttttagttatatgttctagtcatgaacgcataaaaaatgttccagtcttgtgtatccgtcatcttccagctcgtctatggacctgtgattaaagagaatggctaattgctagctaaacaaaaaaaaaaacagttttaaatgtttctaaacaagatgtgtctaacaggcgagctaattattgtttttactaattctttttaaccaacttaaagctaatccgaaatcacttttagcccaaccgataactagacaggcgtatatggtgcgggaactgtatcatcgtctttattatattttgcattctcacgcaccatccaaatccattcacgattcatcgctatctgaacatgggggcgccgctcctgacttccccaaggcacatggcgtgtgatcccgtgcttggattggacgactcgccggtcgccgctctcgtagtcctcacgggtcacacacccatgtgctgcgccgcgcgcccttcatcctcagttgtcagcccatgtcacggcgtcggctcctcagtagtctgcctgccctcaggagggcgacttgcatcccggtccggatgtgatccttcgtaccctttgagtttcagctaagcgagtacctactacgtactagctgtatctctgcgacgtgccggtgctcgcacgcaactacggactagcatgtattattcggtcgtcgtcgtcggtgttaagacgcagacgcagggagctgtacgtacatacagctgtctgtcatgtcatgtgctgttcaaggcaaatcctgctagtaccagtagttggttaacatgtacaactctcattttcacgtagccggacttacttagtatttgttttctcgttttctttaaatgcaaattcgtacataaaatttgcagcaattgctcattgagattgattgcaggccgggcacgcggtcgtgcccaagttcggctcgtgggacgccgagaacatcggctacaccgtcttcttcgagaaggtgagagacaacaaggctccgccggctgcgccaccggcggccgctcccaagccttccgcccccgctgccggcggtaacggaggctacgacttcgacccgtacgagcactacgagagcatcagcagaaagccgccgtcacgcccgccgagctcgcacggccagcccgccgctgccagggcgccggcgcccggcgccggctacggctacggcgacttcgacccctatgagcactacgacaacctcagcagcaggaacgtgccctcccgcccgccgagctcgcacggccacgcgccggctgctggctacgacttcgacccctacgagcactacgagaatctcagcgccaggaacgtgccgccctcccggccgccaagctcgcacgcccacgcccacgcgccagcgcctcagccccaccatcggacgtaccagcaccagcatccgcaccccggccacgggcaccaccgccgcaccgggagcagcagcaagcaacgcggcgtcggaggccagtagccgcggcagcaagttctcgccgcccaggccgtaccagcccaggtacaccagcaacagtaccagcgaccgaagcttcccgccgcagccacaaggcggcagccacggccacggcgcccaataccaccacggtgcgccgaggccggcgtccgcctcgccgtcgccgtcgccgccgcgccaccagcagcccccgctgccgccgcgccccaacaagccgtcggccgtgccgaggttcggcgtgtgggacgagcagaacgccgcgatggcggcgcagggattcacggtgcagttcgagaaggtgaagcgccaccgggaggaggccaggaccgcccccgcgccgcccgtgcagccgccgaagctgctgtcgtcgcccgaccacgcagcgccgccacgcgcgcggcgacacgggaaggggaaggccaagaggtccttcatgtccaggatctacaggtgcctgttcccaagggtcagagagtgagtgatccgacgatggttatacacaaccgctcagccgtatacggtgtactacgtgttcttcgacagagacggtactgtttttcgattaggatgttctaggtaatggtctcgtgctgctgtataatctccatgcattagaagaatcactcggtcacacagaagaatatcgtgctgggggtacatgattcacgtgcctgatcttcacttctttcattgcactactacgtagtataatcctcctaggtagaagatgtattttcttcttaatttctatttcgaatgggaggtcaacgaaaaaatctttattaaggccagtttgtaaactttatttttctaagatattcctttttttctaaagaaaaaataataatttcaattagaaaaaataccttaaaaatgggtccctaaactagttcttaaagaacaagatcctctgcagtcggcaggttcaatgtcaaccgttcgcttgtatccaacggtaaacttttgaacgtgtgctgccacgacgctgctcggtgagttcggcccaatctcaggacatgccgtttcacatcagagcctcggtagggtgagtcctcgtgcgttactacgggtataaaaataaatttatatagagtatagataagaatgataaatattactataatatttaaaatacgtgtgataaacattattaatatcacacaaatattttctaaagaggtaatataaaattttaatgacaagcaaatatatcgacaaccatttataattacaagcatgaattgtggttgtatgaatttgttagcatcttttaaagattaaggaaatatgtaccatgggttgctacggaataaaaaaataatatgaaacatag

SEQ ID NO: 5288 - DNA, 1300 bp, Zea mays
  misc_feature (39)..(39): n is a, c, g, or t
gaactatggtgctccaccgcgcgatggtccaggacgtgnaagaggccgccgcggtggcaggactggcccgaggcgagattttggcgatgctgatgcccacggctttgagggggggtatggtggcggcggcggcggttttggggacggtggagttgctcgcggtgaaaatggtgagggtaggcaggcagagaggggccgtgggccccgccagccttaccgtggaggtgggcgacgtggtgggtacagcgatgggcaggctgggaatgagtttggacgtcctcgccgggcatatgagcgccacagcggcacaggccgtggctacgggatgaagcgtgaaggggctgggcgtggaaattggggaactgcaactgatgaaggccttgaacaggacactgtggatgctgttaatcctgaggagactactgccgtggtggaggatgagaagaaacctgaagatgcaccacagtctgaggttgagaaggacaaggagggcgcggagaatgaagaagaagaaaaggaacctgaggataaggagatgactttggaggaatatgaaaaggtactggaggaaaaacgaaaagctttactctcccttaaggctgaggagagaaaagttgaaattgacaaggagctacaggccatgcaacaactgtcagttaaaaaggatggcgatgaagtgtttatcaagctgggctctgacaaggacttgaaaaagaaagaaagtgctgaaagagaagaacggggcaagaagtccctgagcatcaacgagttcttgaagccagctgaaggcgaaaggtactataaccctagtggccgtggccgtggtaggggccgtggggggttccgtggtggttacaacggcggttatcggggaccagctgctgctccagcgatcgaagaccaggctcagttccctgccctggcctaagcacagctcgtgttctcgctcaagattgtgtcacttttgcggagtgcgtcagtcagtcctagtgttgttgctcccaagcttgctttccggattatgtgtatccaacattttctgatattatgtactggtgtgctcgtgattgcatggttttgctaagctcagctgaggggtgtcgtgttctgtttgcctggctgatggctgttgacagacttgtcacacatccttcgagcctgaccggtctccagatttatttacttttttcctcggatcagccatgggaggaaatagtacaccattctttgcattaaaaaagaggacaaaaaaaaacacaaccaaaaaaaaaaaaaaaaaaaaaaaaaaaaaaaaaaaaaa

SEQ ID NO: 5289 - DNA, 3999 bp, Zea mays
  misc_feature (279)..(279): n is a, c, g, or t
  misc_feature (518)..(518): n is a, c, g, or t
  misc_feature (726)..(726): n is a, c, g, or t
  misc_feature (747)..(747): n is a, c, g, or t
ataggtaaaaacacacaatggcttgcatatactctgttttggaggccatatttcgttgtttgtaagttctaatgaatagtagcaaacccacaacaaattaatacatatttagcaaataaaataagaagttggtcctattagaagaggcccagctgccatgtcaattttggatctgcccttgctgggcagtttgggatatgctttactatttgaagtacattttgggaagtatatattgcaatttaaagtgcaactgctaattgcaatatttatttggtntcataactactatttaaaaaaggaatatcgttagttaaagggactactgatgcactactacaaatgtcaatgtggtcattttagattggaaaagatgttgctacacaatatgttgaaggatgggattggatgtgcccaataaggtagttgatgatttctgtttgataaagctacattcttcattggttgatctttggcctcctaagatgtatcacatgttttgagttcccaaactattnagtaactaaggtcagaaaccctacactgaagactgctgcaatatctgaatcttttctaacctttcaagtaatctttgacaaataattagaactaattaccaacttttgtttctcttgcacttatgtaaccagtcaaagtagtgtatttgtttttacttattttgcaacaacaaggtttttttctttattttctgttttcattatgttntactatttttaacatcaacgnctttctgacatttctattttttctggcatcttagggatagaaatactggtatctgggatgaggtatcaatttgagtccatgaattcttgttcccttctaatactactttatccatcttttgtcattgcggcgtcaccactgatacacgaagaggaggtgcacaaagaagaaataactcattgactttaatctttttagaccaaggaccaaacggtccagcttatattgaaagcttaacatgagtatttctggggttaccagcttacaagcattcacagaacatccatagaaaggaaacaaccaagcacctcaaacaaaaatccctgagcatgaagatcataccttggtcgaggcctgcgcgattgagcaattagcagatatcattcctatccggtggcggggcaagctcgcacttcttcgtccttcctctaggacggggcgaggcaatgaagtggtgcgggattgttcaggggattgagtaggggaactaaggtgctcagaggatggcggttttttgcggctagctcggggccgggattgttcagggattgagcaggggaatcagccgcgggcccctacctcccgcccctgaacaatcctacaccacataaaacagaatcaacagaaagttcatacaattcagtaattcacacataaaacagcaacacacgttgaatcataagcatccaattagtgagttggatgtggaagctgaagccatttctgattactggccatatgagttattacactgaaccatcaaatattttacaacacttaaattgtcaattaatcctcatgaaattagtgagtccgtaggctataatattgaatacgtacataggttaaatgctttatcaactcatttttttgttaaaacatctggcgactgccaattaatgaatggcagttgatttcatcacaagctatacaatagtggatatgtgtggtaaacagaacccccattatacacaaaaataaacttttatgtgtacctgttggtcccgtggcacattcagcttgtcaaatattatcactcaaagtttttggttgaagtctcactaacaacagaagcttggggtaattccttgctcatcaagtacttgcgcttttgaaggctcagccagaccaatatactgtcagtctggacaatactgtatccagctttcgtgtacatgttgaatgggacttggtcaattattctacagtgaaggtatacacgtcttttggcattcatcttgaaaaccagatcctcgcatgccttaagaagttgctttccaattcctctcctgatagttcaaaaacattacagtcgacatattttaaacatgatgtaatgaatacactacttgatatgcattgaaccaacagtgactgagaacagatcaacagaatcgtcttaatggcgactgatccttcatataaacacaagttgcttttatttcggatgtgacgagaatgtttctccctacaaggatgcaacatttgcaatccactcatgcatcaaacttattttcccacaagaaatattcaaagtggttgctcaacccagaataccttctcagtggcgtcttcacagtcatgttgcagatgtaggggaagttgagcggcggagtgggcgtgggcggggcccctggtgcgcccaccgcgtcaaacgacacctccgcggtgcacgccatctccccttcatccccaccctccccttcgtcgtcctccggggcggcgttggcgttgtcggcgccggcgtcggcgtcggcggggcggtagaaccccacgagcaccgcggcgtgcggagcgagcccgcggcggtcgtggaggtacctgcggatgacgaacgtgaggagctgcgcgtaccgctgggccggggcccagcgcacggtctcggagaaggaggaggcgaggaggcggacgagcgcctcggccacggcgtcgtcgtcggggccgcgcgagagggcgcgcacagtgaggaggccgtgcgggaaggcgtgctcgtagcggaaggccgcgagctcgtcgagctgcgagagcgcgcgcggcgataggaagacaccggggccggggccggggccgaggccgtttccgtccgaggcgggtgtggcggttggaggggcgaggcggatgtggcgcggcggggggcaaggggagcagaagaggaggtggggatgcctggtgacggcgggagtcagcgagacgagagcgggcgacgccgccatgggaggagcgaactgggaaaacagaacggcgattttttagtctctttttcttgtaacaggcttacgtggataaacgtcaactgtaagcctgtaatgtgtggctgacctgtgtgtgtacggttagtgtaagatgaggcgctccttagtccatgtacggtgcaggcatggttcctctagtacaggaataaagtttaattaagaggttattgtgtttggttgtagagactaaaattattaaatgattcataaaaagattaaaatatcttttaacattcttctaccataaatataactgaaataaacgagaacaaaaaataaaattaatataatttagtcactctttgaaagactagagactaaagcagtttaatctatattttagtcccaccaatttactatttagaaactataaataaaattaaaatgatgaaactaacctttagtccctcaaatcaaattgtgcctaactctaatccgctagagttggcgatgatgctgacaatacgacgacaccgatctcataatggacaccaacatgaaggttcaaaggtgcaaacagatacttatttgaatattagtttttgatatttttttgtgaattaatagaatatagaatttgctatataaatttatattcttttttaagattgaacttgtaaatatttatgaaaaataaacatcaaatttatcatatattttctccaatatatatataaattttggatacagacataaatatttttttgtctttttattatatagagcaaataatgtattaaacaatttatacaaaattttattcttaattatagtaatgtgcttcataacataagaagagattcgattaaattttatacatatttatttaaaatattaaatttgttttaataattcggatatccgtttacatccttggtcgcaagtctgcaactgcaaagacaaagaaaacgagtctacatccatctgcatcaactttttgcgggtagcaaggatatatcatatcagaaattatctgttttatatttatttttatatttta

SEQ ID NO: 5290 - DNA, 1342 bp, Zea mays
  misc_feature (1303)..(1304): n is a, c, g, or t
  misc_feature (1325)..(1325): n is a, c, g, or t
atccaaacactcgcacgtcgaaatctggaaagcgcaaaaggcccgcacgcacctgcgtctgtgtgcagcgaccagcgacgcaacaacgatatccgggtcgttctcagcgcacatccccaattttcattcccctgaaaccctagccgctccgtccggtcgcgccactcccttcgcctctctaaggttccggcggaagccgtcctctgcgtcggctgcggttgagatggcttcctcgtcggcgtcttcgaggcaccaggtcaccatcaccctcggccgcagcggtcaggttgtcaaaaggagagctatgtctgatgatattaatgacggtgaattgcctttgttggggaaaaagcgatctctgagggataggttaggaagtaatgtgtctgattctgatttttatgaaagccagcagagaaacaaacggcgacagttagaaagtaatagctcacatggagatgatggttcagaccgcctggttgggaatgggaaggatgatctgagactgaaactcatgaggaaaggcttgttgccgaggagcaatggtggtgcagaacagaatgacatagatctccgtgaaaagctttcccgaaaccataagttaccaaattatgattctagaggtcatgctgcagaatcaagggctagttatgatatgagagatgagcctccagagttaagttccagatattcttcgatggaagatgtcctagggtcgaggcactcttctgttgtaagtcgagttccttatgcaagaagtgtggatgatttgttaaagttggattattcaagaaaatcctacccgtcatggacagatgatggtttgaggcacaaatcacctgaaaggatgttaaaagttcggagcgatatgtatccaccaatagcttatgatcagattaggcccatgccaccccttaggtctgctggttcctcgagatatcaaagttttattacaagagatgctcctgacacatcaaggagccaaccatatgctggcaaattcaccatttctattgatacagtacaaaggactaatggaatcactccatctagtgcagctctgcctaaggcccctgttatggtttgtatctgtacttcctctcgtagaccataattcactgaagcatttgagaaaacctaatgtaattttggagcaattttttttgtgcatattatttttaaaattctttccgaaatcacacctgcctgtttttaatgctgttggggctatgaaattggcatacaatccagagacattatgacatccaaaaaaaaaaaaaaaaaaaaaaaaaaataaataaannaaaaaaaaaaaaaaaaaaaanggaaaaaaaaaaaaaaa

SEQ ID NO: 5291 - DNA, 4271 bp, Zea mays
  misc_feature (1454)..(1454): n is a, c, g, or t
  misc_feature (1943)..(1943): n is a, c, g, or t
  misc_feature (1978)..(1978): n is a, c, g, or t
ccggccgggtttaagtgttcgtagtgatgtgtctccaccagtaggttatgatcagattaggtccatgccaccacttagatccggacgcgtggggtgacctcaaagttttattacaagaggtgctcctgatacgccaaggagtcaaccatatgctggcaaagccaccatttctgttgatacagtacagagaactaatgggatcactccatctagtgcacctttgcctaaggtccctgttatggctgaagccccgcttacagttactggattgttgaattcgttgggtcttgagaagtatattgttctctttcaggctgaggaggtggatatggctgcattgaggcaaatgggggagagtgacctcaaagacatgggggtacctatgggcccgaggaagaagattctccttgcagttggccctcagtcgaaacaacggcaaatatgagcaacatggtgtgggacttgcgagcatttgttggcaactgaaaatattggtgcaagaacgccagatagcagatattgtatatcaatccatattgtctgtctcaatccactcttttgttgctgatggcgttgtttcgtgccgtagttgacaccatgtaaagtctattcagccagctgttaatctaggttctatcattcagtctgcctgcccactgttattgtttcgaaacgggtggatacgtgtggtttactcgtgacgattagtttggaatggatgctacgttcgattcttttgtgtcacaagacgccgagcctttaagaaggccctatttatctatccaaatgaaagcgtttattgattgtcatagtgaactgatggtaagctcgtaccggcgaatgactcatcaatcatcaaatcatcaaggggttgtttggctcgcataattgataacgttaaaacatgtttatttaagttcaactgtaattgaataccacattaaaaacgtaattagataccacactagaaagtgatactggtctattcaaactttatattgtttgagctaaggttatctccaataaaaccttctaaatggtcctctactctaaatataggtgaagttaacttctctatttttttcctaacaacgtcctttaaaacatccttcaaatatagaggatagaggatgttcctccatcatctacatagagagattttcttaactcttctctatctttttaatattataaacactttctactgtgatatctgattacggttagacttaaacaaacataatttaacgttattagttatcatttacgttacaaatatgtgaactaaacaacacctaaattcataaggaaaagtaaataccatcaaatactactatactaatatagagatgttgcatgctacataatcagggatgtatatacgaatatattgttaggagaagagtgggcatgctggtttggtattagacttttctaggtggagattttatttnggtttcacctttatgaagtagctcgttatataagaaaaactgatatggtatttttagaagctatgtaataaaattctatattgagaataagcattgattttttgagctctctcgttgcttgggcactagagccgtccctactcgcgtgtccttggtccttattgaaagcagtcgaaggcttcgccgagcaaggccgtacaatcgtacttgttggcggtggaggtggacagcagccgttgtggtagtgcaacccggccagctcggtcgattttattggggggcgtcgggtgtcccgtggtccattgcccattggtggcatcgtcgcatcgagttacgagcacctacacaaaaaggccaatgccgcccttctgttccgtgtgccgacacaaatggttgcaggcgcaccgaacgtccttgcttcgaccttccagaccttccagcgtagcttggatactcctacttcgactgcagcgaactattaatttcttncgctagtaacaaagggaacgtgagcgtgttactcnatgtggatgctctcatggacgacgacgacgacgggacacaacggccgcacgtgaaaacgacaaccacatgatggcactaaaaacgtcattcaagccaagcccatgcatgagagagaataagttctttaattcgaatccacatcatcctacattgaatgtggtctactggtctatgactttgagcaatccactatatcgactagtaagcatggaaccacattggccttgattataggttcctccacggggtatgtttctaatctatatatagtgaacctttcagtggtctgcatgccatatgaaaatgggggaaatgtcaaaaagaacatttcataaccttataaatacataagtaaaaaaataaaaataaaacaaaggaaacaatgtccgcaatcttttcaacggcacttgggtcagatatttcagaggcccactttacactaacataaaatgtcctacaatgccagagtcaagagactgtgggaagtacgggaagaaaatggattatgtaggggtctcccctacaatatggttgcttcttctttgactgccagttcagcaaatcatgttggcagactattggtttacaatagacctcgtctcttccattcttcagcatgatgatagaaacaagacagaataatcctccacaacttctattcatggacgtgttcatgattgctgcttggaacatctggaaagaaagaaataaccttatctttgagaagaagcagccaaacatctcatcttggaagcgccacttcacagcatgatgaagaatgataaaagagctcctttttagattgaatagattcccttcgttaactatcttctgtcctctcatttcttttgagctcctctcttgcagttcagctctaggccttcctcaggcttaactatgtaaaattttgtttgtttctatcctattataatatacctaccacagtatttacataaaaatgcgaaagggcctctaggttaaggacttccgagtagcacctccaagtcctgggttcgattcccctcgggagcgaattttcaggcttggttaaaaaaatcccctcgctgtgccctatccgctctcgggttacgatgtcctgtgcgccaccctccggttgggccgttgcagagtggacagttgacgccggcccgttagtgatggggggccagggttcggggattttctcggccgggaccattgtttcggtctcttcttaatataataccgggagggcggtctttccctccccggccgagttttttttgtatttacataaaaatggattatataaactgaacaactgatttggtgaacagagaattgaagggaatctatggggaggaattcccttgctattcgaatagcaaaagaatccctcccatagatcccaaaccagtccgaagtagatgtcatatactcatatgattgtgacatggtaaggtttgaacctcagcagttaaatattttccgagggaagaccctggcggccggcgttcgctgcatattcaattggacggaaccagatggaatcactgctttgcgagcaacctgtgttttagctctgtgagagtgtgagatgctaatgacaagtagcaatgtacccttagtcaccagtgacaaattgacatagtatagactctatagagtagaccagtgttctttgacaagattatcattgaagtcagcaactgaaagtttcccatgttgaaaattgccctgcatcactaaggacatgaacacaagaaagtcaatttggattgatattcagttatatcatctcccttaggtgatatcctagtatcctcagatcttcacatagcctgattcatatggtttaagtgatctagaggctacaatacgccaaagtggctcatcagcatgatgttaactcccctggtggaaactccaaccaaagtttacagtcacagtaaagataaagttttcacttggcactttagatcccacaattttacactgatggcattgtagaccaaatttctagtagaagaatcagaaagagagatcaatgtcacataagttgaaatgcatgacatacacctggacaaacttgatgaaatattagctgcagacttgcttgagatcaatatcttagtcatatgaagttcctgatagttattcaggggggaaatatctgtatgaaggtgggaaactcattggatgcaatatgcatatactgctcagaggataacatttcaagcttcgatgtcacttcagctgttcagatggcacttagatcagcgctcaataacttgaacaactgccaagaatgtg

SEQ ID NO: 5292 - DNA, 2276 bp, Zea mays
tttctattttatttgtactagagataataattaattaggtagtgagattatgtatctaacaaatagccagctagctagtaactaatttgctaaaaaagctaatagttgatttattagttagattgtttattcaacttaattttagtgcatttggacagacacttttatcatagcgcgctggttaaagttctagtaaaaactttggcgccgtcgagaccggcaaagcgaaaaatgcccgcccgcacctgcgtgcgtgtgctgtgtgggcatgggcagcgtcaccaaagcgaggctcctctcgtcccaagcgccggttaactccgtctcagcgcacgcggcacgcccctaatcttcattcccccgaaaccctagccggtccttggccttgtcccggtcgcgccgctcccgtcgcctcttccgcggaagccgtcctctgcgcgtcggcggcggtggagatggcctcctcgtcggcatcttcgaggcaccaggtcaccatcaccctcggccgcagcggtcaggttgttaaaaggaggactatatctgatgatattaacggcgatgaaatgccattgtcggggaaaaaacgatctgtgagggataggttaggaagtaatgtgtctgattctgatttttatggaagccagcagaggaacaaaaggcaacagacagaaattaatagctcacatggagatgatggttcagatcgcttggttggcaaggatgatctgagactgaaactcatgaggaaaggctcgtttcagaggagcaatggtggtgcagaacagaatacaatggatctccgtgaaaagctttcccgaaatcataagaagttgccaagatatgattctagaggccatgctgcagaatcaagggctagttatgatatgagagatgagccaccagagttaaggtccagatatttttcaagggaggatgtcctagggtcaaggaactcttctgttgtaagtcgagttccttattcaagaactgcggatgacttgttaaaatcgaacccttcaagaaaatcttacccctcatggacagacgatggtttgaggcacagatcacctgaaaggattttaagtgttcgtagtgatgtgtctccaccagtaggttatgatcagattaggtccatgccaccacttagatctgccggttcctcaagacctcaaagttttattacaagaggtgctcctgatacgccaaggagtcaaccatatgctggcaaagccaccatttctgttgatacagtacagagaactaatgggatcactccatctagtgcacctttgcctaaggtccctgttatggctgaagccccgcttacagttactggattgttgaattcgttgggtcttgagaagtatattgttctctttcaggctgaggaggtggatatggctgcattgaggcaaatgggggagagtgacctcaaagacatgggggtacctatgggcccgaggaagaagattctccttgcagttggccctcagtcgaaacaacggcaaatatgagcaacatggtgtgggacttacgagcatttgttggcaactgaaaatactggtgcaagaacgccagatagcagatattgtatatcaatccatattgtctgtctcaatccactcttttgttgctgatggcgttgtttcgtgccgtagttgacaccatttaaagtctattcagccagctgttaatctaggttctatcattcagtctgcctgcccaggccttgttcgattacatgggatataatcccaccatggatttaatccaggtatggattgggtgaatccatatctcacacccaatcccatggtgagattaaatccatcaacaaatccatgtggtctttcaaagctagttattcttttgatccatggattctaatgtaaacttgtgcaatatctcatggatttgttccatacctaatgggctatggatagaatccatgtcttccatagtttaaaaaatttccaaacctttgggttatattccatgatgggtttaaccgaataaaaaaaattaagtagtcatggattattttggggcatggattgaggcatggatttaatttcaattcatgctaatccagagcgggattggtgtaaacgaacaaagcctaaaatggaacgtggcaagggatctgcgtccgaccgaccaactgaggtgcggccgaaatggtcagccggggcagagtcgtgatggaaggaccgtatctgcggcaagatcgacagcccgggctagatctcagggacgacgacaagcgacaccagcgc

SEQ ID NO: 5293 - DNA, 1955 bp, Zea mays
actgcgcgcaagcaagcaagcaagcgaaacggcagggctgcctgccacacaagagacaagggaagaggagaagggtagacgagtagacgactgtgatgaggatagaagaagagcaggcaggagctataagtaccccgcccccttccaccctctccttccacctccctcccttgctgcctcatccattccagagctgcgaagacagacagacagagagaaagagggatcgacggagcaaggcggggccgtgtccggtcacacacgagcgagccctctcggccgcgcgtttgtgaatggtgaacggcgagcggcgggcggacgcggagtgcacgcgggcgtcgctgctggggaggtatgagatcgggcggaccctcggcgagggcaacttcggcaaggtgaagtacgcgcgccacatcgccagcggcggccacttcgccatcaagatcctcgaccgcagcaagatcctctccctccgcatcgacgaccagatcaggagggagatcgggacgctcaagctgctcaagcacccgaatgtcgtccgcttgcacgaggttgctgccagtaaaacgaagatctacatggtgcttgagtttgtcaacggcggcgagctcttcgacaagatcgctatcaaggggaaactgtccgaacacgagggcaggaggctcttccagcagctaatcgacggcgtcagctattgccatgacagaggtgtctaccaccgagacctcaagccagagaatgtccttgttgatcggaagggcaccatcaagatctctgacttcggcctcagcgctctacctcaacatctcgggagtgacggacttctgcacacaacatgtggcagccccaactacatagctcctgaggttctgcaaaacagaggctatgacggctccttgtcagatctctggtcgtgtggggtgatcctctacgtgatgcttgttggctgccttcccttcgacgacaggaacctcgtcgttctttatcagaagattttcaagggagactgtcagatccccaagtggctttcgcctgccgcgcaggaccttctcaagaggatcctccaaccgaatccgatgaagaggatcaacgtcgcggggatcagggagcacgagtggttcaagaaggactacgtgcctgctgttccgcacgatgatgacgaagacgtccttcctagtccagctccctcgataaagccaatcgatgagccggcgcaagagaagtgtactcctatcaacgcttttcagttgatcgggatggcctcttcccttgatctttctggtttcttcgaggaagaggatgcagcgcaaagaaagattcggttcacttcgacgcacccacccaaggatctatttgacaagatcgagagcgttgtcatggagatgggattcaaagtccataggggggcaggcaagctcaaggtcttgaagaatagcaagtgttccaggaactccaggaacccgtcatcattgttggtgtgcaccgaggtgtttgagctcggtccatcattatatgtcgtagagcttaggaaatcccacggagactctacgttgtatagacagctgtgcgaaaggctctccgatgagctaggtgcctgcaagacagaccagatcgcgaggactgaatcatcgagtgacgacctctcgagcctcgatggcgaagcgttccctctatctgggttctgatcatattgctttccctgtgttgttttgggaacaggggatgaggaacatgctcgttcctgatgcaattctagattaggatcatgaatatagtgtacaaagccagcggcggcggcggtgcaaattagccaccgggttgaatataaataatatatatatatatatgttcattttcttcttctaaaaaaaagaaaacgaaaacaaacgggggggaaaaaaaaaaaaaaaaaaaaaaaaaaaaaaaaaaaaaaaaaaaaaaaaaaaaaaaaaaaa

SEQ ID NO: 5294 - DNA, 1848 bp, Zea mays
  misc_feature (1807)..(1808): n is a, c, g, or t
  misc_feature (1824)..(1825): n is a, c, g, or t
  misc_feature (1827)..(1827): n is a, c, g, or t
  misc_feature (1829)..(1829): n is a, c, g, or t
  misc_feature (1840)..(1840): n is a, c, g, or t
atagaagaagagcaggcaggagctataagtaccccgcccccttccaccctctccttccacctccctcccttgctgcctcatccattccagagctgcgaagacagacagacagagagaaagagggatcgacggagcaaggcggggccgtgtccggtcacacacgagcgagccctctcggccgcgcgtttgtgaatggtgaacggcgagcggcgggcggacgcggagtgcacgcgggcgtcgctgctggggaggtatgagatcgggcggaccctcggcgagggcaacttcggcaaggtgaagtacgcgcgccacatcgccagcggcggccacttcgccatcaagatcctcgaccgcagcaagatcctctccctccgcatcgacgaccagatcaggagggagatcgggacgctcaagctgctcaagcacccgaatgtcgtccgcttgcacgaggttgctgccagtaaaacgaagatctacatggtgcttgagtttgtcaacggcggcgagctcttcgacaagatcgctatcaaggggaaactgtccgaacacgagggcaggaggctcttccagcagctaatcgacggcgtcagctattgccatgacagaggtgtctaccaccgagacctcaagccagagaatgtccttgttgatcggaagggcaccatcaagatctctgacttcggcctcagcgctctacctcaacatctcgggagtgacggacttctgcacacaacatgtggcagccccaactacatagctcctgaggttctgcaaaacagaggctatgacggctccttgtcagatctctggtcgtgtggggtgatcctctacgtgatgcttgttggctgccttcccttcgacgacaggaacctcgtcgttctttatcagaagattttcaagggagactgtcagatccccaagtggctttcgcctgccgcgcaggaccttctcaagaggatcctccaaccgaatccgatgaagaggatcaacgtcgcggggatcagggagcacgagtggttcaagaaggactacgtgcctgctgttccgcacgatgatgacgaagacgtccttcctagtccagctccctcgataaagccaatcgatgagccggcgcaagagaagtgttctcctatcaacgcttttcagttgatcgggatggcctcttcccttgacctttctggtttcttcgaggaagaggatgcagcgcaaagaaagattcggttcacttcgacgcacccacccaaggatctatttgacaagatcgagagcgttgtcatggagatgggattcaaagtccataggggggcaggcaagctcaaggtcttgaagaatagcaagtgttccaggaacccgtcatcattgttggtgtgcaccgaggtgtttgagctcggtccatcattatatgtcgtagagcttaggaaatcccacggagactctacgttgtatagacagctgtgcgaaaggctctccgatgagctaggtgcctgcaagacagaccagatcgcgaggactgaatcatcgagtgacgacctctcgagcgtcgatggcgaagcgttccctctatctgggttctgatcatattgctttccctgtgttgttttgggaacaggggatgaggaacatgctcgttcctgatgcaattctagattaggatcatgaatatagtgtacaaagccagcggcggcggcggtgcaaattagccaccgggttgaatataaataatatatatatatgatatgttgcatcttctaaaaaaaaaaaaaaaaaaaaaaaaaaaaaaaaaaaaaaaactcgagcccggggcccnntcccggaaattttatnnancntgaaaacccantctttttg

SEQ ID NO: 5295 - DNA, 885 bp, Zea mays
  misc_feature (11)..(11): n is a, c, g, or t
gtaccctccgnagcccggcattgggtacctcgaggccggccgggacctccctcccttgctgcctcatccattccagagctgcgaggcagacagagagacagacagacagacagacagagagagggatcgacggagcaaggcggggccgtgtccggtcacacgagcgagccctctcggccgcgcgtttgtgaatggtgaacggcgagcagcgggcggacgcggagtgcacgcgggcgtcgctgctggggaggtatgagatcgggcggaccctcggcgagggcaacttcggcaaggtgaagtacgcgcgccacatcgccaccggcggccacttcgccatcaagatcctcgaccgcagcaagatcctctccctccgcatcgacgaccagatcaggagggagatcgggacgctcaagctgctcaagcacccgaatgtcgtccgcttgcacgaggttgctgccagtaaaacgaagatctacatggtgcttgagtttgtgaacggcggcgagctcttcgacaagatcgctatcaaggggaaactgtccgaacacgagggcaggaggctcttccagcagctaatcgacggcgtcagctattgccatgacagaggtgtctaccaccgagacctcaagccagagaatgtccttgttgatcggaagggcaccatcaagatctctgacttcggcctcagcgctctacctcaacatctcgggagtgacggacttctgcacacaacatgtggcagccccaactacatagctcctgaggttctgcaaaacagaggctatgacggctccttgtcagatctctggtcttgtggggtcatcctctacgtgatgcttggtggctgccttcccttcgacgacaggaacctcgtcgttctttatc

SEQ ID NO: 5296 - DNA, 817 bp, Zea mays
cctcgaggccggccgggccacctccctccctttgctgcctcatccattccagagctgcgaggcagacagagagagaaagagggatcgacggagcaaggcgggggcagccggtcacacgagcgagccctctcggccgcgcgtttgtgaatggtgaacggcgagcggcgggcggacgcggagtgcacgcgggcgtcgctgctggggaggtatgagatcgggcggaccctcggcgagggcaacttcggcaaggtgaagtacgcgcgccacatcgccaccggcggccacttcgccatcaagatcctcgaccgcagcaagatcctctccctccgcatcgacgaccagatcaggagggagatcgggacgctcaagctgctcaagcacccgaatgtcgtccgcttgcacgaggttgctgccagtaaaacgaagatctacatggtgcttgagtttgtgaacggcggcgagctctttgacaagatcgctatcaaggggaaactgtccgaacacgagggcaggagactcttccagcagctaatcgacggcgtcagctattgccatgacagaggtgtctaccaccgagacctcaagccagagaatgtccttgttgatcggaagggcaccatcaagatctctgacttcggcctcagcgctctacctcaacatctcgggagtgacggacttctgcacacaacatgtggcagccccaactacatagctcctgaggttctgcaaaacagaggctatgacggctccttgtcagatctctggtcttgtggggtgatcctctacgtgatgcttgttggctgccttcccttcgacg

SEQ ID NO: 5297 - DNA, 1515 bp, Zea mays
ttgggtacctcgaggccggccggggacattgccatctctttcaatcaccttcttcgtttcatcctctgattctccccctgctggtctgctctgctcccatcccatggagcccgacgccgcccaaaaccctagccccagccccgtccccccgcccatctccgcctactaccagacgcgcgccgaacaccacgccgtcgtaactagcgactggctcgcccacgccgccgccgcagccgcagccttccccggcgccgataccgccgatgccgccccgcccccgtcccccgggggcggcggcgtgatcgaggagttcaacttctggcgccgcaagcccgaggccgccgaggcggtggccgccatcatggctctcgccgccgtcatccgctccagcagggccaccaccatgatggagctcgagatcgagctcaagaaggcatctgacaagctcaagtcctgggatgctacatccatttctctttctgctgcttgtgatttgttcatgcggtttgtaacgaggacctcacatctggagcatgagaagtttgatgcagcaaaatcgcggctaattgagcgaggagaaaaatttggggagatatctttaaaggctcgcaagacaattgcaatgcttagtcaggattttatttatgatgggtgtactatacttgtccatgggtattccagagtagtactggaagttctaaagcttgctgcatccaatcgcaagctcttccgggtactatgcacagagggcaggccagacagaactggtttaaggatgtcaaatgaacttgcagcattagggatccctgttaaggttctaattgattcagctgttgcttattccattgatgaagttgacatggtttttgttggcgctgatggggttgttgagagcggaggaataatcaatatgatgggcacttatcagatagctcttgtggctcatactatggacaaacctgtttatgtggcagctgaaagctacaagtttgctcggctatatcccttggatcaaaaggacatgacgccagctcaccgaccaatagattttggagtcccaatacccattggtgtggaagtggagacatctgcaagagactacacacctccccaatatctcacactcctcctgaccgaccttggtgttctgacgccgtctgttgttagtgatgagctcatccaactgtatctatgatctttgcggcaggcgccgttgtttcattggcatgtaacatctacagttgagtccagggtttgccctatcagttttgactatgatgtatgcttgactttgtggtgctgatgcgatgtagaagaatttctcggaacgattatgctgagagaaatcaacagcttgtaagagcttaaagtacagtcatggttacgaatctgccccagaccattttcagcactaacccatttgtaggacatgctctgttaaaattatggttccctcaaacagtaagtgtaaatggatctccacaacagaatatgaatcccattagtattgcctag

SEQ ID NO: 5298 - DNA, 2586 bp, Zea mays
gatcagaccttatttatattcattttttactgaaaatatttagagccttaacaattagtgaagaaacatttggatcgcgatctattaccacatctatctgtaccataagatgcatatatttctgtaatagacatactgtaatatctatgaggtatatagtgaaattgttacaaaatggctttgaaattattcatctcttgccctttttaaagctattttactgttcttatgctcttgtggttgttcaataattacatttggaacagattgctcataaaatgacttaatttcttgaggagaagtattatatgtatcttttgtaagaaatatattctaaaaacatatagcatctctagattcaattactatatcgacaagcatattaggtgattctgatttaatttataggcagtgctatgataaacataaacataaatcagaaagccattttttttttttttttgtttttttttttgttctttttcttattggtatactgaatctgggtacagcgcggggggagaccaaccagggactgttccatgctgccacgatatatagtgctagtatccaacacggaaacactacatttggctacaaagttcaccgggaaatttgagtaacagaactcagatgcggaaaacagcattgagaaaaatttgaaaagatcgattacgaacactctgaacagattatacggacacgtgcaggtgtgggccgcatcaggtctcgtctcagcctctcatcaggcgcgctctctcagctcgcatccctcttcgatccagcacgcgctgacgccccgtacggcacgtgctcgtggtagggccgtgcgaattccagcgcgcggcacggaaaaagacatgcagtctctcagtatcccagccggcagccggtcagtgtgcctgtggtaggtcaccacgcgcgctgcagagcgcagatcccgcccatgcgcgcggcgaggaccacgacgacaccgcgcgcaggcgagaggcacccggcccggcgcaataatgcagcgccggccccagcggccggcgctctcgagagattcttcaccggctggccgcctccttgctcgctcatgggctcatggcatgtagagccggttgccgcacttgcacctccacgcctccgggtagtattcggtggtgacaggcacgcccggcggcacggccacgtgcaccgggtagcacgggctgcagtcgccgcacttggacgtgcaccgtggcgggtatgaccccggaccgtccgccagcagccgccgccattgcccagtcgtgtagcacccctgtgcgccgcgcgaggcggctaatgaatgaatcatcgtcagtactcgctgccgagggcacgtacgcgtggaacgtacgtacgtatcagtattcagtaggggtaaggtcgctatcattgctggtgttgcattgccgttgcatcggcagtgacgtatggtcaaaaggcgtgggatccggcggcgttgttggagggctgtcggctggggactggggctcggagctgcgagctggcatgtgcctgtgatcgctactcgctactggcagctgcagtgtgcaccgggccggccatggcggagagccgggtgtggttggcgacgtgtcctgtatcgctctctctctctgtgtgtgggttcagatttgatgtgctagcggctggtccatgaatgcggttctcggagcagactacgaacaacagaacaaggcaacagctaatcaagccggtttgatctaaacgcggtctcatcggtacgtgctcagtagatagaggagaagaagaggtagcagagagagatggataccaacctgattaccgcaagatgctgccgctcgtcctcgtctcaaggactctgaagagcaaaaaaaagggaaaaaagaggtcaatgaacttactttgagagcgtaaatggcagtgaaacgaagctcaatccggtgctagacgacgactgcagactgctgcgtgcgtaaagaacacggcatgacgaagcaagcaactagcgaatgaaccttgacaaacatgaactacggatgagaaacgtgtcacaccaataactaactatgcaagagcaggtcactcgagagaacccacccagaaaaagtttccgaaatgcggcaaacatctgcataggagtgagaacacctttcttgattcgttacctgaacggagcaacacagtactccccctgcagccgctgccgctgccactgcaagcccaggaccgaacgccgcacaggcagatggcaacggcgacgcacaaccccgccagctttagcatggatctgccacaccacctccacctctgcatctgcctctgcctcccccgggagcactccatggtctgcagggaaactcctctttttcaagccgccgcagcaaactgtgtagaggcggacgtcggcaggcaaccaaatctaggaaaccgagaggcacgggggagggcgtgcgctcgcgctgcgcaccttcactgctgcattgtaatatagagccccccgcctctagctgcgtccctctcccgctcaaacctcagcgcggctacctcaggcaacctgatcgtcaagtttaatggatcagcgagaagccg

SEQ ID NO: 5299 - DNA, 1450 bp, Zea mays
agagaaaaatttgaaaagatcgattacgaacactctgaacagattatacggacacgtgcaggtgtgggccgcatcaggtctcgtctcagcctctcatcaggcgcgctctctcagctcgcatccctcttcgatccagcacgcgctgacgccccgtacggcacgtgctcgtggtagggccgtgcgaattccagcgcgcggcacggaaaaagacatgcagtctctcagtatcccagccggcagccggtcagtgtgcctgtggtaggtcaccacgcgcgctgcagagcgcagatcccgcccatgcgcgcggcgaggaccacgacgacaccgcgcgcaggcgagaggcacccggcccggcgcaataatgcagcgccggccccagcggccggcgctctcgagagattcttcaccggctggccgcctccttgctcgctcatgggctcatggcatgtagagccggttgcccgcacttgcacctccacgcctccgggtagtattcggtggtgacaggcacgcccggcggcacggccacgtgcaccgggtagcacgggctgcagtcgccgcacttggacgtgcaccgtggcgggtatgaccccggaccgtccgccagcagccgccgccattgcccagtcgtgtagcacccctgattaccgcaagatgctgccgctcgtcctcgtctcaaggactctgaacggagcaacacagtactccccctgcagccgctgccgctgccactgcaagcccaggaccgaacgccgcacaggcagatggcaacggcgacgcacaaccccgccagctttagcatggatctgccacaccacctccacctctgcatctgcctctgcctcccccgggagcactccatggtctgcagggaaactcctctttttcaagccgccgcagcaaactgtgtagaggcggacgtcggcaggcaaccaaatctaggaaaccgagaggcacgggggagggcgtgcgctcgcgctgcgcaccttcactgctgcattgtaatatagagccccccgcctctagctgcgtccctctcccgctcaaacctcagcgcggctacctcaggcaacctgatcgtcaagtttaatggatcagcgagaagccgagaaggaggcactgtgcacggccatactacaggaggctagtacagaagaggccggagagcacgcaggcagaggggcagtagccagtagctgcgtacactgactcaagtagtgcacgtgctagcagcctcgcatcctccacctctcggctctcgcctcctcacccgtcacttcaggtagacttctaggagtagttgtgtgtgtctggggtggggtgactgctcggtgccggctactgctagagatccatgtcaatcggcgtcaccaaatgctactactgccgctgccggaccggatggatactcatcttttcgattaggatgttctaggtaatggtctcgtgc

SEQ ID NO: 5300 - DNA, 1588 bp, Zea mays
tgcatgcctgcagaatgtcaaacacacttatctaagggctagtttgggaaacccattttttcaagagtttttcatttttctaaggaaaattagttcattttttttgggaaattagaaatcccatggaaaaatggggggccaaactaaccctaaacatatgattatcaggcggaaactgaaaaatttcccggtgcgtcccatccctgccattattttttccatgtgatgtgaggaaaagcaagatgcgacgaagctagttgttatcatgcatgatatatatcacctactttggtcttgcccccagaacagtttgcctgcttttctttttttcttcttcttaaatcatataaacccggccatcgcataccatgttccgagtaaactattcggattattccttgtatcctgatcgtcggttactttatagcgatatcatttgcgatttaaattggtttgggttaggtaggggtgctagtggcgcggggaaaaggtgtgtattagaataatcaggagggtgggggcagatataagtatagagatatcgacaggaataatcagcctctttatccttccgaaaggctatcaccctactcttatatttactaccagtcagcagacaaaaacataatttgtggcaggaagtaaaactggtagtggagctgtgtggttggtcgctggtcggtcagtcagtcagtcagagaagaaattctgggagtagaattgcaacttaataggagtattcagaccagaacgccaagcgggtaatgacgctgtcagttgtttgttggacttggacattgttttggaattggacggcaatcacggagcagtacctgatcaaggcagccatccgccacctgctcctgcggctgcgactcgtcgccggagcccgtgctcccgcccccgtgcttcggctcagctacctgcagcagcagctgctgctgctgcgccttccgggtcttctcctccttcttggcctgcagcgccttggcgacctcggcgacggtgatgaggcggtacgcctggccgagcaccagcgtgtcccggggcttgagcagcttcacgcgcgtcacgcgcgcggcgccgtgcctctgctgctcctgctcccgctgctgctgggaccgcttcccctcgtcgccggcgcccgcgcggtgcgtcacgagcgccacgtagtggcctgggttggcgcgcatgacctcggcggcgctggtggcccagtacaggcgctggacgcggccgcccgggtgctgcaccaccgccgtcgccgcctccgccgcctggcagttgcccatcctcgctcgatcggtgatccctgctcctctgccgcgccgtggcgtgggccgtgggtgtgcagcgcaggggaggggacgcaggcacgcacaagtttggtgctggcggcggccgcgagcgagcggttttatgatttatgatgaagcggcggtgggcgcgggcggtgggtgggcagactgcctgtggcctgtggggtactagcgacttactgagacggcgctccacggacggatccagatccagcggcatccattgcctcaccgcgcgctggtaccggcccgcatcggcgtttttattt

SEQ ID NO: 5301 - DNA, 524 bp, Zea mays
cctgcggctgcaactcgtcgccggagcccgtgctcccgccgccgtgcttcggctcagctacctgcagcagcagctgctgctgcgccttccgggtcttctcctccttcttggcctgcagcgccttggcgacctcggcgacggtgatgaggcggtacgcctggccgagcaccagcgtgtcccggggcttgagcagcttcacgcgcgtcacgcgcgcggcgccgtgcctctgctgctcctgctcccgctgctgctgggaccgcttcccctcgtcgccggcgcccgcgcggtgcgtcacgagcgccacgtagtggcctgggttggcgcgcatgacctcggcggcgctggtggcccagtacaggcgctggacgcggccgcccgggtgctgcaccaccgccgccgccgcctccgccgcctggcagttgcccatcctcgctcgatcgctgatccctgctcctctgccgcgccgtggcgtgggtgtgcagcgcagggggaggggacgcagacgcaggcacgcacaagttttt

SEQ ID NO: 5302 - DNA, 1528 bp, Zea mays
gcacgagaccattacctagaacatcctaatcgaaaagagaaactggcagcgcggcactcgctcgtctgcccattgccctgccgtgtcgacgcagattgatccggtctgatccatcaccgtggcgtagcccagctccgccttgtcgtcgtgggcgcgttcatggcggtccggctggaccctggctctttgaggatagcagtcgctcctgctgaattttgcacatcatcaccgtcagcatcggcatcgtcatcaccatcaccacagctctgcacttccccaaactggaccatcgatgtctcggacgtccgaactatcaaggtgaccaacgtgcctctctcggcgaccgcggagaacatgaaggagttcttctccttctccggcgagatcgagtacgtcgagatgcgaagggactcggagacgtctcaggttgcttatgtcaccttcaaggagttccatggagccgatacagctctgctgctctctggatcaagcatgtgtggcgatgtttccgtgaacatcgcaccggtggaagactacgaactgccaccggaagcgtactcccatgcaggagcaaggtctccgggtccgggaacgccgacgggggaggccgtgaagaaggcggaggaggtggtgagcaccatgctggccaggggcttcgtgctgagcaaggacgcgctgcggcgcgcacagtccttcgacggccggcaccagcagctgctgtccacggccacggcgcgggtggcgtcgctggaccgccgcctgggcctcagcgacaagttcagcctcggcacggccgcggcccgcggcgcggcgcgcggcgtcgacgagcgcttccaggtcacggagcgcgcctggggggccttctcggcggccggggaggtcgtggccggcagcccctacgcgtcccgcggcgccgcctgggtgtcggcggccgtcggcgccgtcgcccgggccgcgtccgacgtcggcgccatgaccatggagaaggtgggcagggccgaggaggagggggaggcctcggcggcggagcatggtcactacgcgtcgtcccgtgtcgacgtgcacgacggacagggaggtgcagctcagcacggtgaccataataaggcaatgtgataaaagtagtagcgcgcacgagtatgaatccataaacgttttttttttgaaaaataatatagaaatgtaactgcatgcatctgtccgattattttgacacaataaattctatatccttatcggtttgaaataagttcagattaattttggccgaaaaaaaatgtttataaaaagaaaaaaaaaaaaaaaagatcttctgcattttagagagagaaaatggcacgaaattttattaaacggtttcaatggagacctgtcttgttattagaggactgatttttttttagcttatcaatcacttagatgttgtagacaatgaatgttgatcgaacaacttagattagtttatttaggtaaaatatgtccctctccctgttcaaacagcgtaacggcctaacgggcctgctgcctg

SEQ ID NO: 5303 - DNA, 1070 bp, Zea mays
agagaaactggcagcgcggcactcgctcgtctgcccattgccctgccgtgtcgacgcagattgatccggtccgatccatcaccgtggcgtagcccagctccgccttgtcgtcgtgggcgcgttcatggcggtccgaactatcaaggtgaccaacgtgcctctctcggcgaccgcggagaacatgaaggagttcttctccttctccggcgagatcgagtacgtcgagatgcgaagggactcggagacgtctcaggttgcttatgtcaccttcaaggagttccatggagccgatacagctctgctgctctctggatcaagcatgtgtggcgatgtttccgtgaacatcgcgccggtggaagactacgaactgccaccggaagcgtactcccatgcaggagcaaggtctccgggtccgggaacgccgacgggggaggccgtgaagaaggcggaggaggtggtgagcaccatgctggccaggggcttcgtgctgagcaaggacgcgctgcggcgcgcacagtccttcgacggccggcaccagcagctgctgtccacggccacggcgcgggtggcgtcgctggaccgccgcctgggcctcagcgacaagttcagcctcggcacggccgcggcccgcggcgcggcgcgcggcgtcgacgagcgcttccaggtcacggagcgcgcctggggggccttctcggcggccggggaggtcgtggccggcagcccctacgcgtcccgcggcgccgcctgggtgtcggcggccgtcggcgccgtcgcccgggccgcgtccgacgtcggcgccatgaccatggagaaggtgggcagggccgaggaggagggggaggcctcggcggcggagcatggtcactacgcgtcgtcccgtgtcgacgtgcacgacggacagggaggtgcagctcagcacggtgaccataataaggcaatgtgataaaagtagtagcgcgcacgagtatgaatccataaacgttttttttttgaaaaataagatagaaatgtaactgcatgcatctgtccgattattttgacacaataaattctatatccttatcggtttg

SEQ ID NO: 5304 - DNA, 2426 bp, Zea mays
  misc_feature (2407)..(2407): n is a, c, g, or t
  misc_feature (2418)..(2419): n is a, c, g, or t
atttggttaccaggaactatagagtttcattgaatttttaccagttgcatgttatcaccattttgattatgtttccagtttccaccattcctagttataggtaactgaaatgtgtctcatgacttcagtaaagttattgttattatgaaaaacctcatggttttaagttggtttttttataaccgcagctatagctaaaaaaattatatatcataaactggaacaagtgatgtttcttatttgtgtatgttatggcttctttttccccctttagtcttacaatttcattctaatagcagctgctgattcacagagactgcagtcagttcaatttctgcatgttaggaagttagcaaagttgcaggaaaagaaattcactaatcatttgagctcactggttagcattttttgcgatgatgggttcagtaaagatcaattggaggcatatacactgttagattcagttttgctaggtgtgatctgttttgtggacagaaccagatacctgtttttgccttgttagcacttaagataactgcttccagctttagaacacaaaagaatcatcaccggcatggttaatgaactccagtcaagtaaacatggttgccagcactggactgaacttgtggcaaaatttggttgtgtcattctggatcagtttgataagaaaggcagagaaaccatttgtcctttcagtagcgaggcagcaatggtgatgctgaagaatgttgtatgctcatctttgcctacacttgcttcaaagagcattattcccagtgtccatcactccattgtgcatttccatgggaaatgcttagttctttgcgccaaaggaaagccaggattaaaaaatgcatttagacttccggattatatttttctggtactgaaggatatggcagggtaactaaaatctacctggtcatggtatagttcacctctagttttgtgcccatacaattgcccaaaagtaactggtctcagttcagttctctggattggatactggttcttgcagcacgtggccctcacctggaactgttcagactcatcattgtcgtctgtgatcacgtgcttgattcttcagttttgacttctgacctttggctgtagtaatcattaatgttcttaaccagtgaatggtcaagcagattttgatttgcattcaaatttgagttgtggcataaggaattaaggattgaccaaactcttgtacagttgggatgatttcactcgttttgcacaatgtttattagctgtttgatttgataccctaatttgcatgttgttcctactgatagaatttttggttgctcactattatatatagtttctgtcttcccattggttcattttcactgtatgtataggttgtagtggaaagggagacaggccgctctaggggatttggatttgtcacattttcagaacctcgggctgtggatgctgccattcggggaatgcataacggagaactggatggccgcaatatttctgtgaacaaagctgaacctaggaactctgatggctatggatatggtggtggtggtggtggtggttactcgtccggtggtagaggtggatatcgtagtggagctgatgtagttccagcagccagtgatgattgtttcaaatgtggccgtcctggacattgggctcgtgaatgcccttattcagatggaagtggtagaactggaaggtaggcgcccggttcaaggtatggtggtggcactggtggacgtggtgatcgctttggaggatcagatcgttttgctcgctatgatgatgatcgatatgatggtgggcgctatgtggacagcagggatacttattatggttccgggcgcgatcgctatgcaccggcagcagaacgctattctggtgacaggtacagtggtgcagatcgttatgcgtccagcggctttgccagagaaaggagctatgagagagatggagggaggtccaatggaggttactaccgtgatgaaacgaggggcactggtggctatggcagaggtggttcacgtggcggcggcggcggcgggcctgctcgctttggtgggagttaccgagataggcctgctccatacgatcgtcccagcaggggaggggcagctcgtgcttatgatgatcgttactgaggaatgtttccttgaggcagaacagagatatctgtgtatttcagctatgcactagtatttacatttgccaggttgatccttcaattccgtgctatccagcagttgcagtttgttttattgttcagtccatgagttattagtatgctggtaccgtaatctttgggcagtgtgctcctggttgattcgtcatgtttgtgtaactactttggactttgcactaaataatgaactaattccagtatggggtccttgtgtgaattaangatcttctgtnntatgctt

SEQ ID NO: 5305 - DNA, 1297 bp, Zea mays
cattgggtacctcgggcccccccatcgtctgctggcatcgttccattctcctctaaaccctagccgcctagcgcctcgatctgagcagcctgtctcgcggaggtagttctggttgatttggtcctagatggcggaggaaaaagtggggcggatcttcgtcggcgggctgtcgtggaacaccacggagcgcacgctcgagcgcaccttcggtcagtacggcaaggtcatcgaggctcaggttgtagtggaaagggagacaggccgctctaggggatttggatttgtcacattttcagaacctcgggctgtggatgctgccattcggggaatgcataacggagaactggatggccgcaatatttctgtgaacaaagctgaacctaggaactctgatggctatggatatggtggtggtggtggtggtggttactcgtccggtggtagaggtggatatcgtagtggagctgatgtagttccagcagccagtgatgattgtttcaaatgtggccgtcctggacattgggctcgtgaatgcccttattcagatggaagtggtagaactggaaggtattctcccggttcaaggtatggtggtggcactggtggacgtggtgatcgctttggaggatcagatcgttttgctcgctatgatgatgatcgatatgatggtgggcgctatgtggacagcagggatacttattatggttctgggcgcgatcgctatgcaccggcagcagaacgctattctggtgacaggtacagtggtgcagatcgatatgcgtccagcggctttgccagagaaaggagctatgagagagatggagggaggtccaatggaggttactaccgtgatgaaccgaggggcactggtggctatggcaaaggtggttcacgtggcggcggcggcggtgggcctgctcgctttggtgggagttaccgagataggcctgctccatacgatcgtcccagcaggggaggagcagctcgtgcttatgatgatcgttactgaagaatgttcccctgaggcagaacagagatatctgtgtatttcagctatgcactagtatttacatttgccagcttgatccttcaattccgtgttatccagcagttgcagtttgttttattagtcccccaacaaccccctcagtccatgggttattaatatgctggtaccgtaatctttaggcagtgtgctcctggttgattcgtcatgtttgtgtaactactttggagtttgcactaaataatgaactaatcccagtaaaaaaaaaaaaaaaaccccccccacaacccc

SEQ ID NO: 5306 - DNA, 1855 bp, Zea mays
caaaagagatcgattcggcacgactaacggagaactggatggcctggatatcgtagtggagctgatgtagttccagcagccagtgatgattgtttcaaatgtggccgtcctggacattgggctcgtgaatgcccttattcagatggaagtggtagaactggaaggtattctcccggttcaaggtatggtggtggcactggtggacgtggtgatcgctttggaggatcagatcgttttgctcgctatgatgatgatcgatatgatggtgggcgctatgtggacagcagggatacttattatggttccgggcgcgatcgctatgcaccggcagcagaacgctattctggtgacaggtacagtggtgcagatcgatatgcgtccagcggctttgccagagaaaggagctatgagagagatggagggaggtccaatggaggttactaccgtgatgaaccgaggggcactggtggctatggcagaggtggttcacgtggcggcggcggcggtgggcctgctcgctttggtgggagttaccgagataggcctgctccatacgatcgtcccagcaggggaggagcagctcgtgcttatgatgatcgttactgaagaatgttcccctgaggcagaacagagatatctgtgtatttcagctatgcactagtatttacatttgccagcttgatccttcaattccgtgttatccagcagttgcagtttgttttattagtctatgaagacaatggttcagtccatgggttattaatatgctggtaccgtaatctttaggcagtgtgctcctggttgattcgtcatgtttgtgtaactactttggagtttgcactaaataatgaactaattccagtatgtggtctttgaattggacttctgttatgcttaccgagaaaactgtgccacgttttgcaccgtagttgaacatggcatcaatactgagatgtgatgtgcggcaatgtgcagatctgcggaaaatgaaagtctgctctgatatttatttatttgccaggcagtgtccaatctgttcagatgttgttgctattgggtttgcctatataaaatcggaaaggcgtgattctgatttatgcaggcaggtgatggtttgttgtgatattttcctgcagcagacatgcatttggtctactcaagtttgctagcaatgtctagggcagatccgcagatgtgatgtatcggcttgtttgctttgttttctggcttgcagctgctgctcgtggtgaaaagttctcaaattcatgctggatccaatgtagttgcgagttgccctggaaaaatttctgttgcctgttccattttattttaaattttcgttgaagggttattcgttgaagattatagcgtcatcttcacagttaaactcaattgggttcagctggttattcgttgaggatgttttggacacgagagagagatatgtgttcagcaaacaagcgatggtaccctacgaccagaagttacagtattgaagttcaatattgaagtgcaagtaaaatacgctcttttgttggttttgtcacgcacaaagtgcaataaacgcctaactagctactgaggaaagtaacgaatttctctgtagctagtttggcaaacccattttctctatggatttttattttctcaaggaaaactaatttattttttcttgagaaaatgaaattttcttataaaaatggggcaaactagccctaaagtaccgatttcccccctgaatttatccgttcatttgttcccacaccaaccgtacctacagcgcaacatcaagtttcagtgcttgccaattggcgctagcagatgtcggcctaatgagcaaggttcatatgctgca

SEQ ID NO: 5307 - DNA, 1135 bp, Zea mays
ccggccgggggtattgcattgggccccgccggcccggccgggaccttcacccaccgcccggcgcccgccatgtattcggccaaccactggggcggctcgttcgagatcgccgatggggcggcggaggatgaccacagccgcaacatggacctggaccgcggcgcgctgtcggcgcggcagcaccacgagctggacgagacgcagcagagctggctgctaggcccgccggaggccaagaagaaggacaagtacgtggacctcggttgtgtcgtcgtcaagcgcaagctcctctggtgggccttgtggtgcgtcgtcgccgctttcgtcctcatcggcctccccatcatcatcgccaagtccatcccgcacaagaagccaggcccgccgccgccagatcagtacacagaggcgctgcacaaggcgctcctcttcttcaacgcccagaaatccggccaccttcccaagaacaatggcatcaagtggcgcgggaactctggcctgtcagacggctccgacgccaaggacgtcaagggtggcctcgtcggcggctactacgacgctggcgacaacatcaagttccacttcccgatggccttctccatgacgctgctgagctggtcggtgatcgagtacagcgccaagtacaaggccatgggggagtatgaccatgtcagggagctcatcaagtggggcaccgactatctgctactcaccttcaactcctctgcttccaccatcgacaagttatacgcccaggtgggtgctgctaagatcaacggcagccggccggacgaccattactgctggaaccggccggaggacatggcgtaccctcgcccttcactgtccgtgagctccgcccctgatctggggtggcgaggtcgccgctgcacttgcggctgcctccatcgtgttccgtgacaacgccgcctactccaagaagctcagccagggcgcggccaccgtgtacaagttcgcgcggcagtcggggcggcgcaccccctactcgctccggcagccggacatcgagtactactacaactccaccagctactgggacgagtacatgtggagcgccggggtggatgtactacgccactgggcacagcagctacatcacctttcgcaccgaccc

SEQ ID NO: 5308 - DNA, 957 bp, Zea mays
gtcaactaccccatcctaatcttcaaaccgtgcggggcgcggcggggccgggggcgacatcgccgtccccgtccatgcgccgctgaccgcgcgcgccatcaaagccaattacccagccatctagctatcagccatgtattcggccaaccactggggcggctcgttcgagatcgccgatggcgcggcggaggacgaccacagccgcaacatggacctggaccgcggcgcgctctcggcgcggcagcaccacgagctggacgagacccagcagagctggctgctgggcccgccggaggccaagaagaaggacaagtacgtggacctcggttgcatcgtcgtcaagcgcaagatgctctggtgggccttgtggtgcgtcgtcgccgctttcgtcctcatcggcctccccatcatcatcgccaagtccatcccgcacaagaagccaggcccgccgccgccagatcagtacacagatgcgctgcacaaggcgctcctcttcttcaatgcccagaaatccggccaccttcccaagaacaatggcatcaagtggcgcgggaactctggcctgtcagacggctccgacgccaaggacgtcaagggtggcctcgtcggcggctactacgacgctggcgacaacatcaagttccacttcccgatggccttctccatgacgctgctgagctggtcggtgatcgagtacagcgccaagtacaaggccatgggggagtatgaccatgtcagggagctcatcaagtggggcaccgactatctgctgctcaccttcaactcatctgcttccaccatcgacaagttatacgctcaggtgggtactgctaagatcaacggcagccggccggacgaccattactgctggaaccggccggaggacatggcatatcctcgcccttcactgtccgtgagctccgcccctgatctgggtggcgaggtcgccgctgccct

SEQ ID NO: 5309 - DNA, 808 bp, Zea mays
  misc_feature (747)..(747): n is a, c, g, or t
cgcggacagctccctaccccggtggcccggtcacctcaccttcacccaccgcccggcgcccgccatgtattcggccaaccactggggcggctcgttcgagatcgccgatggggcggcggaggatgaccacagccgcaacatggacctggaccgcggcgcgctgtcggcgcggcagcaccacgagctggacgagacgcagcagagctggctgctaggcccgccggaggccaagaagaaggacaagtacgtggacctcggttgtgtcgtcgtcaagcgcaagctcctctggtgggccttgtggtgcgtcgtcgccgctttcgtcctcatcggcctccccatcatcatcgccaagtccatcccgcacaagaagccaggcccgccgccgccagatcagtacacagaggcgctgcacaaggcgctcctcttcttcaacgcccagaaatccggccaccttcccaagaacaatggcatcaagtggcgcgggaactctggcctgtcagacggctccgacgccaaggacgtcaagggtggcctcgtcggcggctactacgacgctggcgacaacatcaagttccacttcccgatggccttctccatgacgctgctgagctggtcggtgatcgagtacagcgccaagtacaaggccatggggggagtatgaccatgtcagggagctcatcaagtggggcaccgactatctgctactcaccttcaactcctctgcttccaccatcgacaagtatacgncccaggtgggtgctgctaagatcaacggcagccggccggacgaccattactgctggaaccg

SEQ ID NO: 5310 - DNA, 913 bp, Zea mays
gccggccggtttccggattgcatttgcacggaaaagagacgctttttaattcggcaccgacagtgccagctgcgcctccacgggaaggccagcaccgtcggcgggtcaaccacccacccccgcctggccgcctcctcttgaaaactccctaccccggtggcccggtcacctcaccttcacccaccgcccggcgcccgccatgtattcggccaaccactggggcggctcgttcgagatcgccgatggggcggcggaggatgaccacagccgcaacatggacctggaccgcggcgcgctgtcggcgcggcagcaccacgagctggacgagacgcagcagagctggctgctaggcccgccggaggccaagaagaaggacaagtacgtggacctcggttgtgtcgtcgtcaagcgcaagctcctctggtgggccttgtggtgcgtcgtcgccgctttcgtcctcatcggcctccccatcatcatcgccaagtccatcccgcacaagaagccaggcccgccgccgccagatcagtacacagaggcgctgcacaaggcgctcctcttcttcaacgcccagaaatccggccaccttcccaagaacaatggcatcaagtggcgcgggaactctggcctgtcagacggctccgacgccaaggacgtcaagggtggcctcgtcggcggctactacgacgctggcgacaacatcaagttccacttcccgatggccttctccatgacgctgctgagctggtcggtgatcgagtacagcgccaagtacaagggcatggggggagtatgaccatgtcagggagctcatcaagtggggcaccgactatctgctactcaccttcaactcctctgcttccaccatcgacagtataccgccccagtgggtgctgctaaatcacggcagccg

SEQ ID NO: 5311 - DNA, 3271 bp, Zea mays
ctgcaaccctacaaatggaatgtttgccaagctcgctgtcatgtcatgtcagtagcactcacgttcagtgtgaccgtagtccgcgtatctcgctcgccgaatgcagctctgttgcagcagcctgtgcaccttgattccattggctggtctatactctatacgcgttgacggttgatcatcttgccacgtatattctccttgtctgatgaggacacgtgtgtaattgtgccgcctcttcttggtgacagccggccggattccgaggaacaacggcatcccgtggcgtggagactctggcctcaaggacggctccgacgctaaggacgtgaagggcggcctcgtcggcggttactacgacgccggggacaacatcaagttccacttcccgatggccttctccatgacgctgctgagctggtcagtgatcgagtacagcgccaagtacaaggccgtggaggagcacgaccatgtcagggagctcatcaagtggggcaccgactatctgctgcgcaccttcaactcctccgcttccacgatcggccacgtctacgctcaggtagtaactaatgatcgcacgtccacaaagaatcggtcgtcacgtattgttgatctggactggttcgtgtgcttcgctgcaggtgggtgcggcaaagatcaagagcaggacaccggacgaccactactgctggaaccggccggaggacatggcgtaccctcggccgtccctggaggtgagctcggctcccgaccttggaggggagatcgccgcggccctggcggccgcctccatcgccttccgcgacgacaacgacgcctactctaagaagctcgtccgcagcgcggtcaccatgttcgagttcgccacccgcgactgggcggacgagcacgccacctactccaggcaccagccggaggtcgagcccttctacaactccaccagctactgggacgagtacgtctgggccgccgcgtggatgtactacgccaccggcaacgccagctacgtcagcttcgccaccgaccctcgcctcgccgagcgcgccagggccttctacgacgacgtgctcgacttctccgtgttcagctgggacaacaagctccctggcgccggcctgctcctgtcgcggctgcgcatgttcctcaaccccggctacccctacgagcagtccctcgtccgctaccatatggagaccggcctcgacatgtgcaagtacctccggcgcttcggggccttcaacttcaccgggggcgggctcgcgctcttcaaccacggcagggggcagccgctgcagtacgtggtcgccaactccttcctcgccgcgctcttcgccgactacatggaggcgatcaacgtccccgggtggtactgcggacccaacttcatgcccattgaggacctccgtgcgttcgccaagtctcaggtaacatatggagactggagcatgcatggtggcgttctctctagctgtaggctgtagctggtttgtgacaatggcgcgtctgtgatccgttattccatgattgggcagctcaactacatccttggggacaacccgaggaagacgagctacgtggtgggcttcggcaacaagtaccctcggcatgtccaccaccggggcgcgtcgacgccgcacagccgcgtcaagtactcgtgcaccggcgggtacaggtggcgcgacaccaagaaggcggacccgaacgtgatcacgggcgcgatggtgggcgggccggaccgcaacgacaggttcaacgactcgcgcatggcctttgggcacaccgagccgactctggtgggcaacgccggcctcgtggcggcgctggtggccatcaccagcagcggccgcggcgtcggagccgtcgacaagaacagcatgttctccgcggtgcagccgctgttcccggccaccccacctccgccgcccgtgtggaagccttgagagatctcgtgggatagaaagcttatcctagcatctctcaaataaaaacagagaaattcttgcttccttggttcaaccaggagattactccaaaacacaaaccttgtgttgttgtttttcctaaaacgctagcgtttcatacccccgagggtgtctaacagaaacgctagcagattgaatgaaagtatacagtcaccacaacaatgacacgatggcaaggtctagccaccagtgtcacaaatattggtgactattatcaccaaacacaagctgaggactctctttcaatccctactacatactgaaagacggatacaaaaagtgaaaaaaaaaactaagagttggaatgaagttcaagagggattttcagccctactgcctggccaaccacggataaccatgccggtaaatattgcaccgagtgctccttatcagtcgcttcagtttcttcgagaagtagcttcatccaaccactggttgcacaggggtgcagggccagccatggcttgcttaaatgggggtgctcctcttgagtaataaacgtccactttgattcacttaatactttctgtgagtgggaaggaagaccctcttttacctcatctagagttagtagctgcccacatactagtgtgataaccacgaaagtatagcactgggactttgtaggagaagctgtagacagcatggaaatcataaacatgaacattgtcgctggagctctcgacccaagctacatcccctgcaccatcgaacttcatctcttcgatctgctcctggcttgttccacagctgcggtacactctttccagggctagatacccttctacctccgacggcacccccaatttgctgcacggcttccacgtccattcaggaagggaatcgtcgacctcgatctccttccacctcttaacaagcgccgccgcggaggtgttgaagctgtccggagacagagtcccgtcccatacaggggagcctcccatcgcgaagcaggggaagacgcagcgcgggcaaaggccgtccaccagtcttccactgtggagtcgctaagctcccaaactcccgaggccgggcgccaaaatccgcagccgctctacctgatttgcccacgacccggcgtcaaaatcagaaggttggggaatggggaactgatggagggtttgcgactctcgctggagatgaagctctccctcagctgccgggccggttgcgggtcctcggcgtcggcgccgggatgcgtcacgcagaacacggtctgtacgttgattgcggctgtcgtcgtctctagcgtcgagcggctagatcgaaagtccgtgcgctcgtggtggact

SEQ ID NO: 5312 - DNA, 1352 bp, Zea mays
  misc_feature (1341)..(1341): n is a, c, g, or t
ttgagccgttaatgcaataacttttttttggcagctcgcacttccccaagcccaagttcagacgctcgagctgttctcttctttttttacacaacagaaacttgtgcgttgagaaagcttgaacaatccacagacaaaattacatggtcacaccatgacacactcgatcaaaacagccactacgacagatgcaacgattcaaggcggggtgacattagcaatctctagcacaaaggcgtggcagcacacagatctcagagcctctgcttctcgatgtgaaccaatttcactgaatggtccttgggactcgcatcccgaacccacgcttcatcttctccaccgttggtgcgagtttaccaaggcaataaagctcttcaccggatacttcgtcggatactttaccagaaatctcaactctgtatgatctatcaggagaatcaggaagccctcgacccacaagtaaatccaagtccttctggtgaagttctcggctgttgatgaacacaccagtatttccgccagcacagttcttaggcataggatagttaaattctgcaatgtatgggggtatcatgccaaggcagggctgtcctatgacaccccagaatccagcacggtagtcataccagtattcacccggatagattggtccagcaatcttctccgccttcctcacagcacgatcagaaatgggatagccattgatgaacacctttgctctgccattgcccatcccaccgttaattttaaagctcttttttatcaggctggagaaaaaggagtcgcccgattttgtggcccttgggtgatcgacgcattgtgctccgtcacctggatcttgattgtactcaggatcatcaaactcatcatctgatgggtctagcacgcttgctacaggtacatctttcactttgtttggcttaaaactttcagttaacacacccttctcatgttcagaccgggtgcttctgcttcctttgcctgacccatcaaccaccatctctgatggagaatatccaaaatgatcacgaagaggcaaacttggaacacgtataaccacttcagcatcaggaggaaggtctctagatccagagttcttctgtgagttagaactagctcggctattatcatcctcagaaatgctggcggaagatgatatgcattgcattttgtctgcttcactggaattcgatggtaaatctttttcttgttttcgattaggatgttctaggtaatggtctcgtgcgaattcctgcagcccgggggatccactagttctagagcggccgccaccgcggtggagctccagcttttgttccctttagtgagggttaattgcgngcttggcgtag

SEQ ID NO: 5313 - DNA, 4927 bp, Zea mays
tgaactaacctgtaaggcccatgtctaagtgttttactaagtgcactttgttcctaggtgctggacagaggagggcttgtttttggaggagaatagaacataattacactactcagaagtcactagcacatccagttcaaacactacaaagtattgaaaggaaggtgggccaacataaaagaaccagtcaacaagtttgagagccaatacatgtcaattcttcatgaaatcgtagtggcttcaatgatacaggtaaagtaagttgtatttatgtacaaagaacattacatttgtgttgtatatatactagtattctcatgtagtacaatggtactaatgcatttcgtattctcttgttgtaggtaagtcctgcaataaacatgtacaacaacattgaaaggaagccaacgacaaccagacattgttgagaaattcttcgtaacgagcccaagtggttagacttgcagagcaaaggtactcaagaacatggtagaggtggtcaagagactcccattgatgtaggagacttaggagctacaaatgacgatagtgagctttagaatcggggaccaaagagacccatgggaagggatgcagcgaaagcttcgaaacgcacgacctccactccatttggaagccaatcaagttctgagtacaccagtttgttgtcaaacttgtagctagagaggattggagcctacaaagaagtggagggggctatggatgcaaacattaagtatatgataacagctcaggaaaaaacattcaagcaaaaatagaggatggcaaaccagctagtggagttaaagaagaagtgggatgcacaagcagctaaagaagaagtgtgtatcatgtccattgatctaagtagcctaaatccgacacagagggcttactatgaagttaagcaacgtcgatatctagagcatgtggcgcatgaagacgagaactaattattatgtttagggtttaccattgctatatggattcatggtaaattgagaactattatttgggtgtatgttcggagaactataagtggctcaaccactactttgccaatgtgcgtgagttgagactttatgcatttatttgaagtttgaaataagtacttaatgttttccgctgcataacaacaaagcattacatatcagatgttgcatatatatcatttgatggatgaggcacttaagtgttaccgaacatagaccacacgtgctcgatagaatcatgcatgagcatataatgtgtgtccctatcgcgaagcttatggtgagcagctatgaactcatgatgctcacgaactaaagtggtagtagttgcaccggagttccatcctatcatacacaaatgggaggttggatccacgctcgtcctcgataatcatgttgtgtagtatgatgcaggtattcattttgttcttaagattatcccgatcccattcgtaggcaggaccacagatgaccgcccatctagcttacaacaccccaaaagcccgctctttatcttttcttgctccttcctgtacatgtgcaaactgacgatcctttttagtgatcaggtgctgccacccacaaggtaatatccaatattgtaggtgtttccatttatctagaaatggacgagtggattctcgttgctaatctagttgtgaaatagaggtgagtgatgcaacatgtttatatcattattgcttcatggcaccccgaagagttttttttaagaatatcgatttctagataatctaatcgtcacaagaatctagagatcatatcataggacttgcctatagaggaagatggagaactctacatgatttaggtttagaaaagacacgacatattctacattcacattgatttaggcattttttttataaaattatcgcaatttttgtataaatgattatcacagaataaggctgaggaaacaaagtgtttggacaacagaagccgatagaaatagaccgagaaacaaagagttggacaccagaagccgattctcacgactacaagccaaaacaaataggcctaaaatataccctggacggaggtgcctgggctgggcttcggcacaagataaagaaaagaatccgtgcttgagccgttaatgcaataacttttttttggcagctcgcacttccccaagcccaagttcagacgcactagcagtaaagttcgtagactacacaacagaaacttgtgcgttgagaaagcttgaacaatccacagacaaaattacatggtcacaccatgacacactcgatcaaaacagccactacgacagatgcaacgattcaaggcggggtgacattagcaatctctagcacaaaggcgtggcagcacacagatctcagagcctctgcttctcgatgtgaaccaatttcactgaatggtccttgggactcgcatcccgaacccacgcttcatcttctccaccctgttttccaatggcaattacaaaatatgagtttgatcaaatatactcagacccacctcaactaacacaaggaaactccaacgcaaacaaaaattcaagaaactggagcttgtttaagttacttacgttggtgcgagtttaccaaggcaataaagctcttcaccggatacttcgtcggatactttaccagaaatctcaactctgtatgatctatcaggagaatcaggaagccctcgacccacaagtaaatccaagtccttctggtgaagttctcggctgttgatgaacacaccagtatttccgccagcacagttcttaggcataggatagttaaattctgcaatgtatggctgcaacaaacaaggaaaccaggttaaaatctttgatcaatatatgactaggatgcgataacacaccaagtcaagtaaaagctctcttacgggtatcatgccaaggcagggctgtcctatgacaccccagaatccagcacggtagtcatacctagaggatacaagaataaaaatgtcaagtaacattccagccacagatcactacagaaccctagagcagaactaggatgttaccaggaaactttaaaaaaaaatcaaatgcatacagaaggcacttcataccagtattcacccggatagattggtccagcaatcttctccgccttcctcacagcacgatcagaaatgggatagccattgatgaacacctttgctctgccattgcccatcccaccgttaattttaaagctcttttttatcaggctggagaaaaaggagtcgcccgattttgtggcccttgggtgatcgacgcattgtgctccgtcacctggatcttgactgtactcaggatcatcaaactcatcatctgatgggtctagcacgcttgctacaggtacatctttcactttgtttggcttaaaactttcagttaacacacccttctcatgttcagaccgggtgcttctgcttcctttgcctgacccatcaaccaccatctctgatggagaatatccaaaatgatcacgaagaggcaaacttggaacacggataaccacttcagcatcaggaggaaggtctctagatccagagttcttctgtgagttagaactagctcggctattatcatcctcagaaatgctggcggaagatgatatgcattgcattttgtctgcttcactggaattcgatggtaaatctttttcttgagagaaatgactgcctgcagaaaagctataagatggaagaagtctctcgtcagcattttgtccattgcttccttggccattgttggagtaatttttacttccaggtgataagtgtgaaactggtgtaggtgctgaaacatcaagcctgtttccatcaagtctgaccacaattgcatgtgaacatgacccacagcgcagcttgtactcatcttttcccagcatgagagaattcttgggaagatgcagtacttcatagcaattgtagcatatggtaaaaggggcaccattggcaattggttcacaagtctgtgcaggttttttactcagggtgtccctcagatgattgtgtcgcatcagaccattaatacctcttggattgtagttctgtgcaccaaacaccaccgggccttctacagggttgttcataagatatggtgccctgcgatggttgaaacccagtggagccccatgaacaggtaataattcacgatggtaacaatgtaagcaagagcaagcaggctgatggtagaagccgtcatggtgataagagatcagagggtcaggatcatactgtccatggaaatagttatcgaagtttctccatggataaggggcggctgggtaaataggagctcccatatgtgcaacagattgtccgtatccatggagatcttgctgtacagatactgaaggataagcaggaggaacaacaggtgcctgtccattcaaagaaggtgagcactgagaaccattacgctgcaactgaggtgaaccataccgcaatcgactcagacgctcatgaggattgtaggagcttgcaggatccaccattctatttgttgaagcattcacacttgacttgtcagcaatctcgtaggatctctgtacctggtccctcaactcatcgagcatccgcagaagctcagtacggtctttctcaaggccaccggctctggtgctaggaacatctaaattcttgtcactcagatgtcccttctcaccgctagcatatatgaatcctggttttttatgacactcagatggcccttctacagggtaagcattagaagggatgttgctaaccacaggccttggtgatctgtcacttgccctcgctggctgctttgcttctcctttctcttcaagacgaatgcggcggtattttgcctccttaacttccctgctgtcatctctaagtgcaggttcaagtttcatggtgcagttgggtgcacaagtagcatggttatcatcgaaactgaatccagattggct

SEQ ID NO: 5314 - DNA, 633 bp, Zea mays
gattttcttcacccgtccacctcgtcttgcgctcctctgtctcggcgacgactgtgctaccgccgccgccgccgcaagacttcgtcgggcactttgccggcgacgatttcccaccagcccaacaggatcagaggaggtgatggcgaggagtgacagctgcctggcgcgcgtgggtgccggaattgctatccggtggcgcggtcggcggagccgtcggtaaccttcgtccctaaacccctaaacactaggcttgcagcatcaatccgtccgtgcgagccgcttcacccgtcggtgtttttttttttgggttggaagtagattagtgtgcgatttcaggaatcttctcgagctagctagtagctacatccctggtttgtgtggttagctagcggcagatgtaataactaggtggcttttgttaagagttactagtgcttaggtagcatcatctgggaggtggaagatatcgatgctcgagttgggagtttgtttgcccccaattgcttgtgctctaagggctgttgctgattcggtctggccgggggtttggttaacttcctgctggtgcttagaacttgggatggaaaatgtaagattttgcatttgcctttgatttgactgcatgaatgactc

SEQ ID NO: 5315 - DNA, 741 bp, Zea mays
  misc_feature (662)..(671): n is a, c, g, or t
ccctccgaatacctgtatgcattcccttcacgaaaacctggtgaggaatctaccaattgcttttcgtctcctgtccatcccttgtgcgctaccgctcctctcccttggcaacgacgactggcgccgccgctgccagacttcgctgggcatctcgccggcgacgagctcccaccaggattagagaaggtgatggcgaggagtgacagctgcctggcgcgcgtgggtgccggagttgcgatcggtggcgcggtcggcggagccgtcggtgcttgttatggaacttttgaggcattcagatacaagatccctggattgctaaagatcagacatatcgggcaaactactgttggcagcgctgcaatttttgggcttttcttgggggctgggagcttgattcactgcggaaaatcctactagtttgtttccctcctttttctgaacacgactttgtcgatgtgcttcagaggaggattctagattttgagcgctaccctgagtggcttcagtgaaaactattcaacgcctgtacaatttaacagctaatacctcagggttggaaagagcaatcaagttatgtcctggtttggtgtggatggaaatactccctccatttcaaattaaaataaaattcgttttaaataattaaaaaaaaaaaaaaaaannnnnnnnnnaaaacgcagctgcgcggtgcacacagagcgaactataaaacaaacgaaaaaaaaaaaaaaaaaagcggcc

SEQ ID NO: 5316 - DNA, 2761 bp, Zea mays
  misc_feature (124)..(124): n is a, c, g, or t
tcaggtccttttgggctaattatagttcaatcagctaaccagagctcactattcagaacattctgaccttttgatgtatacccagcaccagaactgaagtttaactatactttgacacattctnttgttacaggtagccagtcactacgtacatcaggtgcgctgggaacatgcagctgcagtggagatatcacacatactccctctccctctgtccctgttccgctccgttctatatttttcagttctgcttcatgctttttagctaataaacaggtctaaatccaccaactctgttctcttaaaaaatatggagtcttagtagagctgctttatgatagagtttgtgaaatagtctaaagtatcttctaaatatgtattatctcgtacttcaagaagtcaatagatcttaagtttgactagatttataataaacatagctcgtatttatatctctaaatatgtcactagaaatatttatgccgtgattaatttagtcatatctacttggtatcgtaaatatcagcatatttttatacattaatttaaatttaaaagcattggactcttcaagttacgagatgcacacttatcttttcatggatggaggtagtagtataacaaggtaccaagtacctaccaactagtcttattcatttcgtttgcactgaagaaagcacatgatcaaagaagatattgaagcagagataggtgcaggggttagatactttggtgtgccaagatttggcttcttggctactgctatttggtgagaggggcacatcaagagggcacatcggtggagagcgtgcgtgagtgccccgagctttggcttgtcttttcgataatggagtgcagacacccaagagtgtactgccgccaaattcctattgccaagtgcttggtttcagagttgtccatgtcgtcccatcgactgagtgaccgaaagcggcggaagcaaaaagttggttgttaatggtaccatcaatcttgtgatcgggttcccttcatacatatcactgaactgtgctgttatgggcttctggcattattaataaagctgattttttttttgcaggagtgcaagtatctgataacaaagcaacagtacataatatagccaaaacttcagaccagtttaattttcctctgcaagccgcttaaagaaacatgtactataaaagaaatggaggatgcatagttgtgaagaagcttcacgccttcgccttcgcctccgcaagtatccacgatatctgatattcatcttcaaggagaagatccatgtcggccatcaatcgactgaacttatctggtctatatttcccgcgcgccccggccgttgttgccagtagtgaaagttacccgccaccagcaagtgattcaaagatttaagctcacatctgacatctccctctacaattattatcgctttgatttcatcacctgcgtactgagcaagagtgagacaccggagactaagacttgatgaccatcagtaatacagttgcaggtacccctgcggatcggataagcatggggggcgccaacggaaggactcacattcaccggatgccacttgaaaaacaaaatccagccagtggatttggtgagacgtatacgtcttggatttgtaggtgaaaagcaacagcagctagctagctagcctcgatcgacctgagggactaactagagacgacggaggacctcgctcccccttttataccatccttgagtgaggccgggggctcacttcgtgctcgagctccagctcagcagcaaggcgccaaggtagcaagctctgggtcgccactactgcaatggaaggcctgattccgttggtgtaccggaccatcgtggagtacaggaaggcgaggcaccaggtcgccatcgcaagccgcctgctgtacggcgaccaccaccagcagccgtgtggttcgtcggcgctcttccgcgtcgttgaccctgcagcaagcagcagcagctggcacgccgcgtcgtcgtcgatgtccccggccacgtcgccggcggcagccagggccagcggcagcctggcgtcgccgctcctccgctcggcgtcgcgccgccagctcgcaggttagtctgctgctcgtgatgggcaacaagttcgagtggtgctttatggtatgcgaggcactgcttggggttggggtgtacaagactacaagtgtacgtattacgtactattataccaggtatattaataagccctagagagagagagagagggagagaaaaaagggtttattttgaagaataagggcagagtcagagggtggtccaaaggagcgcctcaactgatgagaagagaaggcaaagcttctgcttcaagcccagctggtggttgtatactgtgcctgtactgtaatactatcctgtagctgctgctctagtagcggccatgtattcgtattgtgtacgtgctacaggttcccagcaactgagcttgtcgttcaactgcacatatacatagcaaataaggatgtgctcaacctactcaactgtatatatatgtcacaaagagtgcaaagatatatatgtgttggcatatatatatatatatatatatatatatatatgagatgcaaaacccagtgaaacctgtaccactggcggcgagaattgtcgcaaccttaggctttgtttggatactctagatactctaatattagtttaatttacacttcaatccacctaaatacacatagattaggatgaatactagagattggataagagtatc

SEQ ID NO: 5317 - DNA, 1553 bp, Zea mays
  misc_feature (1549)..(1549): n is a, c, g, or t
  misc_feature (1551)..(1552): n is a, c, g, or t
aatttcggcacgaggccggcgtccgcttaacaccccccccacacataagaggcgacatcacatcgcgttccgccgcctcacacgctagttggagctgtagtattagccaaccagccagcctccgatctccatccatatggaggaggctgcgcccgcggcggtcatggagcgggagcgcctcacggccgagatggccttccgcggcgcggacgaagctcggcgggaaggcggcgacccggcgcccagcatcgtcatcaagatccgccgccggctcccggacttcgcccgcaacatcaagctcaagtacgtgaagctcgggatccgccacggcggcagccccacgtcgctgctgccggcgctctgcgtgccggcggtcgccgccgccgcctactcgttcgtccgcctcgacgtcatctactactccgtcgacctgctcacctgcgtcgcctggctcggcaccgcgctgctgctgctcaccgtctactacctcaagcggccccgccccgtgtacctcgtcgagttcgcgtgctacaagccggaggagcggctcaagatctccaagtcggccttcctcgagatgaccgagagcaccggctccttcaatgaggcggctctggacttccagaccaagatcaccagccgctccgcgctcggggacgagacgtacctgcccccgggcgtccaggcgcgcccgcccaggctcaacatggcggaggcgcggatggaggccgaggcggtcatgttcgggtgcctggacgcgctgttcgagtccacggggatcgacccgcgccgcgacgtgcgcatcctcatcgtcaactgcagcctcttcaacccgacgccgtcgctggcgtccatgatcatcaaccactacaggatgagggaggacgtcaagtcgttcaacctcggcggcatggggtgcagcgccggcctcatcgccgtcgacctcgccaaggacatgctccaggcgaaccccggctcgtacgccgtggtgctcagcaccgagaacatcaccctcaactggtacttcggcaacgaccgctccatgctcctctccaactgcatcttccgcatgggcggggccgccgcgctgctgtccaacaggcgcgcggacgccgggcgcgccaagtaccggctgctccacacggtgcgcacccacaagggcgccaccgacgagtgcttcaactgcgtgtaccagcgcgaggacgaggccggcaaggcgggcgtctcgctggcgcgggagctcatggcggtggccggcgacgcgctcaagaccaacatcacgacgctggggcccctggtgctgcccctgagcgagcagctcaagttcctcaggtcgctgatgatgcgccgcgtgttccgcgtcgggggcgtgcgcccctacatcccggacttccggcgcgcgttcgagcacttctgcgtgcacgccggcgggcgcgcggtgctggaggaggtgcagcgcagcctgagcctgcgggacacggacatggagcccagcaagtgctccctccaccggttcggcaacaccagcagcagctcgctgtggtacgancnng

SEQ ID NO: 5318 - DNA, 1720 bp, Zea mays
cattaggagtaataggaaaaatgctaggacttcagccacggcctggtcgcggcccaggtacttcggataagcgtgctgttactacacagcaggtaactgtattcaaggtgcaagccagtaagttgctcgctcttaacaagcggctgtttgggattaaagttggaaatttctgttacgtgaaggagggacttgttcttggtcagctcacaggaaatcgatttacaattactctgaggggtgttactgcagaatctgaagacatgataaaaattgcagtagatggcctaggaaagaatggatttatcaactactatggtttgcagcggtttggaagtggttcaataccaacacatcttgttggggctgctttgcttagaggagagtggaaggttgctgtaaacttgattcttgatccaagggaaggagagcgtgatgacatcaatgaggtgcgcaaacgttacaaagaacatggtgacattgatatggcactgagaaacttccctcgacacctcgtagctgagagggccatacttcaatgtctgaagaaatgccctggtaaccatctacaagcactcaagggtataccaagaacactgagaatgatgtacgtacatagttaccaaagttatctgtggaatcatgctgccagtatgagagtggaaaagtatggcatctcacaggttgtagaaggtgacttagtgtataacaaagaatgcccttcagaagaatcaacttccgtagatattctggaaactgatgatgaccatacaaattcaattgaaatcgatctatgttctgaagcacaaccagaagaaagcatccagtctgcgaagatagttgattctggagattttactaaggggatatacacttttgatgatgttgtcctacctttgcctggttcacaagcattgtttcctgggaatgaaattgccgagatttaccatgaaatggctagaaaggatggcattagcttgacggagaatgctcatggtgtcaaggagttttcgattacaagcatgaaaggtggttaccgccgagtgttccagcggcctattggttttgagtgggaactcataacttacacagatgatacttcatctttagcagaaactgatttggatgttctgtccagaaccaagcctaaagaagcaaacgagcttatttctaagcaggaatcgcaggataagttggaaaaggctcctgatacctctgtgccaactaatgggaatagctcccaagaaaagcttattggcagcccagatatacgaccaaagaaattggccttaaaattagcatttactttaccaacatcatgctacgctacaatggctatccgggagcttctgaagacttccacctcagttgcatatcagaaaacactcagctgctagattctgtttggaagacattccttcataggagtatctcttaattacatggctgctgcctgtcttcacggcagttagaatacctggaggactgatgaatccacaaacatgatgcattctgcacatgaggcataacaaacaatatgtcctaataagtgtttcttaggggaagaccgtgaggatgatgtattgggatatctattccgcgacatgctttgtataacataaactccatttgcaataatggaatcaacttgggttagcagtaaaaaaaaaaaacttgggatccaaaaaaaaaaaaaaaaactcgagactagttctcctcgtgc

SEQ ID NO: 5319 - DNA, 2585 bp, Zea mays
cggagtacccccacttccattatttttgtcaggcttggtcttctgctgacttgacctcacacgctcgagggcgtctgggcgtgaaacttgtttagcaactgctccctcatttccactgcaaaaccccatctccgacgttgttgccgttgtacacttgtacggtcgcgtatatatctgcgccccagtggccctccctctctctctcatcacaccaaaatcacaccaaagccagcagcaggcacgagcagcctccagagacccagtgcgttctcagagccaagcagcttgcaatataatggcgtcgtcgctcaagttcacggtgcggaggcggcccgcggcgctggtggcgccggcgtccccgacgccgcgggagctgaagcggctctcggacatcgacgaccaggacgggctgcgcttccacatccccgtcatccagttctaccgccggagcgcgctcatgggcgggcgggacccggcgccggtggtccgggacgccgtggccagggcgctcgtgcactactacccgttcgccggtcggctcagggagctggaaggccgcaagctcgccgtggagtgcacgggcgagggcgtgctgttcatcgaggccgacaccgacgtgcgcctcgaccacttcggggacgcgctgcagccgccgttcccgtgcctcgaggagctcatcttcgacgtccccggctcgtcccgaggtgctgggctcgccgctcctcctcttccaggtacgtgcgtgacggcgtccttgtactctctgctcatcctcgtttggtaccactaccatcctgcctggtttctttcttgggcacttttcgcggtgtgtgccgtacgtacgtagcatgtacacgtgcgcgcagcacgggtaaacgaacttgtgtgacgcgcatgcaggtgacgcggctggcgtgcgggggcttcatcctcggggtgcggctgcaccacacgatggcggacgcgcaggggctggtgcagttcctcgacgccgtggcggagctggcgcggggcgcggcggcaccgacggtccggccggtgtgggggcgggagctgctggaggcgcgcgacccgccgcggccggccttcgcgcaccgcgagtacgacgaggtgccggacaccaagggcaccatcatcccgctggacgacatggtgcaccgctccttcttcttcgggcgccgggaggtggcggccgtccgcgccaacctcccgccgggcctccgctcgcgcgcctccaggttcgacctcctcacggggctcctgtggaagtgccgcaccgcggcgctcgccccggacgccgacgaggtgatgcggatgatctgcatcgtgaacgcccgcggcggcaagtccggcgccgccatccccgagggctactacggcaacgccttcgcgttcccggtggccgtcgcgacggccggggacctcgccgcgaggccgctcgggtacgccgtggagctggtgaagcgggccaagggcgaggtggacgtggagtacatgcgctcggtggccgacctgatggtgctacgcgggcggccgcacttcacggtggtgcgcgcgtacctggcgtccgacgtgacaaaggccgggttcggcgacctggacttcggctggggcaagccggtgtacggcgggcccgccaagggcggcgtgggcgccatccccggggtggccagcttcctcatcccgttcaagaacgccaagggcgaggacggcatcgtcgtgcccatgtgcctgcccggccccgccatggagacgttcgtcaaggagatggacaagctgctgagcgcgcccgcagacgcagaggcagagcagcagaaggatgcgttccccgtcatcaggtccgcgctctgaagtgagctctctgctgaggcagccgcgcgcacggcgccgatcgaaccatcgttttcgcttcgtgctacagcaagcatataggtaatcatcagcgggtcctgagcagctgagcttgtgtaacgtagtgggtgtgggtgtgggtgaaccatagtacgttgacgtgcgtggagctacgttgatgtatacgtatgtaatgcgcgcatttggccggctatatgggttgttgtgacgttgtatgtatattttggtaccttttcatccaataattcatatacacttcttcccttttccattcaaattcgtacgtcttcttttaagaaaaactaaaaccgtacttcttttagaacaagttctttgtgtatatccatatatttccagagagcgcacgtttataacaaggtagctccgagcatagctttcgagcagatccagaagatgcttctcaccaaataaattaaatatccctacagcgtttgcaatgcccaaccctagcaccagcaaccacgtgcatgcgatcgtgtacagcattatttgacactgtagaggatttgtttatatagagaaattttaaataggaaatgggaccaggaatgagatggagagtctattagagataatctaaaagtttgtgcaatgtgcacagacatctacatatagtttgaggatgccctatggtggaatgttattttctttcttttcttgcatagagaggcgaaccaatgacaaagacgaca

SEQ ID NO: 5320 - DNA, 2679 bp, Zea mays
  misc_feature (524)..(524): n is a, c, g, or t
aaacggattagtcttatttacgtttctcgaataaaatggttatatacttctgtctaaacttctatcacagaagaagtttgcaacgcgttgctgcgcagcaactgatggatctatttacttctgccatcagaacgtatagacattatactagtctatacttcaaacatggtaaaaactcacccaatcaaatcactccatgcataacctccactaaatacaccaaataaattgtattcagatttaacacatcatcaaaattaacggtttatcttcttagataactttctctcccttactcaatggataatattattttgatcatccctctccgtgaccttgcaagcgctatcaacccattgcaagcgctatcaacccatccactcacgctgtcaaccgccatcgtcgaactctctcttactcagaattctaccataagcacgagctatatgttagtagtataataactgtacatgtttccaccacctccaggaggtcatgacgctagcgcgctgcgtattacccantccccactgcccagttcgctcacactctgatcgcacaactttgaacagctaaatcaaaaccggacgagcctcattatataatcctacacaccaagcccagcaacgtgcctgctccctctcggcacaccaaaccaaacccagtagagctgctcccagcagcagcaggcacgaaccgcccttgccacctcacctccagaaccagtgagtcactgtacgttaccggagcaagcaagaatggcgtcgtcggtcaagttcacggtgcggagggggccggcggtgctggtaactccggcgtccgcgacgccacgggagcttaagcgactctcggacatcgacgaccaggacgggctgcggctccacgtccccatcatccagttctaccgccagaacgcgctcatgggagggcgggaacctgcgccggtgatccgggacgccatagccagggcgctcgtgccctactaccctttcgccgggcggctcagggagctagaaggtcgcaagctcgccgtggattgtaccggcgagggtgtgctgttcatcgaggctgaggctgacgtccggctcgatcacttcggggacgagctgcaaccgccgttcccgggcctcgaggagctcatctttgacgtccccggctcgtccgaggtcctgggctcgccgctcctcctcttccaggcacgtgacggcgtccttgtctctgctcatcctcgtttggaaaaaaaaataagaattaccgccgccatgcggctagtttcacgtgtgtgccgtacacgtacacgtgcatggtaaacaaacttacgcgagacgtgcgtaccgtacgtgtgtggcgtgcaggtgacgcgcctggcgtgcgggggcttcatcctgggggtgcggctgcaccacacgatggccgacgcgcaaggactcgtgcagttcctgggcgccgtggcggagctggcgcggggcgcggcggggccgacagtccggccggtgtgggggagggagctgctggaggcgcgcgacccgccgcggccggcctttgcgcaccgcgagtacgacgaggtgccggacaccaagggcagcatcatcccgctcgacgacatggtgcaccgctccttcttcttcgggcgccacgaggtggcggccatccgcgccaacctcccgccggacctccggtcccgcgcctctaagttcgacctcctcacggggctcctatggaagtgccgcaccgcagcgctcgccctggacgccgacgaggtgatgcggatgatctgcgtcgtgaccgcccacggcggcaaatccagcgtcaccatccccaagggctactatggcaacgcctttgcgttgccagccgccgtcgcgacggcaggtgatctcgtcgccaagccgctcgggtacgccgtggagctggtgaagcgggccaagggcgaggtgaacgtggagtacatgcggtcggtggccgacctgatggtgctgcgcgggcggccgcacttcacggtggtgcgcgcgtacctggcgtcggacctgaccaaggccgggttcggcaacctggacttcggctggggcaatccggtgtacggaggacccgccaatgtcggcgtgggcaccagccccgggctggccaccttcctcgtcccgtgcaagaacgccaagggcgaggacggcatcatcgtgcccatgtgcctgcctggccccgccatggagacgttcgtgaaggagatgggcacgctcctgagcccgcccgcggagcagaagcaggacctgatgctccccgtcaacaggtccgcgctctgagctgagatgagctgacatcagctgagtgtggtgatttatgttggaaaataaacacgtcatgtgtgatgtacgtgagttcgtagcgcgtagagtgttttgttccagctcgtgtatgtacatgtgtgtcacgtacgggtctctaggaggtactggtgtgcgtggtgccgatttgcatgtaggatgcccagtctctatgtgagtgggtggctcatggcggtgtcgagaggatcatgcggatcatggcaagaaggctggacgtggaggcgtgcttctggcagtccgtggcctatatgtagcccctatgctcttctttatttgaggtcaagcccaatgaataaaagtgccaagaaacaggtgttcgtcgctaaaaaaaaaaaaaaaa

SEQ ID NO: 5321 - DNA, 1861 bp, Zea mays
ggcacaccaaaccaaacccagtagcgctgctcccagcagcagcaggcacgaacaaccgcccttgccacctcacctccagaaccagtgagtcactgtacgttaccggagcaagcaaagaatggcgtcgtcgctcaagttcacggtgcggagggggccggcggtgctggtagctccggcgtccgcgacgccacgggagcttaagcgactctcggacatcgacgaccaggacgggctgcggctccacgtccccatcatccagttctaccgccagaacgcgctcatgggagggcgggaacctgcgccggtgatccgggacgccatagccagggcgctcgtgccctactaccctttcgccgggcggctcagggagctagaaggtcgcaagctcgccgtggattgtaccggcgagggtgtgctgttcatcgaggctgaggctgacgtccggctcgatcacttcggggacgagctgcaaccgccgttcccatgcctcgaggagctcatcttcgacgtccccgactcgtccgaggtcctgggctcgccgctcctcctcttccaggtgacacgcctggcgtgcgggggcttcatcctgggggtgcggctgcaccacacgatggccgacgcgcaagggctcgtgcagttcctgggcgccgtggcggagctggcgcggggtgcggcggcgcccacagtccggccggtgtgggggagggagctgctggaggcgcgcgacccgccgcggccggcctttgcgcaccgggagtacgacgaggtgccggacaccaagggcagcatcatcccgctcgacgacatggtccaccgctccttcttcgggcgccaggaggtggcggccatccgcgccaacctcccgccggacctccggtcccgcgcctctaagttcgacctcctcacggggctcctatggaagtgtcgcaccgcagcgctcgccctggacgccgacgaggtgatgcggatgatctgcgtcgtgaccgcccacggcggcaaatccagcgtcaccatccccaagggctactatggcaacgcctttgcgttgccagccgccgtcgcgacggcaggtgatctcgtcgccaagccgctcgggtacgccgtggagctggtgaagcgggccaagggcgaggtgaacgtggagtacatgcggtcggtggccgacctgatggtgctgcgcgggcggccgcacttcacggtggtgcgcgcgtacctggcgtcggacctgaccaaggccgggttcggcaacctggacttcggctggggcaatccggtgtacggaggacccgccaatgtcggcgtgggcaccagccccgggctggccaccttcctcgtcccgtgcaagaacgccaagggcgaggacggcatcatcgtgcccatgtgcctgcctggccccgccatggagacgttcgtgaaggagatgggcacgctcctgagcccgcccgcggagcagaagcaggacctgatgctccccgtcaacaggtccgcgctctgagctgagatgagctgacatcagctgagtgtggtgatttatgttggaaaataaacacgtcatgtgtgatgtacgtgagttcgtagcgcgtagagtgttttgttccagctcgtgtatgtacatgtgtgtcacgtacgggtctctaggaggtactggtgtgcgtggtgccgatttgcatgtaggatgccgagtctctatgtgagtgggtggctcatggcggtgtcgagaggatcatgcggatcatggcaagaaggctggacgtggaggcgtgcttctggcagtccgtggcctatatgtagcccctatgctcttctttatttgaggtcaagcccaatgaataaaagtgccaagaaacaggtgttcgtcgct

SEQ ID NO: 5322 - DNA, 2373 bp, Zea mays
tggatcccccgggctgcaggtggacttaagccctaccacttgcatgattcaatcccttaccagttgccatctaaccttacctatctgtaatgtctcccaacgtgtacatattattcatgctattcgattcttgaaatttgattcaaagcgaatacaggaatctggcaaaaaataacttctctggtaatcttccatactctatatccaacttggtttcacttgagtacctgtaagtttctgtccactgcaaagatgtaattctttctgtgatgatctttttagttaacacaatctaactgcaaggaaccattgggtgcagcaatctcagccacaactcgttatttcaggaaattggtgaactatttggaagcctcaatccgctttcagaactagacgtatctttcaacaacctcacggggaatcttcctttctcaatgggctgctctgtcgaaactttctagcctttatatgcaaaacaatcaactatcaggcacagttgatgtcctcagcaacataagccttgcgacactaaatattgcagacaacaatttcagtggcatgatacctcaagaattcagctcatttccaaatttaatagttggaggaaactcatttgtcaatatgcctgcctccccgccatcaactctgaagccacctctggaggaacctcaaggacccgttagcgctccaactagccctgatacccccattgatcaagacgacaggaagatacagacaggtcctcttatagggatagctgttggctcaatagctgctgcctcatgtgttcttttcgtcttggtgttctgcctccacaatgcacgcagaagaaatgatgacgagatcagcgaaaccaaaagatcttgtgggttctcttgcagtaagcatagaaacagcagcatccagtagggaagtcctgaacaacaatcatgaaaatagtgctgtagcaacttcagatctccaacatgttgggaagatgatgatgactccggacagagtgcatgatacgacgaacggttctactacagccaaaaggccaaaggttcctgtgacggtgacttcatatacagttgctgatctccaagtcgctacgaatagcttctgtgaagactctctcctaggcgagggttcgcttggtcgtgtttacaaggctggttttcctaatgggaaggtacttgccgtgaagaaggtagacgacagtgccagcttgctgtctctgtatggaggaggagaagaagacgccttccttgagctggtctcgaacgtctctcggctcaggcatccgaacatcgtgcccctcacaggctactgcgtcgagcacggacaaaggcttctcgtgtacgagtacgttgggaacagaacgctgcatgatgtgctgcagcacttgtctgacgacgatggggcgagcaagaagctcacgtggaacacccgcgtaaggatagcgctaggcaccgctcgcgccttagagtacctgcatgaggtgtgcctacccccagtggtgcatagtaggaccttcaaggcatctaacatcctgcttgatgaagagtacagcccgcatctatctgactgtgggcttgctgctgctctcactactgctgtggtctccgctgaagcggttggctcctttggatatagtgctcctgaggtcgccatgtcaggaacatacactgcaaagagcgacgtgtacagcttcggagtagtgatgctggagctgctgacaggccgcaagccactagacaggtaaaaaaacatgtcactgcccgccatttccgacctggtggcccattatttgttgtatagatcaagctcacgcggttcagtctctccctcgtcgcccatcccgcttgccagctccagagagaggtcagaacagtctctcgtcagatgggcagccccgcagcttcacgacatcgatctcctcgccaggatggtcgacccggcgctggacgggctgtacccttccaagtccctctcccgtttcgccgacatcatcgccatctgcgtccagccggagccggagttccgcccgccgatgtccgaggtcgtgcagcagctggtgcgcctgatgcagagggcgagcatcataaggcggcaatcggacgatctgggctactcgtacagggtccccgaccgcgacggcggcgcagcaggcgacgtcctctgactctgagtgaggctaggagacccaagttggttcacgttttgtttccgtccgtcacctactcacctgtaaatgacatttgacatgtactatagggttcggagtgtaccgggacttttcgtcagctgcgagtgtcatgtattgtgtgcgctcttgcaagtggtagatatatatatatagaagggaaaaaaaacgtgtcctttttttgtgtt

SEQ ID NO: 5323 - DNA, 4168 bp, Zea mays
caccgttgtttttttttaaaaaaaattatcactcgtcttattcaaaagataatgagttactatttatttttttgtgatttattttatcaattaaggtagtttatgtttgatttaaaattttatatttttgaataaaacgagtgattaaagtttccgaaaaaattcaacggtgtcaacgaaggtaatattataagttatttttcattggattcagacaatcgctcgccactcaaacttctctgcttgcagtggatcttgtcacctccgtattattattattacccatagctgcggactgcaggcccactactccactaggctgcaatctacaactacaaatgacatgaccaatcgtgggtattagctgggctgggctgggcatcgtgagggctttcctttcatgcaatgtaagcgcatggggtttttcttcttcaggccgaaacgtcacgtttcgctcgcctcatcatctccttggcaatggcaagctggagctctggggcctggtgacagacctgcccctgctgcccctgcggcccttggcggccgacgacccggcggggctctggccgaggcgccgcgccggccgcctgcgcgagttggcgccggcggcgttcccgagcgccgcctgcgcgacgctgtccttggccacctcccgcgcgcgctgcggcttgacggcctgcttgttgaggtactcgatccgcgggagcaggcccgacacggccctgcgcagcgtgtcgtcgccggcgttggcctgcaccgggttgcccagcaggttgatcgcccgcagcgagccgtagttggccacgagctggcccagggacttggccgtgccgatcttgttgaagctcacgtccaggacggccagcttgagcaggcggtgcagcccctccacgtcgccgatcttgttcccggccaggtacagctccctgatcgccgtgcagctggacaggcctgaaccagagcaagcagaaaccacatgttaatcccacatccgttccgcgctgtacctgtacagcaatgctgacggctggaccagctgatggacgtggcatacagccatgctatgcttctgaacatccactgcactgcaccaccaaacatgactaacatgggatgcgccgaagcgtgtcacgggcatcgaaggcaggcagtagtatgcgaaatgtccgcgtcagatatctgaagcatgcatgtgctggcgacgggcgtgcgtaatggcgttctggttaccagtaccacatccagacgccgcatacatatgaaatgaaatgaaatcctgagcctgttcagtcacgacgagctaaacacagcaggcatggaccatgctagctcgaccagaggacctgacgaagatctctaaatgccaaacatccagggtgtcacacattactgctgcactggacaatattcgtgcggtgcaaatagctccaagcatgctcggcactgtgctctcgcctgcctgggcctggcaagtattcagagcacgggagtgccggccgaactggtagtagtagtcagtacagtagagaagtaaacagtggtgtcgcatggccaggacaagggcatgcatgcatggttgcttaccgtgcccgatccgtgagatccggttgtagctgaggttgagcacccgcagcctcgtcaggtcccgcagcccctcgatgattgcgatcttgttcctcgacaggtccagcgagtgcaggcccttaggcaacgatccagcggtgattcgaactgcaaatccaagcgcaattatggattcagtttcagtcatgtaacatgtttcaaacgaaatttacttgtgttagcttagttactagcacgtactagggaaaaaattcgtgtcaggaattaccgatcacgtttccagacagattgacggcccggagggtcgagaaggccgcgatcgccgggacggcctggagccccatgccggcgatgtgcgcgacggaggagaaggtgttgagcgtctgcacgatgatgccgctcgcctggccagcctcggccgccgccgccgccgcgcgccgcctcgcctgcggctgcggatgcctcctgccgccggccgccgacgttggcagctccacaatctcagagcgacgcggtcgcgggcgcaggcgcgaggcgccgtcgccgccgtgccccgtggcgccaccgtcctcgtcgacggcgtggaacgagccgttcccgaggctgttcacccacgcgctgacccggtccagcggcgaggcctcggcggagaacgccacccactgggtcgggacgcgggggccctcctcctccacggcgacgcccttctccttggcgtcgtccgcagtggccgtgcccagcgtgtcggacgcgtacccgtcgcgccggtgcgcggcgccgccgccttctctccccggcgatggccacagcagcgtcgtgggcgtgggcgcgctcgcgccccgacgacggtgcacgttgcggtggctccagaggaacagctgccaccacagcttccggctccgcgacgggagcacctgcctcgacgaccgcttcttcagcatgacgcggtcagcggagcacgaggtcctggaggacgccggcgtcgggctcgcgcgcaccgcgccgccgctgcgggcgctcgagcttccgtgggagggcagcgtcttcaggtcgtcgtaggagcgtgacttcgccggcaggtcggaccctgtcaggacagacctcgtcgtctcgatgttggagcaggagcgcatcagctttggcgatgccgccgtcggcgacatgcggccgaggctgcagggctcgccgtcgtccggctcggcgctcttggcatcgtcgcctgttccgtcgctgctgtaaccggaggaggaggagccagcggcggaggacgagtccctcttagctgcggccttgtcgccgttctcgccagtggcatggcgtgccagctcggcggctgcgtgagcgacaagcctactgctgcatgcagacgctggaacgctgtctcggcacctgctgacgtcgtcgacaacagcgtccgccaccaccatgtccatgaattccaccggcttcaccttggggcaatcattgccgctagccttcttggcgtaagcgcccttgttcttaccctgccattgacgcacaagtccaaagtcactaattaatgagtagctccgccaaagttcaggggcggcgaaagccgaatctcattctgccaccaacctccaatgccttcttcttgcaggggtaccgaccggagaagcagctcatcttgcccatcccggccgcgccgtcgcacggcgcaggcaggcaattctttgatgcctcaacgaacttttggaaacgttgccgagagagtaggtaactaggtaggcgttctgttctgggagagagcgcttccggaggagagagccggagaccggaatggcacctgcgtcgtgcgcccgtgcccgcgcggtggttgatgagccaaccggcggcgaaggccagagcgatccgtacaacctctgcccctgcatgcagcgagcgagaagcccaggatgagaaccctgaacatggaaacaggatcgatccaagaggatagagatggtaccttgagacgcagaagtggtgggctctcaccgcggaactggcaagcagagccgatgggatgggagatgagaagtgtgaactgtgaagtgtccggctccggcggtgctagcaatagtgggcctgattggttgcccgcatataggccaaccaggctcacggtatgcggccgtagtgtgtttggttgtaggttgcatccacgtaaccaggcgcgtgctactttgccgcttgtttggtttgccgcatatgcatcagcgcctgtgtctcgcgatgcaaaaaaggagctcgggccaggctctggagatgcgaccaaaatctgcgcatctgtggagccaggctcacgcgatgcacagccaggctgccgcagacctggctcgctcggccaccctgcctagatacggcaaccaatcaggccctaggagacccaaagttggttcacgttttgtttccgtccgtcacctgtagatgacatttgacatgtactattagggttcggagtgtaccgggactttttcgtcagctgcgagtgtcatgtattgtgtgcgctcttgcaagtggtagtagatatatatagaagggaaaaaaaagaaaaaaaaaactagagggggggcccggtacc

SEQ ID NO: 5324 - DNA, 1870 bp, Zea mays
gatcgacattcgaatattgcaagcaacaatttcagcggcatgataccccaagaattcagctcgatcccaaacctaatagttgcaggaaactcatttgtcaatatgcctgcctccccgccacaagctctgacgccacctccgaatccacgtggccggccagacgatcgtcgaggaccaaccagcgctccaactgtcccggagactcccattgacccggacgacaagaagatgcaaacgggacctcttgtagggatagctgttggctcaatagctgctgcctcgtgcgttcttttcgcgctggtgttgtgcctccacaacgcacggaaaaaaccagatgatgggagcagtgaaccgaaagcgtctagcagggacgtcatggacagcagccatgacaacgctgctgtggcaacttcagacctccaactgatccagcctgctggaaagatgactccggacgacagagcgcatggtccaaacggttgtaccgccaaaaggccaaagcagcaggttcctgtgacgacagtgagttcctacacagttgctgctctccaagtcgctacgaacagcttctgccaagactctctcctaggcgagggctcgcttgggcgtgtttacaaggctgtttttcctaacgggaaggtacttgctgtgaagaagatagacagcgcttcgctgtctctgtacgaagaagacaactttctcgcggttgtgtcgaacgtgtcccggctcaggcatccaaacatcgtgccccttgcaggctactgcgtggagcacgggcagaggctccttgcgtacgagtacgtcgggaacggaacgctgcatgacatgctgcacttctctgacgacgacgggatgacgatgccgggcaagactactaggctcgcatggaacacccgcgcgaggatagcgctaggcaccgcgcgcgctctagagtacctgcatgaggtgtgcctgcccccggtggtgcacagggccttcaagtcatcaaacatcctgctcgacgacgagtacagcccgcgtctgtccgactgtgggctcgctgctctgtcgccgaaccctgagactgagagggaggctttcgctggagtggttggctccttcggatacagcgcccctgagttcgccatgtcagggacgtacactgccaagagtgacgtgtacagtttcggggtagtgatgctggagctgttgaccggccgcaagccgctagacagctccagggagaggtcggaacagtctcttgtgagatgggcgaccccgcagctccacgacatcgatctgctcgccaagatggtcgatcctgcactggatgggctgtaccctgccaagtccctctcccgtttcgccgacataatcgccatctgcgtccagtcggagccggagttccggccgccgatgtccgaagtcgtgcagcagctggtgcgcctgatgcagcgggcgagcatcgtgaggcgacaatcggacgaccagctgggctactcgtacagggttcccgagcgcgacggcggcggcacggcaggcggcgacgtcgtcgtcgcctgagctagctagctagctagaggccgcgacgagaccaaagctggcgtacactcctactcctacacaaagcgctgcacagtttatatatattcataaacaaaagagcgagcaaaagaaaagaaaagcagttggatatggatggatccttcacgttttgttaaaaagtcacccgtaaacgacatatatgtatagggtttgcagcgtactgggacgtttcttcgtgagctgcgagtgtcatgtatagtgtgcgctcttgccagtggtagatatataggataggagaaaaaaaaaacgtgtcttcttttgttggtgtgttcagttcttcggccat

SEQ ID NO: 5325 - DNA, 1018 bp, Zea mays
atttaggtggctctataaaagagttatgccgttgaatgtatgtgtaagttatgtttggatcttttatattttttgtccttttttttttttttttttttttttttttttttttttttttttttttttggccgctttttttttttttaaagttgtacaatacagccactggctaaaacacatgtatagatgatacaaggtctgtcacgcagggaaataccaaagacggctggtgtttcgatacaccgtttgccgtgtcctgttccttttaccaacgagatctagaataacctacagagagatgaatttcttgcacggttaattcaaacttatctaattgagccctttcacacaagaaaaacatcatattgatacggcaaggtcctttagctgaacccatccaaatgcacatctgtctcggattttctggatctctagcagtgccaatttaattgtttggcctactgctacaaactctctctcgaaggggagccttgccttctggtccagcttttcaagacaccgggttgcatcaagtacataacaaaagtatgatagttgcctgtacagatctgactccttgtactgtcttactaggcgaccgttgcagcgtgggtagttaggacagacagttcctctctcagaatcccccataactctaaggtttacgctgtgagtcgagtatttgcaaccctcatcgtcacacatctgcaaacctttataatatagactaatgaaattatcagcctgtcttttcatctggttggcgagcatagaaggggaaaatttggactcaacagtattatctaggcatcttgggcaccgcatatggcgccagaaattagcagtagcatcctttccttcaattggatctgatacacttgtagcactagcactagtaatcagactagatacaggggggcagtcgaaggtaccagaacagcttgggcatgcacaaacgcagtggttcacaaccacgatatctctcatcttcgtcatcgccggccgacctcggcggcag

SEQ ID NO: 5326 - DNA, 1464 bp, Zea mays
  misc_feature (25)..(26): n is a, c, g, or t
acaggctcctcaccttggtggtccnnaaaaaaaatgtaataaaatagtccaatcgccttgactaccgcttccggttccggatccgaatctcgccctcccctctctttcttgcctccaggtccggccgtccgggcggcgccgggaggagagaatggcctccacggcgtcgccgccggtgttcgagagggtggccgggatccgagccattgccgagtccggccgcttcaaggcatggttgctggaccagtttggcgttcttcatgacgggaagaagccgtaccccggcgccattctggcattggagaagctagcggagaatggggcaaagatggtgataatcagcaattcctctaggcggtcatctgtgacaatgaagaagctcaagagcctggggttcgacacgtcctgtttcctcgcgaccatcaccagtggggagctcacacatcagcaccttcagaagagagacgacccatggtttgctgctcttggaaggaagtgtatccatatcacttgggacgatcgaggggcaatttctctcgagggccttggtttgcaagttgtgaacaatgttgatgatgcagagttcatattagcccacggtactgaagctcttggctcaccttctggtgttcctcttcccaaaagtcttgaggagcttgagcaggttctaatgcttggcatagaaaagcgacttccaatggtggtagctaatccagattatgtcactgtcgaagctcgagatctccgtgtcatgcctggcactctggcagctaaatatgagagtcttggtggtgaagtgaaatggatggggaagcctgataaggtgatctatacatcagcgatgtccctagcgggcgttgatgcccgtgaatgtatcatggtgggtgattcgctgcaccacgacatcaaaggagccaatgcgtcagggatggcatccgcgttcgtcactggaggggtccatgcggacgaacttggactcggtgaatttggagaaactgctggggaggatgctgtcagttcgctgtgcagcaagcacggatcgtacccttcttatgttctgccttcattcgcgtggtagagatgcggcctagattttttttttttgttttaggtgcacgggaaagtgattttaggcagatattgttgttatggaaataagtgccacgcaatgatcaagccgctggaggtgtcattcttcttaataaataataagtgacacgcaatgctcaagccgctggaggcagatttgtatttgcatttgtagtgtgtgtgtgtctatatatgctgcctgtggtgtatataccgcctgtgctgcaatgttcggttgagactttagacagcgatactgtatgaaggattcacattgttctgctcaattatgtaaacccgctctattacttttcctggataaaattacaaaaaaaaaaaaaaaaaaaaaaagtactctgcgttgttaccactgct

SEQ ID NO: 5327 - DNA, 4437 bp, Zea mays
  misc_feature (820)..(820): n is a, c, g, or t
  misc_feature (1767)..(1767): n is a, c, g, or t
  misc_feature (3792)..(3792): n is a, c, g, or t
  misc_feature (4171)..(4171): n is a, c, g, or t
accagatcgcaaatcctgtgagaaatcgccttatcgttgtggaaactagaaactgttcttgccatctgctgctgctacacgctcatctggctacagctgaatctgtctcgcactctcgcaggcatggttgctggaccagtttggcgttcttcatgacgggaagaagccgtaccccggcgccattctggcatgtaagttggcacagagaatgcacgccacttctgtgaagcgtgtatttgtttcctttgtgttctgatgctgctatttatttatgtcaacaatcgaggtgattcttgcagtggagaagctagcggagaatggggcaaagatggtgataatcagcaattcctctaggcggtcatctgtgacaatgaagaagctcaagagcctggggttcgacacgtcctgtttcctcgcgaccatcaccagtggggagctcacacatcagcaccttcagaagtaagattcctgggggcagtttcttctgccgatagaagttatgcttgtgataactggctcctttaaggatgtaaaacctgataggtgtcatgagtataatcacctcaacatttgctgcgttctgaggatttcatatttacattggactgcacatatcaacaaaaaatgcttatgatactaccaaccagaggagttcctttttcttgtatgcaatagtattttgtcgtttgatgcaacttattccaaaactatagaaaaactttctacactttactgcaagaataaactgtctgttaattcccctctacgatttaatccctgaatataggagagacgacccatggtttgctgctcttggaangaagtgtatccatatcacttgggacgatcgaggggcaatttctctcgaggtttatttcctgctatttctgcttagcatcagaatggatttttttcttatcagtttttcattttctcatactatagggccttggtttgcaagttgtgaacaatgttgatgatgcagagttcatattagcccacggtactgaagctcttggctcaccttctggtgttcctcttcccaaaagtcttgaggagcttgagcaggttctaatgcttggcatagaaaagcgacttccaatggtggtagctaatccagattatgtcactgtcgaagctcgagatctccgtgtcatgcctggtatgttttttttctgaacatgctggacagatgtgtatccttatagggtagagagagaaaaggggaaacaaccccattcaaagcaacctctccacctcacctatgagataagagaaagttgcagcaaagcaccaattgaagaaaaacttgtccaacactggttgggatggtttggatcggtccaatagagatctacagaggcactagaggcgtgatagcaatgggaagagagacaggagaatgctgaagttgccataggaagatgcagtaaaagtagacttgaaagggtgaaatatacctaaaaatctagccttgaataggagtatatagaaaataactatctatgtgtctgaaccttgacttatggtttttgttgggttttgactttagcctatccaacttgcttgggactaaaagactttgtttattgttttaagttttatcatttatcaagaagggaattagtctggaaatgtgtgtgttacgttagatttgtggtcatataagaaaggattgagcccgggatgatgatatatgataggctaagggtagtaccaattgaagaaaagcttgttcaacacttcaacatcggttgatatggtttngacatgtccaatcgagatctacagaggcactagtgtgtagtggggttctaaggtgcgatagtaatgggaagagagacaacgaaaggatagaatatacccaaagatttttatcttaaatagcagtgcatgaaaaacaactatccatatgcctgaatcttgacttatggcttctgttggattcatacttattaaggcgtcgcttatgttttatccacaccacccatgtgttgtttagcttggaagaatatgcatggcttatgatcatggtgttaagtattgcagtattgctcctaggttagggcagatctagtgacggaggctcacatgagtaggttctgagaaagggataaatcggggcaagcccttcactcacaaatacggagatgccatgatcttgtggctcagtgaaacagctctcactactgcacccaacatgcccttggtattattcctatgttgtttagcttaaaatgaatcagcatgcccgcactaccaatttagatattgattaattatgagagtatgatgtaaatcttttgctaagtatgtaagcctatgtcgcctttaacttgtacatttctggttattcacgtaaatgcaacctctcgtttcaggcactctggcagctaaatatgagagtcttggtggtgaagtgaaatggatggggaagcctgataaggtattcaactaactatggcatatgcctatttatgtaggttaaagaacaattcgactgcatcgtttctgcatgttcaagaaaagaaacaattcaactctatcggtcaggggagcttaattggctcttcctcagtcttcattttttttttgttgaagaaatcatttgattttattcaacagtttttgctaagcataacttgtagcttggccccctctacatctgtcatcaagctacgtcagcgtcagcatgatacttaagttgcaatggcactcaaagaatatgatgaaccacatgctagtgcacccttccatagtttttcccttgcaaaaaaattgtttttgtgtgtgtgtgtgtgtggtaggtgggcagaaccttttgtgtcagccactaacgtgttatgacctcgtcaggtgatctatacatcagcgatgtccctagcgggcgttgatgcccgtgaatgtatcatggtgggtgattcgctgcaccacgacatcaaaggagccaatgcgtcagggatggcatccgcgttcgtcactggaggggtccatgcggacgaacttggactcggtgaatttggagaaactgctggggaggatgctgtcagttcgctgtgcagcaagcacggatcgtacccttcttatgttctgccttcattcgcgtggtagagatgcggcctagaatttttttttgttttaggtgcacgggaaagtgattttaggcagatattgttgttatggaaataagtgccacgcaatgatcaagccgctggaggtgtcattcttcttaataaataataagtgacacgcaatgctcaagccgctggaggcagatttgtatttgcatttgtagtgtgtgtgtgtctatatatgctgcctgtggtgtatataccgcctgtgctgcaatgttcggttgagactttagacagcgatactgtatgaaggattcacattgttctgctcaattatgtaaacccgctctattacttttcgtggatgctgctttacgtataagtttttgttgggtcttgtattgcagttatctcacgtttctgtatcccatggccagattgatctcgatcaagctcgtcaaagcattgaacggcatgatctccatagaagaagaacgtcttcagctctgtccttgaaactgttatggtgaagatgacagcattcggggtacggtcggagagctttcctccagtgaccaagtgctcaccgatgtattattgcttcctaaaccggtccagctgcataatcaatgtataatgaccctgtcttgatttctgatattagctggagctattgggaaaaaaaaggggctccaatcggctctgcaaaacattactngagttgattggagttctaacaaaggagccctagataactttagttaggtaagcaaaacattaccttaaggcatctgttttttcgaggtggtggtccaaagcgtgttctccattggctatagtttaggcctgagtttgatcagagatcggcttacccgcgtcacgagtcgactgactgcctgcctgacgactccggtgcatttttttaggtttaggccgtcgtcgcgcgtcactcactcactcacagtgacaaccgagagcaatgctaagatcctgtgcgtttgggtgagcagtgaagaagaatgaagtggctcgatttctattttatgaatgtgagtgggtcctggagtcttcgtattaaaatttatcataaataactngaatgctctcgctccaccaaaacgaccggatacaagcgctcataggatgagatcgctctccttccatctacactcatatgactcttcaaccaaacaaagaacagaacagcgtcactctattatactcttcaaccaaataaaaaatagagcgattctgttctatttgccaaatacagaatagaaggactccattctcaaaaactagaatggaaccgctccattctagttgactctccaaccaaacacacatggttagagagtcaata

SEQ ID NO: 5328 - DNA, 1448 bp, Zea mays
cattagcatccctgaaagcgctctttcctaatttccatacaaaagaaacactatcaagccaagaggagcttgctcctttcctgaagttctcatctcgcatggctgcaatcgatttcattgtctgtgaggaaagtgatgcttttgtggctaacaacattgggaacatggccaaaattctggctgggcaaaggagatattttggacacaagagaacaatccggccaaatgctaaacagctctatcccttattcatgaagaggggaaatatgtcatgggatgcatttgcctcacaggtgcgaacaatccagaaaggatatatgggagagcccatggaaatcacaccaggaagaggcgaatttcatgcaaaccctgccgcctgtatatgtgaaaagaccagcagaaactcagcaatagtcaaatccatttctggaaataacctggaacctgtaactgacagtggaataaggaaaaccattggcattagtagaccaccatatcctgtttatactgatgaagaggcagatggatctgatacagaagaagatccggacagcagtgggagaggagaggtgattgacactgaacctgacgatgattctgcggtcagacaggaggaccctgagctagaggagatcctgtcagattagttcagttgtgcggctgtttcccccggttaagctatgcaaatctgactgcatatacatgtgttgtatgtggcagcaattttatggtttgggcatcaccgaactagcttagatctgcagccgctggtgtacatagattttgtggtgtgcagctgtccaccctctttttcttagctgaatgagggcatgatcatgtttgtcacctgtgcaagccagatttgcttaccttttcttagtatcccgccattgctcaaccctcaagcaaatgtgcaaataaaagagaataaaaacaagagaagttggttctccagtgctgttcaccaccttgtgtgttggacagcacatataaggctttgttcgtttataccaatccagatctggattatcatggattggatttaaatctatatcacaatctataccctaaaataatctaagattacttaaatttttttattcggttaaatacatcatggaatataacccaatggtttagtaaaattttaaactatggaagacataaattctatccataactcattagatatggaacaaatccatgaagatattgcacaagttacattagaatttatggatcaaaagaataactagctttgagagacacatgaattagtttatggatttaatcccacaataggattagtgtgaggtatagattcacccaattcataaccagattaaatttatggtaggattttatcccatgtaacctaacctaatatggaccggaacctttgcccgacgaggcgacaaggagcttcaatccagttcctcggaggtcgc

SEQ ID NO: 5329 - DNA, 1690 bp, Zea mays
aattcggcacgaggcacaccacgcggtccgcgatggcaggccaccaccgcgcccgccgagtaaacggcacgcgcgcgcccccgcgccggccgtcggcggaaaaaatcacgcggagccggagccaccccgaaaagccacgcacgtcgccaacaaccgttctacgcgtccagcccctgctgtgcgcctgcgtctggctcgccctgctgctggcgtgcctcccgcgccacgccgcggcgcatgacgccgaggcgcggccgcgcctgcagatcaagagcgcgtggggcgacccggcgccgctcgcgtcgtggagcaacgcgaccgcggcggcgccgctcgcgcagtgcagctgggcctacgtggtctgcgacggggccgggcgggtcagctcgctcaacctcaccaacgtcacgctggccggccgcaccatccccgacgccatcggcgggctcacggccctcacggtgctcgacctgtccacaccagcgtcggcggcggcttccctgcgtccctctacaactgcgccgccatcgcgcgcctcgacctctcccacaaccagctcgccggggacctcccggccgacatcgaccggctcggcgccaacctgacctacctcgccctggaccacaacaacttcaccggcgcgataccggcggcggtgtccaggctcaccaacctcacgtacctcgctctcggcggaagccagctcaccggcaccatcccgccggacctcggccagctggttaaccttcggacgctcaagctcgagaggacccccttcagtgccggcacgctgccggagtcgttcaagaacttgaccaagctaacgaccgtctggctggccaagtgcaacctcaccggcgagatcccgagctatgtcgcggagctggcggagatggagtggctcgacctgtccatgaatggactcaccggaaacataccgtccgggatatggaacctccagaagctgacgaatctgtatctgtacaccaacaacctctccggcgacatcgtcatcaacaacgggacgataggagcggcaggtttggtagaggttgacctgtccgagaacatgctgactgggaccatcccaggaagcttcggaagcttgacgaagctaaggctcctcattttgcacgacaacaatctcgtcggcgagataccggcaagcatagcccagctaccgtccttggtatacttgtggctgtggagcaacagcctcagcggagagctcccggcggggctcggaaaggagacgccggtgctgagagatatccagatcgacgacaacaacttttccggcccaataccggcggggatctgtgagcacaaccagctgtgggtgctcaccgcccccggtaaccgcttgagcggctcaataccgaccggtcttgccaactgctcgagtctcatatggttgttcctcggaggtaaccagctgtccggcgaggtgccggccgctctatggacggtgccgaagcttctgaccgtgtcgttggagaacaatggacggttgggcgggagcctgccggagaagctgtactggaacctgtcgaggcttagcatcgacaacaaccagttcaccggaccgattcctgcatcggctactaatctcaagcggttccacgccagcaacaacttgttctccggcgacataccaccggggttcaccgctgcgatgccccttctgcag

SEQ ID NO: 5330 - DNA, 1535 bp, Zea mays
ccgggacccacattcgtacgcgtgcttgttgtctctgcctcccatcaactctccagtgagctgcgagcctacaaggctgtgggtacctcgaggccggccggggacctcccccagtcccccaccgaccaccggcctcctttcccgcaggcacgggtgcacggcacgcggtttccactcgcttcgtccgcgttcggatcgccctcagagtaacagtctagcagagcaagcatgtcgtcgtcggcggagaacgaccccacggtgacggtgaccgagcgcggaggcaaggacaagcacgaggacggcggcgacaaggagcagggcggcggcggcttcatcgacaaggtgaaggacttcatccacgacatcggcgagaagatcgaggaggtcgtcgggttcggcaagcccacggccgacgtgtgcggcatccacatcccgcacatcagcctccaccgcgccgacctcgtcgtggacgtgctcatcaagaacccgaacccggtcccgatcccgctcgtggacatcgactacctcatcgacagcgacggccgcaagctggtgtcgggcctcatcccggacgccggcaccatccacgcgcacggccaggagaccgtcaagatcccggtgtcgctcgtcttcgacgacatcaagagcacctacaaggacatccagccgggcagcatcatcccctacctcgtccgcgtcgtgctcctcgtcgacgtccccatcatcggccgcgtcaagatcccgatccagaaggacggcgagatccccatcccttacaagcccgacgtcgacgtggagaagatcaagttccaccacttctccttcgaggagaccaccgccacgctccacctcaagctcgagaacaagaacgacttcgacctcggcctcaacctgctcgagtacgagatgtggctcggcgacgacagcatcgcctccgccgagctcacacagaccgccaagatcgagaagcaggggatcaccaggatgcaggtgcccttcagcttcaggcccaaggacttcggatccgctgtctgggacatgatcagggggaggggcacgggatacaccatcaagggaaagatcgatgtcgacactcccttcggcaacatgaagctgcccataagcaaagagggtggaaccacccgcctcaagaaggaggaggaggaggacgacgacgatgacaactgaagtgaggactgctggggggcgctgctgttacctttcacgaaacgcagcgaagcagaagatgcggggatcgtcgtcgacctgatacccacacccttagcgctggttaagctcttgcctttagcttatggtgctctgttgttttgcattgtctgaacatcctctcacttcctgagtgtacgttcagtttgaggtttcctgtgttgtccatctgaattctttcaaactttgcggttggaactggatgaagaataaaattccaacccgccctggttcttttgtgggtctgtttggaatagatgctgcctgccaatgatcctgaaacgaaaaaaaaaaaaaaccgagcggcc

SEQ ID NO: 5331 - DNA, 731 bp, Zea mays
  misc_feature (665)..(665): n is a, c, g, or t
  misc_feature (681)..(681): n is a, c, g, or t
ggtaccctcgaggctcggccgggccacattcgtacgcgtgcttgttgtctctgtcagccatcaactctccagtgagctgcgagcctacaaggctgtgggcagtgccagcctcaacctcgacctcccccagtcccccaccgaccaccggcctcctttcccgcaggcacgggtgcacggcacgcggtttccactcgcttcgtccgcgttcggatcgccctcagagtaacagtctagcagagcaagcatgtcgtcgtcggcggagaacgaccccacggtgacggtgaccgagcgcggaggcaaggacaagcacgaggacggcggcgacaaggagcagggcggcggcggcttcatcgacaaggtgaaggacttcatccacgacatcggcgagaagatcgaggaggccgtcgggttcggcaagcccacggccgacgtgtgcggcatccacatcccgcacatcagcctccaccgcgccgacctcgtcgtggacgtgctcatcaagaacccgaacccggtcccgatcccgctcgtggacatcgactacctcatcgacagcgacggccgcaagctggtgtcgggcctcatcccgggcgccggcgccatccacgcgcacgggcgggataccggggagatcccggtggggctcgtgttgggcgacctgagcagcncctgcgagggcatgcnggcgggcggggacatacagtacctgtggcgggggcggctgctgggggggc

SEQ ID NO: 5332 - DNA, 1564 bp, Zea mays
ccgggacctccccctgtcccccaccgaccaccggcctccttttccgcaggcacgggtgcacggcacgcggtttccactcgcttcgtccgcgttcggatcgccctcagagtaacagtctagcagagcaagcatgtcgtcgtcggcggagaacgaccccacggtgtcggtgaccgagcgcggaggcaaggacaagcacgaggacggcggcgacaaggagcagggcggcggcggtgttatagctactctactgtctacgagcagaaggaagaggaagacagaattacggaggtatgcgcacaggcggcttcattgacaaggtgaaggacttcatccacgacatcggcgagaagatcgaggaggccgtcgggttcggcaagcccacggccgacgtgtgcggcatccacatcccgcacatcagcctccaccgcgccgacctcgtcgtggacgtgctcatcaagaacccgaacccggtcccgatcccgctcgtggacatcgactacctcatcgacagcgacggccgcaagctggtgtcaggcctcatcccggacgccggcaccatccacgcgcacggccaggagaccgtcaagatcccggtgtcgctcgtcttcgacgacatcaagagcacctacaaggacatccagccgggcagcatcatcccttacctcgtccgcgtcgtgctcctcgttgacatccccatcatcggccgcgtcaagatcccgatccagaaggacggcgagatccccatcccttacaagcccgacgtcgacgtggagaagatcaagttccaccacttctccttcgaggagaccaccgccacgctccacctcaagctcgagaacaagaacgacttcgacctcggcctcaacctgctcgagtacgagatgtggctcggcgacgacagcatcgcctccgccgagctcacacagaccgccaagatcgagaagcaggggatcaccaggatgcaggtgcccttcagcttcaggcccaaggacttcggatccgctgtctgggacatgatcaggggaaggggcacgggatacaccatcaagggaaagatcgatgtcgacactcccttcggcaacatgaagctgcccataagcaaagagggtggaaccacccgcctcaagaaggaggacgacgatgacgacgacgacaactgaagtgaggactgctggggcgctgctgttacctttcacgaaacgcagcgaagcagaggatgcggggatcgtcgtcgacctgatacccatacccttagcgctggttaagctcttgcctttagcttatggtgctctgttgttttgcattgtctgaacatcctctcacatcctgagtgtacgttcagtttgaggtttcctgtgttgtccgtctgaattccttcaaactttgcggttggaactggatgaagaataaaactccaacccgtcctggttcttttgtgggtctgtttggaatacctgctgcctgccaatgatcctgaattaagctttagtgaaaggctttatccatattaataaaaaaaaaaaataaaaatttttaaaattaaaaaaaaaaaaaaatattatgg

SEQ ID NO: 5333 - DNA, 1599 bp, Zea mays
gacctcccccagtcccccaccgaccaccggcctccttttccgcaggcacgggtgcacggcacgcggtttccactcgcttcgtccgcgttcggatcgccctcaggtcaaccaccactcctcccctctgttcctctcagcatctcgcgcttcagatctcgcccaccgatctggaactggaattccctcccgatctgtatctcacgcacgcttgctcgcgttcttggctttgctcccacctctctctctagcagagtaacagtctagcagagcaagcatgtcgtcgtcggcggagaacgaccccacggtgtcggtgaccgagcgcggaggcaaggacaagcacgaggacggcggcgacaaggagcagggcggcggcggcttcatcgacaaggtgaaggacttcatccacgacatcggcgagaagatcgaggaggccgtcgggttcggcaagcccacggccgacgtgtgcggcatccacatcccgcacatcagcctccaccgcgccgacctcgtcgtggacgtgctcatcaagaacccgaacccggtcccgatcccgctcgtggacatcgactacctcatcgacagcgacggccgcaagctggtgtcaggcctcatcccggacgccggcaccatccacgcgcacggccaggagaccgtcaagatcccggtgtctctcgtcttcgacgacatcaagagcacctacaaggacatccagccgggcagcatcatcccttacctcgtccgcgtcgtgctcctcgttgacatccccatcatcggccgcgtcaagatcccgatccagaaggacggcgagatccccatcccttacaagcccgacgtcgacgtggagaagatcaagttccaccacttctccttcgaggagaccaccgccacgctccacctcaagctcgagaacaagaacgacttcgacctcggcctcaacctgctcgagtacgagatgtggctcggcgacgacagcatcgcctccgccgagctcacgcagaccgccaagatcgagaagcaggggatcaccaggatgcaggtgccctttagcttcaggcccaaggacttcggatccgctgtctgggacatgatcagggggaggggcacgggatacaccatcaagggaaagatcgatgtcgacactcccttcggcaacatgaagctgcccataagcaaagagggtggaaccacccgcctcaagaaggaggacgacgatgatgacgatgatgacaactgaaatgaggactgctggggggcgctgctgttacctttcacgaaacgcagtgaagcagaggatgcgggatcgtcgtcgtttgatctgatacccatacccttagcgctggttaagctcttgcctttagcttatggtgctctgttgttttgcattgtctgaacatcctctcacttcctgagtgtacgttcagtttgaggtttcctgtgttgtccgtctgaattccttcaaactttgcggttggaactggatgaagaataaaattccaacccgtcctggttcaaaaaaaaaaaaaaaaggaatagatgctgcctgccaatggtcctgaaataagatttagtgaaaggctttattcaaaaaaaaaaaaaaaa

SEQ ID NO: 5334 - DNA, 1693 bp, Zea mays
  misc_feature (15)..(15): n is a, c, g, or t
  misc_feature (33)..(33): n is a, c, g, or t
gggtacctcgaggcncggccgggaaaaaaattnttgggtacggccacctcgccgccgggcgacctcgacctcccccagtcccccaccgaccaccgaccaccgacctcctttcccgcaggcacgggcgcaccggcacgcggtttccactcgcttcgtccccgttcggatcgccctcagagtaacagtctagcagagcaagcatgtcgtcgtcggcggagaacgaccccacggtgacggtgaccgagcgcggaggcaaggacaagcacgaggacggcggcggcttcatcgacaaggtgaaggacttcatccacgacatcggcgagaagatcgaggaggtcgtcgggttcggcaagcccacggccgacgtgtgcggcatccacatcccgcacatcagcctccaccgcgccgacctcgtcgtggacgtgctcatcaagaacccgaacccggtcccgatcccgctcgtggacatcgactacctcatcgacagcgacggccgcaagctggtgtcgggcctcatcccggacgccggcaccatccacgcgcacggccaggagaccgtcaagatcccggtgtcgctcgtcttcgacgacatcaagagcacctacaaggacatccagccgggcagcatcatcccttacctcgtccgcgtcgtgctcctcgttgacatccccatcatcggccgcgtcaagatcccgatccagaaggacggcgagatccccatcccttacaagcccgacgtcgacgtggagaagatcaagttccaccacttctccttcgaggagaccaccgccacgctccacctcaagctcgagaacaagaacgacttcgacctcggcctcaacctgctcgagtacgagatgtggctcggcgacgacagcatcgcctccgccgagctcacacagaccgccaagatcgagaagcaggggatcaccaggatgcaggtgcccttcagcttcaggcccaaggacttcggatccgctgtctgggacatgatcaggggaaggggcacgggatacaccatcaagggaaagatcgatgtcgacactcccttcggcaacatgaaactgcccataagcaaagagggtggaaccacccgcctcaagaaggaggacgacgatgacgacgacgatgacaactgaagtgaggactgctggggggcgctgctgttacctttcacgaaacgcagcgaagcagaggatgcggggatcgtcgtcgacctgatacccatacccttagcgctggttaagctcttgcctttagtttatggtgctctgttgttttgcattgtctgaacatcctctcacttcctgagtgtacgttcagtttgaggtttcctgtgttgtccatctgaattctttcaaactttgcggttggaactggatgaagaataaaattccaacccgccctggttcttttgtgggtctgtttggaatagatgctgcctgccaatgatcctgaaataagctttactgaaaggctttatccatccagattccagaagctcacggcctcgcgggctcaacctcaaaccaagagtgtaatccgcctgttgcatcacatcaacaagttaacacattggatgtcaaaaaaaaaaaaaaagggcggccggtcgcgatctagacccacgcgtccgcggacgcgtgggcggacgcgtgggcggacgcgtgggcggacgcgtgggcggacgcgtggg

SEQ ID NO: 5335 - DNA, 1359 bp, Zea mays
gtgggggtccccgccccggcccggacctcgacctcccccagtcccccaccgaccaccgaccaccgacctcctttcccgcaggcacgggcgcaccggcacgcggtttccactcgcttcgtccccgttcggatcgccctcagagtaacagtctagcagagcaagcatgtcgtcgtcggcggagaacgaccccacggtgacggtgaccgagcgcggaggcaaggacaagcacgaggacggcggcgacaaggagcagggcggcggcggcttcatcgacaaggtgaaggacttcatccacgacatcggcgagaagatcgaggaggtcgtcgggttcggcaagcccacggccgacgtgtgcggcatccacatcccgcacatcagcctccaccgcgccgacctcgtcgtggacgtgctcatcaagaacccgaacccggtcccgatcccgctcgtggacatcgactacctcatcgacagcgacggccgcaagctggtgtcgggcctcatcccggacgccggcaccatccacgcgcacggccaggagaccgtcaagatcccggtgtcgctcgtcttcgacgacatcaagagcacctacaaggacatccagccgggcagcatcatcccttacctcgtccgcgtcgtgctcctcgttgacatccccatcatcggccgcgtcaagatcccgatccagaaggacggcgagatccccatcccttacaagcccgacgtcgacgtggagaagatcaagttccaccacttctccttcgaggagaccaccgccacgctccacctcaagctcgagaacaagaacgacttcgacctcggcctcaacctgctcgagtacgagatgtggctcggcgacgacagcatcgcctccgccgagctcacacagaccgccaagatcgagaagcaggggatcaccaggatgcaggtgcccttcagcttcaggcccaaggacttcggatccgctgtctgggacatgatcagggggaggggcacgggatacaccatcaagggaaagatcgatgtcgacactcccttcggcaacatgaagctgcccataagcaaagagggtggaaccacccgcctcaagaaggaggaggaggaggacgacgacgatgacaactgaagtgaggactgctgggggggcgctgctgttacctttcacgaaacgcagcgaagcagaggatgcggggatcgtcgtcgacctgatacccatacccttagcgctggttaagctcttgcctttagcttatggtgctctgttgttttgcattgtctgaacatcctctcacatcctgagtgtacgttcagtttgaggtttaaaaaaaaaaaaaaaaaactagagggggggcccggtaccca

SEQ ID NO: 5336 - DNA, 3100 bp, Zea mays
  misc_feature (2364)..(2364): n is a, c, g, or t
cctccgatcgacgatggccatcgctcaagctcagctgggccgacacaatcacacaagggtcggtccacccacattcgtacgcgtgcttgttgtctctgtcagccatcaactctccagtgagctgcgagcctacaaggctgtgggcagtgccagcctcaacctcgacctcccccagtcccccaccgaccaccggcctcctttcccgcaggcacgggtgcacggcccccgcgtccgccccgcgtcggccccgctcggatcgccctcaggtcaaccaccactcctcccctctgctcctctcagcatctcgcgcttcagatctcgcccaccgatctggaactggaattccctcccgatctgtatgtatctcacgcacgcttgctcgcgttcttggctttgctcccacctctctctagcagagtaacagtctagcagagcaagcatgtcgtcgtcggcggagaacgaccccacggtgacggtgaccgagcgcggaggcaaggacaagcacgaggacggcggcgacaaggagcagggcggcggcggcttcatcgacaaggtgaaggacttcatccacgacatcggcgagaagatcgaggaggtcgtcgggttcggcaagcccacggccgacgtgtgcggcatccacatcccgcacatcagcctccaccgcgccgacctcgtcgtggacgtgctcatcaagaacccgaacccggtcccgatcccgctcgtggacatcgactacctcatcgacagcgacggccgcaagctggtgtcgggcctcatcccggacgccggcaccatccacgcgcacggccaggagaccgtcaagatcccggtgtcgctcgtcttcgacgacatcaagagcacctacaaggacatccagccgggcagcatcatcccctacctcgtccgcgtcgtgctcctcgtcgacgtccccatcatcggccgcgtcaagatcccgatccagaaggacggcgagatccccatcccttacaagcccgacgtcgacgtggagaagatcaagttccaccacttctccttcgaggagaccaccgccacgctccacctcaagctcgagaacaagaacgacttcgacctcggcctcaacctgctcgagtacgagatgtggctcggcgacgacagcatcgcctccgccgagctcacacagaccgccaagatcgagaagcaggggatcaccaggatgcaggtgcccttcagcttcaggcccaaggacttcggatccgctgtctgggacatgatcagggggaggggcacgggatacaccatcaagggaaagatcgatgtcgacactcccttcggcaacatgaagctgcccataagcaaagagggtggaaccacccgcctcaagaaggaggaggaggaggacgacgacgatgacccctgaagtgaggtactactactatgtactatctgctgcctctgttgatctaatgccatactactgaagtgaggtactactactatgtactagtcagcactcttttcttcttcttgcaagatgtttccaattcttcattatggagtattcaccagttcagtaagtaactggtctttttgactaacgagaatgccagtggaaaagatataatgctttatcatgagcatgaatctttctagtttgattttaggtgtgttgacaggataagttcagtactgctacacgatgcaatagctgaacttggtaggcttaagttccaaaaacctgaccattttatagctgtacactctccatggatcaactatactgaaaagcttagtctactatgacctcactagtcatagagatttttgcaagtacttatctgaactcgttatgctaggcgatggcaactgtgatacactagtactatctgttgcttgtcgatccagtaccatctttgttcttccatgttgccaattcgttcatccgtatgatgattcataagtttagtacttgttattatctgtagcactcttcggctaactagaatactagcgggaaagagacagctttagcataagcatgaacccctttttagttgatataaggggtgttggctaaatgcaatatccgaaattgctaggcctttgagtctccagaaatccagaatttgggattggcgctagaaataggcgttacaagtttgtcattctggaactctgtagtctcgaaaagcctagtcaactatggccttattaatcggagagattttgcaagcacttgtctgaacttgtctatgcttgacgacgttctagaatatgtgtgagacagataaatatccagtgcatgtcagtaatactaggttttatactcttgtccaaatgctcacactacacacacgtacagtttgattcaagcagagatcgaangtttcaccattccgcttcagacgatgtttagctcaaagcatgccaccatctggactaggctgtaaaattcggaacacaatcccatgtgaaaattgaagagacctttgcagtgcaggactgcaggcagttgctgtgtctgtcaattgctcgtgggaaaaacattgggtgtgtttgctgaactctgtttctgaaccaccctaccattgttgcaggactgctggggggcgctgctgttacctttcacgaaacgcagcgaagcagaagatgcggggatcgtcgtcgacctgatacccacacccttagcgctggttaagctcttgcctttagcttatggtgctctgttgttttgcattgtctgaacatcctctcacttcctgagtgtacgttcagtttgaggtttcctgtgttgtccatctgaattctttcaaactttgcggttggaactggatgaagaataaaattccaacccgccctggttcttttgtgggtctgtttggaatagatgctgcctgccaatgatcctgaaataagctttactgaaaggctttatccatccagattccagaagctcacggcctcgcgggctcaacctcaaaccaagagtgtaatccgcctgttgcatcacatcaacaagttaacacattggatgtcattagatttgtatatgaactgtaggtcattttacctcgcatatctatccaatagaggggcatatgctaggctccatccttctgtg

SEQ ID NO: 5337 - DNA, 3656 bp, Zea mays
  misc_feature (3448)..(3448): n is a, c, g, or t
cattgggtacctcgaggccggccgggaaccttcactcccgactccacctctctccgatcgtctcatcttcttccttctcttccaccacatccttggcatctcatccggatcgaccagtacacgccccagtagtactaaagaaccagtttctgagtaaaacatggcggcgtcgccttccccgtccggcagcggcggcggcaaggccggcgtggaccggatcaagggcccctggagccccgaggaggacgaggccctgcagcgcctcgtgcgccgccacggcgcgcgcaactggtccctcatcagccgctccgtcccgggccggtccggcaagtcgtgccgcctccggtggtgcaaccagctgtcgccgcgggtggagcaccgccccttcacgcccgacgaggacgacgccatcctccgcgcgcacgccaggttcggcaacaagtgggccaccatcgcgcgcctcctctccggacgcacggacaacgccatcaagaaccactggaactccacgctcaagcgcgagcgcgagcgcgagcgcgagtactacgccgatgcgcgccccggccccggcgaccagcgctcgctcaagcgcaccagcagcgacgggccccccggaagcccgtccgggtccgacctcagcgactccagccaccagagccttcccaccgtgatgccgtcagccgcttctaccgccgtcacctcccagcagcagctacaacacgtgtactaccgccccgtgccgcgcgcgggcggcgtggtcctgctcccggtggcgccgccttctccgcaggctcctccagcaacctccttgtcgttgtccctctccctgccagggctggaccagcagcccgaaccatccccgccgccgccgccaacacctcaagcacaagcaagctcgccgttgagcgcggagttcctgttgatgatgcaggagatgatccggatcgaggtccggaattacatgtccgggtcgggcttcgacgcacgcgccgtgatgggcatggccgagatcgactagtttcagcggcaggggtccaagaccaagacaacgaatcgccgaccgatcccagattcctttgttaatcagcagagcagaggccttcgttccatgcttgctgctgtgctgcctgctggtggtactcagtataaccagtagagtttagactacagtaccagagagacggacggacggacggcgagacctccgatatcgtcatgctgttcttgtacaggagacagcacaaaaagggatcgagaagatggatcagggagaagagagaggactcactcgtgtttcttggctcgtgcaaatttgccttttggtttcgagtgcaaaattggaccactaagataaaggggtctcttcgattggcgggctcagaaatttggtcgttcttagattattaggctagatgttgggattttatttcctagatagtaagttttaaaaatatggattaaatcttagtttagtgtgtcctaacacccactgaccaccgtacacacagaaccgtacggacaacactagaatggtctgcctgggagctgaggagctcttttttttttggtagttgtggatcactgctgagctacttcagtacttctagatggtatggtatggatggatggatggatgggcaaggaaaggacgaagagaaaatatatggccatgatggctggcagacagggtagctagccggccgttggcagaagccgcggcagagttgagtgagtgacagctaactggctgcttgtcccagccgtcgatgacgatgaagtgtggtgtttttctttatgattcagcatgtctgtctgttccgttgatgacaaccgctctactcctgtcctacgcaacaactccacgaaaaactaattaattaaagaccgctgctggctgcaggccggctgcatgcatgccccccgtattatattctcgtcctgtggcctgtcgttggcatccatcgggtatatattcacagctggttacgcgttgttggcagttcgttggtgataactacgtacctgtggtagtcgtattgcttttttatatataataataactgcaaaattaaagcagacgacccaaggcacacaaagaaagccaacctctctagctgaatggtccagcaaggcacgaaggtctggcgagtttttaatcatgcttcctggcccttgagtctggtgttacagcatctatcggctatattcacaaagaggatacatacctgctgacatagacatctacagtgtacttaacaggtcaagcagatggagcaacatacagcaaactatccttgctgtgttgcataagaaaaaataagtgcaacagaccaaaacctcatagacacagcaaaatgtaagcattatatacaaaattgcagaacttctattagcttgccacaatgactacttttattcatcttaaacaggtatgcgcccatctgctccgtcatcagccgcctgtaccttgtcctgtgtgtagagtaatacatggcatccaccatcagtcactgccactgcacctgatttggaatcaacagaaacacaggagactcgtccacctggttgcacgactttgattagaacggaccgacttgtaccacaagtcatataattcactccaaaaaaaaaacaagaaattatggttaacatgaataggctcactgaactaatgctcacaggtggaaaagagcatggagtatccatacctaattcctggtaaaaatctacctactatttgccaatcatgtttcaatatagatgtggaactctatgcattaagtgaatatgtattataatggtgttgagatgatttaatttgttcactcagatgagaaagaaaatggccctcggtgaatatggcatgtttcaacattacaacatgacatcaaacatccaagacagggtaacgcatcacttactgttgaaacactgtgttcccgtcacttttctccccgaagacaattcccacagatacagcagaccaccatgtgtcccagcgtatccgtagttaccgcaggcatctaaagcagtaattctgaaaaacaaaaaatatatatatacatatgacaagctgccgaaaattcaactaagaacctgagattatttcaagcatgtctatgaatcagtagagaaggacagcaggggaaggagaaaggccgcgagtagcagaacggagcagagtaccggagcatgggcctttttccactccccacctgccgtgcaaaacgagtgcttcaagcgtagagcaggcaggtgcagcggcgttttgctgcgttgcaccgaatctcatcccccgacgtatgcatcccttcacttacaaaaaaccaagtattctaccctcacctatcataaaacatttgatctgggtggttttgcctcgctgaccccccacatgccaggtgaccccttatatctcaaaataattcagagctttttcatgtgaaantaaatgaagatatactttatatccaaatgatagagcttgacgtgttccacaagtttgttgttgacaactattctatttgagatcatttagaagaccaaatagtttttctatattatcagatttcgagttcaattgttttttgaatttttcaattaacttcgaatattaacattgtctataccaaagttggtagcttataatgtgatcc

SEQ ID NO: 5338 - DNA, 1433 bp, Zea mays
atattttcaaactctactctacgaatagtatatactacaatacaaaataatattttagttgaccatatacctacttgttacagtcaagactaataactagttcatacatctctccttatacatacttatcactcataccccctgcccttctctctagtttgtgcaagtctaaagccgacccttctttacatcctaactaagatctcgtacgtccaccctctatttccatactcgaagaagctcaactttgtcaaacatcgtcattctctcgacaagatccggacgacaatgctggacaaggaagacaggacgagaatggtccccaagagctcaagccagacgaagacgctcctggccgccatggaggaggagagggcgagtacagccaaccggcgcttcctctgcaaggacgacgcctcctccgtctccaacccctccttccgcgtctactacggcgtcgcctccgcggggtcggtgccattcatgtgggagtccgcgccgggcactcccaagcacgccatgtccagcgccaccctcccgcccctcaccccgccgccgtcctactacaagggcgcggccaagaccaagttcgccaaatcccagtcctccaagaagctgctctcgtccaagccgcctagcagcttcgtgcagagcatcctccccaagctgcgcaggagccataccatgcccgtgccgtcgcggtcaccgtcggcgccggcgccggcgccgcccagagagagcgcgcaggtgcagtgtgcccggagccgggggaacaggctgctgctcgcgagcccgcggtcgtccttctcgtccaactcaaggggagacgacgacaacgacgacgaagatgctggtgcggccgcgacggcgtcgccgacgtccacgctttgcttccggacccggcactcccgcaggggcaccggcaggctgcacgggcttctagcgtccgtggtcggaggagggcaaggtaccgctgcctcctgatgattgattaaaacgaagttgggttggatcttccagttctttggtcttggtcacatctatcgatcttggtagtgtgctctgctatggtcgtgcagtgcgcgacctagtcttgtacacttaattacgagattgatgagggttttgtcctttacatacatgacatatggagatgaacaatactcctatatagtaaggtgtgtagtgtttgtagtaggatggaccctaagtactgtacgtggttctttttgttcgtgctgaagccaaaaaatatgtggatcctatatatctgcaaatcgtgtcaacatgtgacaatatagctgctttatttgtccacggtttaatttctccaaattaatctctatatatatcacctttatggatgcatactccgtattcaagatgcaaacataaacaggtccacttgccacactttttcttgctttaacact

SEQ ID NO: 5339 - DNA, 5056 bp, Zea mays
tgattcctaaaagctagatacttttccggagtgtgatgatgttatacagactgtgagcgaagaagggatgtcttatactcgggagtgagtctgttagaactagtttggtaagtatattttcttaagagatttttattttactaagagaaaataaactaattttttttaaaaaatattatttttttagaaaaaacggggtttccaagctaacctataaaatttggaagttgtaatgttccaacgacgtcaaacaatttgtttggcggtgtaataaattaggcacatgggtgaattaaactacattaggtagcagtatgaattaacggcgccggcatggtgacgtccacgagtcacgccctgcgagatcggaggcaccgaccaaccccaggtgtcccggtgtccccacgccctccgcctcctgatcctgatcctaagggctatgtcccttaaggagaatctgtcgcactctttagattggtcacatatactatatacaatattttgtaacatcccggtcgcccccacgcggcctctggcctctgccgcacgcgtgtccccgccgcaacacgtgtgcccaccactgagaagtgataattgagagcacacgctagggagggctgcctctacccccgtctcctgatccatccacgcgaaccctataaataaacgcaagcctgccattccagttaccaaattggcacttccgtaccccgaccccggccaccgtgtggaaacagaaacagcaatggcggggaggctggtgccgagcacgaagaaggcgatggagcaccgggaggagaagcccaaggtgccgtcgagcgacccgggctccgacctcgacctggtgcagctggtggccgggcagcagccgcccaacatctcggagatgaagccgctgacgcgggaggcgtacggcggcgggatgtacgcggccgaggaggagggcggccggcggaggggccccgcgcggccgcgcgcgagcgccacgcagagcgccgacgggcccgaggagcagcgcgctggcgcgaggcccagccacccgccgccgccgtccaccggcgaccgcgacctcgacatcaccggccagtcctacatccagtagccgcatgtgccggctgccgagcgccgcgcttgggcgttggccattggcgttgtgtgtgtgtacacagtacagtacagtaagtacttgctagtatacttggttgtgtacttgccaaagtgtccttgtacacgtcgctttgttaagatgtgtacgtacgtactagttgccgacgaataaaggtttggacttgggctttcagaaatcccctgaaggaacgagtaaaggtttgggcttacggttgcaggacgacctaaagggactgaagcgattcaaccagcccagcccagtcgcacttgccgtcgcggcccatctgttccgttctgttggctcagctcagcgtcttggagaattcgacaaataaacgtttttgcactattattaacccccgcacgcgcgtttttttctttcaaaaagagaaatacgaaacaaacgcagaattataacaaggaagacaaaatgaaactgaactctccatacaaagccacgtcgtcacccgcactgttccatacgacagcagcggctgggatgcgccttcggacgcaccgcagccaagcgcttccaaaacccgctcggccgatgagagcaggagaagaaacatgccatgccagcatcagcatccgcgcagggtcggtatcgggggaaagcgcggcaacggaccggcgtgccggagccggaggcaaagctgagccacgagctatctgccgcttttccacgtagtaaagctttgccggggcctgatcctgatctggtttcggcagccacgttggcacagagctacttgtccacatgttcttcgccacatgttcttcgggggtgacgtgcttgtttgaagaatcatttcgagatactgcatgtgtaatccctatgtgtttttttttgtttctttggaaactggataatgcacaaaaatctaacacagaccatattatcaactttgtgagattatggcgtaaaatcaatacaaagtttacaagctgtttggctaaaaataagatctagaatgagaaggtatgcacattaaaactaatagctacttaaattagttagagacatctagacaacccgactaatactttagctatcagagcatctctaaatttatctccttaaattatagatttagagagttattaaaacactttaatgaataaaaaaacatttatgataacggttctctatttattatttattaatagttgatattttttaagttgtccacaacataaatgggtctgtttctatttttgactgaactaacagtagaaatagaaatacgtatcaataaccttctctggctttttttcttcagtggtatagaatctgtttaagatcttgacgggatgcacattttatcagcctccataaaaaatgccagcaacgtcttcgtgagattgaagctatcgatggaagatcagatggacgtgtgataacacacattgtctacagaagtctttgtggcgataacatgaaggcatcacaggaggtgctttggcgacaacctgaaggcaacaacatgaaggcatcacaggtgctttggtgtggtctcggtacaagaggttatctagtggcgatagattcaaaacgtctgaaggggtggagatggatttgtggacacaaagccggtgggacgacccgaaacggcagcaaagtagtcttttcgcgatggatttggtgtcaacgttgatttcgagagtcctaacaaggttgttaaatgtacatatgaaattgggttttgaaatgagtttgtgaatgttggaacttctttagtttttcttgaaaacttaaattcatacttatggggtaaattaactactacatatgctcttaattacttttagttaaaaacatccaaacatccgtatccaatatagttcaactaacttttaattacaccctcaactattatttgttgtttaacctatctaaagctagtcaatagttagtcaactaatttcactagcaactttttagttagctaactattagctctagtatatttaaatgggtcttattatattattcgactttcattgttctacaacaaacagataattaataagagctagtttagaaaatcaatttcccttcatatttagatggaaacgagaagaaaataaactaatttatcccttttccactccaattcagaaggaactactagtgcgagaaaaatggctcgggctcgacgagccggctcgagctcgatgatactaggttcacgagttggcaacgcgcaaatccagatttacaagctcgccaaaatcacgagcgaagcggagctagcttgcgcgagctcatgagccgctcacgagctgacccaaacacccaacacaataggctgcttcgatcggtccaaacccaatagaaagctctatggaccaaaacccaaaatacacacaaaacctaagacgctaatccatctccatccaacaactagggttggaaacgagacgagctaaaccaggctcgactcggttcttcaacgagctataaataatggtccagctcgtctcatccgctcgcaagccgtctcgagcggactaccctaaaagaaatatgggacgaaaatggcttcgattttcctcaaatttttggttgttgtgatactcgaataaatgttctacatttaagcgcatacaaatcatactcccccgttctaaaataatagttattttagctctagatttttatgtctatattcatatagatgattataaacctaaatatatatagaacatatacattaattattgtatgatctaataaaaagatattttttaaaatttgggacgaaaagagtattgttttttgaatgtgccctaagactattttcagtgtaagtttcattgcacggtttctaaaattgatacatcaacttttatgaaactatgtatcctaaattttatcatggatgaaatcctctctctttctatgaaactctctccatctctcttattataaatacagtgacattcattaaatatgttgatgtgttacattagaatgaaactgtgatgaaattccatcgggaatggcctaattaccttccccaaaatcaatttggcagcccaactacagttgcatgcgtgacatggtcccacgttacatcctcccgtgacacaggctgatgacaggcacagccaggccggtctgaaactctgaatctgccaccgacaagtgggttcgtccaccgcaccttctcccttcttcgtctccgtctctcccagccccatatcaacgggggacggctctctcgccattctccatccgaaaaacccatagaaacttccctcgtttctctctcctcggccccgcgggagcgaaccattatcagtcgctctcgttggtccggagcagcgatgcgcaccgcctgcctccgccccaccattcgaataaaaccctcccctccgcctccctccttccgccactcctaggcccattcccacccgcgccagcctcggccgccgcggccgcaccacccacggtcccgcctcgccgtggcatgagaagatggccgcgtgctccaggggcctcgcgtggccgccgttcgatctgaccacggcgaggggggcggcgtcctggccgcgccgccgcgccacgatccggtgctgctgcgccgggacggacccagagccgcggaggcgactctcgagggcggccgcggccgcgcccgagcgtgccgaggagtggcgcgtcgatgggaacaagccgtctgccgcggcaccggcccggcggcgcgctagtctcaccgccatgcccccgctccccttcccggcacctcggtacgttggagggcggctggcaacgtcgcatctagggatttttttagttctatacaggacttgaagggtgtgcccggcctcgcatttaacagttatcagtcgcttgcatcattccgacaatttgtttttgtgtgtggttattttggttgtcgtaatgacaggttaacgtgcc

SEQ ID NO: 5340 - DNA, 1352 bp, Zea mays
  misc_feature (30)..(30): n is a, c, g, or t
  misc_feature (1020)..(1020): n is a, c, g, or t
  misc_feature (1033)..(1033): n is a, c, g, or t
  misc_feature (1079)..(1079): n is a, c, g, or t
  misc_feature (1114)..(1114): n is a, c, g, or t
  misc_feature (1150)..(1150): n is a, c, g, or t
  misc_feature (1176)..(1176): n is a, c, g, or t
  misc_feature (1201)..(1201): n is a, c, g, or t
  misc_feature (1216)..(1216): n is a, c, g, or t
  misc_feature (1231)..(1231): n is a, c, g, or t
  misc_feature (1268)..(1268): n is a, c, g, or t
  misc_feature (1275)..(1275): n is a, c, g, or t
  misc_feature (1332)..(1334): n is a, c, g, or t
  misc_feature (1337)..(1337): n is a, c, g, or t
  misc_feature (1339)..(1339): n is a, c, g, or t
  misc_feature (1341)..(1341): n is a, c, g, or t
  misc_feature (1351)..(1351): n is a, c, g, or t
gtaactcttgcggtcttcccctcattgganatgcacacagagatgcgagaattggtcccaaatttccacttcccggcagccatggttgactgcagacgcacgcaggacacagattgggatccatgcaactctacctcgaagcactataaatagggtcccctcgcggccggcccggagagagaccttacggcttaagcaagtagcttcattcaccgagcgtgcaggcacaggcagcagcttgccatggcgtctcccaccttgatgcaatgcctggtcgccgtttccctcctctcctgtgtcgcccacgcacagctctcgcccacgttctatgcgtcctcctgccccaacctgcagagcatcgttcgggcggcgatgacccaggccgtcggcagtgagcagaggatgggcgcctctctgctcaggctcttcttccacgactgcttcgttcaaggctgcgacggatcgatccttctcgacgccggaggggagaagaccgccgggcctaacctgaactcggtgcgtggctttgaggtcatcgacaccatcaagcggaacgtcgaggccgcgtgccccggcgtcgtgtcgtgcgccgacatcctcgcgcttgccgcgcgcgacggaaccaaccttctcggcgggccgacctggagcgtgccgctcgggcggcgggactcgacgacggccagcgcctcgctcgccaacagcaacctcccgcccccgacggccagcctcggcacgctcatctccctgttcggcaggcagggcctgtcgccgcgcgacatgacggcgctgtcgggcgcgcacaccatcgggcaggcccggtgcaccaccttccgcggccgcatctacggcgacaccgacatcaacgcctccttcgcggcgctgcggcagcagacgtgcccgcggtccggcggcgacggcaacctggcgcccatcgacgtgcagacccgcggtgaggttcgacacggcctacttcaccaacccctgctgtcgcggcggggcctgttccactcggaccangagctcttcaacngcgggtcgcaagacgcgctggtgaagcaatacagcgccagcgcctngctcttcaacgccgacttgtggcaaccatgattangatgggaacctttgggtgctcaaccggaccgttggnagatcaagggcaacttgccggtcgtnaaaactagaaatccatcggatcgancgattacttgaactntactagcttgttgtnaacgaaccccattgatggatcgaccgcacaaactcgntttgatnaacccaatcggtcctttagattttcctaatttactttgatgaaacctattaatccannnaanangngaagaccccnt

SEQ ID NO: 5341 - DNA, 3301 bp, Zea mays
  misc_feature (3)..(3): n is a, c, g, or t
  misc_feature (5)..(5): n is a, c, g, or t
  misc_feature (7)..(7): n is a, c, g, or t
  misc_feature (10)..(10): n is a, c, g, or t
  misc_feature (23)..(23): n is a, c, g, or t
  misc_feature (26)..(26): n is a, c, g, or t
  misc_feature (29)..(30): n is a, c, g, or t
  misc_feature (32)..(32): n is a, c, g, or t
  misc_feature (38)..(38): n is a, c, g, or t
  misc_feature (40)..(41): n is a, c, g, or t
  misc_feature (49)..(49): n is a, c, g, or t
  misc_feature (58)..(59): n is a, c, g, or t
  misc_feature (82)..(82): n is a, c, g, or t
  misc_feature (91)..(92): n is a, c, g, or t
  misc_feature (105)..(105): n is a, c, g, or t
  misc_feature (110)..(110): n is a, c, g, or t
  misc_feature (117)..(117): n is a, c, g, or t
  misc_feature (119)..(119): n is a, c, g, or t
  misc_feature (137)..(137): n is a, c, g, or t
  misc_feature (148)..(148): n is a, c, g, or t
  misc_feature (151)..(151): n is a, c, g, or t
  misc_feature (153)..(153): n is a, c, g, or t
  misc_feature (159)..(159): n is a, c, g, or t
  misc_feature (170)..(170): n is a, c, g, or t
  misc_feature (176)..(176): n is a, c, g, or t
  misc_feature (186)..(186): n is a, c, g, or t
  misc_feature (196)..(196): n is a, c, g, or t
  misc_feature (201)..(202): n is a, c, g, or t
  misc_feature (234)..(235): n is a, c, g, or t
  misc_feature (238)..(238): n is a, c, g, or t
  misc_feature (247)..(247): n is a, c, g, or t
  misc_feature (1129)..(1129): n is a, c, g, or t
  misc_feature (1474)..(1474): n is a, c, g, or t
  misc_feature (2879)..(2879): n is a, c, g, or t
ggnananttngttattggggganggnaanncnttttgngnngccaattnaggcacctnnggggggggaataaaaaaggtaanaattgtttnnaaaaaaactcccnccccnaaaggcnancttgggcagttttatttncttttttggcnagnangccctntcccccccccngaaaantaaggcgctntcgggggcgnacacnnatgggcagggccgggtgaacccctttcgcggnnggnaatttatgngaccccgacatcaacgcctccttcgcggcgctgcggcagcagacgtgcccgcggtccggcggcgacggcaacctggcgcccatcgacgtgcagacgccggtgaggttcgacacggcctacttcaccaacctgctgtcgcggaggggcctgttccactcggaccaggagctcttcaacggcgggtcgcaggacgcgctggtgaggcagtacagcgccagcgcctcgctcttcaacgccgacttcgtggcagccatgattaggatgggcaacgttggggtgctcaccggcaccgctggacagatcaggcgcaactgccgggtcgtcaacagctagagatacgcatcggattcgatcgatatacttgtagctatagctagcttgctcgtcgaccgagcgcccattgatggatcgaccgacacagagctcgcttctgatgaaccccagtacgtgtactctctagtatatatacatagatatagctatagattgaacacgtcatcaataccagtagaataagtggtgaacgaccacgcaacgacaagagtgatcgaagcagtgtcacttggttaccgaaatgattcatctgacattttcgtattggattttgaacgcaactatatatatagacaccatccatgtttactctggtctcagtcatgtgttcgaaagcagtgaaggcacatcgctcatattgtagcatctcggctagactgttgctgtacttcaagcctctagctagtagctagtcgtgtcacgtgttctcaactggaaagaacgagacaaactggaagtatttgcattgggccaaaaatctgcaggggttgtgcctcaggctttatgtgcccgccgctcgcccagttcttgaactgaatacgtgtaganaattcaatttgcttcgatccactttcgtcgtccgatttttctccctaattaaaccagttctttaacctcatcaactttttaactgtgactttgatgatgtagcaccacgtcagagatggttaattggaataagtttaaagtttaagcaggtaaatcacaccagaatattatttaaaaaatatccaaaatcatgaaaatatattttgaaaaaacatttttttacatgaacgcagttgtgttcatatgcatggtgattgtccgactacgtagaagccctggaattatgtttgtgcagcagagcgaacgctggtcccttgccctagatacattctaaaataagttgtnttaggcctcgtttgggataggcagcccacggtcatagacaacacgagctcttcgtatgcgtgtttgggatgcctgttcgtaggattgctaagcccgtgtaccggcagttttgacgggggtagggttctactcctccggcggctggttttgtgtgccccgcgacgtcctaactttgcgccgcctccctcacacgccgccgccgccgtcgtcagccaccgtccagccgtcgccacatctctcattcacggccccaggttgttgtttctctcgacctcacctctgctttctcacccgctgtccgtgccatcgccatctctctcatcctccaccgccaggttgcagacgctgaagaacttgcccttgaacggtgtacggcgacggcaagaagacgtggagcttccaggacgtcttcgatctggtgagcacttcgcttattttctcccttccgatttttgtttagttgcagttcatggtcagtggacgatggcaagttttctcccttccgatttatggtcagtggacattgagcctctagcatcctccaccagatttatccatctataattctataggctgaaaatctggttgggttgggcactcaaccaccctgagctgtacaagttgtagagtatgttacgtttctccttatttttctctaaatatgttctgattagttttcattctagattgagtggtagttgtgtttttgtgtacctgaaatggatttattttacgatgaaattcactagataattttaaagtttttgtttatatgtttttagtttcacagtatcttgatgttctactagtgctagttagttagcattgcttatccatcttggtgttagttagcattgcttatccaactatatgtcgtacatactatgttcaggtcatcagttagcatttcttgtgtttgaattatataactgaatgccaagctagtcatgataattgtatctctctctatataatagataatgagttcttgggaggaggatgctagacaatttcttttagaccaggaagaagatgatgatgaactcttcttagtaattgtacctgttgttctcgcggctatgcaagaagagaaaagggcagtccatacttcttctcttactggtgctatgaagattaaggaagttctagaagggcatgaaatttggagcaaagttgagtttaggatggagcaagatattttcagagcgatagtagctttccttagagccgaggatcttctacgtgacacacgaggtgttactgttgaagaacagtttggcatgtttatgtacatgatctcgcataatggtactaatcaagatatgcaaaaatggtttcaacacagtggtgaaaccattcacaggaagataaatgaagtctttgatataattccagccttgacaantaggtttgtaaagcttccaagttcagtacaaactcacatcaaaattgcaactgactctcgtttcatgccttttttccaggtagacataaaacccaagaatttctaattcttcttaggtttgtgtgcctctaataatctctttcctaacatgcagaattgcattagtgccatagacggtactcttattcctatcactatttcagaagacaaggctgctccatacagaaataggaaagggtctttatcccataatgttatggtagcttgcgattttaatctaaactttaccttcatttcgtgtggatgggaaggatccgcatcagatgctggggttcttcgttcagcacttgatagaggattccatgtgctagaaggaaagttttatcttgtcgatggtggatatgcaaatacaccatcattca

SEQ ID NO: 5342 - DNA, 518 bp, Zea mays
  misc_feature (510)..(510): n is a, c, g, or t
ctctctacccggagaaaacaaaaccagaccatcagcaggagactggggtgtgagtgaccgtgcgagaagggggaaaaacaatccaaacactctcgccagcacacaaatctcgcgcacgggttcgggggcgccagctcgatccgcggccgaaaccctaggtggtgacgacggtggtgctccgtggtggtgctggaggacgaggaggagggctgggagcgatgacgtcgccgaggaaggacgcggggttcctgacgcaggaccagcgggagaagctgcggatcgcggtgcagaacgcggagacgcagtcgctcgcctccccgcgctcgcccacggggggcaccacctccgcgctgctgcagcagtacgagctgcagatgctggagcagaagcgcgccgccgcggccgccgccgccgcccggggcggcggcggcggcggaggtgggcccaggcacgtgcgccggtcgcattccgggaaggccatcaaggtgaagaaagatggagctggcggcnaagggact

SEQ ID NO: 5343 - DNA, 2740 bp, Zea mays
aacgaaacgaaaactctcacgcgcgacctccaccgcctcccgccggttccggatcgcggaccagcgcccctcgcccaccccacgcatccgccgtccaccagaacgcattctacggctccccacccacgatccgtgtggtcgattcccattggctgttcgctgcggaccctcgcctttatatattctcgccctcccactcggcccgcattcgcctctcccgcgacccgtaccccgcctcccggttcaaccaaatccctctcgcctcatccccaccagcgcaaagccgccctatcgtcctgtcgtgagaagcaatggcgggccgtggcaaggcgattggcgctggtgccgcgaagaaggcaacgtcaaggagctccaaggctgggctgcagtttcccgtcggcaggatcgctcggttcctcaaggccggcaagtacgccgagcgcgtgggcgccggcgcccctgtctacctcgcagctgtcctcgagtacctcgccgctgaggttcgtgccccgtttccatttcgccttaactgtggggttcgcttcgggtccctgtcgctgccgtcctatctggttgttgctccgtctgcggtgcgacagctcctagatctgaatcgaatagtctcgttgatttgttgcataattataaagtgatttcaaaggatttgtcgccggcattatctgcacttttgctttattggtgaccaaaacaattcctcttgattatttgctagaatagtaaatctatctaggagtcctataattaagctgtcatcagtaattttgtacatcaaacgttctagaaacatgagctaaatgcctctttactatttttgcctgtagcattctgtctcggcttcgccttttatcccgcgaaaccccaagcgccagaagcaatttcatctgacctaccttttcgtttttattcgatgcttcaacaggtcctggagcttgctgggaacgcagcgagggataacaagaagacccgcatcgtgccgcgtcacatccagctcgccgtgcgcaacgacgaggagctgaccaagctgcttggtggtgccaccatcgcgagcggcggcgttatgcccaacatccaccagcacctcctccccaagaaggctggctcgtccaaggcttccaccgtcgatgacgatgacaactgaagctgcccactggagaaggcattcgctaccgtcttgtttcctaggtttagcacgcagttagtcgccatgtctttgagagagttcgatgtgtttgggaatgacaatagttcctttcttggttccctaagttcgttgaatcagatgtgaatacggctaaggtttttgggttatgcaactctgggacgtacgccagttgatttgatcgtttgaaaagaaatggaaggacgttaaagtttgaacaattctgatgcgttttatttcaatttctgttcagaattagctatctgttgctgctccgatttcagtgtgtacctcatttacttttgaggtaacaagctcgtttcaactgtgttttcaccgataattggaacaaattgatcgacaatttagcacacaacagtttcttaggaatcagccgccgaaatgcccgcaagaaatgacaaattctgaggccgacgcccgggcaaacggctctgtttgagtgtaaagctaattcgtacacattaaaaccacactcatgcaatatgcagtgtaaaaaaatgttttgattgaccaaacaggtgaactgctagacatggtgtaataggtataaaaagacttgtttactcgattccgctggttaacgtttaatctgtatcaaattggatttttgaatgtcaattacaaacatcaattagtaagtcttggactgtagtttgtcgtgttgttttgtctttatgttgaacaaaatcctcatggctcgattactgtatcagggttcaacaaaatctttatggctcaattactcgtacgacttaacttgttaatggcttggcttgttttattattttagcagatgaatcggtcttctagctcggttctctgacgagtcaactctcaatgacaagcactttatctagttatcagtgacgcctcacctattctagttttgttctctcgtagttataacatatatatagacatatgtgcatgttccatgtaattaaatttatgtatggctatatatttatattgtttatttaatatttgattactagtgttggttttatgaatttgtgtttactagaagtatacaacattagtgttgtgaaatgaaatattatatatttgtggaatgaatgattgaacccagattggtgcgtacctctttgttgggtgtgtcatatcgagtttttttagctttgggttgtttttgggttgagttagattttaaataaaaaatcatgttagcaatctctttttctatatctttaatttctagagtggtttcctaaatctcctgttatatggcactataacaataaaatattatttgtcatacctattaattatcagttactattttttcttaattaacaaactatgctgcccacggaaatcaagactaggaggccggcaggcgcgtctccaaatatggtggttcgctgtacaaaacgttaacattatagctgttgcggggggaaatgatgaacacaaatcgtcgccagagtgaggtgggtgcgttcggcggtgaccgctgctatgggaaaaaaaagtctcggaggcccactggcaatttatgtgcgacccacaatccggacg

SEQ ID NO: 5344 - DNA, 836 bp, Zea mays
cattgggtccctcgaggccggccgggtcgggattcgcctctcccgcgacccgtaccccgcctcccggttcaaccaaatccctctcgcctcatccccaccagcgcaaagccgccctatcgtcctgtcgtgagaagcaatggcgggccgtggcaaggcgattggcgctggtgccgcgaagaaggcgacgtcaaggagctccaaggctgggctgcagtttcccgtcggcaggatcgctcggttcctcaaggccggcaagtacgccgagcgcgtgggcgccggcgcccctgtctacctcgccgctgtcctcgagtacctcgccgctgaggtcctggagcttgctgggaacgcagcgagggataacaagaagacccgcatcgtgccgcgtcacatccagctcgccgtgcgcaacgacgaggagctgaccaagctgcttggtggtgccaccatcgcgagcggcggcgttatgcccaacatccaccagcacctcctccccaagaaggctggctcgtccaaggcttccaccgtcgatgacgatgacaactgaagctgcccactggagaagaggcattcgctaccgtcttgtttcctaggtttagcacgcagttagtcagcatgtctttgagagctcgatgtgtttgggaatgacaatagctcctttcttggttccctaagatcgttgattcagatgtgaatacggctaaggtttttgggctatgcaactctgggacgtacgccagttgatttgatcgtttgaaaagaaatggaaggacgttaaagcttgaacaaaaaaaaaaaaaaaaaacggcccctaaggcctgcggcgctacctctctgct

SEQ ID NO: 5345 - DNA, 848 bp, Zea mays
cattgggtacctcattgggtacctcgaggccggccgggattcgcctctcccgcgacccgtaccccgcctcccggttcaaccaaatccctctcgcctcatccccaccagcgcaaagccgccctatcgtcctgtcgtgagaagcaatggcgggccgtggcaaggcgattggcgctggtgccgcgaagaaggcaacgtcaaggagctccaaggctgggctgcagtttcccgtcggcaggatcgctcggttcctcaaggccggcaagtacgccgagcgcgtgggcgccggcgcccctgtctacctcgcagctgtcctcgagtacctcgccgctgaggtcctggagcttgctgggaacgcagcgagggataacaagaagacccgcatcgtgccgcgtcacatccagctcgccgtgcgcaacgacgaggagctgaccaagctgcttggtggtgccaccatcgcgagcggcggcgttatgcccaacatccaccagcacctcctccccaagaaggctggctcgtccaaggcttccaccgtcgatgacgatgacaactgaagctgcccactggagaaggcattcgctaccgtcttgtttcctaggtttagcacgcagttagtcgccatgtctttgagagagttcgatgtgtttgggaatgacaatagttcctttcttggttccctaagttcgttgaatcagatgtgaatacggctaaggtttttgggttatgcaactctgggacgtacgccagttgatttgatcgtttgaaaagaaatggaaggacgttaaagtttgaacaattctgatgcgttttatttccacggccatgttcaagaatgcgccctctgttgctgc

SEQ ID NO: 5346 - DNA, 849 bp, Zea mays
attggctgttcgctgcagaccctcgcctttatatatctttgggccccccgaggcgggccgggcctctcccgcgacccgtaccccgcctcccggttcaaccaaatccctcgcctcatccccaccagcgcaaagccgccctatcgtcctgtcgtgagaagcaatggcgggccgtggcaaggcgattggcgctggtgccgcgaagaaggcgacgtcaaggagctccaaggctgggctgcagttcccagtcggcaggatcgcccgtttcctcaaggccggcaagtacgccgagcgcgtgggcgccggcgcccctgtctacctcgccgctgtcctcgagtacctcgccgctgaggtcctggagcttgctgggaacgcagcgagggataacaagaagacccgcatcgtgccgcgtcacatccagctcgccgtgcgcaacgacgaggagctgaccaagctgcttggtggtgccaccatcgcgagcggcggcgttatgcccaacatccaccagcacctcctccccaagaaggctggctcgtccaaggcctccaccgtcgatgacgatgacaactgaagctgcccactggagaagaggcattcgctaccgtcttgtttcctaggtttagcacgcagttagtcagcatgtctttgagagctcgatgtgtttgggaatgacaatagctcctttcttggttccctaagatcgttgattcagatgtgaatacggctaaggtttttgggctatgcaactctgggacgtacgctagttgatttgatcgtttgaaaagaaatggaaggacgttaaagcttgaacaaaaaaaaaaaaaaaaagcgcccccaaaaaaaaaaaaaaaa

SEQ ID NO: 5347 - DNA, 848 bp, Zea mays
attggctgttcgctgcagaccctcgcctttatatattctcgcccgcgtggtccccggccgggcgcgcattcgcctctcccgcgacccgtaccccgcctcccggttcaaccaaatccctctcgcctcatccccaccagcgcaaagccgccctatcgtcctgtcgtgagaagcaatggcgggccgtggcaaggcgattggcgctggtgccgcgaagaaggcaacgtcaaggagctccaaggctgggctgcagtttcccgtcggcaggatcgctcggttcctcaaggccggcaagtacgccgagcgcgtgggcgccggcgcccctgtctacctcgcagctgtcctcgagtacctcgccgctgaggtcctggagcttgctgggaacgcagcgagggataacaagaagacccgcatcgtgccgcgtcacatccagctcgccgtgcgcaacgacgaggagctgaccaagctgcttggtggtgccaccatcgcgagcggcggcgttatgcccaacatccaccagcacctcctccccaagaaggctggctcgtccaaggcttccaccgtcgatgacgatgacaactgaagctgcccactggagaaggcattcgctaccgtcttgtttcctaggtttagcacgcagttagtcggcatgtctttgagagctcgatgtgtttgggaatgacaatagttcctttcttggttccctaagatcgttgaatcagatgtgaatacggctaaggtttttgggctatgcaactcagggacgtatcgtttgaaaagaaatggaaggacgttaaagcttgaacaaaaaaaaaaaaaaaaaaaaccaaaaaaaaaaaaaaaaaaaaaaa

SEQ ID NO: 5348 - DNA, 917 bp, Zea mays
tcgtcaatcttatcctcctgcctccgccctcccccgccgcgacctttatagctctagcttccttcctccattctctacccatgccttcatcttcgtcgtcttgcagccccgcaacagtcgttagcttagagcatcgcacctcatcgttccaccgtccgtccgtccgctcgttcgcgtgatctgtttgagagttggggaatggaggcctacgtcctgttcgcgcccgccaaggaggtgatcaggttcgaggagcaggaggaggacatcggctgcccgtccgagtcgtccgcggcgcgttcaacgtcgtcgtcctcctcctcgtcagacggggtggacctcgccgacgacgccagctcgtccgggtccagctgtcacttcgagatggcctccctcatgacgcagctcccgatcaagaggggcctgtccaagttcttcgacggcaagtcgcagtcgttcgcgtcgctggcggcggtcggcggcctcgaggacctgcccaagccgccggcgaagcggctcaagacgtcgcggagctgcggcgtcggcctcgaggacgcgcaccgccgtggccctccctccgcgaccggcaggaagcaggcgtccagggctcggctgacgccgccggcgctcgcctcggcgccgagaaggctggtgcgagcgcggccgctcgtactggcgagaccggcggcggccgggaagcccctgttatttgcgtaggggatccggcggccgcctaccaggaaaatcgctgtgacatgataccgctgttagtttgcctgagacttgaaaatgaaatggccaaacgagatttggcgactaggcgcgtgtaaaatattttgcaagtcccagctaacatgttacttacaaatgtttctccctctgaatttgttccaatttgcatcaaattggtctgtccttcc

SEQ ID NO: 5349 - DNA, 923 bp, Zea mays
  misc_feature (1)..(1): n is a, c, g, or t
  misc_feature (5)..(5): n is a, c, g, or t
  misc_feature (7)..(7): n is a, c, g, or t
  misc_feature (11)..(11): n is a, c, g, or t
nacananaggnctgctgtagataatgctacacttttccggggttttctctctctctctctcccgcgagctgactgacggctcctcgagcccctcccccgggcatcccccagctactcgtcattcttatccgcctgcctccgccctccgccaccgctacctttatagctctagcttccttcctccattcccacctcatgccttcgtcttcgtcgtcctgcagccccgcaatagagcatcgtacttcatcgttccacttacatcgtttgttcgctcgttcttccgcgtgatctgcttgggagttggggggaatggaggcctacgtcctgttcgcgcgcgccaaggagcaggaggaggacatcggctgcccgtccgagtcgtccgcggcgcgttccacgtccgagtcgtcggacggggtggacctcgccgacgacgccagctcgtccgggtccacctgccacttcgagatggcctccctcatgacgcacctcccgatcaagaggggcctgtccaagttcttcgccggcaagtcgcagtcgttcgcgtcgctggcggcggtgggcggcatcgatgacctgcccaagccgccggcgaagcggctcaagacgtcgtggagctgcggcgtcggcctcgaggacgcgcgccgcggccctccctccgtgacgaccgccaataagcaggcgtccagcagggcacggctgacgccgtcggcgctcggctcgacgccgagaaggctggtgcgagcgcggccgcttgtaacggcgagaccggaggcggcggccgggaagcccctgttatttgcatagggggaagggattcgcctgcctaccagtaaaatcactatcacataattcggctgttacttgttagtttgcgcggaactgaaaagtgaaagtggccagagattgacccagttccgcgtgta

SEQ ID NO: 5350 - DNA, 1595 bp, Zea mays
gcactagccacccgacctggctgtaggctgtagctgtctcctatatgctgccggcctatcctgcccgcccgccggcatcaatcatcaccgcaagcgtgcgcgcaacccagctcccaccgacgactgcaccggccgtcgctgccgcgctacttcggccccttttccggcgacgagcaccaccaggtagctgctaatggagattgacagcctcagagaaggatttgatcgagttgctgagaaacgttcattatcttctgctaaagctctggaagttgttgatcaaatagtgaatgaaattgagcaggctattgtgaagctgcagatgatgaatacagattctactggaaatgttgaccacccatccatccttgcagaactgaaagctaagctcaatgaaatggcaccactaaaccagcttgaaggcagccaaaaggagctcaatgttgctctgagcaaatatctcaaactccttgagaagtctttcaatccagatatatctaaggcatacagaaatgtggattttgaggtccatacagtaaacaatatcatagcgaatcatttctaccgccaaggcctctttgatcttggtgacatgtttgtccatgagtgtggggaactaggcggagcttccttgaagctaccgtttcaggagatgtatgctatccttgaagccatgaaagcgagaaacctcgagcctgctctcagttgggctgccaaaaaccatgatcagctgttgcagaatgggtctatgctggagttcaagctttatcagcttcagtttgttgaaatattgtccaaaggcagtaggggtgaggccaaagatgaggctcttttatatgctaggactcacttggtcccctttgcagccgtgcacaaggaagaattccagaagctaatggcttgccttctatgggttggccggctcgatcaatccccatattctgagttaatgtcatccgcgcattgggagaagctagctgaggagctcacccatcaattctgtagccttctgggccagtcgagggagagcccgctgagtgttgcagtgtcagctggttttcaaggactaccaactctgctgaagctgacgcaagtcatggctgcgaagaagcaggagtggcaagttatgaagcagcttcctgtccccatagacatcgggccagaattccagtatcattctgtctttgtgtgcccggtgctcagggagcagtccagtgacgagaatcccccaatgcggatgccttgtggacatgttgtctccaagcagtccatcatgaagctgtcgaaaagcagctcgagggccttcaagtgcccctactgcccctcggaggctatggcgtcgcattgcaagcagctgcatttctagatgtgttaatcttttctggctgcgcaaaactgcaaacctgttggtacatgtttcccctcctgttccatgttgcaccagtccaataactgtctctctgtaatataaacatctacgtccggataaacatgtagtttcgtctgtattactgatatgtacagttgcatctttgatctttcagtgtgttgcttaagtctcttctggagattaaaggaaaaaaaaaaaaaaaaaa

SEQ ID NO: 5351 - DNA, 1692 bp, Zea mays
cggacgcgtccgcccacgcgtccgtcaccgcaagcgtgcgcgcaacccagctcccaccgacgactgcaccggccgtcgctgccgcgctacttcggccccttttccggcgacgagcaccaccaggtccatgcagagtaggaaggcaccttttcgtcactcgaacctgttgcttgacctgcaagtgtcgggcggtgcacctgtgcccttgttgccgcgatgcagattatgtgggttttgagttggacagctgatggagtgcaaatctctggcctgccaggtagctgctaatggagattgacagcctcagagaaggatttgatcgagttgctgagaaacgttcattatcttctgctaaagctctggaagttgttgatcaaatagtgaatgaaattgagcaggctattgtgaagctgcagatgatgaatacagattctactggaaatgttgaccacccatccatccttgcagaactgaaagctaagctcaatgaaatggcaccactaaaccagcttgaaggcagccaaaaggagctcaatgttgctctgagcaaatatctcaaactccttgagaagtctttcaatccagatatatctaaggcatacagaaatgtggattttgaggtccatacagtaaacaatatcatagcgaatcatttctaccgccaaggcctctttgatcttggtgacatgtttgtccatgagtgtggggaactaggcggagcttccttgaagctaccgtttcaggagatgtatgctatccttgaagccatgaaagcgagaaacctcgagcctgctctcagttgggctgccaaaaaccatgatcagctgttgcagaatgggtctatgctggagttcaagctttatcagcttcagtttgttgaaatattgtccaaaggcagtaggggtgaggccaaagatgaggctcttttatatgctaggactcacttggtcccctttgcagccgtgcacaaggaagaattccagaagctaatggcttgccttctatgggttggccggctcgatcaatccccatattctgagttaatgtcatccgcgcattgggagaagctagctgaggagctcacccatcaattctgtagccttctgggccagtcgagggagagcccgctgagtgttgcagtgtcagctggttttcaaggactaccaactctgctgaagctgacgcaagtcatggctgcgaagaagcaggagtggcaagttatgaagcagcttcctgtccccatagacatcgggccagaattccagtatcattctgtctttgtgtgcccggtgctcagggagcagtccagtgacgagaatcccccaatgcggatgccttgtggacatgttgtctccaagcagtccatcatgaagctgtcgaaaagcagctcgagggccttcaagtgcccctactgcccctcggaggctatggcgtcgcattgcaagcagctgcatttctagatgtgttaatcttttctggctgcgcaaaactgcaaacctgttggtacatgtttcccctcctgttccatgttgcaccagtccaataactgtctctctgtaatataaacatctacgtccggataaacatgtagtttcgtctgtattactgatatgtacagttgcatctttgatctttcagtgtgttgcttaagtctcttctggagattaaaggaattccaaagtgtccccggcc

SEQ ID NO: 5352 - DNA, 2295 bp, Zea mays
  misc_feature (168)..(168): n is a, c, g, or t
ttgctaattaacgtgttaaccacctagtttagactcgccgcaataaggacgtaggttgctagtaagcaactaaaccttggggataaattattatgttcatttactttcttggtttggtttggtcactaccacatgcatttacttttatatatttttcttatgcgatanttgcttgagcatctatggagaagctcatatttataattagttatatttgtatctttagttagctctatagtgtaattgtgtagttgataatttatgtgtttgagtaaagttaacccatatacatagcaactagagttgtttaaggggttgtcgctaaatagagatagagctagagtttacatttgtgtcaccttttatttatactaatcaactttactctagtattttggggtattgaaagaaatttttatagggtattcaacatctctagctatctacatcttatcaaagaaacgtagggcatgaagccatggctgagcgatgaagaaggggtgcgaccagggaagaagaaacactcgggaagaaaaaatgaactgatcagtgatggtggtcagtaatttttttctccgataaatttgagttggtgccaaaaatagtaaatttggccatcatatccactagtttgatgaatttgaattaggtggttcaataccattttagaacttactgggttgcatgggaatcatagtggacgaagggggattaaatcacattctatttaattttgactagtaaaggatttaatctcctttaagacttgttcattttgacatgaatccatatagattggatgatattgagtcgatttaaatccataaaaaagtcaaaattcatcaatcccactcaatctcctccaattcacatagaacgaaaataaccgaacaagtccttaggccttgtccgattgcatgtagacttcaaatgtcgggtcggttcatgggtcatttggcatggtccgtatccgacctgtgtctaatgtcggttcagatcaagttggccggtgcttctttgtttagcatgtcgagattggtttttcgggttagttgggtttttcgggttgggtcgagttttggattaaaaatcatggctcacgcatggcttggggtttgttacgggtcaaaaactatggtatatacccgctcgttacattaatcgggtcgagtcagatttttttgacaggtcgctaggtcgggtctggttggtaattagtaggttcaggtaacccatacttaggtctaattgcatgagatcagagaggattgagtgaatggaatctcttttttattcaattttaactggcgaataatttaatcactttaaaactctttcaatttactccgaactgaacaatttaatcccttaatctcctcctagctatttttggacggtttagactccagagtccagacctaacctctgcagtctgcatcaccaactattccactagtaggtctaaattagtagccaagatgacgtcagcagcatcgttccccagcagcctcttccccttcccgaccagagcaagcacgccaccgcttccgtcgtcgtcctcccgaccgtctcactcccgcccccacctccgcatccgatctccgaaacctaataatccaacggtcgcgcccgcgtcctctcggatggaggtggcccagccccaggcgagcaacgcccagggaggggcggagccggccatgaagctactgttcgtggagatgggcgtcggctacgatcagcacggccaagatatcaccgccgccgccgtgcgcgcctgcaaggacgccatcacctccaactccatccccgccttccggggcgggtccattccaggagtgaacacggaccagatgaagctgcagatcaagctcggagtgcctaggtcgacgcagcacttgctggatgctgagagagtcaaggccgtcttcccctatggcaagataatcagctttgaggtcgttgacggtggcatgatctgttcaagcggcgtgtgcctggaagcaatgggggataagaacgatgactgctacatagtcaacgctgcagtgtatgtcggctactgatgtactgtagtacctggaatggaacagtagagattggttatggttcctccgttatagaaaaaaaaaactgctacctccgtcctaaaataaaatagttgatattttttcttcatagaagccaaatattgtaaactttgactaaatattactccctccattttcttttaaaaaaaaaaaaaaaaaccgccctcgcactatttggcgttaaataaaaaaaggatgtaggtagtat

SEQ ID NO: 5353 - DNA, 3436 bp, Zea mays
gttttaatttcaagtgtatttcatgctaagtcatagattaaaaggaaaatagagtcttcggcgaagacaaggttttcactccactccatcgaattattcatccttcgccgtcactccgcaccgttctccaatttggtataatcttcactcatatattatttaccaaagggggagaaagtttgaaaaagggcttatatgtcactccgcaccgttctccaatttgcttgaatctgatatgggccgatatagcgaggggctagcttgaccttgactccgaacctcttggttcctctgataggtaacatcttcaaatagacataatctcccacttcaaaactgagttctcttcttctggtgtcagcatagctttgttgtctagactatgctgccttcaaattctcccggaccattctgatgttctctttggcttcaaactaaatatctggtccgaacacctgtatttcactttttatattaacacgggtattctagattgcagtgcatgtagttaatatttgtagataaataagcatagcgctgcatgttgttacgtattatttgcagcctacttttttattaattgatcgccggaactgtttgtaattattttttaacgaacaaacggccgtaaagcacgtacatgtaccaacctatccatgatcacaaaatccatcgaacacaaacagacaaacaacaagtttaatccgtagaactttaggggatatttataaaattttaacgcgggatgacagttgaaaatgatagtagagatttaccctacatcacgctttacctcatgcagatgccgggccgctcctcggcatcgacggacggcggaatggcggatgaattagtacggccacggagtcaaaatgatagacactgacaagtgatcccaccaagtggcacgtgaccaatgccccgatttccgctttgcgcgcgcgtctgccgacgcggaaccgcccaaatgtacgaaacctccagcgcttcccgccggttccggatcgcggacccgcgacccgggcccactccacacatccgccgtccgcccgaacgccccaacccacgatccgcgtgatcgactcctattggctcgctgcgcgggcccgggcccgtgcccgcgcccctatatatcctcgccctccccccggccggccgctatctccctgtttaatcaatccttcaagcgcaagctgcctcctcctcgtcgtccggtcgtgagaagggatggcgggccgtggcaaggctatcggcgctggcgccgcgaagaaggcaacgtcgaggagctccaaggccggactccagttccccgtcggcaggattgctaggttcctcaaggcgggcaagtacgctgagcgcgtcggcgccggcgcccccgtgtacctcgccgccgtcctcgagtacctcgcggctgaggtttgtgccccgcttcgttttctttcccctctccttgttgcgattcgcttcgggtccgcgtcgctgcggtctcggatctggttgttttgccgtggaggattgttcctggatctgaaatgagtcgcggcattgtacttcataaaaagtctcaatacatttcccgattccaattgcttcgattgcacatctatgcatcctgtaatttaccaactaatttgaacagacttggcactgaattattcgcattgtaatttctaggtgaaccggacaattttctggaataatatatctctgaatcctgcaattaagcagttggtagtaatgttaagcatgaaccattgtagaaaatcggagccaaatgcgtccttactcttactatttctagcattttctcccgtcatttctcaatggcaatatatccagtgttccaatggttacaacagtttctgactatgttcatttatccacggtgcaacaacaggttctcgaacttgccgggaacgccgcgagggacaacaagaagacccgcattgtgccgcgccacatccagcttgctgtgcgcaacgacgaggagctgaccaaactgttgggtggtgccaccatcgcgagcggaggtgttatgcctaacatccatcagcatctgctccccaagaaggctgcctcctccaaggccagtgtcgacgacgacgacaactgagactgcttcctgcagaaatgatccgaccaccgccttgttttgtaggaataggatgatgttgtcttcgatcggggaggagtcgggtatgctgggaaggagaattagattagtatctgtttttttgaatgggatgtgaacgtggctgtgaatctcaggattgtatgctcgttgagaaagaaatggaaggacttcgtgatgcacgatgttgatgccgcatcatattcagcgtagaactgcatttcttctgagtggcaatggtgtcaccgaaaaatgaaagtatttggctggtgtcgccaatctgaattggtgaattctgatttgaggcctgcatggatggccagcaggttgcatgacatctagatccacagtcatgaggctcgtgccaaagttaactcaagggcttgttccgttcatttggaaacaataaaaaacccgtctagacttggcaggccaatttgatcgaaattgacgaacaagcgaaaaaagcccacctgggttcgtaagtcagtgatccaaaggtgaggcccacaattcgggagtaacacttgcggcatataaaacgaggacaattccctgtcgtttgtgtgctactggacctatatgtcatatacataaaataatgaaaataaattctgatagaacatagaatttttttcctataaaagatagcctgccacagtccacacgacacttcccttccaccggaaggttagacaactccagtaactactcctcacccccacttcgcatctgtatttaacactcgtcaccccccttcacatccgcattttacacgttgaggcatatatatggatacaaatggggattagaagaatattggagctttgtttgggtaatttagtattgatcacgtgtgctgaagtagattatgatgtaaattagtttaagttaaatactaatctattttaataaatgtgaattgagtttaatattagaaaaactaggactgagtgaattgatcaatgcggattgagagcagctccaaaaaaagcactaaaaatttgttcccaaaatcttttattagcgcatattggaaaataaaatccactaaaaatatattatctcacagtagatcactaaaaacttgtccctaaaaaaaataaaaagggacatgagccaacggatgctgtattgggccagtaaggatatgtttggtttgagatcaaagtgggatggggcgggggcgacatcgtcccctcgatttttttggatcatgccgctacaaaaagactactccgatatttacttcgtccctacatgactcttatccaaacattatagaaactgtgaccgctctctccc

SEQ ID NO: 5354 - DNA, 871 bp, Zea mays
  misc_feature (22)..(25): n is a, c, g, or t
cattgggacctcgagccggccnnnnaaatttccaattgggtaccattcggtgggtcccccccggccggccgggatctccctgtttaatcaatccttcaagcgcaagctgcctcctcctcgtcgtccggtcgtgagaagggatggcgggccgtggcaaggctatcggcgctggcgccgcgaagaaggcaacgtcgaggagctccaaggccggactccagttccccgtcggcaggattgccaggttcctcaaggcgggcaagtacgcggagcgcgtcggcgccggcgcccccgtgtacctcgccgccgtcctcgagtacctcgcggctgaggttctcgaacttgccgggaacgccgcgagggacaacaagaagacccgcattgtgccgcgccacatccagcttgctgtgcgcaacgacgaggagctgaccaaactgttgggtggtgccaccatcgcgagcggaggtgttatgcctaacatccatcagcatctgctccccaagaaggctgcctcctccaaggccagtgtcgacgacgacgacaactgagactgcttcctgcagaaatgatccgaccaccgccttgttttgtaggaataggatgatgttgtcttcgatcggggaggagtcgggtatgctgggaaggagaattagattagtatctgtttttttgaatgggatgtgaacgtggctgtgaatctcaggattgtatgctcgttgagaaagaaatggaaggacttcgtgatgcacgatgttgatgccgcatcatattcagcgaaaaaaaacaaaacaaaagagtggcaatggtgtcaccgaaaaatgaaagtatttggcctggtgtcgcccatctgcaaaaaaaaagcggccctggccct

SEQ ID NO: 5355 - DNA, 1321 bp, Zea mays
  misc_feature (34)..(34): n is a, c, g, or t
attgggacctcgagccggccgggaaaaaattccnaaaaaaaaaaaaaaaaacattgggtacctcgaggccggccgggatctccctgtttatcaatccttcaagcgcaagctgcctcctcctcgtcgtccggtcgtgagaagggatggcgggccgtggcaaggctatcggcgctggcgccgcgaagaaggcaacgtcgaggagctccaaggccggactccagttccccgtcggcaggattgccaggttcctcaaggcgggcaagtacgcggagcgcgtcggcgccggcgcccccgtgtacctcgccgccgtcctcgagtacctcgcggctgaggttctcgaacttgccgggaacgccgcgagggacaacaagaagacccgcattgtgccgcgccacatccagcttgctgtgcgcaacgacgaggagctgaccaaactgttgggtggtgccaccatcgcgagcggaggtgttatgcctaacatccatcagcatctgctccccaagaaggctgcctcctccaaggccagtgtcgacgacgacgacaactgagactgcttcctgcagaaatgatccgaccaccgccttgttttgtaggaataggatgatgttgtcttcggggaggagtcgggtttgttgggaaggaaaattagattagtatcagtttttttgaatgggatgggaacgtggctgtgaatctcagggttgtatgctcgttgagaaagaaatggaaggacttcgtgatgcacgatgttgatgccgcatcatattcagcgtagaactgcatttcttctgagcggcaatggtgtcaccgaaaaatggaagtatttggctggtgtcggcaatctgaattggtgaattctgatttgaggcctgcatgggtggccagcaggttgcataacatctagatccacactcatgaggctcgtgccaaagttttgaagggcttgttccgttcttttggaaacaagaaaaaaaaacccgtctagacttggcagtcctatctgatcgaaattgacgaacaagggaaaaaagcccacctgggttcataagtcagtagtgatccaaaggtgaggcccacaattcgggagtaacacttgcggcatataaaatgaggacaattccctgttgtttgtgtgctactggacctatatatcatatacataaaataatgaaaataaattctgatagaacatagaattttgttcctataaaagatagcctgccacagtccacacgacacttcccttccaccggaaggttagacaacttcactcctcaccccacttcgcatatgtatttaacaatcgtcaccccccttcaca

SEQ ID NO: 5356 - DNA, 891 bp, Zea mays
  misc_feature (859)..(859): n is a, c, g, or t
ctgtgcggcgctcgaggcggccgtttcaaaacgggtaataatccttcagcgaccctgcctcctcctcgtcgtccggtcgtgagaagggatggcgggccgtggcaaggctatcggcgctggcgccgcgaagaaggcaacgtcgaggagctccagggccggactccagttccccgtcggcaggattgctaggttcctcaaggcgggcaagtacgctgagcgcgtcggcgccggcgcccccgtgtacctccgccccccgtcccctcggagtacctcgccggctgaggttctcgaacttgccgggaacgccgcgagggacaacaagaagacccgcattgtgccgcgccacatccagcttgctgtgcgcaacgacgaggagctgaccaaactgttgggtggtgccaccatcgcgagcggaggtgttatgcctaacatccatcagcatctgctccccaagaaggctgcctcctccaaggccagtgtcgacgacgacgacaactgagactgcttcctgcagaaatgatccgaccaccgccttgttttgtaggaataggatgatgttgtcttcgatcggggaggagtcgggtatgctgggaaggagaattagattagtatctgtttttttgaatgggatgtgaacgtggctgtgaatctcaggattgtatgctcgttgagaaagaaatggaaggacttcgtgatgcacgatgttgatgccgcatcatattcagcgtagaactgcatttcttctgagtggcaatggtgtcaccgaaaaatgaaagtatttggctggtgtacgccaatctgaattggtgaaaaaaaaaaaaaaaaaaaaaaaaaaaagaaaaaaaaaaaaaaacccccnaaaaaaaaaaaaaaaaaaaaaaagtacctgcc

SEQ ID NO: 5357 - DNA, 1134 bp, Zea mays
ttgggtacctcgaggccggccgggaaagaaagtccggggtactctgtaaaaaaaaaaatcggggtcctccgcctcccgcaatgcctcccccttccgcctccgcctcccgcttggcgacccactggatagctgacgccctcgccgacgacgagtccctcgacttctccgtgctgaaggctctgtttggggactcgtcgaagtccctcgcgggagccccggaggccacgcgtgagcgggtcgcgctccggtgcattcaggaggtgtcgtccgtgatagcctctgggggtgatgccgcggccccggcgggggtgcctagggttgatggcgcttggtcatgcgaggatgtgttgtttcggcttatcagagacgttggaagctccggagaattggagaaggatttgcttccacctttaagtcaagacatccaggaatatatatgtaccaagaaatttacactaccagaaacttctttccagttgcttggaagttttggagaattggaggatttgcttccacctttcagtcaagacatccaggaaaatatatgtacaaagaaatttacactaccagaaacttctttccagttggcacccccgaatcccctgcgtccagcacctcatccaaccatcccgttctgtaggttcaaagaagtaaaaaacggatgtcattcgtcagttgtggaaatgaagcactacgacttgtgcacaatgaatttgaatgaagtgttgtcgagagtagaagagatgtcacaagaagaagcatctgtttgcggtcttatggatatggatgagcctagtcctcccagttgtgatgattcagttgaggttgaggacgacagttgctatgaaggtttaactgatgcagagtgggcagctgagaattatgcagattgggaggaactttataaccgtagtatgtgatctaggaaaactataaagtgtcatgagaagtactattgctgtagtacctgatccaagttgtgaggacttctattatgttgtagtatgtgcttgtgcttctagttgtggtgacttctattatgttgtactacctccgttctcgaatatttatcgcccgctattttatttttaaactaaaccgtgacaaatagaaaaaaaaaaaaaaaagtatgtg

SEQ ID NO: 5358 - DNA, 1640 bp, Zea mays
aatttttgccagtttctcataatccaaaaagaaacaaataaaatcatttactgacacccgaatactgtatcaattctggctcggaatctactagattttatagaaattacagacaaaaactctctttttttaattccgaaactgatctaaagctgctcgctgtactgcactatgcactctctcacctccctttatatttgaccaccgcccctctccaccaagcgcatccacctcgacctccatccctagcgctctcgccccaaagcacgccgcaggcgcagagccatcaccaccatccttccccccctctatctctctctaccccatccctcctctctctcctcatataccagcgacgctgcctccttccatggaagccagcaacaatgagtccgcgcccacggccgaggcagctgcaggcagcggcccggccggcggagaagggcggaagggcaaggcgcccaagggcgggcccgagaacggcaagttccggtaccgcggcgtgcggcagcggagctggggcaagtgggtggcggagatccgcgagccgcggaagcgctcccgcaagtggctcggcaccttcgccaccgccgaggacgccgcgcgcgcctacgaccgcgccgcgctcctcctctacggcccccgcgcgcacctcaacctcacctccccgccgccgcctacgctcgccgcgccgcgctcgcacccgcactcctcctccgccacgtcgtctgccccgccagcgctccgcccgctcctgccgcgcccgccactgcaccagctctccagcgacggtgctcctgcaccggatttccactaccacaatcagttccagcgccgtctcttgccgcagccgacacccacactatactacgccaacacggccacggcgtccacagtgaccaccagtgtgccgacacgggtggcggtcccgcaggagccggccatcgcgcccgcagtaggctcctcgacgtcactacaggagccgcaggtaggtcccccggaggaggcgcgcggggaggcagggtgggactacaacggcggcgaggaggaggattatgcggcggcgctgctgtgggacgagccggagcccttcttctggtttgatgtcttcctcaagtgatggccagcgcacgacgctgcatgccaactcgaatcctgcatggttggtttggagtttcggagtgacggcagctcatgctcatgcatctgcatgcatgtgttgggcagtaagcaagcaagaaaggtagataggcttgctagctagggtttctgattcctttgtactaaattatctttatattttttttatcttatccttcttttttccctaagggtgtgattgaggtatagtaatgtgaggtggtattactggtgggaggatttagggttctttgttgatttaaagattcaattttgaatcacatcgaatcgatttcttgcatggggatgcaatctatttaattgtggcatgtataaaaatcagcgatgcaacaatttttaattctgtgttttcttctatcgaatgttgaaccatgctgtttctattttactgttgtttctatttttacggtttcaagactttatgattcactaggttcgtgcccgtgcgttgccacgggagtaaaaaattagtatgaaac

SEQ ID NO: 5359 - DNA, 879 bp, Zea mays
cgatccgcacgacctatcgaggagaaggtatatcagcgtcaaatgtcgaaagaaggcctgcaaaaagttattcagcaggagcaagcggacaataaaatgcaggggaattctctttcaacagaagatctgcgcgatctttttatttttcatgaacatgtcaggtctgaaatacataaaaatttgaagtgtagccgctgtgacaaggatggagatccagctttggatggtactggttttgcagccactggtcataaggcttcaatacctggagtgcaagattatgctgatattggtgggtttggtgagatatctggatgtttgcagaaaatgaatagcgcacatcagcagattggaagacctactgaagaagacttaggaagttggggacatcactgtgacccatcaactgtacctgatactatactgcagtgttctgctggcgaagaggtttcttttgttttcaccaatcaggttgatggaaaacttgttccagttgaatctatggtgcgatcagcagctcatcaacaaaacggaatagcagccaccggagaaaaaggagtgcagatacccaattctcctagcaaacctggaaagcaatccttaaatggcaagaatttgaagatgggatttcatttaaagaattcgtctttgaaatgttcaaccaaatccagaccatcaccaaattgcttgcaagggttgatgaaaaccagcccctttttggatcaacctcaaattaaaaagcttcatgttgcttctgatatatctgacgatgattttgtttgagtgtcaattcagaattacttatagtctcatatatgttgatgggcgggcccgggcccatataatgccatcagctttgtcggtgcctattgcatcttt

SEQ ID NO: 5360 - DNA, 1833 bp, Zea mays
gttgtgctttttttttaacaaattagcttgtactaaacgtcgtgtattcaaaaaacgaagggagtagttcatcattacattgtgctttctgctgatggggttttagcattagaattttcagtgactgcaaaggtaaaccgagttttcttcgactgtttggatttagcagaatagtacccacattctctaatattttctttaaatttgaactaaattcacaaaaaacaaatgtctagaaggatgacgggtaacttgatccttgaggaaagaaaagcagcatgcacaactcatctgagaatactgattaggaagctgttgaattcactttcacacagttattgtaccaccaatatttttcttcttttcagaaagtgacttgttcgaaatatcgtgctattttctcgagagcaaataatatcagcgttggagcttatgctctgttccggttgaattttggcaggtccctgattttttttttttttttggtcctgaatggctacagcaacgtgtaccatctggaaggaggactttacacatggttcaaagaaggactaccagctgttgcaggagaagagtaagagagacattacgaacatagtgttcgcatgctggagagagtggagagtggagactagagttgcgaggacttgtagtgatgtgcttgcttcacagtcacagggttgtcgattgttgtgtacggattgagatgtcgaagatttctcctgccaatgtgatgctgtcctagattttctcgcggcgcctttgttgctcgaacttgtcagtgcttgagccatgcatcgtcatgagcaagcgcactgcgagctcctcttcatggcgctggtctccatgatggagcccacgtccaccgcggtccccttgagcgacagcacctcgccgccgccgtcgccctggtcgccgcgcatccggcgggcctcgtcgagctccagcgccctgcgcgacacggcggcgaagacctcctcgaggagcgtgaggaaggcgcgctccacgttgtcgcccgtgagcgcggacgcctccgagaagaagaggccctggtcctcggccagacgcgcggcctcgtcggcgggcacctcgcgccgcgccgcgggcatgtcggccttgttcccgatgagcgccacgacggtggacccgtcggcgtgtgcgcggagctcctccacccaccgcgccacgtgctcgaacgtggcgcgccgcgtcacgtcgtacaccaccatggcgcccagcgcgccgcggtagtacgcgctcgtcaccgccctgtacctgcgctttgcgcgcgcgcgcacgcgccaggaaatgcggtatcagaaccaaagcatgcttgatgtttctctcgcaccatccacgtgttaactgacatttggaatttggaggagaaccaaccagagtgttactatactagtatcattcggaagatcaatttcactgtaatagaggcaattaaaatttcttttctgcttcctgcgagattcttaggttctcaacctcctctggctacaggggattgaacagaggaccaatctgacagaaacagcgaggtgccaagtgccaagtggtacgagttgcttcaaattctgaattgctaaactttctgcccaccatcgtgcgtgcttatgtataaaaaatgtttctttttgttgaattgtaagagtatctctaacagcatgacctataaaaatgtattataatttaaaaattaataaatttagggtaccaacaaaatattatgctctaccagtaaagctctaaatatatattataggtcagttattacggtatagtatatttgaagcaagtgccttataatttttgaccaaaatc

SEQ ID NO: 5361 - DNA, 2110 bp, Zea mays
ttacttgatctacatccaatccaaaaccagtgggtcctttggacatttctgcctctaaaaaaatatctcctttcagtaacagtatgcagccttaggagaagctaagctgtcttctaactctctctccgagttcatagtttttgctcttcctctctcatggtcacaatgcttgcagctagttctctagtgaacagcaacctcgcttgctcatcaaggatatcatcctgttcagacttcacatatagccactcctggcgtcccatacatgctatgaaactccatcagatgcgtgctgtgagctcaatacgtataagttgtgctgccactaaacctgcaaagactcctgctgaagaagaatggaaagttaagcggcaactgctatcagaaaagcgggtacgaagtgtcgatgtgaaggaagcactgcgccttcaaaaggaaaacaactttgtcattcttgatgtcaggccagaagcagagtttaaagaggctcatccacctggcgccatcaatgtacaaatatacagattaatcaaggaatggacagcgtgggatattgcgaggcgtgcagcgtttgcgttcttcggcatatttgctggaacagaagagaatcctgagttcatacagagtgttgatacgaaggttgggaaagatgcgaagataattgtggcatgctctacaggagggacactgaagccaacgcaaaatttccctgatgggaagcaatctcggtccctgatagctgcgtacttgttggtcctgaatggctacagcaacgtgtaccatctggaaggaggactttacacatggttcaaagaaggactaccagctgttgcaggagaagagtaagagagacattacgaacatagtgttcgcatgctggagagagtggagagtggagactagagttgcgaggacttgtagtgatgtgcttgcttcacagtcacagggttgtcgattgttgtgtacggattgagatgtcgaagatttctcctgccaatgtgatgctgtcctagattttctcaaaaaaaaaaaaaaaaacgaacttgtcagtgcttgagccatgcatcgtcatgagcaagcgcactgcgagctcctcttcatggcgctggtctccatgatggagcccacgtccaccgcggtccccttgagcgacagcacctcgccgccgccgtcgccctggtcgccgcgcatccggcgggcctcgtcgagctccagcgccctgcgcgacacggcggcgaagacctcctcgaggagcgtgaggaaggcgcgctccacgttgtcgcccgtgagcgcggacgcctccgagaagaagaggccctggtcctcggccagacgcgcggcctcgtcggcgggcacctcgcgccgcgccgcgggcatgtcggccttgttcccgatgagcgccacgacggtggacccgtcggcgtgtgcgcggagctcctccacccaccgcgccacgtgctcgaacgtggcgcgccgcgtcacgtcgtacaccaccatggcgcccagcgcgccgcggtagtacgcgctcgtcaccgccctgtacctctcctggccggcggtgtcccagatctgcgtcttgacgcgcttgcggtggagcgtgagcgtgcgcgtctggaactcgacgccgatggtgggcttggagtcgagcgcgaactcgtcccgcgcgaagcgcgccagcagctgcgtcttgcccaccgccgcgtcgcccaccaccaccaccttgaacacgtagtcgatctccgcctccttctcgctctcccaccgcgccgcggcctcctcctccgccctgtctccgccctgcccgcgcgccaccatggtcgactcgactcgaggtctccaccaggccgccttgccggcctaccactagctttgcttccttgctcgcccccttcccccacaactcgacaaacaagtggtacccggtctgtgcgagctgcgctgcggtctatgcccgcgagcaacaacaaggcgagaggaagaactctgcaggagctggtggtcaattcttttgatgtttgcttctgttctgctgctggtcagctcagcttgggtggtggtctgcgtgccctgcttttggagagaaggattgccgcgcaaatgactggccggc

SEQ ID NO: 5362 - DNA, 5813 bp, Zea mays
  misc_feature (1281)..(1281): n is a, c, g, or t
ttatgtttttttcaaatcgatttaaactagatcgaacgatatatgtattatattaataatataatatgtatacttttttgacgaaggggacaagataatagctaaataatctactgcatgataccgacatccacacgatggactcctacattactacatgtgtttttcactggcccgatgggtgctcagacctgccgctgttcccgattagatgatgattgctttcgaagttcaaagttcaaacacatattgatcttgcattgaaaacgagtcaagaaagccacgccatgtgatgtgatgtgatgtgatgtgactgtgagagccgcgcgttcagccgacgaaagctctgccctaaatatctcatgatagcaccatgcatgcacctggattaactcccctaaatatctcatgatagcatagcaccatgcaccaaccgtgaaaaaaagtattaataacattcattttcacgacagcaggtgaaaaaaaaaacatatttggatttacctatatcacccatctaataaccagataaaatcacaaccggctagcttggccgtataaacaatactccctccgtttctttttagttgtcactggatagtttaattttgtagtatgcagcgacaactaaaacgaaacggagggagtatacgatggcacgctactccatccaggtgcacctatccgtcattttcgttttgggtgacagagatgtgaacagtctggtcaaatcaaatggtaatggttagctaccttagccagtagtgatcaaacgcggggtttttttttttgttttttgtttttgtcgcggcaagagagcgattacatatatgtgtgtggacgcgtacgatgcatgataacgtagccagccgcaacacgcaccttgagaaaaaaaaaacatgttaacgttgcgctgcagggctgtcctgtactactcaggtaatcagtcaggttgtctagcagttttatgagagtttggacccatcatccaccacacaacaccactgattggatcggacaagtcggcgacgttggcccgcacgggaatggaagcagaaggagtcacaaaccacaacacaccatcccgtgtccgtgtggtccatttccatggtaccggaccagagtggcgtcgtttggtttactggtactcaagtcaaggtgcgtgctgctagtaaatgctagtgctactacttgcatgcttcatgttttcggtccaattatctgtagcgagcgagcaccatgcaagccatcgtaccagtatattatcctcggcatgcatgnctggcaccgtcaagctccatacggttcccttgggaatcatgatcgctggatacgatgcagcgcgttactcaccaggacgcacttccggttaaaataaaataaaggcaaagaggcagggacggccgttcacgacgagttatcttcagatttgctgcagagattgagaataatatagcagtccttcatttctgtgtccccatgcatgactggaactggaagagaaggtttcctacgctacgattcctcttgccgtgtcacgccaagggggccagcacagcacccagcagttctcgattcgtcacttcatcgcttcgtcagaccagacaagggctgtccgcttcagagtctgactacagcgtgcgctgacgtgcgaccccgaactgaaggactgccctccacacttccaccgtgcacggacgaaaacaaaaaaaaaaccttcttaatcacgtcaggaaaaaaaatattcttcttcgacagagaaagaaaaaggcagagactagcccttgaacgccgccgccaaatctcacacgaagatgcacatgaaacatataattgtggagagaggcgaccgaccggtcttgaacgccgaacacgtacgcggcgaccgtggctagttggaaacgcggaacgctcaattgcatcatccatccaggactccaggcgggcgagatggcaggcactcgcgggcggcgtcggcggggaacggaagcagggcagaagccacaagtggtgggaggcgtgaaggtaccgaccgacgcgcgcactgcgcacgtgccggagacaggcggtttgtgacgccgacgcgccgggccggccggccgacctgagatcagcagactagggactagccgactagggagggagagggattttttttccttctcttcctcttcactttccctgcatgtaaacgcaagcgcatttattttactgaaaaactgctgcggggatggcgccgtcactgggatggagcagagtataaaacccaggagcgaggggggcccggccgggaccggtcggtcccgagcgacacaacagacagaggaggaaggagaaggatatgggaggcgaggcgggaatggggctccgcgtccgcgcctcctccctcctgctgtcactggtcctcgagctcgccgtcgcgctcgtctcaggtaactccagtcgcagtcgccggctcggtcggtccctgctcgcttgtatgttgtatcactgtggattctccctctctctccttgctcgtgctctgctttctgccgtcattgctctctttgctgcgaatcggtgccgcgtccgcctgtcccagtgagacgacctcagttgctatgtcagttcttccgagttctggcacgacgctgcgtcccggtttcattctccgtatggacagcactgcaagaagccgcgaacgaagaacatggaggcgtgattgattcagctcggttgctaactcagctctgacacgcatccgtccatggccattacatgattttacatctctatctagctagctgtttcaatcatagcattttgcctctcccacagatgaatgatcattccgtctgcttccctatacattattattgagtgtagctatatacgaaagcgactttgcacctaaaacactttatgatcgctgtctgagaaaaaaaaagggaattcaatcccctcgaacgaaaatatatacagaacagcatcaactcttcgactgcgccagtaacgtattgccccgcgtgtgcgttaatctggcagtgtcggcgcagcacaagttcgggatcaactacgggcagatcgcgaacgacctcccggacccggcgcaggtggcgacgctcctgcagtcgatgggcgtgaacaaggtgaagctgtacgacgcggacccccgggtgctgacggcgttcgccaacacgggcgtcggcttcaccatcgccgtgggcaacgaggacctgcaggcgatggcggccagcccggacgcggcgcgccgttgggtggcggcgaacgtgcagccctacgtcccggccacgcgcatcacctgcgtcaccgtcggcaacgaggtcctgtcgggcaacgacacggcggcgatggccagcctgctcccggccatgagggccgtgcacgccgcgctcggcgacgcgggcctcggccagccggtcgccgtctcgtcggcgcactccgtggacgtgctcgccaccagcttcccgccgtcgtcgggcgcgttccgggaggacctggcggggtacgtgcgccccatcctcgacttccacgcgcagacggggtcgccgttcctcgtcaacgcgtaccccttcttctcgtacaaggcgagcccggggccggggccggggggcgtgtcgctgccgtacgcgctgttccagcccaacccgggcgtgcgcgacccgggcaccggcctcacctacgacaacatgctgtacgcgcagatcgacgccgtgtacgccgccatgcaggccgcgggggggcgcgcggacgtgggcgtcacggtctcggagaccgggtggccgtccaggggcgacgacgacgagcccggcgccacggcgcagaacgccgcggcgtacaacggcaacctcatgcggagggtcgccgcgggccagggcacgccgctcaggcccgccgtgcccgtcgacgtgtacgtgttcgcgctcttcaacgaggacttgaagcccgggcccacgtcggagcggaactacggcctgctctaccccgacggctcgccggtgtacgcgctcgacgccggcggtccgggcccgggcggctcgctcaacccgtactacacgtccatgttctcctcctcctcctcgtccggatcggcggtgggcgtaacctttttgacggagaaagtggtactatcactgctgctgcaagcaattgtaatactccgacgatcacattcgtactgttagactgttagtcagtgccatatactcttgtaatcttgtatacgaaaaatatgcatttcaattcaaccatagggtaggcctagattcgggaattttgcacgacggcggtgtggctgctccgaaagctctcgtcttttctcttattcccccgcccccagcaatggtcttgaaaaagggtgaccttttcttcttctctgtgcactaacctatcgagatgtggaaggacctaaaggtgaggtcgatcgatggccgggctgggcatcgtcgaaagcgcagagcttttgacccaccggacgagccaaacatttggccgcgtcctttccaagctggcctgataccagtagctaacctttgggcggcagcaagaaactgaaactgaaatggggaatgtcaaaaacctagcactagcagcaaaacaatcatctcccagcctggtttatggcactggcaacaacgcagatgaagatttgcttatgtttgcgttcccttgtcatggtggcttgcaatcgcttgcagataacgtatcagagaattcagatgacgggggtggttgtcctgctcgccgcattattcacctgaggcatgttcttcagtgcctcagggtggcgctggcgcctcattcgctgaggcatgtgctgtgcatctgttgcagatggccccttccgttcgtccggtcagggcgcggcggcccaaacggaccagcagatcaccgagagccgtcgaagcattttagcgtcatgcgcaaggtcccatcacgattcacggcatgagggacgtttcaagatggggctcagtgcctcagtcttgtcgatgtccgcacagtcgttgctgtgttgttcggcatgttgcatcgaagcatagaattaggactgctgtagcaaattcaggcaggaggagtggaggatgtttcgtcggggtcgccttgaccgatcatgcggagcgtggcgctggcgccgtttgctgacgcacgacgcacgagtggatcggcgaatatctgtgccttttgtctcgtacacactttgttggaaagttattcgccatgtagcatttgtgtaattgtgtgcggttgagatttcaaggctagaccatggggctttcttccttgattcagaatgctgctggggacctactagcctaaccatctattcctctccaagaatgtccatgtagtgtaaccaagctaaatatacagggtatctggtatagatgtcggataggccgtgctaagcgagccgccccgcgcgcggtttctaaggctatgagccagcacgactcggaggctaatcgtgctcgagacaacccgacatagcaggcggaccgtgcagtgtgtgtttgggacgcctcctcaacacagggtgccgacttggccaacacggttactcgccaccacatcctcaaccctcgccttccccgtcgtgcctccttgcattcatttcctccgcctcctcacctccaacctccggcctcccccgtgcctcctcgcctctgtacatcaagtcgtcgatgtattggatctacgacgttgtgctgtgcagttgctcagtcctctgcagatctagtcgtcatcatcttctctgtctccgatggactctagactggatccgcgctttcgtgccgtgcagtccttcg

SEQ ID NO: 5363 - DNA, 4028 bp, Zea mays
actgaaaggctgctaacggagatggcgccgtcactgggatggattggagtataaaaccgaggagccgtggcgtgacggccaccggtcccgaagggctatcgaacgtaactaccggtcttctgtctcggcgtcggcgagcaccagaacagacagagggaggggaggcgaggcgaggcgaaaatggggctccgcgtccgcgcttcctcgcttctgctatccctcgccatcgagctcgcggccgtgctcgtctcaggtaacccagccccccgggcttgctcgctccctgcctgcttctatcgctgtgggattctctgtcttcttgctcgtgctcttctttctgccgccattgctagctcttgctgtgtggtggatcagtgccacgcccgtctgtcctcatgagacgtcatgagtaggagttgctaggtcagttctctcgagtcctgccacgatcacgatgctaagttgctatgtttgttgccgatttttgggtgggcgcggctagaatttgcagcgagggcacagcactggaaagcccctgcgactgcggaccaagaacatggcatggaggcctctgtcctcgtgagatgcgagttggggttgcttgtattgtatcggtcctttcgagctctgccacgatgctgccttccagtttcattgtccgtgcggacaagggtacggagttcttttttggttgccaattttgggaccgattagaatttgcagcgagggcacagcactgtaaagcagccgcgaaccaagaacatggaggcctgacgacgaggtccggcaaagcataccagcgcaaataactccggtgcccctcatattgtcgcaatcagttgagctgaataatccattacacgatttcttcctgaaaccgcacagtttgctgaaaatttctgtttttttacatatctactagctgtttaaatcttaccatttttgctctctccctcataaatgatttctagctctgcccctagccgcctactatgaatgatcatcccgtctgcttccgtatacattattgattgtaggtgtaaggtgctctcctcttgccaccgaacaattttttatgtcgtttaatcacgaaagcgacttcgtacctagagcatttcggtgggactctatatattccggattactaaaatatagtatgtttttatgcaatgatttttttactgttacttaacatgtaaagctgagatttatcttatatagtaaaaattaagtaacgaagtggatataatatattttactgttaatttaggaactctatttttactgttatatatcccggttgctaacaatgagcgcctggcgtgcgttaatttggcagtgtcggcgcagcagaaattcgggatcaactacgggcagatcgcgaacaatctcccggacccgacgcaggtggcgaccctcctccggtcgatgaacgtgaacaaggtgaagctctacgacgcggacccccgggtgctgacggcgttcgccaacacgggcgtggagttcatcatcgccgtgggcaacgagaacctgcagaccatggccggcagccccgccgcggcgcggcagtgggtggcggcgaacgtgcggccctacatcccggccacgcgcatcacctgcgtcaccgtgggcaacgaggtcttctccggcaacgacacggccacgatggccagcctcctccccgccatgaaggccgtccacgcggcgctcgcggacctgggcctcggcggccaggccaccgtctcgtcggcgcactccgtgaacgtgctcgccgccagcttcccgccgtcgtcgggcgcgttccgggaggacctggcggagtacatgaagcccatcctggacttccacgcccagacggggtcgccgttcctcatcaacgcctacccgttcttcgcgtacaaggcgagcccgggcagcgtgtcgctgccgtacgtgctgttcgagcccaacccgggggtgcgcgaccccagcaccggcctcagctacgacaacatgctgtacgcccagatcgacgccgtgtacgccgccatgaaggccatggggcacacggacgtgggcgtccggatctcggagaccgggtggccgtccaggggcgacgaggacgagaccggggccacggtgcagaacgccgccgcgtacaacggcaacctcatgcagagggtcgccatgagccaggggacgccgctcaagcccaacgtgcccgtcgacgtctacgtgttcgcgctcttcaacgagaacatgaagccagggcccacgtcggagcgcaactacgggctgttctaccccaacggctcgccggtgtacgcgctcagcgccggctccggcggcggttcaggtccgggcgggtcgctcaacccgtactacacatccatgttctcctcctcgtccagatccgcggtgagcgcgaccttcttgacagagagagtgatgctgttactgctgctgcaagcaactgtaatactccgacactactgctagtcagtgaataccttgtaatcttgtatacgaaaaaaaaaatgcatctcaattcaacccaaaaaaaaaaaaaaagattcggaaattgggcacgacagtgtggctgctcgaaaaggtctcatctttttttttttctcttttattcccccgcagcaatgaccttgaaagttcttgaaaaggtgacctttttgcggccctgtgcacaaacctatcgagatgtggaaacacctaaagctgaggtttgaggttgattgatgtccgggcatcgtcgaaagcgcggtcattcctgagctttttgacccaaccgacagccgcgtatttccaagctggccttatacagttgttaaccttgggcggcagcatggaactcaaactgaaactgaaacagaatgccaaagggatatttaactatggcaagctttggatagttttgcatgtaccgactaagttagggtattatctgttttgctggttttctgagtttgatgacacaattgtagtgtggcaagtttaaggacagctactatattttactcaatcatttatgctgctcacgattaaaactggcaaacggaaggagggctttggtcggatggtgaatagttaaatttcagtctcatatactacttacgttctcaaatatttgaggaccgagtagttaaatgttccaatctcatcaaattgcagcaacaaaacaatcatctctcggtctggttttctggcactgacaacgaagatggggattcgcttgtctgtgtgtgttctgttgtcctggtggtggtggtgggtttgcgatcgcttgcagataacgtatcggggtgggggggtggttgtcctgctcgcccggcattattccgccgaggcttcctccacacgtacgcaccgctcgcaaatcattggcagcttcccttccggctgacgcaactccgggctgggttgtcgtccgtcgccactcgtccgtgccggccggggccgggggccgttgcggtgcgttgctcactgacagcgaggcaacggacacagtggcacacacgctggatgaaatcatctcaggtttcttttccatttttctgttcctgatcctgacgcagtttagggggtgtttggttaccccaaactaaaatttagcccctgtcccattgaatatttaaacatccgttccgggtattaaatatagtcggattataaaactaatttgtcagccgaagattaaaagacgagacgaatctagtacagttgattgggtctatatttcatactcctatttaaaagtcaaacgcttgatagacccgagctaaactttagcaggagtaaccaaacaccccgttagtgtaaaaaaacggaccgtaccgtgaccgtgagtccgtgactgacaactgacaacgagagttcaaatccggcgtttgctctcggctgtgagcctgagcgagctcgtgtggttaggtaccaggtcctgccctgcgtcgtccaagccgcgacactttggcaactggtgagccaatgtgatgataagatgcatgcggccgacgggtgaggcaactggtggcgccccg

SEQ ID NO: 5364 - DNA, 1487 bp, Zea mays
cattgggtacctcgaggccggccgggaccggtcggtcccgagcgacacaacagacagaggaggaaggagaaggatatgggaggcgaggcgggaatggggctccgcgtccgcgcctcctccctcctgctgtcactggtcctcgagctcgccgtcgcgctcgtctcagtgtcggcgcagcacaagttcgggatcaactacgggcagatcgcgaacgacctcccggacccggcgcaggtggcgacgctcctgcagtcgatgggcgtgaacaaggtgaagctgtacgacgcggacccccgggtgctgacggcgttcgccaacacgggcgtcggcttcaccatcgccgtgggcaacgaggacctgcaggcgatggcggccagcccggacgcggcgcgccgttgggtggcggcgaacgtgcagccctacgtcccggccacgcgcatcacctgcgtcaccgtcggcaacgaggtcctgtcgggcaacgacacggcggcgatggccagcctgctcccggccatgagggccgtgcacgccgcgctcggcgacgcgggcctcggccagccggtcgccgtctcgtcggcgcactccgtggacgtgctcgccaccagcttcccgccgtcgtcgggcgcgttccgggaggacctggcggggtacgtgcgccccatcctcgacttccacgcgcagacggggtcgccgttcctcgtcaacgcgtaccccttcttctcgtacaaggcgagccccgggccggggccggggggcgtgtcgctgccgtacgcgctgttccagcccaacccgggcgtgcgcgacccgggcaccggcctcacctacgacaacatgctgtacgcgcagatcgacgccgtgtacgccgccatgcaggccgcgggggggcgcgcggacgtgggcgtcacggtctcggagaccgggtggccgtccaggggcgacgacgacgagcccggcgccacggcgcagaacgccgcggcgtacaacggcaacctcatgcggagggtcgccgcgggccagggcacgccgctcaggcccgccgtgcccgtcgacgtgtacgtgttcgcgctcttcaacgaggacttgaagcccgggcccacgtcggagcggaactacggcctgctctaccccgacggctcgccggtgtacgcgctcgacgccggcggtccgggcccgggcggctcgctcaacccgtactacacgtccatgttctcctcccccccctcgtccggatcggcggtgggcgtaacctttttgccggagaaagtggtactatcactgctgctgcaagcaattgtaatactccgacgatcacattcgtactgttagactgttagtcagtgccatatactcttgtaatcttgtatacgaaaaatatgcatttcaattcacccatagggtaggcctagattcgggaattttgccaaaaaaaaaaaaaaaaaaaaaaaaaaaaaaaaaaaaaaaaaaaaaaaaaaaaaaaaaaaatataa

SEQ ID NO: 5365 - DNA, 1506 bp, Zea mays
cattgggtaccctcgaggccggccgggaccggtcccgagggctatcgaacgtaactaccgtcctctgtctcggcgtcggcgagcaacagaacagacagaggaggggaggcgaggcgaggcggaaatggggctccgcgtccgcgcttcctcgcttctgctatccctcgccatcgagctcgcggccgtgctcgtctcagtgtcggcgcagcagaaattcgggatcaactacgggcagatcgcgaacaatctcccggacccgacgcaggtggcgaccctcctccggtcgatgaacgtgaacaaggtgaagctctacgacgcggacccccgggtgctgacggcgttcgccaacacgggcgtggagttcatcatcgccgtgggcaacgagaacctgcagaccatggccggcagccccgccgcggcgcggcagtgggtggcggcgaacgtgcggccctacatcccggccacgcgcatcacctgcgtcaccgtgggcaacgaggtcttctccggcaacgacacggccacgatggccagcctcctccccgccatgaaggccgtccacgcggcgctcgcggacctgggcctcggcggccaggccaccgtctcgtcggcgcactccgtgaacgtgctcgccgccagcttcccgccgtcgtcgggcgcgttccgggaggacctggcggagtacatgaagcccatcctggacttccacgcccagacggggtcgccgttcctcatcaacgcctacccgttcttcgcgtacaaggcgagcccgggcagcgtgtcgctgccgtacgtgctgttcgagcccaacccgggggtgcgcgaccccagcaccgggctcagctacgacaacatgctgtacgcccagatcgacgccgtgtacgccgccatgaaggccatggggcacacggacgtgggcgtccggatctcggagaccgggtggccgtccaggggcgacgaggacgagaccggggccacggtgcagaacgccgccgcgtacaacggcaacctcatgcagagggtcgccatgagccaggggacgccgctcaagcccaacgtgcccgtcgacgtctacgtgttcgcgctcttcaacgagaacatgaagccagggcccacgtcggagcgcaactacgggctgttctaccccaacggctcgccggtgtacgcgctcagcgccggctccggcggcggttcaggtccgggcgggtcgctcaacccgtactacacatccatgttctcctcctcgtccagatccgcggtgagcgcgaccttcttgacagagagagtgatgctgttactgctgctgcaagcaactgtaatactccgacactactgctagtcagtgaataccttgtaatcttgtatacgaaaaaaaaaatgcatctcaattcaacccatagggtaggccttagattcggaaatttggccacgacagtgtggctgctcgaaaaggtctcatctttttttctctcttttattcccccccagcaatgaccttgaaagttctcg

SEQ ID NO: 5366 - DNA, 2029 bp, Zea mays
  misc_feature (1093)..(1093): n is a, c, g, or t
gcttagcttagtttagttagttaggggagttcataataaatatttgaattccatatacgtaggggttcgaaatatgcctcgaacttgtagttaattctatagcgcaccggattgttttggattttactcccggcaccggcagcgtcttgctttggcatgaagaaaaactgactcaaacccggacagcctctgcggatttgggatcggcttaagttagtaatattgtactttccatttctttttataaaaaaaagttcaagctgaatgctacgcacgcaattatatatcaggttcaggatcgaggcaaaagaatagttcacagagttcaactaaaaccacgccggcatgctgatcgcgcgttacacagatgaacagagcagagcagtaacgtacgcaacgcatcgatccaccttccaaaagagacttcgaaatcggagaaggaaaaaaaaggaaagaatgaaaaattacgcgaacgcaaaacgctcgcataaaccaccaggaacacaataacgcgattgcgaacgccggttgactggtggccagcgccgagctgccgggatcatcatcagtagcaggcgtcgtcttcgtcgtcgcccttgacgtcgtcgtcgcactggcgcagggtgcagtagtacgggccgacggcgtaggtgaccttggtgggggaggcgtgcgtgaggcgggacgggacctggccagtctggccgcggttgaagtcggtgaaggcggcgcaggcagcgtcgcccgaggaggcgaggcggacgaggcagcgggacggcgcgaggtcgcagccgttggtcgccttgctgggcacctcgatgttgaagatgccctggccgtccgtgtagtccgagccgtggtacaccacccggctcctgtcgtcccggcacgtgatgctcaccttgctgcctgcacgcacgcgcgcacgtggacatgcatggcatggcgggttaattagccgccggccggccaggtcgatcggggctgtatatatatctcgtgtcaacggcaccactgccggcgaggcaggggggaagggaaaggaaaggaaacgaaccggggatcggcttggcgttgtaggcgtaggcgttcnagttcttggtgcagtcctggcactgcactttgcccgtcaccgtgaacgtcgacgggtggtagtccggcagccgcgcctcggcgcacgcgacggccacggcggccaccaccaccagcgcgagcgcgggcatgcccctggtgcgcgccattgtacttgtaccgcctgtcgcgcgcgctcgcctccgacaacctttcgcacgcgcgcacgtagcctggcgtatgtgccaacacacgcgcgctccggaagaccacagcggactggtgcttgagggggcaggcaaatgcgacggtatggcttttatcggggacaatgcacatttaacattggtgcacattgtgcacatattaaattatcaccacttattttagatctaacgtctctagttgtttggtacattttactaaggacacccttcaacgtggtggtgtgtagtggtggaatgtgttatttgtaaattgaataattaactagagacgttagatttaaaatgagtggtgatgatttaatatgtgcaccatgtgcaccagtcttttatgtgcaccagatatgtcccctttatcgggagggatttgtcactcgccgcgggcgggcgacgtgagcccaacccaactctacgactacgatggatggctttggttggccaacgacgtgcgcgccagtacgtacgcgtcgtgttcgtgtcggtagatatcgtcctcaggcgccacccatccatccgtccgtccgtcgtggaggccacccacggtcggctctggccggcctcatgcgcaccgcgcgtagtcgcgagcacgtgtatcacttgagtcaccaaactacttgttcgatccatccaaaaatcggttctggctcatccaaataccatggatgtgaatgcccagatccgattaacctgtttttttatttttattttgagagtctaaaaacctaaggacaagg

SEQ ID NO: 5367 - DNA, 1565 bp, Zea mays
gcgcacgggtgacagactgacaggtccgtccgcaaatctgcaacgttgcctcgtcacctctatcctccggtctctcaccgcctaacacggccgccatggccgccgcctccacctcccttccccttggcttctcctctcaccaccgcccaactcccagaatccggccgcagccccagtcccagtcgcaaccactgaaggcaaaaccccttaacccccttcgcttcagcctagccctcaccccggcgaccgcgaagccccgcctcgctgcgatgcccgacgatgtcgctgtcgccaacttcgtggagaaggactggtcgttcctcgagtccgcgggcgcaaacctccagcgcgctctcgcgtcgggggcgctctcgccggcgtcgcgggtgttggcattgacgcccacggcgtccttcgtgaggtcgctcctcgcgtcctcgccctgcgagctactggtggccgcgcatgagtcgatgtacgtgctggcaggggtcaaggaggcgcacgacgaggtgaggtgcttccacctcgagggtgggggcggcggcagaggcggcggcgtggtggaggccgtgccagagaggttcgacgacttcgatgttgtgttcgtgtgctacttccctggaatgggagtctccgcgggggcgctcctcaaatcgctggccaagaggtgctcaaaaggtgcaagagttgtcatgttcttagatcaaggcagacagaattttgagcaacaacggagagagcatcctgatgttgtaacttcggatttgcccagtatagccttcctggagaaggctgcatctgggaacaagtatgaaataacagagttcgttgacgagcctagcttttaccttgctgttttgcagtttcaaggatgatttgttccttttttgcaatatttgtgaagcaaattgtgactgtctgtaaatttgcaatatttgtgaagcaaattgtgactgtctgtaaattctgatggacgtagtttgtgggtggcttatgtcgtacaaaaaaaaaaaaaaaactgccgccggtatcacactttgactaattttttgtgtctaaggttagttcttctatctgaacgactaaccttaatgattaagtgtggaacaattagctgtgcttgattggttggtcgagctttcgcgtccgagaacatatctaatgcacatggaagattggtgcacatattaaatcatcaccactcattttagatctaacgtctctagttgtttgttatattttgctaaaaacatcctccaacgtggtggtgtgtagtggtggaaggtgttatttgtaaatttaatgatcaactagagacgttagatctaaaataagtggtgatgatttaatatgtgcatcatgtgcaccaatctttcatgtgcaccagatatgttctcttcgcgtccatgcccgtgcatgcgttgacagtggctgggcgtgtgcttgcttggctgcatggcagcctctgtgtgtacgcagtgtaggccagacctttttacccagtaataagaagcgtgcatatcaatatcaatcggtgcgcgagctagacgccaaggctgcag

SEQ ID NO: 5368 - DNA, 5715 bp, Zea mays
  misc_feature (839)..(839): n is a, c, g, or t
  misc_feature (2624)..(2624): n is a, c, g, or t
  misc_feature (2786)..(2786): n is a, c, g, or t
  misc_feature (5281)..(5281): n is a, c, g, or t
cgaagccccgcctcgctgcgatgcccgacgacgtcgccgtcgccaactttgtggagaaggactggtcgttcctcgagtccgcgggcgcaaacctccagcgcgctctcgcgtcgggggcgctctcgccggcgtcgcgggtgttggcattgacgcccacggcgtccttcgtgaggtcgctcctcgcgtcctcgccctgcgagctactggtggccgcgcatgagtcgatgtacgtgctggcaggggtcaaggaggcgcacgacgaggtgaggtgcttccacctcgagggtgggggcggcggcagaggcggcggcgtggtggaggccgtgccagagaggttcgacgacttcgatgttgtgttcgtgtgctacttccctggaatgggagtctccgcgggggcgctcctcaaatcgctggccaagaggtgctcaaaaggtgagacctgttgaaacggcaccttatcctttcttagcttgttgtttcttgtttcagacttccagtggactgagcctgaggtggttagaaggatgcggcttattacgctgtgcattgcgtttgctaaaccacaactaaatcatttgagatggcaaattggtggggtttagagttgaggtattgattgatcagattggttattttgaggctgttgttgccagatatcatattgcatcaagcccctaacatatacttgaactacttggatacttccaatgttggtatacatcatacattttatgcacaaatgatctggatggttaatttgactttgttattttagtttaattggagcagcagtgattatggttctgattacgcatacaagggtgttcttgatatggtcngttcctttgagtttttacttgttaggctagttttgaagacttatagggtgtttgtttgaggaatgaactggtccatcatcttctcactcctcacgtttttgtttggtttgtggaatgaaatgaattgattcatcatcatttcattccacatagttagttagttagtactaatatgaggaataagaccatcccaccaaatttgaggaatagaatcatgatgcaccaccttattttgaatgaatcatgatgcaccaccttattttgaatggagtgactcctcaaaccaaacaccccattaaagcaggctgcaagtataatattagcatgcattaccctttataagttcattcgagattgtgctgagtgatcaatacttctatatgtcaaatcaggattaaaactatgccaacaccaggagcatatctattagaagtgaatggtggcatgctatggtgaatcggtcacaaatacagctggtaacagtttgggttaaaaccgcctttagtggtttggttttctatttggttctacatagtttgattgaaaataggttgaaaattctaatggactataatcagtggcgaagccacattaagcttgcctggtgccagtgcaacagggtaagaaaaaaaattaccactaactagacaaattttcaccatgtatttcttcaaaactatgtatattgctttagcagtgcaccaccataaatttgaagttggcttcgcccctgactataattgatgagtagctataatgggctggtttggtctggaatcgattcttgatggttcggctaaggggattcagatccagtgcgttctttaccatacacctgctgcgctgtgctcatagagttcttgctggacagctggagtttaccgctgagcacaacgccttgcccactcagctccttgtttcacgcatagctgtaaagtggcgtgtcgaggaatgcccaggccgtcagctttaacgtggtgcacgaagaggtcaagcacgatgtcgctggggatcctcatgacctgcatggacatcatgggcactgaccaccgagagcaccttgatggggaaccctgacaccagatcaggaatgttgggatgtcgcgagctggcgaattggcggcagcatgactcatgttgtgtcgaaggacagcttgacgatggggttggcagcggtgcgctgccggtgcgaagcacagacacagccagcacgcacaccaccaccgccagtggcgtgccaatggtattgaactcaccgccgaatagaacaggtactagctaggtagcagctgtaggatactgagaaacatttgattagtactttggtgctcaacgatagctagaggacagtcagccggtgttcccatgatgaacctaggaaggatgtggcatagaaggaaggggaaagtttcatgtgacaggctagcctactacggtaacaacaaatagatcggtgattgtttcatttgtgaaccgagctgagataaatggcatagctgcagtttggaaccatttttttaagaaataatctggactgattctgtcccaataatgctggaggttaggttaaacttggttttggagaatgaaaagatagaagaatggggcggacatggcgttgatctagggcatgtttggttcactacatcagttgccacactttgcctaacttttttgcctaaggttagttattcaattcgaacgactaaccttaggcaaagtgtggcacatttagccacaaaccaaacaggcccaatcacagcagagtttggtctgggtgcggcngggttttcaaaccattagcacgtttagtcacaaagtggtaaatagggcacacaaaatagccgaggcagtgtagagttggcatccaaacccaacaatccagcccacacagaatccaggttccttaacagcaaccagcttttggacctttagcttttcacaatncaactttccacattctacaatccacaagctgctttccaaattttctagccgcaacaaattgagcctaagccttgcccaacaagatatcaagcctgccaactctcattagccttgctgcgcctatagaatgaaagacatgcttaattttgaaacttgagattttctcgtgtgatattattgtttgtggttacacatgcaaaaaaaatttgcttcaattttagaacttgatcgaatgattttccccccaggtgcaagagttgtcatgttcttagatcaaggcagacagaattttgagcaacaacggagagagcatcctgatgttgtaacttcggatttgcccagtatagccttcctggagaaggctgcatctgggaacaagtatgaaataacagagttcgttgacgagcctagcttttaccttgctgttttgcagtttcaaggatgatttgttccttttttgcaatatttgtgaagcaaattgtgactgtctgtaaatttgcaatatttgtgaagcaaattgtgactgtctgtaaattctgatggacgtagtttgtgggtggcttatgtcgtactagcctgtttggtttgctgtctaatttatcacactttaactaattttttgtgtctaaggttagttcttctatctgaacgactaaccttaatgattaagtgtggaacaattagctgtgcttgattggttggtcgagctttcgcgtccgagaacatatctaatgcacatggaagattggtgcacatattaaatcatcaccactcattttagatctaacgtctctagttgtttgttatattttgctaaaaacatcctccaacgtggtggtgtgtagtggtggaaggtgttatttgtaaatttaatgatcaactagagacgttagatctaaaataagtggtgatgatttaatatgtgcatcatgtgcaccaatctttcatgtgcaccagatatgttctcttcgcgtccatgcccgtgcatgcgttgacagtggctgggcgtgtgcttgcttggctgcatggcagcctctgtgtgtacgcagtgtaggccagacctttttacccagtaataagaagcgtgcatatcaatatcaatcggtgcgcgagctagacgccaaggctgcaggcaaccaatgaggctgtatatatgtctttggcgggagtttgtgggtggcttatgttgtacggtattatgttttggcgggcttgtgtaaacattttgcgcgacgttcaatttgtttgttgaatcgattaggcatgccttcagcatataatactccgtttataaatgtacgatatcgttgacttttaaaaaacgccattgatttttttaaaaaaattgaccactaatcttatttaaaaaatgatgagttatcatttattttgttgtgatctgttttatcatttaaggtatatgtgcttaacttaaaattttacacttttgaataaatattttgaataaagcgaatagtcaaagtttctaaaaagatcaacaatgtcatatatttgtgaacaaaggtagtacttatttggatcccatgaactaaaactaatatttaaaaagtctttctcatcttatcattagattatttttataacgtcccccggttctagagaaccaaacataactaagaacatcttcaacaaaatgcctcaaaatagtatcctgaactttaaaatactacatcatttaaagtgattagggattagggtactaaaaagtaaaaataacttttaatagttaatccctaaataatgaattttagaaaataaattatattattttaaaaaaacgttgagtatgatattgaaactaaggatatttaggggtagtaatggatcaagatctaaatgtttcgacacactttcgagctcgaagcattgagctggctcagccttgtgtgaagctgaagtaagcctattaatggcaaaaaaacccaacccacatccaacccacacccaaatctagtaactttgacattcatcccacaaccacctaaaaatataaggaagaaattaaacacaatccacccaataatattattaacagaacatacattttcatcatatataattattaaagaaataccgataaaagtataatatagtttctcgaattgatagcttgtcgctggctatctgccgtctgcctgtgttcaaaaatcagaaccgaagtaccccccaataatgcatgggagacagacacaaccagggagtgaaaagatgctattaaatgcagtgttgttttttatccacacggaccacgatccaactagacatgacatgcttgcaggaatgtactccatgtaccgagtagaaacacacatcttgctgagttgacgtgttctgtcagaaggatgaacagctaaacatactagtatgtgaaacatgctaaacatactagtatctgaaataggccgcagcgaatggacgtggagctggcaaactacaagaggaactcaatcaacaagggaaaaaataactagtcnaaccagcgatttgtcgcgcagggggctcggcgtctgcaggggatggagcacaggagaggagcgagatgcaccatggcgggatggagcacgggagaggagccatcggccgccagggcgggagaggagcactgagtgtggtacggggatggagcacgggagttagggttcattacttgagttgagtctgtaagtctgttgggatacttggtagttgaattcgaatacggatgcgtgaagacccatggaaggacccatggaagctcatttctatgcaaacccatttacaccatgggtatcaaccattttgacccacaatacaaaataaacccaccaacccaaaccgttcacaattaaaacccattcttaaacccacttaaaatacacgtttacacccaccccatttgcaggcctaagctgaaggtacactgtaacca

SEQ ID NO: 5369 - DNA, 1480 bp, Zea mays
gttcataagaattttgttataatttggatgtgcagggagcaaaaggataaggtgcagttactattctagcttcttgctcgacgatgcgctaggggtctagggcagctggcaatgaagccgaacaaaaatcccgaatcgacagcctttaaatgtcacataaatcgccacgacgaagaattgagcagcaccgtcccccacccatctcagctgccaattctcctatccgacagcttgcaggacggatactaataaccgtcgatagcacgcaggttcttgcatccgacggctcagaaagccagcctctcacgggctgctctacgcctcccgggccacctggctacccggccatcataaagaggcggcctcccgcccctcctctcctcgcgctgcttgcttgtccgttgtcgcagagagagaaagagtgggatggcaatggagaggtcgttgtcgtgcgcggagaggggcagccagtacggcgccggggcgggggcgggggcgatgaacctccggagctacagcgcctcctacgagcgaccgacgacagcggcgccgtccacggtgcagcgcgccaggagcgtgagctcgtggagcacgccgccggcgccgccgcccgtgcagcgggccgggagcaccaagagcggccccaccgccgccgccggtggccgggccgccccggggctgaacctgcgctcctacagcgcctcctacgcggcctcctacgggcccaccctggccgataccggcgggcagctgaagcgctccggcagcgtcaccaactggacctccgccaaccgccgctccgtcaacctgagggggtacgccccgtccttcgccgcgatggacgacaccgccggcgcggtcccggcgcccaggaggaagctgcgggcgggggcggacgacgccgaggtgcagcggcggcggctggtcgtgtacaagacgtacggcgtggaagggaaggtccgggagtcggtgcgccgcggcgtcagctggatcaagggcaagtgctccggcgcggcctacggctggtggtgatcgatcgccagctccatcgccgtgcccaccggcctatcggagtggtactactacggtacggtctaccatatgagctggtgcactgcatgcccaccgccgcaccagtacctcctgttacttgttcttggagttaggagtttttttaatctttaggagatggatttggttgtatgtagtagcatactagcatgagctgtggagcttcttctcttggtgagtgatctcgtgtcttgtgagggaaggaggaagttcatgctgtgggtgtcctactcctctttacagaacagatatctggactctggtctatgtaaatataggtgctgcgtatgtatatatgtgtgtatagaataagatttctgtaaattattactactactacaggcaagactgctgttgatggcctctttgaaaaggccggcttcggattaaaaaaaaaaaataacacggg

SEQ ID NO: 5370 - DNA, 663 bp, Zea mays
gcacgagaccattacctagaacatcctaatcgaaaaaaatcaacggaacggagcgcaacgcaatcctatgtcaggcgcgcaaggagctcagccgaagggcgccttcacggcgaccacctacacatcggctgcgcccaccggtggcggcgccggcgcggcccaggggcaggggcaggggcaagaccaccaggagagacggcagactccgcggacggagctccggtcggccgaggacgagcgcgggctgcctgtcaggaagctggaggacgcggtcgaggatgccgcgggcaagggcgggccggtgttcggcgccggcacggacgacgggaagccggatctcggggtcaccggcaccggctgatgctagccggatgtgcttcttgatgtgacgctcagtcaacgagcgagtcagcaagtgaaagcacaaggatgtgtccagcacatagtgcatacgatcggtcgtgtaaaatactgtacaaagtatgcacgtgcgaaataacactgttttgctgagcgtttgaaatagaaggtgaatgagatggaagagctgttagagatagattaagtatagtgtaccgtgcaaactgtgatgtaattaaccgtgtactgaattacaagttaatccattccaacctaaaaaaaaaaaaaaaaaaagggcggccg

SEQ ID NO: 5371 - DNA, 2122 bp, Zea mays
atccgcagcccgccccgtccgcccgcccgagtcacactcacacagagccgagccgagcccaggcaggcaggcaggcggcccaggcgcccagcccacccccctacccccgcggcgccgccggagccagagcgagagcgatggacgcgctgccggaggcgtggtcgcaggtgcgcgcgccggtgatcgtgccgctgctgcggctggcggtggccgtgtgcctcaccatgtcggtgcttctgttccttgagcgcgtgtacatggccgtcgtcatctccggggtgcgcctgctccgcctccgccccgaccgccgctaccgctgcgaccccctccccgaggacgacccggagctgggctcctccgcgttccccgtcgtgctcgtccagatccccatgttcaacgagcgcgaggtgtaccagctgtccatcggcgccgtgtgcgggctgtcgtggccggcggaccggctggtggtgcaggtgctcgacgactccacggacgaagtgattaaggagatggtgcggatggagtgcgagcggtgggctcggaaggggatcaacataacgtaccagatccgggaggaccgcaaggggtacaaggccggcgcgctgcgggcggggatgaggcacgcgtacgtgcgcgactgcgagtacgtggccatcttcgacgccgacttccagcccgacccggactacctcaagcgcaccatcccctacctcgtccacaacccggagatcgccctcgtccaggcgcgctggagattcgtgaacgcggacgagtgcctgatgacgaggatgcaggagatgtccctggactaccacttcaccgtggagcaggaagtgagctcctccgtctgcgccttctttggattcaacggcaccgccggcgtgtggcgcatctccgcggtgaacgaggctggggggtggaaggaccggaccacggtggaggacatggatctggccatccgggccagcctcaagggctggaagttcgtctacctcggtgacgtccaggtgaaaagcgagctgccgagtaccttcaaggccttccggttccagcagcacaggtggtcgtgcggcccggcgaacctgttcaggaagatgctcatggagattgtgacgaacaagaaagtgacgatctggaagaagatccacgtcatctacaacttcttcctgatacgcaagatcatcgcgcacatcatcaccttctcgttctactgcgtcatcatcccggcaaccatcttcgtccccgaggtccgcatacccaagtggggctgcgtctacatcccctcggccatcaccctcctcaactctgtcggcactcccaggtctttccacctgcttttcttctgggtcgccttcgagaacgtcatgtccctgcacagaacaaaggccacgctgatcggcttgctggaggccggcagggccaacgagtgggtggtgacggcgaagctcggcagcgccatgaagatgaaatcggctaacaaagcggggctcaggaagcagttcatgaggatatgggagaggctgcacgtcacggagctcggggtggcagcattcctcttctcctgcggctggtacgatcttgcgtacgggagggaccatttcttcatctacctcttcttccagtccgtcgcgtttttcatcgtcggcgtcggctacgtcggcaccatcgtcccgcagtcgtagcggaagcgtgtccagatcatccgcttctctctggttttcgcattgtgtcttgggtaagtttcgtagtggatgaccggtttgaggtaaagatcatgcatgcggtcctctcttccatcgtctttttttggggaccggccgtgtgtgctgtagccttccttccttcgtcgaccttcggctgcatgcgcggtgttttactgtaaaataggaaagcagtgttgcaagatcgctgcaggagaatttagagattggtgccacatgggcaggagatgtcctggtgtttctgcttatatgctatatcaactatgtgatgtgttttaagggggggtgcaggatggctgcttccaatgtactagtaacatacagagaaacaggttcagacatgtgttcagaaaaaaaagagtcaactattcagccttcttgtagcaaaaaaaaaaaaaaaa

SEQ ID NO: 5372 - DNA, 2178 bp, Zea mays
  misc_feature (2068)..(2069): n is a, c, g, or t
  misc_feature (2142)..(2144): n is a, c, g, or t
  misc_feature (2146)..(2149): n is a, c, g, or t
  misc_feature (2178)..(2178): n is a, c, g, or t
ctgcagcaaatccattcgctaaatatatggatacgaccgactgcacagtgaaagaagcgaccccagctttctgatattctccggtcaattgcagagtcaacagagttcatccgctcatacaaattgtaaaacaacaaaaaaacgctaccgtattggcagaacctcagccacctagttttgctataaacccacatttgcatgcagtgaatcggcaatgaataaaatttaatgcttcaattgaaattaaatacatacatatttgccagctgtccagggcttggtcgacaaccctcaactcctcaagccgttagcatagcaccacgaagtttgtcagattatagaaaacttactagtaggaagaacagatgtaaatacctacttggaactcctgatgtgcgcgaaatcggcaggatataggtgaccaatcaacacaacggagacattgtgaaaattcccgtttattaaaggttacgcgagattgcagctccctccgcgtttgaaggagcattggctaccgctccacgtgacgcgtgtcgtgtgctgtcagacccgaaaactctcgcccgagcccctctcctcgcgcttcgctcgcgttcctctctcccacctctctgcacgatgcgtgcccggacccgaaaattctctccaaaccagctctgagcctctgacagcggtacactcgtgttcctctcccccacgccctccctcccatcgcgccatgcctcctcccccagacctctcccctccccgcgatccttctttggccaggcggtctgtcggtgcttgcgcccgggcccctcgcgcgctcgcccggcgtcccacggacagcaggggcggcggcggcaagccggtgcgtcagcttctgtcgcacgtcgcccgcacgatgcgacccgcgcccgcggcccgccccctttccctcgctgccacacgatggtcgacaccgggcggagcttcgtggtcaatcaccggggcccgtccgagaagtcccctccgtcaccgccaccgacgcaggcggaggccacgacttccctaacgaaggcaggcgcgccggtggagcccgcgtcgcccccaccgccgtcctagagccgatcggccaagcccaccaaggttgtggttgtgcgggcggaggaccccggtgcgccgcgcggcaaggcggtgggcccagccgcggtcgacgtcctcgacagttccgtccgtggcaaacctgcagggcatggccaggccgtcgggcgtcaacatggcctctttctccgccgtgtccaattccggaggcgcgtggagggtttttttatatatctttatggttttcttggttacagggaggaggaagaagaataggccggtgagggtgttcccgacggacaaggggacgctctggaagacacgatccgccgatggccacgctgagtcctggggtagattgatttcccagtctagattggtgaggagatttgtatggtcaggtatcgaatacaattcttccaagagatatacgtgtactgggttggtgtcatgttccagcatattttaatgcaagatgcggtcgctggcgctcatgctgacgtggtccgtcgccaccgtgctcactctcctcgccgtgggctcgccccatccaccacctcagcaatgctagaacggaaaaccaggttgtgcaaaagagtacttgcgactttgaaggtcttatggtcagtaatagaggatatgacgaagtacatatcaccagaggatgcaaaaagattgatatctaaagaggtatatactagagcgaagagcgaacaacaatctaagattgcagcaagaaaggtccagcaagaaccagattatgtacatgtatatgtgtggatagaactaaccgccgatattatcctaaatctaagcacggtcacccacaaaaaatgtgtaatttgcttcttcccagacatacgaaatgtgttatgcggactatgttggctattggaaaggcattcgaaatgccgtctgtaatgtttgatggttacaaactattgtcgtgctatgtaatatgcggtcttgacataaaaaagaaaaaaaaaaaaaaaaaaaaaaaaannaaaaagaaaaaaaaaaaaaaaaaaaaaaaaaaaaaaaaaaaaaaaaaaaaaaaaaaaaaaaaaaaaaaaaaannngnnnnaaaaaaaaaaaaaaaaaaaaaaaaaaaan

SEQ ID NO: 5373 - DNA, 2854 bp, Zea mays
ctgatacggtacaaatcgtaaaggaatccacttcatattacgatttttttaacatttatgctaacaagtataagtatttatgcagatctatattagtatttatgctaagtcgttttcttcaatgttgttttcgtaaaatcatctccgttcgtgtaacgatattgggatcaccattttatgacttagttacagagtttatatacattaagatttaaaatgcataaattacgacatccaccattagtttttacgacagtttctttgaaaacggtatattattcgctttatgcccattcctaaatttacgtgtatgcggtggaactgatttcgcgcatacagcagatctgatttggcgcatgcagtggaaactaatctcaagatttacggacacaattatttaacgcgcgcactggtggggtggtgattatggcttgtaccaaaattagaaggcacaacctaagctcagtacaattaaattatctctaacatacacaacataatatctttaacggcagcctgtaggccgcattcgcttgtcatacagaggagttatccaaacctgcttataaagggactatgcaactctgaaacaaccggggatctgaagctaaaatggagccttttcaacctcaagcaaagtaattgtggtaaaggcatcgctccttggcagggttgggcatatactgaacggatatttatatgttcctagtgccttatcttgcctgaagcttttgcaaccaatggtaaggtgacataacaccttttgtggggccgtacctatcacttctcttgtttccgtatgcagggagcgtccatgctaatggctacagctccttcctgtttctggagataccaagcacgagtgcagcaatggcgcatcccatgcctcccctctcagcatcacagagcacaatcaccaccgttctgaagatccttccaaaacctcctgctgctccggagagcagaagcaataattgtgcttttggggccaaattcgacagtaggaggtatatatattcagttcccccgcgatctagaactagtcgctgtgagtttgataaatgtgttgctgttctatctagggcacttctatgcggcttggtcgctgctgctgctgctggcaccatgctgggcgctgacatcgctggtgctgcttcgaagaggcggcctccaccgccagcgccggcagaagcgaagaaagacccgaacgtcagcggagtgcaggctaaagtgcttgctagcaggaagaggaaggaggccatgaaggaagctgtggccaagctgagggagaaaggtaagccggttgataagtgaaggccagaacccagtgacccttgatcaagaaatgtaacttattgttaaataatatactccctttattcttctaaagtaataagtcattaatttgaatagtctactcactttatgtgtacagatgagaataaaaatacaactattttgcttgtatgtattttgtcccagcctatctgttgcgtgtaatccagtttttgccacatgctctgatttggcgaaaaaactaatcatttttttaatcgccgtgcaatgaaactaacaaaaagcacaaaaaaactatgtcaatctatcagatttatagttctaattcattatatattaagggataaaaaacagaaatctttagcatttttaaatttttagaattttatatttgcacgtctcttaatattagatgaatacgagcttaaattttgatatactaatagagtcaataataaatttggttcaggttttctttagtagtcaacgattttcatgaaaatttggcccagcggcccaacaagacgtccgttcatgtgccctgcactgcgtccacctaggggatgctaatgacagtaggttcgtacttcgtagttcgtaccctgatttatttcgatgggattcaggaccggatagctgcaaaagggatagatgaatatatagatcggatatttatttaaacgaataaataacgtatatagatattatttgatcagatattcgatacttatatcgaataatgcataaattgcttatcacatattacaatttagtttgcacataaaacagttacacataagcattatatagaacataaattaacacaacaatataacaataagcttaaattacataatagtccaatacaatatttcaaacatgatgacaaaattcaaatcacacaacaatctaatatatcaaaagatagctttcaaatgatatggggtagtgtaacacaacctaagatagttcaacgcaatagtttaaatataattataaggtttaatcaaataatattctaacacaaaataagatagcccaacataattgttcgaatataacgacaatgtttaaatcacacaattgtctaatacaacacaagatagtttatatatgttaccattataattagcatatatatatattataggctaagaaaattactacaggcactaatatgttgtctttttaaaaaataagcaaattacaacgttaataagctttgatgtatagtctattgctttgatatacatttggacgatatttcaatgatttcaacgagaagatgcgtttaaacaaaaaagtgatgtactacaaagttgtagatttcttcgagctctatgatttttatataaattttacctttatatgagtttatatatcaaagttatggttttataacaatattacacaaaaaacgggtacccaaaacctggatacccatatccgactcgaatattcaggtatttactaggtactcctcgcttcgtatctgacccgaacttgaagttgtattatctaggtactagccatatccatcctgagtataaaactattg

SEQ ID NO: 5374 - DNA, 621 bp, Zea mays
gccggccgggtcgggacagctccttcctgtttctggagataccaagcacgagtgcagcaatggcgcatcccatgcctcccctctcagcatcacagagcacaatcaccaccgttctgaagatccttccaaaacctcctgctgctccggagagcagaagcaataattgtgcttttggggccaaattcgacagtaggagggcacttctatgcggcttggtcgctgctgctgctgctgctggcaccatgctgggcgctgacatcgctggtgctgcttcgaagaggcggcctccaccgccagcgccggcagaggcgaagaaagacccgaacgtcagcggagtgcaggctaaagtgcttgctagcaggaagaggaaggaggccatgaaggaagctgtggccaagctgagggagaaaggtaagccggttgataagtgaaggccagaaccagtgacccttgatcaagaaatgtaacttattgttaaataatatactccctctattcttctaaagtaataagccattaatttgaatagtctactcactttatgtgtacagatgagaataaaaatacaactattttgcttgtaaaaaaaaaaaaaaaaaaggcccctagggacggccccta

SEQ ID NO: 5375 - DNA, 3232 bp, Zea mays
ttcctacaatgtttagtgattattgaaacctgtttctatgatgtactatgggatttcttgtgaaatctaggtttttctatgtaatctgggattttatgtgaagttagacgtgccgcgcgagtgggtggcataacccgtgatggccctatgggttgtcgggtcggcatggcctaacctaagcccgtttgtgccgtgattggacatgattcgaggcctgtgacccggttcgacatggcccagaccaatctcgtgccgtgccaggcacaacactcttcatgtcgggtttgagcgtgcctgagccatgtccgtgtcgagtggaccggatgtacatctataacctgaaccggtcgcgccaataactaaactggaaacaatgaagaagcaatgatgcatgtatcgtctctgcccatgcctagctaagctagtaccaaccatatgatacacgcgcacatacttccatcagtcacatcatgtaccttgcttcgttccttttcgttccacggaacggacagccgggaaggacaaggacagccccgaccagccagccgccgttcctgctgcacttcatccggccagcagcttgcattggcagatctccgatgtctcaacaacacactactcacatcacaaggcggcgtgggcgtttgggtcctccggcggctgctgtagcggctccagcgacgcgacgacgtcgcgcatgagcggcctcgccttggggttgcggttgaggcagtggtacgcgagcatggccgtcttctgcacggccctggcgggcggcgggtcgtcccagccggcgcccgccagccttgggtccacgatgccctgcacgcgcttcttgtgcggcagcgccgggagcgcccagtcggtgagcgcctgctcccgcggcgggcgtgagcggtccagcgagcgccgccccgtgagcagctcgagcagcacgacgccgtagctgtagacgtcgctggacgccgtgaggtggcccgtcatcatgtactcgggcgccgcgtagccgtaggtgcccatgacgcgggtggacacgtgcgactgctccccgactggcccgtccttggccagcccgaagtcggagagcttggcgcccaagcgcgcggcctgccggttgctgctggtcgtgaagtcgcggtagatcacggggcggggctccgcgtcgtggaggaacgccagcccgcgcgccgcgcccagcgcgatcttcatccgcgtggcccacggcagcggcggcgacgtgcgcgagaagaggtgcgactccacgctgcccagggccatgtactcgtacaccagcacgcggtgctcgccctcgcagcagtaccccaccagcttcaccaggttcgggtgggagagctggcccaggaagatcacctccgccagccactcccggtggccctggaagctgttgtcgccgtcgtgcaccttgatggccaccggcaccgggagggtgccgccgctcgggtctgccgccccggccggcggcgcgaaggaacccttgtacacccggccgaatccgccgccgccgatgagcgcgtccttccggaagtcgttggccaccgtcctgagctcggagaaggagaaggccacgagcgggttccgccgcgtcgccgccgacgcgccccgccgcagggcctctacctcgcccgggttcgatggcagcttgcggtcgtcgctccggtccacttccgacgggctctgcaccttaggaggactctctgcaccccggccgaatcccggaattgaaacgccaagccaagagcgtcgtgagaacgtcagaaaataattggtaaggatttattggtccaattaattagcttcttcctcataattaattaacttcttttgtttgtgattaaggtgcagttctactgattcaattgagattacgaactaaacaggcttgctgttttattttaaaaacgatcctctagactctagttctggattcgggttgcctagaaaacccaaccgggctgccaaccacccctcgacccgttccccctcctacttttacagttctacttctttgctcggaatacaggcgtttgtggaacgcaacacagagctctgctcaatcaagggtatagacatgtggaaggagaaagcaaggcaagaaccggcggaggaactagactcacctggctttgcggtggaggagaccttgttgacgtaggagctgccccccaagcagttccccatgggagacaatccttccgatctctatcttctactatctcttcttcggagagcaccaagaacggaggcaatccgctgggcgccctggcgcctctctgaagccgaagcaagagcagcagcaggctgctgacaaacagagagacgagcaaccaagaagacggggctgggctctcctggttcggtttccgcgggggtgccgagcggaccggcaccgggtcgcccgtaccggcttccttcaggtggaaggaagaggcagagagagatggatgatggaggaggagggaggaaaagaagctggtggcgatgctatcttccgtcctcctccccaccaacggccggagggagaagagttggaggaggtagccggagcaggacgtttttccagtggggcatcactttcgctgctttatcagcagccgcagcatatcatagctttcacaaaacacacacagcacctaattaaacgctacgctattacgcactttgcaccaggatcggagcacaatgaatcatgcatgtatggtacgtaccgggagagggcaggaacaaggacacctgcgtctcatgtgcccaactgccaaatgggaaccctgttccgctgttcgaggtcgtcggcttgagttcgggttatccttcaaacctggtaagtattttgagtttaagtataaaatctataattaaaaattatatcatgtgagatggaatggtcgatttgaaagctgatgcacactgaaaaagttgttttcaaagaaacattctatgactgctggcacggtttgcacctaatacgttccatatatatatgtacccacatgctaatcatctcgcaggatgaagtctatcatctgaatcaaaaggtccatccggactagccgaccagagaacaaattaactgcaccaaccgcgtgtaattaacgggactgatccgtccaccacaccaaatattcagccattcaaggtttagttcaaccattcgaggtttactatagccatttaagatttacattaacgtataacaggaacaatatatcaatca

SEQ ID NO: 5376 - DNA, 885 bp, Zea mays
  misc_feature (87)..(87): n is a, c, g, or t
cgtgcgcgagaagaggtgcgactccacgctgctcaggcccatgtactcgtacaccagcacgcggtgctcgccctcgcagcagtagcncaccagctcaaccaggttcgggtgggagagctgtcccaggaagatcacctccgccagccactcccggtggcctgggaagctgttgtcgccgtcgtgcaccttgagggccaccggcaccgggagggtgccgcccctcgggtctgccgccccggccggcgccgcgaaggaacccttgtacacccggccgaatccgccgccgccgatgagcgcgtccttccggaagtcgttggccaccgtcctgagctcggagaaggagaaggccacgagcgggttccgccgcgtcgccgccgacgcgccccgccgcagggcctctacctcgcccgggttcgatggcagcttgcggtcgtcgctccggtccacttccgacgggctctgcaccttaggaggactctctggctttgcagtggaggagaccttgttgacgtaggagctgccccccaagcagttccccatgagagacaatccttctgatctctatcttctactgtctcttcttcggagagaaccgagaacggaggcaatccgctgggcgccctggcgcctctctgaagccgaagcaagagcagcagcaggctgctgacaaacagagagacgagcaaccaagaagacggggctgggctctactggttcggtttccgcgggggtgccgagctgagcgagagcagggcgcccgaaccggcttccttcaggtggaaggaagaggcagagagagatggatgatggaggaggagggaggaaaagaagctggtggcgatgctatcttccgtcctcctccccaccaacggccggagggagaag

SEQ ID NO: 5377 - DNA, 2565 bp, Zea mays
gattgggaccctcgaggccggccggatcctatcttcagtctcctcaccgcgcgctctctaccgcttgtccgtttcttcctcttccgaggtagcaacgtggtgagtgaggcagccgctgctgtgctgcactgctgctgcggaggcccaagccgaccggcggagagcacccgtccttgggcggcggagggtggaagaataaggccgggcttgcggatgccggggtgcggagtagcggggagaggtggtgtgggggtatcgtcggccgcgcgccgcactccgccacaagggaagagccgcccctgcctctggatgactatcgctcgcggctacgggaggcaacatgagctcaaatattgcacatcgccacaaagcaaatctgtgttactagaagcaagatttggtcgacatgttactaggagcactgcttatctgctccaaaattcccggagcactgcaatgacaagactacagaagtctgggaagtttctgcaacctgtcttggactcctcaagaaattatttgactagtacattctacaatgcaagcttgaagaggagagttctgtcgagggttgagtgctttgtgtcttcagatccaataaacaatggttggttgaaaccaaggaggtcagagaacttcactagtttggagagcgcatgtgttcagccagaatacaaactaccagtcaggacacgtgctgactgtaaagcagagcagtatgaaataacaggctcacctttgagcccttctgatgttcctgctgatgccgttatgattggagatacaaacgagatttctccctggtggcaggagtttccaaagcgctggacggtcgttctcctctgcttctttgcgtttcttctttgcaatatggaccgtgtcaatatgagcattgcaatccttccaatgtcgtcagagttcagctggaatccagcaaccgttggtctaatccaatcatctttcttttggggttaccttctcacacagattcttggaggtatttgggctgacaggtttggtggtaaggtagtactaggatttggggttgtatggtggtcatttgctacagttcttacaccccttgctgccaagattggtcttccatgcttactcaccatgcgtgccttcatggggataggcgagggtgttgccatgcctgctatgaacaacatcctttccaaatggatcccagtctcagagagaagcagatctcttgccttggtgtacagtggaatgtaccttggatcagtcaccggcctgtctttgtcacctctgttgattagcagatttggctggccttctgtcttttatgcatttggatctcttggaaccgtttggtttgcactgtggcaaagcaaagcacacagctctccagatgatgatccggagctaagtaaagctgaaaagaggcatatactgggtggcagtgccttaaaggagcctgtcacttccataccatggaggctaattctatcaaaggctccagtgtgggctctcataatatcacatttttgccataactggggaacattcattcttctaacatggatgcccacatactacaatcaggttttgaagttcaatctaactgagtcggggcttctctgtgtcttgccatggctgacaatggctgtttttgcgaatattggtggatggattgctgatactctagttcagagaggggtctctgtaacaaacgttcgtaagatcatgcaatcgattggtttccttggaccagccttgttcttgacactgctgagcaaagttcggactccagccatggctgtgttatgtatggcatgcagtcagggtagcgatgctttttcacagtctggcctgtattcaaatcaccaagacataggaccacgttatgcgggggtacttctcggactgtcaaacactgctggcgttctggcaggagtttttggtactgctgccactggctacattcttcagaaaggttcttgggatagtgtgtttaaggtgtctgttgtgttgtacatagtaggaacggtggtttggaatgtcttttcaactggagagaaaattctcgaataagctgtggacattcctatatgccactatacggaactgtgtgattttgatgatgtcattttggcaaacaaaataaattttagaagagatacatctggaagaaaactccattttatgcaagaggtgtacctgaatctgatgtttgggctatcggaagaaccagatcaaattagggtactgtgtgaggtcaagaaggtacacttggaacttgggaaaattcttgtacacaaagcaaccgcaccaagggcacgtcagatttttgcagttgtttcttgagaagtccaggcttctgtcaagatcaccaatccacatctttttgttttaaaatgattgacagttaaatcgtgtatcaccttgcctttgcttaaggcgctacaggtactgccaaactaatgtatgtgcttttcttatcgaaaaacctaaatgtatgtgcttcagatatcttgaacatctctgctgtttgcgtcaaaaaccccaaaaacccaacaaaaaaaaaaaaaaaaaaaaaaa

SEQ ID NO: 5378 - DNA, 926 bp, Zea mays
ccggccgggttgttttattctgtgaacgtcacattgggaccctcgaggccggccgggatcctatcttcagtctcctcaccgcgcgctctctaccgcttgtccgtttcttcctcttccgaggtagcaacgtggtgagtgaggcagccgctgctgtgctgcactgctgctgcggaggcccaagccgaccggcggagagcacccgtccttgggcggcggagggtggaaggtggatgctctaagcccccgcctctctctgccgccttatacccccgcgttttatccttcttctagcttcttcattcacctgttccagaataaggccgggcttgcggatgccggggtgcggagtagcggggagaggtggtgtgggggtatcgtcggccgcgcgccgcactccgccacaagggaagagccgcccctgcctctggatgactatcgctcgcggctacgggaggcaacatgagctcaaatattgcacatcgccacaaagcaaatctctgttactagaagcaagatttggtcgacatgttactaggagcactgcttatctgctccaaaattcccggagcactgcaatgacaagactacagaagtctgggaagtttctgcaacctgtcttggactcctcaagaaattatttgactagtacattctacaatgcaagcttgaagaggagagttctgtcgagggttgagtgctttgtgtcttcagatccaataaacaatggttggttgaaaccaaggaggtcagagaacttcactagtttggagagcgcatgtgttcagccagaatacaaactaccagtcaggacacgtgctgactgtaaagcagagcagtatgaaataacaggctcacctttgagcccttctgatgttcctgctgatggccgtaatgattggcgatacaaaccagattactccctggtg

SEQ ID NO: 5379 - DNA, 740 bp, Zea mays
gtgaaccactgcagggccatcgtggacgccggcggcgcgcggcacctcgtccagctagtgtacctcggagaccagctgcagatcgaggcgctcatattgctctgctacatcgcgctgcatgtcccggagaacgaggaactcgcgcaggccggcgtgctcgccgttctcctgtgggcgtcgaagcaggcacacatggtgcaggacctgcgcgttgaggcattgctcccggaagccaaggctcggttggatctgttccaatccagggcatctaggtgatgattgcagcaaccacgggtgaggatgaattttgctttgcacaatcagattaggatcgtgtccattgttctttgtcattttcaaattccagttatgttgttgttagagtgtacagatcacggtttcaaattccagttatgttattgttagaatgtacagatcacggttatacggagtatgtctcaaatggaaaatactgattgatgtagtgcttattcttaactccaaaggaattcgggtcgatcgttcctgtacgtgtaaatggaaatggtaacaaaaaaaaagtgtttatcatgcttagatccaccaatctggtcccacttggtcgctggtttaagtgtagctgcagcccgactctcgggttgacttgaccccaaatgcacctctgagtcatctctttcctgaacgcaatacatcagctacagtgatctaagaaaaaaaaggcagaactgctagtacagcat

SEQ ID NO: 5380 - DNA, 907 bp, Zea mays
cctcggggccccccgggatcctagaaggaaacaggaacaggcagctctgaaagactgaaactcacggccatggccatcctgggcgccctcaggctcgcgccgtctccacccgccctcgccggcgccgcgccaccggcgacgtcgccgtatacggctgtacgctcctccgtgcacttccgcctcgccaatgccggcgccgccgcgctcgtcgccgcctcgctcctcgccgccgaccccgccgtggctttcattggaggaggaccgtacgggaagcaggtgacgcgggggcaggacctcaccggcaaggacttcagcggccagacgctcatcaagcaggacttcaagacgtctatactgaggcaggcgaacttcaaaggcgcgaacctgctcggcgcgagcttcttcgatgcagacctcacaagcgctgatctctctgacgctgatcttagaggcgctgatttgtcgctggcgaatttaacgaaggcaaacttatcaaatgccaacttagaaggggcacttgccactgggaacacttctttcaaaggtgccgacataactggggcagattttaccgatgtgccgctgcgagatgatcaacgggagtacctctgcaaaatcgctgacggagtaaattcaaccactggaaacccaacaaaggagactctgttctgcagctgatcgacggaaggacctgggacttgtgacttattcaacgtcttgataaacttgcatctgctgctgtaagcacgtgaggaatgtaaattgagttatagagggttcctagaaataataactggtaattacgtgtaaatcaaccaacaatataagtgtgtgctgccctttgaatgtgcaaaaaaaaaaaaaaaaaaaaaacgtcttaaaaagggcggccgccaccgcggtggag

SEQ ID NO: 5381 - DNA, 1455 bp, Zea mays
cctcgaggccggccgggccgggtcccccgccggaaccgacaaacaacagcaataattcatagttgaagacaggcacagggcgagaccgccgtcatggacactgagaccgaggggaaggcggcggcggtcgaggagatgagggagtggtgcgtcgctctccccaaggtggagctccacgcccacctcaacggctccgtccgcaactccaccctcctagaacttgcaaaacagctaggcgacaaaggagtcattgtttttgaagatgttaaggatgtgatcatgaagagtgatagatctcttccagagtgtttcaagctttttgatctgtttcatatacttacaactgatcatgatacagtaacaaggattgctaaggaggttgtagaagattttgctgcagagaatgttgtatatttggaaataagaacaacacctaagaacaatgaggcaaaggggatgaccaagaggtcttacatggatgctgttattaaaggtctgaaagcagttgaagatgttgatgtcgaattatttggttctaatttcagaacgaatgaaacactaagttctaagcttttggatggtgacacaaagaaaaagaagatatatgttaggctccttcttagtattgatcgccgcgagacaacttcggctgcattggataccgttaatctagccatggaaatgatggaccaaggtgtcataggcattgacctttctggcaatccagttgtgggggaatgggaaacatacctgcctgccctacaacatgctaaaaatctgggaatccccgttacaatccactgtggagaggtggcgaaccggaaggaaatccaagcagtgctggacttttgccctcagaggctgggtcatgtatgctgtctgaatgatgtagaatggaagaagctcaagtctctgatgattccggtagagatatgtttaacctcgaatgttatgacaggaggtgctccttccctagagcttcaccactttgctgacctctacaatgcgaagcaccctttgtccctgtgcacggatgattccggcctgttttcgacaagcctctcaaatgagtattacctcgttgcaacaactttcggcctcagcaagtccgagctgttccagctggcccaggatgcagtgcagtttgtttttgctgatgatgtggtgaagaagtctctgaaggaggtgttcaagcatgctgaaaagaggctgctcatgtgggatgaacttgctgcaccaagctagtgtacgtacccgttatgagatcagtatgtatcaacccaattgtatgatttatatatggttgtgtaacttttcgtttatgcacctattatatgtgtaccgtttttcaacgtcttagtagaaggtcccgctcgcgcaaccattggacacgcaaaaaaaaaaaaaaaatctacgcattaagctaagcacccccccatcatgtttggttcccat

SEQ ID NO: 5382 - DNA, 1320 bp, Zea mays
tatatatggggttgctgaaaaatacaagcacagcacagtaacgtgatcagatcagtgctgacatttgccccctgctgtaaacattgtatctaatagggtgtttggttttgagtccatttctcaaatttgatgagatgactttatttcttacattattactaactaactatagagaataagctgatgatggataactcattttattccacaaaccaaaaaaattgaggagtgagaagatgatgaactaacttatttctcaaactaaacgccctgtaaataataggtttgatttaatcaagatgactagtatacgctctaatcaatctcctaagaaaatatcggccgtccaattcgtaaggacaatgacacgcgaggaagcgcgtacgtacaccaagaagaagcggtgtcccatcaattatcatcaattaaaaagtttggcatggtacgtagtacgtacgactggaatatgtccatgtttgaatctcagagacgataaatggcggggccctccacgccgcccgggcaaacttgtcaagcttttccaagaaacctagctagctagctagtaagaggcacaggcaggcaccatgtcgcaccaccattcccaccacaattctcattctcacaaccgtacccaccaccactctcactctcactccggaggaggtggaggcggcggcggcggtggcggtgccggtggaggcggaggcggagtggctaaatgccactgtgattgctcacaccatgatcattcaccgccaaggcaaccgttcttcccgccaccgcagcttccaccaccacaaatctttcttcctgcaggaccaccgctccctccgcctgggccgctcccatttccgccaccgatattcttcggacctccgccgccacccccgcccccgcctccgttcatgtgcccacgaccgccaccatgcatgtaccggaggtggtaatggagataaaagttgatatacacggtgtgcatgtggttgtgccaaagcttctcgtacgtggtgttcgtgtttctgtcaccccaaataagaaccgagcttctccggagatagaactatcttcacagggttccctgttcaaggatggcacgcatcatctcagaagggaagccctcggggagtcttctcccatgtatgggtggagttttgaaagaagtcattatttctagttcttgttcaagttccctacgtactagatgttctcgttgatgcgtggatttatatgtgtacttgttctcttgtgcttttcaccggccctgatgtcgtcccgttgtaaccgatgtttgtgtttcaatgtgtctttggtttaatg

SEQ ID NO: 5383 - DNA, 2237 bp, Zea mays
tcggccgtccaattcgtaaggacaatgacacgcgaggaagcgcgtacgtacaccaagaagaagcggtgtcccatcaattatcatcaattaaaaagtttggcatggtacgtagtacgtacgactggaatatgtccatgtttgaatctcagagacgataaacggcggggccctccacgccgcccgcaaacttgtcaagcttttccaagaaacctagctagctagctagtaagaggcacaggccggcaccatgtcgcaccaccattcccaccacaaatctcattctcacaaccgtacccaccaccactctcactctcactccggaggaggtggaggcggcggcggcggtggcggtgccggtggaggcggaggcggagtggctaaatgccactgtgattgctcacaccatgatcattcaccgccaaggcaaccgttcttcccgccaccgcagcttccaccaccacaaatctttcttcctgcaggaccaccgctccctccgcctgggccgctcccatttccgccaccgatattcttcggacctccgccgccgccacccccgcccccgccaccgttcatgtgcccacgaccgccaccatgcatgtaccggaggtggtaatggagataaaagttgatatacacggtgtgcatgtgtttgtgccaaagcttctcgtacgtggtgttcgagtttctgtcaccccaaataagaaccgagctcttctccggatagaactatcttcacagggttccctgttcaagttaggatggcacgcatcatcatatctcggaaggaagccctcggggagtcttctccatgtatgggtggagttttgaaagaagtcattatattattgctagttcttgttccctactagatgttctcgttgatgcgtggattttatacgtgtacttgttctcttgtgctttccaccggccctgatgtcgtcccgttgtaaccgatgttcgtttgtgtttcaatgtgtctttggtttaatgatatgttgtgtgtctgctttccttcaaaaaaaaaaaaaaaatcaagtgaaaaaaattctaacttttattaagttttcatgaaacattaaactaaatatgcaagtaaattctttatttgtcaagatatatatatatatagctttaataaacaatatgaagaagctaatttgatgttgtagaaggaaaccctaaagtgatccaaagtctgaaactgatggggtattatgtttcatgtcgtcatgctgtgtgattatatgtcaaatcgataatccacagtcccggccaatgcaagtagaaatcttcttccagttgcgtagagctagaggatcggaggaagggggaagcatctgtagatggtcgcttctgctacatatataggcacttcatataagaggtataggtcgagaaccagttggtcgatgcccagcagaagctgagaacgggagaagccatgatgcagcttgatggtgttggtcgtctcgtcgctttgaaaatcatctccagctcgcgccagcaaaagctgctggggtgtttatcaccagtttcttgtttggcgataatgatagatattggtgggtgcctaataataatggtggttcgaggaggactttaatgcatgggatgagcggaccctccttcagatgcagtcatgcagatacgtggtcgagaagaaaattcaaagaacactttcttttctaggggtagaaacggatcgaatacgcacgaatataaattcgaatatcacaatttgccatattttaatccggatttatatacaaattcgaatatcttcggatacaaatacaaaatggatagttgaatctgaatttctattcggatatttactcaattcaactcaaacaaccctattcctttccaaacacagactccatgatgcgcggataactatggtccatggaatcgagcatcaccgagacgatgcgcgcggcctctttaccgagttcttaacactcgacaaagaggacctcgataacactcggtaaataggttttggtgaactgattatcgacaacaacctctttaccgagtattttatatcaaccactcggcaaagaagctaatttgatatatatagctttaataaataatatgaagaagctaatttgatgttgtagaaggaaaccctaaagtgatccaaagtctgaaactgatggggtattatgtttcatgtcgtcatgctgtgtgattatatgtcaaatcgagaatccacagtatcccggccaaaa

SEQ ID NO: 5384 - DNA, 4687 bp, Zea mays
  misc_feature (2340)..(2340): n is a, c, g, or t
  misc_feature (4088)..(4088): n is a, c, g, or t
catggagactgacgattttattgaggaaagcagaaacaaaaatgaaaatatattccaggaagggcttctgttttcttcacagaatgatgcagagtttcatggcattacatctgacgtgctgactgtttcaaagaattccctcttactggatcatgaaacttgcaagatggtagagactaacactaccattttctcggatcatctggaactgctgaatgaaaagcacagcgaaggcgtggaatctacaagaaacatgatgtgggcctggcttctgttcgcttacctggctaatagtccggttcgaaaccatccacgggaactactgaccagtgcaaacagcttggaatcaattgacaaactaagagcttctctgccagatctggtggcaaagttcaggctcgagaacaagttgaatgaaatggataaggggaagcaatactcggatcaaaggacacgtactccaagaagtcctttgacgcctgtcaaccagtaacctgagtggagaatgcgccaaattctgggatgctcaaatgttgtaaagatggcaagatatcttgccgatatgttaccaccttaatttagcgtgctcgtcagacgttaggatgctgcatgcaaagattctgattagggttagataagaaatccagcaatattggatttcaatttgtatcatgtaaaatcaacataatattctcacttatgccttccatttctgatcagtcatttgagtaaagtagcatgcaatgtcgaatttgtttctcgtccctgaatgtgtacatggtaagttcaaaaccataataagtgctattaaaagcttgctaacatggtatgtatctcgcgaatccacctgttacttctgtaacgtgctttccatttttttcctaacgcaaaatgttgcagtactgagcccttccgtttgttcgtgctatctgggcaggagatcacatgaggaaagcacagcacagagaatagagtgatacgcagaacggctcataaatcattttgggaaagagaaaggtgagaggtaaggatatgtgatgcagaacaacacagaggagcagggccttctgagggaagatcacgtttcatcgaccagcgatgcagaggtatgttcctcccttcccttcccttgttccagcattttccctacttttctcttgaagaaaaaagaaactgtcttctgtgcactctgttcttcacaatcttgttatgaactcgctagagatgcaacctagtgacctactatatataataatattgtacattgcttggcaattggcatcagtatttcgggtataatattgtatcttttgtagtgatttacgtataatttatctagctagatcaatggatggatcttggaagactgcgagctttttcagtggtatatgtttaccatgttgtcgagatttcgtacgcattttgggttctaaggagcgtatgaatttgacaacgtttgcattgcaattccattagcgcagagttcgtactactaaatcaaatagctttgcccttgctcgttctgctggcaggagcgcagagttctggaggagcaacttggctgggccagactggagcggcaaaagatcctcgctttgtctgcggaggctgactatgcaatctggcatctggccacgctcgcacggaggaggatgcaagaaagggacgaggccaggaaccaggcgaggatgctgctcgcggacctccaggcaaggaacgcccggatgaaggcggcggttcccggagcatcgtgctccagagtcgcgcggcctgacgcgttcgccgccaccggctacgagcacatccaggcccaggcccaggcccaggcccaggcactcgctcctgccgcgttcgggccgcgggggcagcgtgcccgtgcgggaactggctactactgcgttgcgtcgtccagcggcttcggccacaggagcatcgactcgtctctggacacctgcgccgttcagccgtcgctgcttggcttcgcttcctcgagctcgagccaggagcatttcgaccctgacatgttcttggtggacgtcgcagaatcgccgcaggatgtcagttccggttccggccaccgcagactcaagccaggggagaagctccggctccggctccggcacttatggtcatagtttggcgagcaaaaggccttgcagtgaaaggaagtaataaatcatcagctcaagctgcagcacgtcctgccacgggccatggccatgctgcctaaatcctaggccggtgccatgttagtgcttgctcggtaaaacttataagattattgatgtgttgtggatttgaatggcgcctagtgtcttttactgtgtttggtttaaggtnaacatgggatgaggcgcccctcgattttttagcatcacgccgccaccaaaaactactctggtgtttacctcgttcgtacgtgactctcattcaaacactattgaaactatttaattaactatcaattaactaaggaaaaatcaaccaattagttaagaaaggaaactaacaaacaactatcaattagttaaaaaagggaactaattgatcaactatcaattagctaagaaaaaactaataaatcaactaaggaaaaaaacaaataaacctagctgcattatgcaacaggcttactagcattgaataattgtggccgttgttgtatatcgcttatcatggtgtcatgaaattatgtaacctggaaattttgtttttttggcataaaaatcactgtattcagaacagttcgtcttgggtcatcaacgacctacccaccagaagggctgtttgcctgttgagagggacgcccatttttgtcagccagtgctctgtccaagacaaagaagcaagagtgctgaaatgagaggataatgagcatgctgacttggctgccttggcttccacccacacactcgataggggaaaagcgagcccttccacggttccaccacccactcgatagtggaaaagtgagctcgagcgtgtccagcagctatggataactgacgatgggggtaacaagcttcacagaactctccctcgagctcagcgctaccctgaacaactgaagccgaaatggcgagcctgcagaacctggtctgctccgtatccaaacaagtacgtgctcaagccccttcctcactgtttttttctggaattcatttactttccctgcagttctgaggagtaataacagcttgaacccgttgcttgtttccagctggctgtgccaaattgcgcggcgactaccaaactgaacagggctcctccctcagctgtggcggcgagctcgatccaaggatctttggacgacaccagtaacccccccttttgttgttgttgttgttttttttccgttcatgcatctagtggtcgacagaatcctggttcataacatctctccgcttgtatagaggtcacgaagagacggctagctttgcttggtgctggagcgttagccactggcctactgaggacaagctctgctgcgttcgctgaaggtaacgatcatccctatatagatggcctggcattgtatctatcaggatcggactaggacggtgtcctcgagcagcgttttttttgcgtttcttacctgtttgacactgatcggagctgttcagaggtgccgaagaattacaagtcgtacgtggacgcgaaagacgggtactcgtacctttatccagctgaatggagggtaggttggcgccatgcgatcgattcttgaacagttaagaactgtagggtgattttcatggtgccttcgttcccttgtccctggataggatttcgacttcttgggtcatgattctgcgttcaaagaccgcaacctggcccttcagtgtgttcgtgtggggttcattcctaccgagaaaacagacatccgcgacctaggaccgatggatgaggtgggggttttgtttccttctttcgactatgtattcttcttcttttttatggaaaaactatgtgttcttcactttggttaggcacaaaagataaaacacatactctctcctccgtttaaattatatacgttttagctctgataatcacttttgctgatgtgatgaatatgtttttttttncacattacaccaggccatcttcaacctggtaaacaacgtctacgctgccccgaaccaaataccgtcgatctacgacatgcaagaggtctgtcatctgttcatcgctttatgcatgcaattatcatttgtttggagttgccaaatctagttggataactctgagcaaaaaaataaaaaaaatggtgctagtgaaataagcggcctatcctactatttttgcagcgcaccgtggacggcaagaactactggacgtttgagtacgatctggaggctccgggctacggcgtttctgcgtttgcgacggtcgccattggaaacggtatgatacctatgaacgggaaacgttcatgtgtttcgcttcgcgttgaaatagagagagatgaaactctgtttgtttgtttgttttttgctctaactaggtcggtactacacgctgatcgtgaccgcgaacgagcgccggtggagcaggctgcggaacaggctcaaagtcgtcgcggactccttcaagatctcggacctgacggcgtgatcgcttgcttctgtgacggcctcatgagcatggtgcggcaacttgtttagcgaaagaatggggggggggg

SEQ ID NO: 5385 - DNA, 1632 bp, Zea mays
  misc_feature (2)..(2): n is a, c, g, or t
  misc_feature (1632)..(1632): n is a, c, g, or t
antccttctctccgagtcgttgtcttcttcctagcgtctccccgttcttctctccgtagtagctaacagtatagtgtgggcgtgtggcccccgcatggagactttccctcctcggctggccccgcatctgggcccggattaaccgccttcggcctcccttcccagattgccccacccaccgtcagcctcgtcaggcccttaacccgaagggtcctcccaggacaaaccatgctccggagacagaggcggcagagctggggcaggagcagagccatcacagaaattcttgtctccaggtatgttgaagtttcaacaacttggtttataaattaacatgattttaaaaaatcacagtgactcctcttgcagattttgtaaaatgttttttttttctctagtgcactgcctatcatttgctgcaatttgaggatgataacattctagacacactaaaatctatcatctatcataaacagtagctatttccccctctgttctttgtgtctctgattgtgtggtaccagctactttggcatacatttgttttttgctttaatcttctgttcagcttctaattcagaaatctttacttcagataaccagaatacttcagcttccatagttccacttccacagttgtaacaatctagcctgtaatggcttgtaacagtacagtgagttgggacacctctgatgtttagagctccaatggtcctgtgggagggatatatttttgttttcatagtgtttagccatggggtgccagggtctacgttctaccttggtttggttctctccttttctcctatctgtcaacacatagtcgtctattacttataaaaaaccacattttcccattttgatccctttatgaacaatgctggaaatcaaattctattcattttggaaaataattacatatttattcgtcgtagctatattccattgttttattaggtgctcaaaaattgtgttgaccggacacatgctattttggcctatgtgctatccatttctatgttttatcggtagggttttccatgcttagataacttcctaatttctcattttttttgtaaataaataaatacttggagattcttggtcaaaggaatgttggacacctgctagccaatgtgcaggtaacaggaacctgaacaaaatggccttgcagtctttttttttactgtgtatatctttttcatgtggagtccattaaaaatccatgcataagcagccgcgagaggtctcagacagataagatggtcgacggcatggacttcgaggagctctgcagcgacttcgaatgcataagcagcccctacgtggagtccataatgaggcaggtcgcgcgggacatctttgagcttcgcgaggataaccgcgcattcagctgctacgccgtccccgtgaagtatgaggctccttcctgatgataatttataattataaatcgaggaaactccaataagtttccttcctttttttcctttcgtttttctcccttctctgatttttcactgtggagggactggacttccgacaaaggaaatcacaacattgtatatgattgacttgtaatatgttagtaaatatatctgtacgttatgacagaaaaaaaaaaaaaaaaan

SEQ ID NO: 5386 - DNA, 4858 bp, Zea mays
  misc_feature (1787)..(1787): n is a, c, g, or t
  misc_feature (1814)..(1814): n is a, c, g, or t
gtatggatatgttcccaggcactttggtgttcaggtcccgaactcttcttctactgacgcaacatctccaccagaccaaacaacatctgttaccgtagtagcatctccaccgggccaaataacgtttgaagcatcaagcgggtaagcacagctctgagcgtacattccaaatggggaatttggtattcgtcaagctccaaccgtatgtccagacgtctctagtctcccgtgctaaccagaagttatgtttttgctactttgggtcctaccgtgtgttgtcccagattggtggcactacatagaagctgtacttaccggattcctcagcagttcaccccgtctttcacatgtcataattaaaacagttcatttggccatcctcgcaggtctctgctgtcatatcgaacttatctgatccctttcaagttcatgtggctattctacagtgtcgagtggtgtctcccggcgttcgcgtggtgcagcaaggactggtgcaatggtcatcccttcgccagtcgctggctacatgggagtggaaggatttggaagctctccgacaacgctttccactagtgcctacttaagggtgcgtttagttgcaataacaggacgggatgagacgatccctcaaataagattattgatttagagtcaaggattgatacaagactattccagtgttgtccccaattatccctcaaaattggtggaacgagatagaatactagagacatccctgtcctggttgtcccgcaaccaaacgcactcttagagataagcttgcgctcaagaccggatattgtcaatacactaaagacgccaccgtcaacagaacctagaataaagagaaaactaataactaatagcagggtgaccggctcagaccgggtgtactcgtcttttaatactgagactcatagaaaataacttgtaggttggctgtatcggaactttgcgatttcatccaaaaagagcagaacactacgagactacctccttctctccaagtcgttgtcttcttcggttcttcctagcgtctccccgttcttctctccgtagtagctaacagtatagtgtggcctcgcatggagactttccctcctcgctggccccgcatctggcccggattaaccgccttgggctccctccccagattgccccacccaccgtcagcctcgtcaggtatgtctcgtgttccctaaccttgacgcttctcccttctcggcgcctgcttcgttggttgccttcagcggacgccgccgattcggctctcctgttcggcgccctccccagattgccccacccaccgtcagcctcgtcaggtatgtctagtgttccctaaccttgacgcttctcccttctcggcgcctgcttcgttggttgccttcagcggacgccgccgattcggctctcctgttcggcgccgtgtcttgcgacagacaatgctacattctggagtacatggattagatgggtgttgtgcactgcttttatatggatctaatgattgtggccttgaacgttctcgccaggcatatctcatgtttttacatggattagataagtacatgaatctttatttaggcctgtttggttactttagtctagggactaaagtttagtactccatatccagcttgatttgagggactaaaagtatccataacgcattaaatgactcgtaagaaaccaaaatgcctctcatcattctctggcattagagcatctgaaataaatgagagccaaaagtggaattaatatggtttagtcccttttatcaccccttnaagggactagagactaaagcagtttantccttgttttagtcctactatttggcaatttatagactaaatgagactaaaatgcccggactgcccctccctccgtcggccccgtcaggcccttaacccgaaggtaattgagattgcgaagaagatgaaagaggagagggtcaagttgtttacttcagaatattttgcttacagatgatacgactagatcaaatcagttgcattgtgagttgtgacatgttggcaggatgtcagtttcccttttaacctggctcttgtttgcttcctgtgtaatttgtgtatatccctgtgatgaacattttagtaatctgggtgctcattcaattggcgcgccctcctcatcactcttagatggggaggttgaaggaacccatatcgatgatgtatacaccgttgagatgtttgcttctcgtgtaatttgtgtatatccccgtgatgaacattttagtaatttgagtgctcattcagttggtgctccctcctcatcacgcaaataggtactgaagcccatatgactatgcagatctaggacagaatgtttgcaataaatactgacatggatatctagctttggctttgaaagatgtagggatcttttgttaaattgatttacctagggtcctgctacaagagcttacctgttacctcgttatatcttttgtgagattacagcaaaagtatccaatttctacatattttactgctacacagatctgtctgtctgtttggtcatggatatggttcggttttactgctgtaaaaagggattgaaaaatctgcaacctgatttcaatttttattttttatttgcatcacgatgaaatggtagggtcctcccaggacaaaccatgctccggagacagaggcggcagagctggggcaggagcagagccatcacagaaattcttgtctccaggtatgttgaagtttcaacaacttggtttataaattaacatgattttaaaaaatcacagtgactcctcttgcagattttgtaaaatgtttttttctctactgcactgcctatcatttgctgcaatttgaggatgataacattctagacacactaaaatctatcatctatcataaacagtagctatttccccctctgttctttgtgtctctgattgtgtggtaccagctactttggcatacatttgttttttgctttaatcttctgttcagcttctaattcagaaatctttacttcagataaccagaatacttcagcttccatagttccacttccacagttgtaacaatctagcctgtaatggcttgtaacagtacagtgagttgggacacctctgatgtttagagctccaatggtcctgtgggagggatatatttttgttttcatagtgtttagccatggggtgccagggtctacgttctaccttggtttggttctctccttttctcctatctgtcaacacatagtcgtctattacttataaaaaaccacattttcccattttgatccctttatgaacaatgctggaaatcaaattctattcattttggaaaataattacatatttattcgtcgtagctatattccattgttttattaggtgctcaaaaattgtgttgaccggacacatgctattttggcctatgtgctatccatttctatgttttatcggtagggttttccatgcttagataacttcctaatttctcatttttttgtaaataaataaatacttggagattcttggtcaaaggaatgttggacacctgctagccaatgtgcaggtaacaggaacctgaacaaaatggccttgcagtctttttttttactgtgtatatctttttcatgtggagtccattaaaaatccatgcataagcagccgcgagaggtctcagacagataagatggtcgacggcatggacttcgaggagctctgcagcgacttcgaatgcataagcagcccctacgtggagtccataatgaggcaggtcgcgcgggacatctttgagcttcgcgaggataaccgcgcattcagctgctacgccgtccccgtgaagtatgaggtgttcctctgctatgtgaaatcttttacattttgtacattaattggctctttcaggcttttggtttgagtcctcttagatcgatatttcactttggattttgcacttgaaaacttgcaggcggttacactatgttgccacggttatcagtttctatgcgtttttatcatttatgttatatgacattttcatgacacgtatgtagagcatttgatagggcgtttttttctagtatcttctaactcaccctcgtctttaattttttttccccaggctccttcctgatgataatttataattataaatcgaggaaactccaataagtttccttcctttttttcctttcgtttttctcccttctctgatttttcactgtggagggactggacttccgacaaaggaaatcacaacattgtatatgattgacttgtaatatgttagtaaatatatctgtacgttatgacaagagatataacttgttttagggctagtttggtaactttatttttttcaaggaattttttcatttttccgagggaaattagttcattttttacaggaaaaatgtaaatcccttgagaaaaatgagttgccaaactagctcttatctagataatttgtagctcaaaattttacatccaacaaacaaggtgtatatatatgtatatttacatgtatatatgtatgtgtgtgtgtatatatataatataatatatatatatatatatatatatatatatgtgtgtatgagttgtaaactctcatatgtcacaaatctaatgtactaatggggaaaaaaatctaattttgatacctaaccatgtctagaaagattttgcactgtcatttgatgtctgtattcatccttctattctggcggttgtcctataaattgatatcttaattgagacttccagcatcctttcgcaagtgactggccaagtaaatcagcaatatttgttgacatggtttgagcctcctgcacatgagggaagttgtcttcccca

SEQ ID NO: 5387 - DNA, 2357 bp, Zea mays
  misc_feature (1256)..(1256): n is a, c, g, or t
  misc_feature (1267)..(1267): n is a, c, g, or t
aggccggccgggacgcggccagcggcggaaatctctccgagagccctcgcgaattgaagctgctgggcacggctatctagctgtatcgctcgtcgagtcaactccccgcgcgcgtcgtctcgttcgagttctctcgcatctcgatccggtgcgctacacgtagacgtagcgtccgctgatacataaacggcacgggcgcggccggccggacctggctcggtgctgtccctactagttccaaagggaggaaaggaagatagcatcatcgatcgtcatgagaccggcggaaggcgcggcgcggttggcttgcctgctcctgctcgccgccgtggccgcggggcacgccggcgtgcagccgctggcgcgcatcgccatccaccgcgcccgcttcgcgctcgacgcgtccgccgccgtgcgggcctcgccggagctgctgggaaccaagggcgaagatactgcctgggtgaaggtagaccttgttactccccatccaagtgccgatgattgggtcggcgtgttttctccttcgaagttcaacgcgtccacatgccttggttctcacggatctggcccaggccctgtgatatgctcggctccaataaagtatcagttcgccaactattcgtcgggctacggggagtccgggaaaggcgcgctgcagtttcagctgatcaaccagcggcaggacttctcgttcgcgctgttcactggcggactctcgaatcctaagcttatcgcagtatcgaacgccattgctttcgcgaacccaaaggctccagtctacccacgcctggcgcaagggaaatcctggaacgagatgactgtgacgtggacaagtggctacgagagcgacgaggcgtacccgtttgtggagtggggaatgaaatggagccccccggtgcgcagcgcagctggcaccgtcacttttgaccgtgaaagcgtctgtggagagcctgcccggtctgtcggctggagagatcctgggttcatacacacagccttcctcacagacttgtggccgaacaaagagtactactacaagatcggccatatgctgccagatgggagcgttgtttggggcaagctatcttccttcaaagcgcctccgtttcctggccagaagtcactgcagcgcgtcgtcatcttcggagatatggggaaggccgagagggacgggagccacgagtacagcaactaccagcgccggatcactcaacaccaccgacacccttgtcaaggacctggacaacattgancatggtgttcncacatcggtgacatcacctacgccaacgggtacatctcgcagtggggatcagttcacgcagcaagtggaggagatcacctcgcgggtcccttacatgattgccagcgggaaccatgagcgggactggcccaacagcgggtccttcttcaacggcaccgactctggaggggagtgtggcgtggtcgctgagaccatgtactacacacccacagagaaccgagcaaactactggtactcggcagactacggcatgttccggttctgcgtggcggacagcgagcacgactggcgggaaggcacggagcagtacgagttcatcgagagctgcctcgccacggtcgaccggaagaagcagccgtggctggtgttcatcgcgcaccgcgtcctcggctactcctccggcttcttctacggcgtcgacggctcgttcgcggagcccatgtcccggcagagcctccagaagctctggcagaagtaccgggtggacctggcgttctacggccatgtccacaactacgagaggacatgcccggtctacgaggaacaatgcatgagctcggagaaatcccactactcgggcaccatgaacggcaccatccacgtcgtggtcgggggcggcggcagccacctcagcaacttcaccgcccaggtcccgccgtggagcgtgtacagggagatggactacggcttcgtcaagctcacggcgttcaactactcgtccctcctctacgagtacaagcgctccagcgacggccaggtgtacgacagcttcacgatgcacagggagtacagggacttgctggcgtgcgtcaaggacagctgccctccgacttcgccagcgacgtgacatgcattgcagccgcgcgtgaggagcagaggggggacaggggtcgcttctgtgacagtgggttaggttccacttcggcgtgtaactgtaactgtttaattaggtggtcgagcgagacccacattataaatcctacactcaataaagagcatgttgaccctgattagttggcttacaggtaaggagctaagagcagccctgtcacatcagcaatttggtgatatgacaataaaattaacgagg

SEQ ID NO: 5388 - DNA, 899 bp, Zea mays
gggcgggatctctgaaactaaacgccttgtgttggagcatactgccggccggctttccgtacaaatataaatacccctggcgagttgggttgggctatctcgcaatcgaggcgttttttttctgcttcgtaagttcgtggtcgatccagcgagcgagcgagcagaccggcggctaaccgcggagggagagatggcgcaggggacgctggaggtgcttctcgtcggagccaggggcctcgagaacaccgattacctgagcaacatggacccctacgcgcttctgcaatgtcgctcccacgagcagaagagcagcgtcgcatctggcaaaggctgtgaacctgagtggaacgagaccttcgtgttcaccgtctccgatggcgcagcagagctgttcatcaagctcctggacagtgacggtggcactgatgacgattttgttggtgaggcaacgattcctctggaagcagtttacacggaaggaaacatccctccgactgtttacaatgttgtgaaagacgaagaataccgcggagaaatcaaagttggcctcacgttcactccagaggaccagggcttctgaggaataacttggcgtgtggccgctggaactggaggcagcaggcagtcgtcttatgattcagaagcaaacgacggatcgattcccttgatgtactgcagtccagtgagcgtgcatctacaacttgtagaagaagcctgcaacatgatcacgggatcctgtactgcatcactctaaagcctagctaaaaccaccagctcctgtacttgatgccgggcgggcttgtcatgtactgaaacctacaataacggtcgccgaaccccactctttgatgttcaaaaaaaaaaaaaaaaaaggcccctggccgtgtgactgctgcaag

SEQ ID NO: 5389 - DNA, 3108 bp, Zea mays
gcacgagaccattacctagaacatcctaatcgccgcaacctcctcccatcccttgcgccagcggattccttggctgcgcggaattctcctagcctcccgagcttccccagctcgagaagggagctcacggtgacgcggcgcgaagggccgggtcagaccttggccgttggccccgaggcggcggtttcgcggggggtccagcagagcccggctcgcgcgggagccgctctgattcgccgggggacgccgcggggaatgctctacctcaagctgccggcgggggatctagggttccgtccgggggcgccgaggcggggatccggcggcggcggggcctgagggtggcgcgggcgtcggaggcggccgccatggagcaggacccggagcgcgcctgccttcggagcttcgagctccacgagagcgagtcgagcctttacgttctaggaactaattctgacagaacactttggagactactcaagatcgatagatcagagccgtcagagcttgtgatagacgagtgttctactgtatatactgaaagtgaacatcctgacttgttgaagggtcttgatgacgagcacaggtcaactggcggagtaaaatttgttacaaagttttatggcataattggttttatcaaattccttgggccatattacatgttgattattactgagcagaaaaaaatcggggaaatctttggtcatccagtgtatcaggtgaccaggacttcaatggttgaattagcaaattctaagacaagatctacttttcaaaacttcaaggacgagaacagatacaggaagatcttgaatgcacttgatcttaggaaggatttctttttcagttactcataccacattatgagaagtcttcagaagaacttggctgatccacaggatggatggaccttatacgagacaatctttgtgtggaatgagtatctgacacggcggatccgtaattgtctcagaaatactttgtggactgttgcattggtccatggtttctttaaacaggataaattctcaatatctggcaaggatattatgctcacactcatcgctagacggtcgaggcattatgctggaaccagatatttaaagaggggggtgaatgagaagggaagagtagcaaatgatgttgagactgagcaaattgtctatgaagctgtgcctggacctactgaagtaagttctgttgtgcagaataggggctcaattccactattctggtcacaggagacatcaaaattgaatcttaaacctgatataatattgcatgagatgcagaataattatgaagctacagagcttcattttgaaaatcttagagcaagatatggaaaccctatcattatcttaaacttgattaagacacgtgagaggcgagagtctatactccgccgagaatttgataaggcgatcaagataataaacaagagcctgtcagaagagaatcatctgaggttcttacattgggatcttcatcaaaactctcaaggaaaacctacaaatgtactcgacgtccttctaaaagtggcatttcgggctctgaatttaactgagttcttctattgtcaagtcgcaccaagttctgagacttctgcacaatgccccaccctattgaatggtcttgatcaatatttatgtgatgacaacaatagtgacgacacggaatgcactgagattgttggtgatgtatcccaagaggatatctcaggcagctctgattcctctggtaatgcaaccacagaagataaatttgagaatagtggactgccaccaccaaaaccaccaaaattccaaaaaggtgttttgaggacaaactgtatagattgcttggatcgtacaaatgttgctcagtatgcacatggtttagctgctcttggacatcaattgcatgcgcttggttttatagaatctccagaactaggtttagaagctcccttggcccatcatttgatgcacttttatgagatgatgggtgacacacttgctgtacagtatagcggttctgctgctcataacaaggtattctctgcaaagagaggtcacttgaagctttttattcagtcacaagagttctttaggacacttcagcggcactacagcaacacctgtatagatgctaacaaacaggctgctataaacttgtttttgggatacttccagccacagcaggaaaaacctgcactgtgggagttagaatcatctgctgggaagcataacaataatctttttgatggccacccaagtacattgaaaagagtaaaatcagatggcaccattcttcatgaaagtaatgcttctatatctggctctggtcgttgccataatgaaccgttaagtgcatcgcagcctgatgtccagaatgggtttcaattcccaacttcagaatccgattcacttcatgaaaatgaaatttcatcagcttgtggaagtggagtagcacacctaaggtatactcccacagcctctgacgtgcttcatgtcccaagagctaaagttgaatattgccatgattctggtgattcaaactttttggatcttgaatggctttccacttcaggcaactcaagtgatgaaaggtctattgcaactagcacgccagatgcaaacctatcaaatgagaatgtcattagtggcataactcctgatatcatggaaaaccatcttgctgaaatgcagtatcagaagttacctcggaattttgtgcagtgggttaatcacggtgataccttttggtactaagatcgcaattactggaattcaatatgtcgccagcttcccagggtgggcattaacacggatctgagtagtagattatagagtgatatggatgctgcggcaaggcatttctcccgtgatatactccgcaccatccccaaagtcctttattggtccacgtgtttttacaatgggtgagtagatagatatctttctgttgaaagaaaatagagatgataattaggcttattattgttgacctgaaattgtcattattcatgggaacatgtcatattttcttgtgtaaatatatatgcttgaggtgtcaaaaaaaaaaaaaaaaaaaaaaaaaaaaaccgagaaaggggccggtacc

SEQ ID NO: 5390 - DNA, 642 bp, Zea mays
aatccacatgagataggaataaccgaacaagcccttctatggccgggaggattgtcgagtgttcctggaataaggaagagaagctttgggcctgtgtgcgtattagatctgataaatcgactccaaacgacatcaacacataccggaaggtgatgagtatatatcacggataagaaaagcttctccacgcggacgacaaaataaaagtaagagcaccttgaagaagaatttgaagtggaagtggaaggggagcttgttcctccatcggaaccttctccaactgaggttgtcactgaaggtcctccagaaggtgtcccatttggatttgctgctaactgcaatatcctggtcgaagaacccgactctcctcctcaccaaggagaaactatcaacacatatgagttttgttaaactcataatggtgacttttacttgtgtacattatgtgggtgctgcgggaagatggtttcttcccagttgatgtaataagttagccctttaactctacctcgggcatgtaataataaatactttgtggtttgtaaacttattagcttgttaatgtatattatcttattgtaaaaacttccgctctactcctgtttttaaaagtttatgttcttgactggttaccgccctttt

SEQ ID NO: 5391 - DNA, 1104 bp, Zea mays
agtgagtgcactagtacgctacgcacctttccttcgtgtaataactccagctacttcctgtctagtgtctccgtcgaccgtcgctgccagccagccacagcaagctccgcacgaccgccggtccgccgcctaccagagcgagctcatctctcagccgcgccggggggcctcctcgtcacgccggcgcagcccgcgcttcgttccaccgtagtttgcccggccgtgctggggcaaaaaaaggtccgggcccacgtgttcccagacggagcgagaggacgtcgatcggtcaggccatcagggaccagaccagacaaagccaaaggggccgcggatcggtaggcggccggcgcggatcggaggaagaagggaggaggaggccatccagttggagtacttggagaggtagcaggacgacgatgcttggaggccgtcccctcttcgtgctcttcggctcctccatcgtgcagtacagcttcagcaacggcggatggggcgccgcgcttgccgacatttacgcccgcaaggctgatgtcctgctaagaggatatattggctggaacacaaggcgggctgttcaagtgatggacaaagtgttccctaaggattcagcagtgcagccgtctctggtaatagtttactttggtggaaacgactcaattgatgctcattgttccggtctcgggcctcatgtgccgctagatgagtacatagggaacatgagaaagattgcagaacacctaaagagcctctccgagaagacacgggtccttttcctgagctgcccacctctgaacgaggagatgcttcgaaactcaaccagtactatactgagtgagatcgtccggaccaacgaaacctgccgtctgtactctgacgcgtgcgtagctttgtgcaaggagatgcacctgaaggtggttgatctctggcatgccatgcagaagagggaggactggaagactgcgtgcttcacggatgggctgcatctgtctgaagaagggagcaacattgtggtggaagagatcctgaaggtgttgaaagaggcagagtgggagccatccctgcactggaaggcaatgccgacggagttcgccgaggactccccct

SEQ ID NO: 5392 - DNA, 1917 bp, Zea mays
  misc_feature (1913)..(1913): n is a, c, g, or t
actgatgaagtctcagcgggtattttgttagcattatggagggtatgccttctcccgatggtgacaatatcaccaaaaaaaactaatgatagtttaattagggatcaaggcaaaatgtgtgccaatataaatagattgctactatataacaatgacatgaatgagttcaattatatacaggagagcaacctacaaattgacacgtgcatacgattgtatacactacggatcaacaatggcagctctggatccacctgtatgttacttagcgaggataggaacaccacaagcagcatttgcatgcttgtcttcagcaaacacaagatttcctctcacaaaagtcgacaggaccttaccagaaagttgctttcctaaatacgctgaaatattctgatgtttatgatatatagcatggttgttgtcaagttgaaactctgtttcgggtttccatactacaatgtcagcatggtatcctggtagaatagctcccttattcttttggcctgcaagtttggctggcctttcgctccaccatgaggctagctgattcagagtaatgccatactttcgcccatatgaccatgtcaccgggaggacaaactgcaatgatgatatgcctccccatgcccttaagaagtccccttcctccattagtttgaggtcaggagtggatggtgagtggtctgaacttagcatgtctatgtgtccatcaagcagagctttccaaagattttctctgtttgtgtcatcacgtatgggaggagaacatttaaagcgagtatctccatctggaacttcttcagacgaaaatgccaggtaatgagggcatgtttctatagacagacttgcaccactgcgtttagcatccttcataagttccaagctagtttttgcatctgatagatgaacaatgtgaatatgagctccttcggaccgaccccccaactccgtatccttcattgcacgttgcagatctctgatagccgcttcctcccatgatggtggtctagacttcagatacgtcatataggaccgaggatctaattcatcgtcttgcaaatcatgatcctcagcctcaggtatacgttctgcatggataagtaaaggtctcttgtattttgccagtgtaaccaatccttcttcgatatgagttgaatttgtcatgggaaagtcgttgatgcctgaggggcacataaaagacttgagtcctaaaacgcctgcctttaggaggccctccaaagcacttgggttgaaggcattctctggcacaaggcctccccaaaaccccacatcaacatatagcttatcccgagctgcttccagcttcagtttgagagtttcttcagagactgttgacgggaagctgttgagtggcatatccaccagcgtcgttatcccacctgccgcagctgctcttgtgccattggagaagccttcccactcggcacgtccaggctcatccagatgggcatgcacgtcgatgaggccgggcatgatgacggcgtccccgtagtcaaggagcggtcggcggagcacgaagctccggtagtccccgacggcgatggcgttgatgagccctcctttgacctctactgcggaggggccgacgcgtccgagcgtgacgacgcggtcgctggcgatccagaagtggtcgtgcgggaggaggctgcacccttcgccgcccaagctcttggagaagggcgcgcggtagaggagcacggccgcgagcgccgccgccaccgcgagcacgggcacgagccgtcccttggccgatgccgccatggtttaccctgccctgcgccgccgccgccgttcctcccttgtcctgtcctgcccgtctactcgtaatcggaatcgccctgacgagtcgcgtccctttcttcccggatgagcatgttctaggtcatggtctngtgc

SEQ ID NO: 5393 - DNA, 2765 bp, Zea mays
  misc_feature (1583)..(1583): n is a, c, g, or t
  misc_feature (2193)..(2193): n is a, c, g, or t
  misc_feature (2204)..(2204): n is a, c, g, or t
gtcggcttcggcggcggtctctcccggtgtctcctcgctctccgtcgccgccgccacggcgcgcgtcgaggtcgacgccacgccgtgctgcatgtcctcccccgcgaggttaagcgcgccgtccgccacgcccagacacgtggtcgtcaccaccgggtcctcctcctcgacctccatgccatggatctggtgggtcgccgacctcatgcggtggatgtcgcgtgcgaagcgtcgatcggccaagaggcagcacgccgccacgtctgccgtggggcccagatggaggccgccgcggacccggaggagcgagagcggaaggcggcgtttgagcggctggacaatctaggacggtgcatcgcggacgtggagagcagcggcgagaaggtgttcagagccctcgtcaacaccagagtctccctcctcaacattctcagcccagccttctgattcccgaatcatcagaacccagcaaactcgactgcattttgcaaccttgaatccattgtaaaaacctagattcttttgaaacgtctaaggattttttccttttgaaacgaacattaaaaaaatccttttgaaacgaacatctaagctttggaatttggatgcgtgtgcatcacatttctagaatcggtagctaattaaagggccattttcctcccccttgtacttgtgcctaaatttagacaacatcctcaaacttaaatatgggacagctcaattgaaaattaagaagcaaattttaaagtttacaaagtaatctctttttatttattcatttcccttttgtaatctggaggggcttgcgtacattattgaaattgagaagcgaagtttaaagtttacaaacaaacagttcaagggacgccaaaaaaaaacaaagaaaatgaacaggcccctactaattaactacaccagcgtttggatccatccattcatcaaaagacggtgaggatcttgacctcactctctataagagagcagcagaactgcacaagttctttgaagaaaacacagcagcaagccgttaagctgggttgaacaccataaggtcattccttgctgtcgctgtccagattgtccaacatatagtagtatcactgttaccatgaagaattctgattgcagtctatctttgaaatatcttgtgacttctggaaattctgcgttagatagtatataagtatgctgacaattcctagcattgctttgcaaaagctgcagtagagggacaaatgttgtaaggtttccttagtatcctgaaggacgcatttgtaagactctaaatgcatgttttttcttcttcttaagatgtccatcgtgcttagcctatccttcttgagcaaccagaaaaagacgttgtgctttgactgacaaaaacaatcccatggccacagataaaagccatgtatctgtggatgaccgatcagtgtcttgtaggcatctgagagaacaaatttggagccctaaatgtacttccaagcatcactaccatcgttcagctttagatcttctacactctgcaagatgacctgcaactgtgcaaaggctacttcaaagattggcaactggagagtggagantctaattgaggtcttcctgattagatgccttttcaaaagagaggtttttttgcaaaagagaatagtgctggtgagctgatctttagattttgattgcgccagttatcttcagaacagtgtgttggcagcccggatgaccgctcgcagggatctcgggacgacagagtggcggtcttggaggttttagtaacccaggacaaattatatatatatatactattccttaagagcgtaacgagggcgtccaccgagcatcaccatgccaccttccgtagttttcaacggcggttgggccccatcaaaaatctaatcctactgtcactccaaagccgactttcttgactaatcggcgacggaatctcgcggtcttggtttggccccattgtgtgcttcctcccgatcggtacttgcctggtggttgataccttctattctcttcccttgtttggtgctaaagggcgcaatttccacttggttcttggtatgttggaggttgccaccttctttctggtttgattttttcttcggtgggagcgtcgtcaacgcgacgcctcgagcgggtaagcttcgttcatctttacaacatccatttacttcgttgttatcgccngcgtcgggtgngaacgagcgatattcacagccaatctcacatcttgcttggctggtggatctattggatttcttggcccatcgacatttgtcaccatgggcggcgtgtgttcggcggggattgcaggggacaagtcgccaacagagctctcattccgagtgatggggtttgtggtggagcatgatttcaaggccttctcagccgttggcaagaacaagaccgcgcccgtcgaagaggtggtggatcctaactaggtgagcgaccagtcgtttcgtttctctgagaagggctcgccgccatcaacgagtggcaaggttcgtcgctcaatctccaaggaggccaagactgtttttctgaggggttcgttcgtgttggctgcgctagaaggttcgttcgtgttgtgaaggttcagtcattgtacagggagctggagtagatccaatctgagaacaagcagatacctgctataagagaagggttgcatgatatacaagaggatatttcgagggtcaggtttgtgttttgtgatcttatgcacgatgcattgatgtggaaaatgtctccataaatta

SEQ ID NO: 5394 - DNA, 896 bp, Zea mays
  misc_feature (4)..(4): n is a, c, g, or t
  misc_feature (32)..(32): n is a, c, g, or t
  misc_feature (37)..(37): n is a, c, g, or t
  misc_feature (42)..(42): n is a, c, g, or t
ctanagttgattactggccgtagggctattgncagcnccagnccacatggagaacaaaatcttgtctcatgggcacgtcctctgtttaacgacagaagaaagctccctaagatggctgacccgaggctggaagggcgataccccatgcgtgggctttaccaagcccttgcagtggcttcgatgtgcattcagtcggaggctgcttcacgcccactgattgcagatgtcgtgactgctctgtcctacttggcatcccagccatatgatcccaacgcagctcttgcttcaaggaagccaggcggcgatcagcgaagcaagcctggcgagaacggcagggcagtttccaggaatgatgaaactggaagctccggccacaaaacacctgccaaggaccgagaggactcacccagggacctcccagcgatcctgaacaaggaccttgaccgggagcgcatggtggccgaggcgaagatgtggggcgaccgggagcgcatggtggccgaggctaagatgtggggcgaccgagagcgcatggtggctgaggcgaagatgtggggtgaaaattggcgtgacaagcggcgtgcagagattgggcaggggagcctggattcggttactgggaacagctagggggcaattaagcgaacagaaacgtgacatccacccatgcatttcgtttgtttatttccaggtccattttcgttctggcggcggtcggcaggccccagggttgtacatttctaggtcagggaagagtgggaaagcggcagcgttgtactggacagtgaatgcatgtggttgtacatgtaaattctcagaaaagttttgtgagaatgaaaggacatatttgagttccaaaaaaaaaaaaaaaaaaaaacaagagaaaaactcgagag

SEQ ID NO: 5395 - DNA, 1238 bp, Zea mays
cctgcgggtacccgatacccgcccgatacccgacgggtacaatttttaacccgcgggtacagtgcggacgggtatgtctaatacccacgggtacggtcgcggacgtatatttgttatacccgacctgaatccgacccgctgttatccctagtttcgtgtgtacttttccaaccacagctgcagagcgtgtgagtacgggacaaaaaggctaaccaggaaacacatgtacccttgtaccagtcacagcctgacgcgtgacaacacggttgtgagaaaaaacacgagacctaggttgcctgttcttcccccccgcaccttctctctcatctcccttttcctcttcactctccatcgtcaccaaaaatatgtctccctatccaagcgattcgccgaaggaaccgcccacgatggcgccgatccaccgtgtgcacaagacgggtctgcctcgagcttcgcgctggtaggtcggtcttgtgatggctcctcgccgtcagcgcaggtgcggggtggcgacgactgcgggtcttaggcgacaccgtcacaaccactgcgtccgcaccgtccagaagtgacgcctccaccttcctctacgcgcagacgccaattcgaccaccttcctcgccgacaccctcagcctcaaggagaacgaggtgtgtgtctcgcgttcatgaaatccatcgtgcctggtgggattgcattcaagatgtacttctctgtcaagagaaatggcatgggatatggtttgtatctcgattcttctgtgtgcgtctaagtaggtcgtggtcatctgtacaggctaaagattggtgccttcttccaatctccccctatattagttccccaccctcttcgtcttccatttgtatattggagacctatatctgagatatcaccaggtctatcttttcattccaaaaaaaaaaaaaaaattctgtcatctgccaccgttgtaatggaattgctgctatagatgccgtttgtgacctgactctcgactaggcctccgtggatacatgtttgttttgctaccgacaactacttttgtatcgtgttcacctacttgttgggtgttgtttttcgattcatgatcaagacacccttttgggtcgccctgcacctgtagttacttccacaagctagcttgttcaagccagaggatagcgatacaggatgaaaaatatatgtcgtacctacaggtataacaaagaaagttgtcatcaaaatgtaaaatagtgaga

SEQ ID NO: 5396 - DNA, 613 bp, Zea mays
  misc_feature (558)..(558): n is a, c, g, or t
ctccctatccgagcgattcgccgaagaaccgcccacgatggcgccggtccaccgcgtgcacaagacgggtctgcctcgagcttcgcgttggcaggtcggtcttgtgatggctcctcgtcgtcggcgcaagtgcggggtggcgacgactccgggtcttaggcgacaccgtcacaaccgctgcgtttgcaccgtccagaagtgacgcctccaccttcctctacgcgcagacaccaatttgaccaccttcctcgccaacaccctcagcctcgaggagaacgaggtgtgtgtatcgcgttcatgaaagccatcgtgcctggtgggattgaattcgagatgtacttctctgtcaggagaaatggcgtgggatttggtttgtatctcgattcttctgtgtgcgtctaagtagatcgcggtcatctgtacaggctatagattggtgccttcttccaatctccccctctcttagttccccaccctctccgtcttccatttgtatattggagacctatatctgagatatcaccaggtctatcttttcattgtagccctccttgattntttctgtcatctgcccccggtgtaatggagttgctactacagatgacgtttgtga

SEQ ID NO: 5397 - DNA, 882 bp, Zea mays
cattgggtccctcggggccggccgggagtgagcgcaaacataacagtcttacagtacgtagcagcagcctagcacgacgatggtgtccggcagcatcagcgaggagatcgccgtggccgtcccggcggagcgcatgtggaaggtggccttcgccgagaccaagtcggcgctcttgcccaaggcctgcgccggctacgtggacgccgtcgaggtcgacggcgacggcgggcccggcagcgtcaccaccatgaagcttaacccatcgctgggtgagaacaagacgctcaagagccgcgtggtggcgttggacgccgcggcgcgcgtggtgaggacggaggtgctgcagggcggcacggtgagcgcgcagctcaggacgcacttcgccgagatcagggtggaggccgccggcgagggcgcctgcgtcgccaaggtcaaggtcgactacgagcgcctcgacggcgcgccgctcgcgcccgaggacgaggccaggctcgcgcaggggtacgtccgcctcgtcaggatggtggaggcatacctcgtcgcgcaccccgacgagttcgcctgagccgccacctttcctacgtacgtcagtacgtgtatgatcatgctatatggccgtgagtgttttggtttggaataacgggaggaaaggctcctctgtttggttgcttcaattcgcttcgaatcgagtatagacggtttgtgagtttgtgtacccgtgctgctaccaagtgtgtctacatctatggtctatttatctacatgttcttttgtttgtttgcttcgctgtgcattgtgaggtcgcgtatagacgtattggttgtgttgcaaagaatttgttagatattgagatcgataataatgtatgtattatttattttt

SEQ ID NO: 5398 - DNA, 1121 bp, Zea mays
agtacaattttgccagcatttatgtgggaagacaactactgtgtctatttctggtcagcacctgtactatcctgtacctgtccgaacgaattctgtgaaattttctcgcggtcaaaccacgtgatctagtggaccaagatttccacgtcaccaagctccggtccaaccgagcagccacatgtatatagtaagtaggtcgtcattgggtacctcgaggccggccggggcagtgagcacaaacataacagtcttacagtacgtagcagcagcctagcacgacgatggtgtccggcagcatcagcgaggagatcgccgtggccgtcccggcggagcgcatgtggaaggtggccttcgccgagaccaagtcggcgctcctgcccaaggcctgcgccggctacgtggacgccgtcgaggtcgacggcgacggcgggcccggcagcgttaccaccatgaagcttaacccatcgctgggtgagaacaagacgctcaagagccgcgtggtggcgttggacgccgcggcgcgcgtggtgaggacggaggtgctgcagggcggcacggtgagcgcgcagctcaggacgcacttcgccgagatcagggtggaggccgccggcgagggcgcctgcgtcgccaaggtcaaggtcgactacgagcgcctcgacggcgcgccgctcgcgcccgaggacgaggccaggctcgcgcaggggtacgtccgcctcgtcaggatggtggaggcatacctcgtcgcgcaccccgacgagttcgcctgagccgccacctttcctacgtacgtgtatgatcatgccatatggccgtcagtgtgttttggtttggaataacgggaggaaaggctcctctgtttggttgcttcaattcgcttcgaatcgagtatagaccgacgtttgtgagatggtgtaccggcccgtgctgctaccaagtgtgtctacatctatggtctatctatctatatgttcttatggttggtttgtttgcttccttgcttgtgcattgtgaggtcgcgtatagatctattggttgtgttgcaaaaaatttgttaaatattaaggtcgataataatatactgtattattcgtttttcaaaaaaaaaaaaaaaaaaagcggcc

SEQ ID NO: 5399 - DNA, 1770 bp, Zea mays
cattgggtaccctcgaggccggccgggatgactggtcgcagactcgcagggaaggacccattctctcctctcctccccggtcccctcttcctcattaacaaaatctctccttagtttccccaacctgcttctgtttaccgaattcctaaatccaatccccttgccaagctctctctttgctgcgggaggtcgaggccggagaggtcttctgggatgggatcaagaaaggggtggttccccgtggccctcctgctgttggccgactctgccctctggccgccggtcgccgccgccgccgccggaggcggcgaggccgaacacgccgttcagcagcatagcgagcgcatctcagggagtgctggtgatgtgttagaagataatcctgtgggtaggttgaaggtcttcatttatgacttaccaaggaagtacaacaagaagatggtcaccaaggattcacggtgcctcagtcacatgtttgctgctgaaattttcatgcatcgtttcttgctctcgagtgctgtccggacactaaatcccaaggaagctgattggttctatacaccagtttacactacttgcgatttaactaacgctggactgcccttgccgtttaagtcaccacgggtgatgaggagcgcgatccaatatatttcaaacaaatggcccttctggaataggactgatggagcagatcatttcttcgttgttccgcatgattttgcagcatgcttccactatcaggaagaaaaagctatcgagcgtggaattcttccattgctgcgacgtgctacattggtccaaacctttggacaggagaatcatgtttgcctgaaggagggttccatcattattccaccctatgctcctccgcagaaaatgcaagctcacttgatttccccagacactccacgctcaatcttcgtttacttccggggacttttttatgacacggggaatgaccccgagggcggatactatgcaagaggtgcgcgagcttcgctatgggagaacttcaagagcaaccctctgtttgacatttccacagaccaccctgccacttactatgaagacatgcagcgcgctgtcttctgcctgtgcccattgggctgggcaccgtggagccctaggttggttgaggctgtggtctttggctgcattccagtcatcatagctgatgacatcgtgcttccatttgcggacgcgatcccatgggaggaaatcggcgtctttgtcgaggagaaggatgtcccaaagcttgacacgatcctcacgtcgatgcctatagatgacatcttaaggaagcaaaggttactcgcaaatccatcgatgaagcaggcaatgttgttcccacagccagcgcaaccaagggacgcgttccaccaaatcttgaacggccttgctcggaagctcccgcacccagagggtacgttcttacaacctggcgatcagcgcctcaactggaccgctggtcctgtgggagatctgaagccgtggtagagaagaatagctatcttcttctttgataatccaagctttgccacgagcaccccttaggactaatgcacgcttcatgagatgttatgtaatcaatatgctgtgcgtgctttaggtgcaaaatacaccttggccgtgcttagtccttatgaacgccatgtaacttattgatttcccatggaaatgaaatggtatatttatcttgctgtcaaaaaaaaaaaaaaaaaaaaaaaaaaaaaaaaaagcggccagaaaaaaaaaaaaaaaaaagcggcc

SEQ ID NO: 5400 - DNA, 1483 bp, Zea mays
gggtacccccggcccgcaaccaccgtgcgcgcatcaactcggcacaaccggtgagtcttctgcatcttcgatggagaaccagggacccaaacccatccgatgcaaagcggccgtgtgcagggccgccggcgagccgctggccatcgaggaggtcgtcgttgacacgcccaaggcgcacgaggtcaggatacggatcatctgcacgtcgctctgccacagcgacgtcacgttctggcgcatgaaggatctccctgacaatatccccagaatatttggccacgaagccttcggggtggtggagagcgtgggtgaacaggtggacgagttcgcggcgggcgacgcggtggtgccgacgttcctggggcagtgcagcgagtgcgtggactgcaggtcggcgcggagcaacatgtgctccaagtaccggttcgcggtgcgcccggggatgccgcgcgacggcaccacccggttcaccgacggccaggggcgcccgctgcaccacttcttcggcgtgtccagcttcgccgagtacaccgtggtggacgtgaaccaggtcgtcaagctcaaccccgccgtgccgccggcactcgcctgcctgctcagctgcggcgcctccacgggggttggagccgcatggaagcaggcgaaagttgagcctggatcttcggtcgctatcttcggcctcggcgctgtaggattggcggtggctgaaggagccaggatttgtggggcgtcgaagataatcggcgtggatataaaccctgataaatgcgagcttggaaagaagttcggcgtgacacatttcatcaatcccaaagagctcggtgaggagaaacctgtccaccaggcgatcgccgagatgaccgacggtggcgcggactactgcttcgagtgcattggactggcggcgctgatgaacgacgcgttccggagctcccgagacgggtggggcaagacgatcattcttggggtggaaatgcacggtgcccccctctgcatctctcctcacgagatcctccacgggaagtctgtcatcgggtccatgttcggcggggtgaagcctaagcaggatatccccattctcgccgacaagtacatgaacaaggagctggagcttgacaagttcataacccatgaagttggcctcaaggacatcaaccaagcttttgacctcctgctgcaagggaagagtctcaggtgcaccatatggatggacaagtgatgcaataaccagagttacgcatcggaacctgaagatgctatgatgcttccacctcgtttcagtgaaaataattgtttcatcagctgccaaaagaaatgttatatgtatcttaaattcgagttttccattccttttcttcacgtcatcactcaaacatgttaaaatgtgcccatgttttgatttttactgctttcaaaagttgtgactatccttatcttattagtgatattttcggaatttatctggcgaaaaaacaaaaaaaaa

SEQ ID NO: 5401 - DNA, 1591 bp, Zea mays
  misc_feature (1046)..(1046): n is a, c, g, or t
  misc_feature (1157)..(1158): n is a, c, g, or t
gggacctcgagccggccggaaatcttcttggccgggatcgttcacctcatccttcccttcccttctctccccggctccaccagcagccgctcatcgaaaccttcccccactatccaccagcatcaagcagagatttcttccgccttctccagagctcgcatgcttccgtttcgtcctccgcgttcgcttccctagagcagagcaggtaggtagtcagtggccagcaatgatccgcgagttcctggccgtggcggcacgcgcggcgctggagtgggcgctggcgtcgctgctgctcgccaacggcgccgcgttctgcctcatcgccgccgccgccgcgcgcctccgcctcggcccgccgtgcatcgtctgcgcccgcgtccaccgtctgctctgctcctcctcctcctctgctgctgccagcgccaccggcgtggcacgcgacgctctccgcctcctcctctgcgacgcccacctcgccgccgtcgctccggatcgctgcgacggggatggtggtgtctcggagacggatgctgcgatggcggacgatgatccgaacacgttttcaggcatggagactcaccgcgacgtctccatcggcagcgagatatgcgagcaggaggaagacggcatcaaacaccacgccggcgaccgcatcgcaagaaccaccagcgccggcgacggttacggcccgctcgtatctctcttcgagctggcgccgatcgtgtcgtcgcgaccacgggaggacgacgattccatagaccagctggcgaggacgatgccacagtcgctgaccctgaccgtggacggtgacgagagcctgacactcggggagctggtcacggcgttcagggcacagaggagggagctggacgcgctgcgcgccgagctcgccgccgagcggcggatgaaggcggaggtcgaggagtaccagcgtcagctggaggagcagggcgagctcgaccgggaggcggcgcggctggccatgcagctcgtgtacgagagcgaggcggagaagcacggcctgcagcggcggcagctcgacgcgnggcggggccagggcgcagctgcagctctgccagtccgatcccgcggccgtggaggacgccggcggaggctgcagtggcgatggcaacaactaccagtcgctcgtggacttnntgccggggtcggtgcactcctcctcgccggacctggccaacctccttaaactctacactgaatctggccatgccggccgtcgtccgggtccggggcacggttacgacgtgccggccattgcggtgggtgaggagggggaagaggccgtcgctgtcgctgtcaccgtcactgtcacagctgccactgaagaatccatcgggcgtgttgatgctacatccgccgccactgtttctgaatctttacaagaaagctccaatactttccacgccgaaacgacagcaacggaagccgcttaatttgccggtcatcacctcgggtctctcgcccatggtggaaacatgcacgaaaacactgtagtagtagtagaatgctttctcttgtacatcgtcacatcgatttgtttttgttaatattgccaaaaaaaaaaaaaaaa

SEQ ID NO: 5402 - DNA, 2458 bp, Zea mays
ctttaatcttcctccgcatgtaatcttcatgatacttaaattctctccatattaagatttttcacacagccagattctttgaaaaaaaactggagaaaaagatgaacatgatcatacttgctaggtgcaaggaattgataaagaatactactaggttggtcaaccacagccacaggacatggttccaaaatcgaagaaggcaagggtccagatcggaacatttctcccccttctgccacctcagccataaataaatccgtctctttcccggttcctcctttctggctcgctagtcgctagcctcgctccgcttcgcttcgacttggacttcgtcgcgccttccccgccatctccggcgaccggcgccacagccaatggagcccatggacagccagctcacggctctcgcgctctccgactccgacagcgcctccgtcgagggcgccgcagctgacgcggcggacgccgacctgcaggcgctccgccgcctctccgacaacctcgcggcggcgttccgctccccagacgacttcgccttcctcgccgacgcgcgcatcgcggttcccggcgcgcccgacctccgcgtgcaccgctgcgtgctctgcgcgcgcagccccttcctgcgcgacgcctttgcgcgccgcgccgccagcgccggcgaggaggagaaggacaaggacagttacatgtgcaaggtggagctccgggatctcctcggagacgaggtcgaggtcgggtacgacgcgctgcggctggtgctcgactacctctacagcggccgcgtcgccgccctgcccaaggcggcctgcctctgcgtcgacgaggacgcctgcgcgcacgtcggctgccgccccgccgtcgccttcatggcgcaggtcctcttcgccgcgtccaccttcgacgtcgccgagctcaccaatctcttccaggtccgcctccatctcccccttaactctctctctctctctctcgccatcgattcatggcgccttttggccttcgcgattatgcgcgttgattgcggatttgttcttgccattaatcggcggcttgcaacggcgctttctatgtccgttgcgcagcgcacgcagatgctgctcgaaggcggcaaccaaagatcacacccctttcgcatactgtttttgcgcatgccactcggatgaaacattttttgctttttttccactgcatatgcaaaatactgttaaccatccaaatttgcctgttatagtgacagtaaactcgtgctaatagtgtaatcattggtaaacagttctgaccttctagatgtagaccaggacaagttgagtcgtgtgcaatatcgacagcttcttgcacgtgcgcacgaactgcgctatgcaccagaagtcattagccagctcaaaccacgcactgagtcactgatccattagtccaagttcaggttgatctgaaactatctggataaatgtattctactggctaaaatgctgccccaggttcacgaattcaccacctaacccaagatgtgttgttgggtaactttcaataacagtgatgaagatatgataaagctgtttaatatttcttgctttcaggaaaaaacaacaacttctttttgtagaatactgagtagaaacgccccaaactctgcactatctattttgggctgcttggatacgatagtttacatctataattttatatacagaaagtgtaaacatacaaacaaaaaaaaaagtcagcatagtttttccacatttattcttaccgtgcgtatctagtataagatacgttgatgcatccatctatggagcgagattcttgacaagatatcatctgggtccttatttgtagtagttcacacaaacccaaaaaactatctctagaaaggaaaataaaacggtctaagaagcaagcaaattgctgatcatgagctatcctgttggttatggtgaaacaccttgcacacaaaatttgctactacctccgtttctctttatttgtcgcctagtagttcaaatttgtgctaacggacgacatatattaaggaatggagggagtatttacttagagcttcactccactatcaagattcaagaaagtgacacaagtactaaaaaccttagccattagtgtttattgaaaacaagcaattagttccacttttttggtgtcttcagttgagctctcaaagtgggaccgtagagccaggttgtgctatctgaccattctggcaaagcacaatactcatgtacttggttccctatttctgatagcgattttaagcaaatatctgtaagggacctagagcaaatttctggtatatttactgtgtatttagttctttttcaagaattcctgataggatcagttgacatttagtgcttcttgctttcgtccccgctgttgctttatacaagtgacactgatttgcaggcatggccatttactgttcttgcttagtacttcctccgtt

SEQ ID NO: 5403 - DNA, 1562 bp, Zea mays
gcacgagaccattacctagaacatcctaatcgaaaaatcaccaccctcagtcgaagcccccctgcggccctgccacactggagatctcgccacactgcggccccgcctcctcgccgtctctacaacaatgacgacaccggcggcggaggccgtgtcgcgccgcctgggagcggccgtgcgtggcctctccggcgcgtggtacgggcgccacatggcctcggccgagcgcgccatccgcgcgcgcctccccctcgtcgacctcgtcctcgaggtccgcgacgcccgcgcgcccgcctcctcatcgttcgagcctctcctccgccgccgcgggcctctggagccagaccgccgcgcggtcgtcctccttaacaaggcggacctggcggacccgtccgaaaccgaggggtgggtggcgtacatcaagaagcagaggagatgctcttgcgtcgcggtaaactcgcacagcagggaaagcatcaaggaggtgctgaaagtcgtgcaagcaagaatgagggagatcaagcatggcgacagcaattgcacgggaactgccctcctggtcgggatcccaaacgttgggaaatcggccatcgttaatgcgatacatcaaattgggaggattgcggcagcagagaaggggaagctcaagcatgcgattgtgagcagccatcctggagaaaccagggacatacgtggatacaagattgctagtcatccgaatatatacgtgttggacactcctggtgtgctttcgccgagatttgcagatgatggttctggccccaggctagccttgacaggagccatcaaggattccttgttagaggattacgatactgcacagctccttcttgcgatagtgaactcagggaaggaatataggaagtgggagaagctgaataaagcaggagattccttttcttgtggcaaacacaatcacgcccaggggccacaacagtaaagagcaatatgcttcagatcacactcaggattccgtcgtgaaagcagtccgccaggtgctttttgagaccatatctagttttaacggggatctagggcaggtggatgagctaaggagattgatcggccaccaacttgtaaacttgcagcaggttttcaaagtcttgactgaaccaagtgagaatatctgtaaacctatagctactaaactggtcaatctatatcggacaggaaggcttggccgatataccttagaacatgtcccagatgttaggcaggaagttgtcgcagaattacctaccgcctaaagcatgccctgttttttttaccttaaaacaaggattatgcattggtttggccaggatacagtacagcccctcctagctgtaggttgcccatggagcatgaagcgcctccggtgttccattagaggccaaaaactgaatcaaccacagtgtactatgtaagtcttgcggattgactactcgggtgcattagtttggcagataatcttaaagaaggctatcatgtgggtgcaagaaacattcacattcatatacatcagctgcggattaccgcgtaccgcaaaaaaaaaaaaaaaa

SEQ ID NO: 5404 - DNA, 969 bp, Zea mays
gcggccgcgtctggtgcatcgagggcaacgccgtcatggagtggatgggcacccgccgcgggtggcgcgaggtggggccctacccgccggggctcaaggccggcacggcgcgcgccgtctgcgtcggcggcggcgagaaggtggtcgtcaccggcgcgctcgacggtgtgggcggcggcggccggcacgccctctgggtgttcgatgtgaggagcaagagctggaccgtggtgcccccgccgccggagttcgccggcttcgtcttctccgttgcgtccgtccggatctgagaaaccctagatctgcttcgtcctgtccatccctccgcgatcgatcaagagacgtaaagactacttactgctagtgctagtacggtagtacctatgtatgtccgtgcgccattgctggatctgatgaacactactagttcgagatctgcgctcccgtgtaccatggatctgggcttctgcttggtacccgtacgccctgccatcgattcgtccaaggaagggtaaggtgaggtggtgacccgacgccagccagatgagatccattgaagccgacagccgagggttgggtgtaaaatatggactcgatgagtgtggtgtttctgtcccgaggtgaaggacacagactgttgttcgttgctcttgtcctacagccatgcttttggtattgcgatccgagtgcgtgtgatctggatggagcttggagatgacggaattgcgacggatcctcatgtgccagcggctccgcctgcgctgaaccgctgtcatgcctaccatcgttgaacaaaggcagtttgtgttctgccgagcgtccatctcgagaacataatgtaatctccacttggctatcaatcatttctctgtatattattgcaatccaagctggcgatttgtccgctaattgtccggaagttgacattgccccaaaaaaaaaaaagtactctgcgttgttaccactgct

SEQ ID NO: 5405 - DNA, 1513 bp, Zea mays
cgaccggttcctggccgtcagcgggtaccgcacggcgcggcagggcgggttcgagcgcgacgccgagtggttcgacccggcggcgcgggcctggcgcaggctggagcgcgtgcgcgcgccgccctccgccgcgcacgtcgtcgtccgcggccgcgtctggtgcatcgagggcaacgccgtcatggagtggatgggcacccgccgcgggtggcgcgaggtggggccctacccgccggggctcaaggccggcacggcgcgcgccgtctgcgtcggcggcggcgagaaggtggtcgtcaccggcgcgctcgacggtgtgggcggctgcggcggccggcacgccctctgggtgttcgatgtgacgagcaagagctggaccgtggtgcccccgccgccggagttcgccggcttcgtgttctccgttgcgtccgtccggatctgagaaaacctagatcttcttcgtcctgtccgtccctccgcgatcgatcaagagacgtaaaggctactgctagtgctagtgctagtacggtagtacctgctgtatgtccgtgcgccattgctggatctgatgaacactgctagttcgagatctgcgctcccgtgtaccatggatctgggcatctgcttggtacccgtacgccctgccatcgattcgtccaaggaagtgtaaggtaaggtggtgacccgacgccagccagatgagatgagatccattgaagccgacagccgagggttgggtgtaaaatatgggtgtggtgtttttgtcccgaggtgaaggacacagactgttgttcgttgctcttgtcctacagccatgcttttggtactgcgatccgagtgcgtgtgatctggatggagcttggagatgacggaattgcgacggatcctcatgtgccagcggctccgcctgcgctgaaccgctgtcatgcctaccatcgttgaacaaaggcagtttgtgttctgccgagcgtccatctcgagaacataatgtaatctccacttggctatcaatcatttctctgtatattattgcaatccaagctggcgatttgtccgctaattgaacggaagttgacattgccacaaaaaaaaaaaaaaaaaaggagggggcggcggctcgcgttccgtctactccacgaggcaagagccatccgtccatctctagtattcacgagagagctaacaaattttggagagaattcaaaaatccaactagcatccaagatctatgaaatttcgccaacctaggtacatatatgtcaaatttgtcgtgtacacacaaactatcatgtaagttgttggcgctcattctgctatttcgcgtgatcaccttctttgtattttaattgtggggctatgacagaggcaagtaaagtggtcagcgtcaatcgtcagctgcctagctagacgataggatgaatcataaagtagtgatgttaagatataagttcctgtaagcgaattagtttgacgatttatgtatcgattagtcattcaacgaatttttatcttatat

SEQ ID NO: 5406 - DNA, 732 bp, Zea mays
gtgcggcgctcaggcggcgcgcgggacaccattcctcagttcccatacacaaactccctcatcttcaaacccctaccatcaacacaatggcctcccttcactacctccctcccgtcaagccttcggccattgccctcggcactgccttcaaccacgccgtctctcttgcagtcctcggccccatcttcggtgatgcctaccgtcgcgcccagcaagcaaactccaaggaggagtacttccactccaaggaggccgccaccgccgccgcttcatggggaagctccatcctcggctccggtatccaggcctacggtgttggtgctctcatcaacgctaccggcaccctcacctacaagggagctgcctaccttggttctttgatcttctttgcttctgctgccccatcgattgtctcccaagtcgtcactgagaagcgacccatggacacgattgccattggtgccgttgcccgcgtcctcgagactgtcggcctcagcatgttcctcacctactggggtacccgcaccaaccccttcgactaagcgcctcataatgttccccgtaaaaagggcacaaggtgtttagggattctgctccgtctgcagcttgattggacagacaggacacagatgacatgagttttcttagcggaaagaagcggaaaattagccttttctctatgatgtaatatataccatcaatgaacaatgtaatttcacttcacttttggcc

SEQ ID NO: 5407 - DNA, 4290 bp, Zea mays
tcggggattttgtaaaaactgtgatcggtttctatttcttaaatagggggtttctctttgtcaaaaaaaaaacctttccataattttctagtgaaacaaaagcaaagcaggcggtactgcctgccactgtgctcaccggtcaccgctcagcaattcctttgagtagcattgacgcctactcaagttgtttaagacaacttcatcagtttcaaatcttaaaatactttattttataaaaaaactaggcaacaatttatatctattcatttacgtatatttaccaaaacagtgaagctaaaactaactagattcgttatttcgtcctttacttcttcagttcttcctcgtagtgctgtcggccacgcctgctcctcctcctccgccctccctgcccaccgccgaggctgcgcctgcgctccagaccgcccgcactggcccgttccggtcttgtaccggcgtctgtatatcggaagaggaaaaaagaataagacagcgataattggaacttatccaagagcaaaacagatacttttaaatgaattatcttatctttatgtagacttgaatctgtcaaacggtttcacggtagatgtccgaggccttagcttcccgcatacgtgcttggctgccctcgctgctgcccgtcgacaatgcctgtatgattgtattgtatctcacgctcgcaggctccgcggccggccgccagagtccaaaccaaacagcactccactctggtctcccaccattgatcccactccgtcccgggcccttgaaatggtttgatgcctgcaaccatgcccggtctctccagacgccgcctgctctgcttattcttgatcgcatgcctcgccgcccttcttttgtcgatcgccggcagcgccgggaagcccaaggaaactgacaatggcgacgccaagttcagagtgctgcgaggtatcgacactctcggccggatgcagaagcagcgtcacggccatggaatctctccggcctcagcgccggcgccggcggcggcgcgtgcccgcctacctctgctccacaaggatgcgcggctcccggtccccggaaaagtcacccacaaccataaaagaggaggaagtgcaacggcaccgaggcagagcccgccgcgcggcgggggaggcaaaggcgaaggcgaaggcgaaggcgggagcaggaagaaaagtatgccgctggccgtcgtcgccgcggcggcggcgctgtccggggcggcgctggtgctcctcgccgtcctggtggtgttcctggcgtgcaagaagttgcagggcaggcgcgggggtggcggcgaccagagcggcggcaccaacaaggtgagcttcgagcccggcccgggcatgttctacctggacgccatcaagccgtaccttgacgacgccggccgcgacagtgaggggaaggcggcgccggagatcgccgcgcccaaggacgaggagcccaagcgcgatgacgaggaaggcgatggcgcttgctcagacgacgacggcgcccagtcggtccactcctcgtgctgcttccagtcctcgcatttctcctactccgagctcgcgaagggcggccaggccgacggcgtgtcgccgtcgccctccgtccgctccaagcggcggggctctgccccgacaacgccttcagacaaggcaaaggtcgcaagcccatattcgccactgggcccgcgcacgccgagcagtgaggaaaggggccgccgcacgcactccccgtcgagcacgtcggtgtccgtgttgacagagcagtcgttcaatgatcatgagatccagggaaccgctcattccgtcaggtctttgaaattccacggcggcggcgtgtgccacgcaaaagaagctggagcagagacagacgccgcaagtagaaaaacagtaccacctccgccgccgccgcctccgccaccaatgatggtaaaacagcagcagatcgttcagatgagctgtggtactctggccgtgcccgcgccgccgccaccgcccccaccgctgctaataccacaacgacagaatggtcagaggagcaacggccccaccctcccgccgccgcaggcaccaccgccgggactgttcaggcagactgcgcctgtgggcaagaacggcgcgccgctgcccaagctgaagcccctgcactgggacaaggtgcgcgctgcgcccaaccggcggatggtgtgggataggatccgctccagctcgttcgagtaagtctggatcgcccttcgcttgccgcgcgctctgcccgactgtcccagtggtcacgaacggattccaaacgtaattcgcaggctggacgaacagacgatcgagtcgctgttcggctacaacgccgccgctcggtgctcggtgaagctcgaggaaggccagggccggagcccctcgctcggacaccatgtcctggaccccaagaggctgcagaacatcaccatcctgatgaaggccgtgaacgccaccgccgaccaaatctacgccgcgctgctgcaaggtaccaataaactttgtggttgaatcaacaacgcccctgtacgcgcgaaacaatacttcgctgatctttgcgttgtcttggttttgtcgggtcggctcagggaacggcctgtcggtacagcagctggaggcactgatcaagatggcgccgaccaaggaagaggtcgagaagctcgagagctacgacggcgacatcggcagccttgtcgcggcggaaaggctcgtcaaggtggcgctcacgataccgtgcgcgttcgcgcgcgtcgaggccatgctgtacagggagaccttcgccgatgaagtcatccacatcaggaagtcgttcgcggtgctcgaggtggggcattcctgagctcccggcgatgaccggtgtaccaattctactcgtaaccgtagtcgtaccaattcctgaacgcccacgtggatatcgttcctgtcgtctgaaaggacgcgtgcagggagctgatgtcaagcaagctgttcctgaagctgctggaggccgtgctgaagaccgggaaccggatgaacgtcgggacggcgcggggcggcgccatggccttcaagctggacactctgctcaagctcgccgacgtcaagggcaccgacgggaagaccacgctgctgcacttcgtggtccaggagatggttcgctcccagaagccacccgcgcgcgctgcggaggggccggacatcgtgacggggctcgccgccgagctcaccaacgtcaggaagacggcgaccgtcgacctggacgtgctcaccacctcggtgtcgagcctctcgagcggcctgtcccggatcaaggcgctagtggggacggaccagctgctggcaggcgacgagaggggccagcgcttcgtcgccttcatggccccgttcgtcagccaggccgaggaggtgatcagggagctggaggatgacgagcgccgggtcctggcgcacgtcagggacatcaccgagtactaccacggcgacgtcggcaaggaggaagccagcccgcttcggatcttcgtcatcgtcagggacttcttggcgatgctggatagggtgtccaaggaggtgaggggagccaggggttgccacggatcaaaccaaacgctgccctgaacagcttgtgaccgatactgcagaaacggtgagagaacaacactgtaattcttggacttgggaagttagacatgtattcgttgtagttcataaacatctctcacgtcttcgttttcacctttcattcgtcaatagcgtaccttaacgaccacccacatcagctgaccagtttctcagaatctgatccttgaaagctcacactaaacaaaagtctgaaactgtgttagagaatctagccttttcagcgtgcagatttgtggtggatgaattcaagcttgggacaaaacgatccccacacgatctgcgacacaaatgtgtgtgtgtctcctcgttttatccgcgtttgtctccatgcgcttacctttccccctgcggaatttgaattcgtatgcgtcacgtgcaaagtttcagagcgccacgttcggatcatcgatgtttatttttttctgccgctctgtctcccacgtgctcgctccaccggatgtccggatcgagccgcaattagaaaggcaatcggtaaatactcactggtattagagtctgtttgattcgtgattaactgtaccacattttgtttaaagttagttacttgaattgaagaactaacctaataaacttagacagaaaagttatacaaaatatgacaaattaggcaacaaaccaatgcccttagtttcctatatccata

SEQ ID NO: 5408 - DNA, 814 bp, Zea mays
aaaagcagcagaaaaaaaaagatatgcatttgagacaattatctgccccaggtccagagcgcaacaaagccaaagccgaatctgagaaccagccgaatccgagctgcggagcctcctcccgatccggctgtatccaactccgaggcttcgaggcatggccacgccacttgctcgtgcgccgctcccgggggccctacttcgccccgctcccgccgtccttcggttggccacgcgctgccgtttccgggccacggcggccagcggtgaaggcgcggctgggccgatgctgcgcacttgcaagaactgcaagcagcagtacgacccgtccgtgaaccacccctacgcttgccgtcaccacaccgcccacttcggaggagaaacaaagagaaaatttgagagcgtttatgctggagggaccatggatactccaaattcaggcaaagtgtttcagtattggcattgctgtgggtcggaagacccatttgatgtgggttgtactgcttctcctcactgttcttatgatgattgaatatctcatgcttgcattatgttcttgtgattgtacttattaattaatattttacatgaaatttctttccaatttgttattatttcttacagggagagtggacatatacattaaacacttctaaattatagtctcatgtttagatttagcctcctaaagtcctaatcacttaacccttaaatgttccctctggatacatttgatcaatttattctttgatgtattttgtaaaaatgacagtttagtccatattcgtacaatgattgaacaaaaaaaaaaaaaaaa

SEQ ID NO: 5409 - DNA, 827 bp, Zea mays
atcaacacaataatgtaacaagcatcagcccagcccagccagcttccattcccaaggaaaccctccgctcctcccacgtctcccatggccgccgccggctcagccgcagcgccgctccgccggctgctcctccgcctccgtgacccgccgccgctgccctttaacacgctcctatcccgcctcgcgccacatctgcagcaaggccccaccctagccccagcaccagccccggctcttgcactcccgacctcgacgccggcccaaacgccatccgggattctccgcgacgcgctcttctccttccacccgggcctccaggcacacccgggcctagatccgattgggggtgcccccgcaagggacgaggccggcgcaggggcggcggaggtgtgggcggacagcgtgaagaagaagcgcaagcgtaagatgaacaagcacaagctccgcaagctccggaagcgacttcgccgccagacatgagggctctctcctctccggttagacaccttgtcattgagttgcgtccagtgatttcatctctcctgcgggtgatccggacagcaagacagaaaggagatacgggtgaatgacaagagggctgtgtaatgaataactggctttgatcacattttctgtagcccgctcactgtgttagaagattttggctggattcgacaaggatcatgttccacaacgagacaaacgtttgttaagccccttgttagttactgtatgcaaatggacatagtgcggtgctcaatatatctgtcgtcaatcttttcgacaaaaaaaaatataaaaaaggcccctagggccgcgggcggtct

SEQ ID NO: 5410 - DNA, 1504 bp, Zea mays
cacctgaaatttcatagttgtaagaaaaaacagaaattaaaatatcgaaccgcagcaagttgggccagagaccaaacgcaccacaagccccgattcgactggacccgacgaatcaagccggccatcaacacaataatgtaacaagcatcagcccagcccagccagcttccattcccaaggaaaccctccgctcctcccacgtctcccatggccgccgccggctcagccgcagcgccgctccgccggctgttcctccgcctccgtgacccgccgccgctgccctttaacacgctcctatcccgcctcgcgccacatctgcagcaaggccccaccctagccccagcaccagccccggctcttgcactcccgacctcgacgccggcccaaacgccatccgggattctccgcgacgcgctcttctccttccacccgggcctccaggcacacccgtgcctagatccgattgggggtgcaagggacgaggccggcccaggggcggcggaggtgtgggcggacagcgtgaagaagaagcgcaagcgtaagatgaacaagcacaagctccgcaagctccggaagcgacttcgccgccagacatgagggctctctcctctccggttagacaccttgtcattgagttgcgtccagtgatttcatctctccttcggttgatccgtagagcaagacagaaaggagatacgggtgaatgacaagagggctgtgtaatgaataactggttttgatcacattttctgtagcccgctcactgtgttagaagattttggttggtttcgacaaggatcatgttccacaacgagacaaacgtttgttaagccccttgttagttactgtatgcaaatggaaatgttgcgttgctcaatatatcggtctccaatcttttcgtcaaaaaaaaaaaaaaaaatgtactgttgtgcttaagtgacttctgtttctgtaggatgcacctagatgccaagctcccctttcttcaatagggtgtggttctgctacgtttaggtgcattagtgagtcgcaatagacctaattctcgaaaaatcggtgcttctcttcactctgtttaagttgtgtcttgtgcctttttggttatatctagtgctgcatttttttgaaccacgcaggagaattgtgcgttatttcattaagaagaaaaaagaggtccactgaaaaaattatacaccctcagggcctcagggggaggggtgtaattacaaccaatattgcccctagaaacgacctaagaggcgcagccttatggactagatcctggaggatagaagccctagccaggcaccaaagttgtccttcagccaatatagacaacacaatactttgtacagcaggccttataccctggaaaacgcaagcattcctatgttttcaaatttcccatgctagtaacaccattaaaagagttaaacctcttctcttccttagacaaggttgcagaaactcagcaccaccaagagttaagggggtgtttggtttg

SEQ ID NO: 5411 - DNA, 822 bp, Zea mays
gccggcccggggccggcagctatagaagaagagaaacagaagaggcacagcttatacccatccactgaccgcgaagtgcacagaggggggaaggaaggagagaccacgtaccgtctgcgaggaggacgacgaagaaggagaagaggctgattcgatcgagcagcatggcgcggcggccacggccgtgggcccacctgacggccacgctccttctgctcgccgtcgccgcggcggtcgccagagccgccgacggcgacgagaagtgcggcagcccgtgcgggaacccctgcggcgagccgtgcgtgtacgcgagcccgccgccgccgccggtctactacccgccgccgccgccgcccgtgtactcgccaccaccggcgccggagtactacccgccggcgaccccgaccccgaccacgccctactgcccgccgccgccgtcgggcggcggctacgagccgtcgcccggatacacgcccgggtacaacccgacgccgccgtccggctccggctggtacacgccctcgtacaactcgccgccgggcacgctctacccgcaggaccccgggttccggcccaacgccgcgccggcccgcgtcgccgcgccgtggcgcgcggcgctcttcctcgccgccacggcgtcggcggcgctggcccgcgcctgcctggccttgtgacgcggtcggaggccgccggggatgaggggatcacgacctccgccgatcggtgtcgcgtctacatggcgccgcgcacgcgccgtgggtgggagtggccgagtgggagggagatcgtcaagggcgtgcatggcgcgcgggtttagttccg

SEQ ID NO: 5412 - DNA, 7491 bp, Zea mays
aattatgggaagtgattttatgtatcacagaatgtgtttctattctgtaatatatgagacgttctttggctcacttctatacagtaaaatgtagcacataaatatatttcacatattactaataatgatatataaatatatttcatataaaaccatattagtttaattaatctattagaatggaattcaatatccaaacggaaaatcgcttgtgtgcatgcaaactgcaaagataagggccaccctccgccacccacacatcatacatgccccatgatctatcctgcattggaaggatagggtaagggcgtggaggatcgccagatatgcttggctgcttgctgctacttgctagtggaacacacgaggaagaggttgttgcccacttggccttcccagcccgaccctgatgttgtattcatttcattccccatgagtacaaagtactctccatactagtttagaaactcaaatctccttcggggttggaggaaattaaagtaaaaataaactaatttcctctcccatcctctctcctcctcctctcgccctccgtgtattcatttcattctgttcgagaggccattagatgccctaacctgaggccatgtacccctgcagaccacaccggtctgcactgattgcacgccatccacgagtgctgctgctggtgggtctggccagtccgcatccaaggaccaaggcctgctttcccttgtaccctctcgcgaatgctccaaaagctcctgcaaattttctccagtacgtggtgcttgctcatcacaaccaaccagttctctctcacggtaggttcctgcagggctgatctgccgcttttcgctagctttgttttagtatcatggacgcatgattagaatttatagaaattaaagaaaaaaggggactccacttcgagttcgagacgaccggagctgcagacgagtagtcaagcaaaagccactgccgctctacctgcaattgccatgccaccgaccgactttactacacgacccagctgcttcatcagagcagctgaacaatgctgacctgtcagtcccgtggttctgaagcgatctactagccatccaggaaaggaggtctctcagatggagactacatgagctctgtacctccatcaaatggagattacaggggatatctgctttagaggccattaagctcgctaacgtgagttctgaccctgttgttcagcactcgagtccatgaatatgatgccaatcgtgaccgtcgctgtcagttaacattgtccaaggacccaggcattcttcattccctttttcgccggcaggcaggtttgtgccgttgcaacgagacggggcaccgacactccatctcatctcagatcatcattcatctaaagcttcctgattgtgagcatattcgttctcacacaggtttcatcaacagccgtcactcggtctcagcctctcagggatgggaggtgggatcggatcggaggccgggggagcggcaccggcgccaccgacggccctcggatcggcatcggacggacacaaacgtgtccccgtcggctttcgcgtgtccagactatttagccattgatacgccggatccaaggacgtcatcttcatctccacgctacgcctgtggctggcactggcacacacagtacagcctcatcgccacttaccaccgtctaacgaaaaagcatcgacgagcgaagcgaaaaagatgccgccagctctgcggcgaacgatcctgctggccgcggcggcggcgacgacggcggtgctgctgctgtggccggccgcctgcgtcgcggacgacgacggcacgacgttcccgccgtcggcgttccccttctgcccgacgcggccggccggggtctccacggggccgttcccctggtcgccgccgccgccgtcgtcggtggcggtgttcccgcaggatccggggttcttgacgtcggacgcttgcgcggtgccacggctgccgctgctcgctgtgttctctgttctcttggtgtttttgcagtgactcgctcgcggttgctgccctggactggatgcatatctatccgtagctgcccagttcagaaaattaaggtttgctccaacgacaggcctttgtttcatacagctctgtggaaaagaaaagaaaaaaaatctactagctttcccctgcagcagctctgtttttgagaacgtagctctgctttgtttcttcacaggcgaaggaatatcttcgtgtataacccgtagctagcttcattcacgtaattcaggctttagcttggataatagtaaaactagtgtcactggcgttgaaggttctgaaatcccagtagctttccttcagacttaacaccatgctctgaaattccattgacaccatcaatgttggttgtgtggtaatcactgagcaatggacatgcaaaacagatctgattgttatgtggtaaccaaggacgtcatcttcgtctcctcagaagtttatttatctccctagttatgccgttggggcgtggagtacagtctcaaactggaatgaggatgaacaggactaacataaatacaggcacttcttgtcatttatctacggtttttatgtttttagccagcagatgtcatcccatgtccccgcttggtaagggcttcttcgtttcaccgtgtggattgagtggtattgagtcagtttaaatccacagcaagtcaaaaaatctatctcaatccattctaatacacttcaatttacatggaattggaataaaccaacaagacctaaattggaaacggttccaaggtccaatctagggcttgttcatttactctagagcagtttctttagaactgttccatataaaaatgacatgtttactgtattaacattgattatctagaataatttctagcctttattgtattaacattgattatctagaattatttacagcctcaattcaaaataaacgaagggcctaaataagcgaatggaccctaaagaagattttgacttgttagagatttaatacacctcaatttctctcactatcggacacaactgctttgtcaagtggctaactggaaaatacttggcgaagtttttgcagagtgtgactctcgacaaagaagtctcggtaaaccgtacatcctattccgctttgttgacgacatcctattccgcttggttgacgatggagaaaccgaacaaggcctcaaaattgaggtatagtcattagtctttcttctctccatccgacggtttaacgcttacttttgcagctaagagaaggtcttaactggtagatcgaattcctaaaccacatgatcttatactgcagaactttttttttacttttgcaatcaagaataaaactggagtctgaattatcagaagagcagcagctcgccggatcccatcaccatcgtcacaaggtaaaacaaagatcgaaaggacaaaaggaacgaaagatgcagcagccagcagggcggccgtgcatgaaaaagattgaatgaattactaccaagagcgtctagtttaggactttaggttaatcacatatatacacgaggaaggcggccgtgcatccatctatagcgattctaaatgcggccgttcgcgatggaattcgtgacccgtagcgggggaggggaggggagggtggtccatcggaaatggtggattaaaacaaatcctggaaagggcgaagaaatcccgatcgctttcagaaagaaatggactagggatggccggatggagggagacgcagcgcgcgcgacgggggaaagggtagcgaggacggcacagcgcaacggcaatggagacgtttacatcacgccacacctttccgcgcacaagagcagcagctattagcgctagctacctgcctcgtcatcattgcttgcttgcggccgcagattaggtagtacgctagacaacccgcgcggccggccgggggccgcggcttattgctgtcacgaagagaaccaagctatagaagaagagaaacagaagaggcacagcttatacccatccactgaccgcgaagtgcacagaggggggaaggaaggagagaccacgtaccgtctgcgaggaggacgacgaagaaggagaagaggctgattcgatcgagcagcatggcgcggcggccacggccgtgtgcccacctgacggccacgctccttctgctcgccgtcgccgcggcggtcgccagagccgccgacggcgacgagaagtgcggcagcccgtgcgggaacccctgcggcgagccgtgcgtgtacgcgagcccgccgccgccgccggtctactacccgccgccgccgccgcccgtgtactcgccaccaccggcgccggagtactacccgccggcgaccccgaccccgaccacgccctactgcccgccgccgccgtcgggcggcggctacgagccgtcgcccggatacacgccctacacgcccgggtacaacccgacgccgccgtccggctccggctggtacacgccctcgtacaactcgccgcctggcacgctctacccgcaggaccccgggttccggcccaacgccgcgccggcccgcgtcgccgcgccgtggcgcgcggcgctcttcctcgccgccgcggcgtcggcggcgctggcccgcgcctgcctggacttgtgacgcggtcggaggccaccggggatcacgacctgcgccgatcggtgtcgcgtctacatggcgccgcgcacgcgccgtgctgggagatcgtcaagggcgtgcatggcgcgcgggtttagttccgcctccgtgttatgttaataataagattatcagaggaagggttacgttgggtgagatatctctctttctttctttctttttttttttttttgcacctcagttcatccgtgtgtcgttcgttgtgttagtgaattcgtcgtatacttatgtcgttggaacatctgttctcgtggtaggaacacaagttcatccacctatcatcagactctgtgaaacattcaaacatatatatgttcgtcttatctgatcaaactcaaaataacatgtactgtgttttattctccaatccccttttgattttcaatccccctaacgccgcaatacactgagtaaccgtgttcaaacttgttttttctcgaaaaagaaaaactttgtgtaacctttttgctcgaaaaagaaccttgcaccacctctctttttcattttcccatcggattctatcctctctctctgtcttttgagtggaaaactgaggcttgataaactttacgtcctggagagagctcttataaaaggtagcagaagttagttattgcgaggataggcgggttaaaaaaaagatcgataggtgaatgtgcttcaagagacgagtaatgctgaccgttggattgtaaaagcggtgcatcattagttttattttctttgtttaattctgtaactgacggctacagttacaggcacaaaacgctgccttgatgccgatgttgctgtctattttgggtttagtcggttttcccgttactatctactaccttcgttcttcaatatttgtcgtgttttaaactaaaacgtgataaataaaaaatagagagcatattatattggtcaaaaaaaaaagtaattattctgtgagaacctcataacacacatatatgtagcttgttattgttacatctttttcgtaagaatgtattttcctccctgtataacataacagctagtgtgtatcaatatgtagtccaaccgtacctataacattctctggtgattggcatttgatttacattacagacattaaagtagtcttctactaagtgagcacagattttctgctggtgctctgctagtgcctagtggacgtgtaaactgttcctaggtctccaaatgaccatggacgcgtgtcgctctcccactctctgtatgagtggccggccggagcccggagccgatcagatcagaacgcagccttggcaaatagcctagcgacgggcatgcatccgcggcgctgcgttttacatggacgtgtcgatgtcgtgtcgtgtcgtgtcgatccagcagagacgcaggacgtgcgacgacgacgacgccgtcgcggtcgaccgacgacccatcatcggtggtggtggttgcgacgttgctgtcagcgccgtgcgtttatgttaccacctaagtacctaaccagcctaatcctaactagccgctgtcagtgccctacgtgcgtgcccggtgcccccaacatctgttgagtcaaggctctgtctgcttttgtcatctctccttcctaacgtttcgccctgcaacacagcttcttatatcttgtgggggatcaatctcgttctttatatatattcggctaatgaaaaattcaaagtacataataacaatgtttagatatttaaataagaaaaaactgttagagagtattgtttgactaaaatctatgttaaatctgtgttgacgatatagagattgagggtgctcctagtcaggttgtgtccaaaagaccgtgtatataaccgtggaaaacactgttttatactgtactgtttacaatcactgtttacaacactgcatgcatgcgtgtctctagcaatccatcaatcattaattcattatgctattattaatgtgtgttttgttttcctgactaaagtttagtatgtgtcaaatcagatgttcgaataacaattacaagtattatatatagtttaattacctaaataaagactaaatggcaagaccaatttattaaacttaattaatctattattagcaaatatttaatgtagcatcatatatgtgaattttggattaattagacttcataaatttgccttgtcggttagccttcatctacgtaataagttttataaatagactatatttaatatttgatatttaaatatccaatgtaacaaggattaaaactttagaaaactggctggcagtgataatatcatacagcacggatctagtatataacacctgacagcaatgtagtcaagcctaagccaacagccaagtatgacagcaaagtatgacagcatgtatagtgatattagggggtgtttgagattgcttcactccaaattttatggctccgctccacaatgtagttgccaaacactttaaacttcagctaatgtggtcctaaaaaaatatagagttggggtcaagtctaccgttttggtggagcagccaaaaaattcagatataatcataaagttcgagtttaattatccaccaatgccactcgctatggagaaataacatttcgtctgttctattcctccatccatgcgtatgcaacagacacttcttcctcaatgcttctagccttttactactcgcaaaaccacatcagacactatagatagccaaacgggccgcctagcctgtcattggcactagcactattagacacaacattgttagtcattattattaatcgtgtcataccgtgctgacactagtgactagttatcggcccgggcactatactatagtgcctagt

SEQ ID NO: 5413 - DNA, 3002 bp, Zea mays
catgtaacaatttcatggtgtatatccttagtccctaccgcacccattctgtgccttttttaatcaaactcaaatcaaatgaaagaattgcctgagtctacaagcctgttatggtttataatcgtgtaatgatttacaagctttcatggctgcattgtatgtttaaacttgttagagtggacacactaaccagtacaactcaaaagcttaagttgatgtgagaagctagtcaatccaattatacacttcaacacctctacttacgtgcaaccagagagaaatgtgtaaacgtggaaataaatggatgaagacacaaacaaaatctctgccaggattcgaacttaaaacaaaatctctgtcatgattcgaacttaagacatctggcttcgatactatgttacagtgaacgcactgaccaattgaaataattaaagtttaaggttttgggataagatagtcaatctacttatacacttcaacaaaactcatgtacaaccagttttatgttcatttatcaataaaatggtattaaagagcatgcagatatgacagtttatcttgtctattttggacatgtttatcttgattcgcaatgaaaattacatgaaagttgttttcatcacctgcagtcggcaattaggttctgaaaattctgctttcatcttgcgatgccagtcttaccatattgatggtttttttttttttttttgaccactcaaaacaatttgcatttatggtgataggagagtgcatacaactgtacaaactctgaccctagtataaagtataaactatcacaacaactcatgctttgtataaactatgattttgtgaaggtcctacagaaaatatgaacatggacactcactgtcaataatgttgtggtgcgccagaactctgtacatggctcttcagctaaacgtgactacgtgagctagctagcttgcttgttaccagtattctccgcacgagcattccccatccttcatcctgtggaatctgttgctatctctcaatattatctccctaccggtggccttggagacatacttgagtgctgaatgacaatcaacgcatacacggaggttcttaaatatccttattggctttgttgctgatgtacaactgatcaaaccgaatgcaacagcaatcttctcgctgtgctgaagcagacacagttccttaagctcatccgacatgtcatggagcactacgctggtgtctggtacatagcccatgactttgatttctcttatcagtgtctccaactttgtatagatctcctctgcttgtggatggctggtatcaccagctcgaaactcgtgaatggtattgtcaacatgcatccagctcaaccctttttctttcatcaagtttttatccctcattagactccttatcctagctacttgatcccacaaaccagcctctgcgtataagttggaaagcaagacatagggggctggatcttgtggttcgagctgtatgacatggttagcagcaatctcaccaatatccatgttgttgtgggtcttacaggcaccaagaagtgtcttccagaccaatgcgtctacttgacaaggcatttcgttgataaaatctagtgcatcttcaacaaggcctgatcgcccaaggagatcaaccatgcaagcataatgctccatccttggtatgagtccatgatgcttctgcatcattctaaagtgttccttcccttctttaactagaccggcatggctacatgcagataaaacagcaatgtatgtgacatcatttggtttcaccccagctgcgatcatatcgtgaaacaattccagagctcttgctgcatacccatgttttgccaaaccactgatcattgaagtccatgagatcacattatggtcattcatttcatcaaagacttggcaagcatctactaggtatccacacctagaatacatagatacaagagagtttcctatggctctatctgacccaaatccagccttcagtgagagggcatgcagctgctggcctttggttagcatccctacacaagcggcagcactgatcagactaccaaatgtgaaagtgctgattcctaactccattctttcaatctgatagtcttgataagtgttgctcctcccatctccgtctaaattgccgctgaaggataccatgttcttttcatatagctggtcgaacgcatgtctagcttcctctatggaaccagattcagcatacatgcttactaaagcattcccaacaacgtttaagtcagctaggttagatttgacgcaatgagtatgaatttgcctgcctgaatcttgatcaccaaggtttgcacatgccttaagcatactagaatatgtgatatggtttggtctgatgccttcatttaacatcttgcaaaacagtatcataacctggttgtcctgcgatccacgctgcacataccctgacaaaagtgccgtccacgacatcacattatgctttggcatccgattgaagacttctctcgcattgtgcaaggactgtccattgtgagactttgcatacatgtccacaagcccacagctcacgcaactgtctgattccagtccaagcctgagcgctagagagtgcagttgctgccccaacctgaatgatcccaactctgtacaggccgataacatactgctcaaggtgtactggtccggctgaaatccgttctccagcatgtcaagaaacaattctacagcctcatcagaataaccactctgcgcataccgtgtaatcaacaatgtccaaacgacaaccgtcctctcgaacaatccatcaaacaccaggcgcatcgccaccaaatccccattcttcgcgaacatgtcgatcagagcgcaacccaccgagacgtcagtgccccagaaacccagcttgaataccaaaccaagaaccgcgccaccagccaagtggaagagctcgctggcgaagcaagcctgggttgcggcgcacagcgtgaacgcgttcggcaggagacc

SEQ ID NO: 5414 - DNA, 768 bp, Zea mays
gccggcccccccggggctatcacatcatcacttccttgagcttacaactcaacctagccagtcagacttcagtcccttcccctaatttatcacacacttcactcaataaactatcgtttttgcactttttcaatttcaatatctcgccgcccatcatgcaatcccccctttttattaccctcattatggctgccagcagtgtccttgctctgccccagccacaaggcggtgattacgactctgaatatgattctcagtctgcaccctcaccctacgactcgcacggggcgagcaaccatccctacacaatgaacccttctccaaggctccctggacaaggttccggtggtctcggtggcatgctaccctctatcggtggcctaatgccttctgccggcggcatgatgtcctctctcggcaatattggcggcatgatgcccttcttcggcgccatgcccggacttggtggcattggtggttttggcggaaatgtcggggttggtgctgatgtcggagctggcgttggtgccggagccgcggctggtgctaacgttggagttggggctggcgtcggtggtgctgttggtgctgacgcaggcgttggtgctggtggtggtgtaggagctaatgtaaatgctggcgctgatgtggctgtgtaacaccttattcaccttcaaattttactacaattgtatctccctctttatcacctcgcatattaattacgtcacttgtctaaggtaaaaaaaaacaaaacaccggccccta

SEQ ID NO: 5415 - DNA, 3002 bp, Zea mays
ctgcagcccttctcagcttgcaggcgtcgcacgccactccttcacctgcatggccactacgtcgtcgtatcacgtactcggtgaaatttatacattacactaagatcgttttctctcatcaagtcaacacaaaccataataatttaaatcaaaccaattcaaacaaaatgttcaaataaacagtaaaatctatgcaaatagatattatggtacctagatcaagtcgataagaagacttgtacgaatgggctcataggcttggtgtcaaaagcccatgggctcggcaactacgactagaaggaaggcctatccgcaaaggtattccaaaaggataaacatatcaaatattttattggattaggacatttgatcgagatcttattagatatgccaaggtccaaatagattaaaaaaacatatatatgtaaggatagagttcaacatagggtcggttacattcccctattttgtaagcaactcggatacacatttgtaaaccactgtctctcctaagactataaaagtagaatctaggtgccccataaggacaagattatcatatcagaatacaaataccactagtaaaaactaaaaaggacgacgcggggtgttatttcacctttagagccctgtataaattttgtatcattcgtgtctttactttaactttcgattacatgagcggctctataaattcactattgaataatcttcgacaacaataaactttgagctactatacagtttacaactttcccttcccttcacctttttccttacaattcctataatcctggccttgttttttcctgagactattgtaagttcctataattcctatagtcctgacgtcgatatctgactggcccaaacacaagaaacagagaggctggccaggcgacaaccgggagcatctttggaaatggcaaattggatctcgatggcgtaagcgctcccgtctgcacaagtctggctggcttattcggcgccgtggcgggccagctgcaaagataagagtcaagacccgatcgagtgtaaagctacttgggtcatcaagcgtgcaaggtctcaatctcgcggtaatggcgaggccacacgtcgtggttgtgccgtacccatgctccggcaacatcaacccagcgctgcagatcgccaggctgctccaccgccacggcgtctacgtcaccttcgtcaacaccgagcacaaccaccggcgcgtgcaggccaccgagggcgccggagccgtgcgcggcggggaggggttccgcttcgaggccatcccggacggcctgtccgaggccgagcggggcaagcaggactacgggcgcagcctggccgtgtccacgagcacgcgctgcgctgcgccgctcagggacctcatcgcgcggctcaacggcacgccgggcgtgccgccggtcacctgcgtgctgcccaccatgctgatgagcttcgcgctgggcgtggcgcgggagctcgggatcccgaccatgtcgttctggacggccagcgcggcctcgctgatgacgcacatgaggctccgcgagctgcaggaaagagggtacgtgccactcaagggtaagcactaagcaccgcggcaccgcccaaattaatcttgcacacgcacgcttgcacctagcctgctcgctttcgcggtgacactgacgccaacgtggcgcgcggccggcgccctgcagatgagagtttcttgacgaacggctacctcgagacgacggtcatcgactggatccccggggtgccgccgatccgcctcggcgacttctcgagcttcctccgcaccaccgatccggacgacttcggtctgcgcttcaacgagtcggaggcgaacagctgcgccaaggccggcgccctcatcctcaacaccttcgacggcctcgaggccgacgtgctcgccgcgctgcgcgccgagtacccgcgcgtgtacaccgtcgggcccctgggcctgctcctccgccaggacgacgaccgagacagcagcgcctccgccagcggcagcaccgagtcgaccggcctgagcctgtggaagcaggacgccgagtgcctcgcctggctggacgcgcaagagcggggctccgtcgtgtacgtcaacttcggcagccacacggtggtgacgccggagcagctgaacgagttcgcgtggggcctcgcggcgagcggccaccggttcctctggtccatgagggacaacctcgtccgcggcggcggcggcggcggcggcgccggcctggacgcgatgccctcgaccttcaaggctgagacggcggggcggtgccacgtgaccgcgtggtgtccccaggagcaggtgctgcggcaccctgctgtcggctgcttcctgacgcattgcgggtggaactcgacgctggagggcgtccgccatggcgtgcctttgctttgctggccctactttagcgaccagatcacgaaccaggcatacattggtgatatctggaaggtggggttaagggtggtgcccgacggtggtgatggcattgtcgccaaggaaaggatcatggagaggttgacgagcctaatgggtgacagtggtgtgaaggaaagggtgaaaagattgaaggaattggcagagaggagcatggggcctgagggcaaatctttgaagaacatcaacgccttcatggaatccatgacgaagagactgttattgagttattgttatattttcgggaatgactaccactgatgtccaacgcatgttccaacatccaacatgatcatacaagatatctgtaaaaaatatcttcaaccatttatcaaaatacattttgcaatatcaagaaatatgaaaagcaatgacaatatcacagtaccagacccggaagaggaaaaaaaccacacgcgaaacttaagtagcatgattcatagattaatcaccgaaaaaaaggtacatcaaccaaaaatctctatgatattacacggtacaaagccattaacaaagtcattaaagtacatcgattgtgcattattgg

SEQ ID NO: 5416 - DNA, 4455 bp, Zea mays
  misc_feature (4343)..(4343): n is a, c, g, or t
caaacacattaatagtttattagagatacgaaattaaaattaagggtatgtttatatctctagtgctaaagtttagcggctgctaaaatttagcatgtgctaaacattagcacttgaggactgtttggataaagtgctaaactttatcaactgcggcggccaatggtgggagagtgaaaggggtaatccatgcaaaataggattggagactatttttagcatagttttatcatctttggttgagctaaagtgctaatatatgctaaactttagcacaacactttttgtcacatgtttgtttctttagcgtctaaacttcagaagaaaaaaatatagtgctaaagtttaacgagaaaacaaacggtcctaaaacaaggttaaaatgtaaaaagttcggtggcctcgtgaatcgtggtccggagcagaactcacgtgggacccgttccccgcgcagagaatcccgaggccccaccgcgggagccactggccgcccaccacggttcacctcgtgcgctctccttcccggacacgtgtcgtcctatcaacgacccgcccaccgcgtctgagccacgctggacgctcggtcgccgcacactcttccaccgacatgcggggttccattcctctccgcccaaaatgtcagtggcgttcgacgtaaccaggcagagtgcagcaggaaggacgttgtgtcgtaccacgtgggggactcgaccgggggaaccggtaaacgtggcgcgggccccgccgagaacgacgcgagcgatccggtcaccgcggcccgggcccgctggcccctagtcgccacgcgaaccactcctttatttcttttgtttcctactcctatttttaattatttttttgtttcctaatgccctcgttttcaattaaaaagtgaagcgcaagccattaaacaaacacaaatagcacacacgggcacacggcaggcctacaactacaagaggagaggagaagagagaggagaattttcaatgctgccgcgcaccgtcatcactagctagtggaggggcggacgagaaggcgaggagctgaggggagagaggcttcacagagcttgcttgagcctggagggggctgccgctgtttgtctctccactccacccaccagcagttacctcgggagggcatggcaaaatctggtgcctcctttccggagtccagttggatggagagggatttcctggccgcgatcggcaaggagcagcagcacccgcacaaggaggaggcaggcgcggaggaatctggtatgctcccggcctcctttcgccgcctgccgcgctgcgtttcttgatctgtgcccgcaccgagccgtgccctagtttcttgccgtgctggggttgggttcgctccattcggtgcggcgagatgcggcatgggtgcgctgcgaaattcaagcgtccctttcctctctctctctcttttctctgtgtgtgttttgttgctgattactttatcttcgcaacaaagagtgtgggcttgcttggctggcatgcctgccgaattccttttgacggccggcctgccgtgtacgctcgattgtggggagagttaatacgtgaagaaagcgacgatgtttccgggagaggctggccgagcctttcggacagccgcgcgtgtcgttagttgatttcgagctgctagtagtctgatcgctcgtgtgggatggggatggttaacggatccatctctgggttcttgctttgctgtgtgtatttatgtgccggcgtctgattgtcagaggcatgtgtgcaatctctctccccagcttacttcggcggagcaggagcagcagcagcagccccggcaatggactggtccttcgctagcaagcccggcgccgccccggcgttgatgtcgttccggtcagcttcgttcccccagttctcctccttcgacggcgccaagaacccggcccctcgtatcctcacgcaccaggtttgcgcggctgcccttcttggttctggtccatgtcagcttccgagtttttactgatacatctaggtcccttttcgggcctctgatgatgcttttgcagagaggtcgttcggccccgacagcacgcactacgccgccgcgcaccgcacgcagcatgcgctgaacggggctagagtcactccggtctcgtcgccgttcaaccagaacagtccgatgttcagggtccagagctcgcctagccttccgaacggtactgcgttcaagcagccgccttttgccatcaacaacaacgctgcggccagttctactgttggtttctatggaacaaggtactcctggtttatctgctgttaccacagtgacttataaaagtggctgtggaattagtatcgactgaaacattgcttgttttgcctgtgaagggatgtggtgaggccaaagacagcacaattgacgatcttctatgctggttctgtcaacgtattcgacaacgtctcagctgagaaggtataatttctcatggcctttccattttgatgctaatttgctttgcatttaagctccttcattgacattttccgttccacaggctcaggagctcatgctcttagccagcagagggtctcttccaagctcagcccccgtggcccgtaagccagaagctcctattctcgctccagcaaaagtcacagcgcctgaggttttgcatgcaacacagatgctgtttcaaaaaccacaacacgtttctccaccttcgtctgccatctccaaaccaatccctggcatcttgcaagctgcaagtctccccaggagcgcctcgagctctaaccttgactccccatttccaaaatcttcagtgccatttcctgtttctcctgtaagtcaggctccgagagctcagcctgcaaccattgccgctacaactgcagcagcaataatgcctagaggtaccgttggctgtttatggtttgcatagcaccaactggctatcattggagtattcagtaattctggttgctcatttgttgtattgaaattgtcattgtctgttgcagctgtccctcaagctagaaaggcgtcccttgctcgattcttggagaaaagaaaggaaaggtagaatccatattcttgctcccaatgtcctaaaaacagggcattggtttccgagtgcatcgcagcaccttaattccttacgacatatttgcatttgcgttccaaagctggttctgatctgtgtatacttctcttgcagggtgacaactgctgcaccttacccatcagccaagagcccgatggagagcagtgacacgtttggcagtgggagcgccaacgacaagtcatcatgcacagacattgccctctcaagcaaccatgaggagtccctatgtttagggcagcccaggaacatcagcttcatccaagagtcccccagtacaaaactacagatctgatctgaatatctgatcatgcccaatgttcatagatttgtccaggctgactgatgcaaggaccatacaatacttttgcattcaggcaaggactcgagaggaagagattacgtatgttatcggtgccgctagctgttgtttatgatgatgttttgttgtgctagtttactgtgatgctggtggtgcccccacctaactaacaagagagctgtcacttgcagactcttgatttttttttgtcctagcgccatttctttagcggtatcaagtcaatttatataggcttacaaattctgcgccttttgtatggccaaagtgtaatatttttgttcttgtattatgaacctccatgctgcagaatgcaagagcaaatcttattgtcaaaaaaaaaaaaaaaaccgccgcctgtacgcagtagcggttcatgttgttttgagctgttctgttttaataatatctcaaaaggttgccgattggtgcccgtaaggatgacatttcaagaacagatgggcagcagtcgttgcaaggttttggatgttcgcaagtggctcctcaaccagtacgttctgatattttcttgctgattcctcgaaagatttgacacatcctcattgaggtcagtcagccatcacaaggtttggaatgttggcatgttgctttcgtagtgggaaattttaaacgcattttgtttgccatgttaattgaaaaattgttgatggccaaatttgctacacgtatgtttgagcttaactaatttagtcagaaccaacaaataacaaatagaaattgtgtgaacttagatgagctagccgtaaacatttttgcatgtatatctatataggactagttagttactatccattgctacggattctatatatcataaattaaaattttcaaatattagtatatatatatttaaaatatcgtttctttataaanacaaacgactgtgttctggtggtagatgccgaatgcttgagccaggagcgggtttgagtcttctgccacacgccctttttgcttttccgcgatttcaaattttcaataggca

SEQ ID NO: 5417 - DNA, 1928 bp, Zea mays
  misc_feature (165)..(165): n is a, c, g, or t
cccacgcgtccgcccacgcgtccgcgcgcaccgtcatcactagctagtggaggggcggacgagaaggcgaggagctgaggggagagaggcttcacagagcttgcttgagcctggagggggctcccgagcccggccgcgctccactccacccaccagcagttaccntcgggagggcatggcaaaatctggtgcctcctttccggagtccagttggatggagagggatttcctggccgcgatcggcaaggagcagcagcacccgcacaaggaatgtgtgcaatctctctccccagcttacttcggcggagcaggagcagcagcagcagccccggcaatggactggtccttcgctagcaagcccggcgccgccccggcgttgatgtcgttccggtcagcttcgttcccccagttctcctccttcgacggcgccaagaacccggcccctcgtatcctcacgcaccagaggtcgttcggccccgacagcacgcactacgccgccgcgcaccgcacgcagcatgcgctgaacggggctagagtcactccggtctcgtcgccgttcaaccagaacagtccgatgttcagggtccagagctcgcctagccttccgaacggtactgcgttcaagcagccgccttttgccatcaacaacaacgctgcggccagttctactgttggtttctatggaacaagggatgtggtgaggccaaagacagcacaattgacgatcttctatgctggttctgtcaacgtattcgacaacgtctcagctgagaaggctcaggagctcatgctcttagccagcagagggtctcttccaagctcagcccccgtggcccgtaagccagaagctcctattctcgctccagcaaaagtcacagcgcctgaggttttgcatgcaacacagatgctgtttcaaaaaccacaacacgtttctccaccttcgtctgccatctccaaaccaatccctggcatcttgcaagctgcaagtctccccaggagcgcctcgagctctaaccttgactccccatttccaaaatcttcagtgccatttcctgtttctcctgtaagtcaggctccgagagctcagcctgcaaccattgccgctacaactgcagcagcaataatgcctagagctgtccctcaagctagaaaggcgtcccttgctcgattcttggagaaaagaaaggaaagggtgacaactgctgcaccttacccatcagccaagagcccgatggagagcagtgacacgtttggcagtgggagcgccaacgacaagtcatcatgcacagacattgccctctcaagcaaccacgaagagtccctatgtttagggcagcccaggaacatcagcttcatccaagagtcccccagtacaaaactacagatctgatctgaatatctgatcatgcccaatgttcatagatttgtccaggctgactgatgcaaggaccatacaatacttttgcattcaggcaaggactcgagaggaagagattacgtatgttatcggtgccgctagctgttgtttatgatgatgttttgttgtgctagtttactgtgatgctggtggtgcccccacctaactaacaagagagctgtcacttgcagactcttgaattttttttgtcctagcgccatttctttagcggtatcaagtcaatttatataggcttacaaattctgcgccttttgtatggccaaagtgtaatattcttgttcttgtattatgaacctccatgctgcagaatgcaagagcaaatcttattgtcgatggtgttctcattgccagcatgtgtacgcagtagcggttcatgttgttttgagctgttctgttttaataatatctcaaaaggttgccgaaaaaaaaaaaaaaaaaaaaaaaaaaaaaaaaaaaaagaaaaaaaaaaaaaaaaaaggcccctagggcc

SEQ ID NO: 5418 - DNA, 1019 bp, Zea mays
  misc_feature (986)..(986): n is a, c, g, or t
gcacgagaccattacctagaacatcctaatcgaaaaacaaatagcacacacgggcacacggcaggcctacaactacaagaggagaggagaagagagaggagaattttcaatgctgccgcgcaccgtcatcactagctagtggaggggcggacgagaaggcgaggagctgaggggagagaggcttcacagagcttgcttgagcctggagggggctgccgctgtttgtctctccactccacccaccagcagttacctcgggagggcatggcaaaatctggtgcctcctttccggagtccagttggatggagagggatttcctggccgcgatcggcaaggagcagcagcacccgcacaaggaggaggcaggcgcggaggaatctgcttacttcggcggagcaggagcagcagcagcagccccggcaatggactggtccttcgctagcaagcccggcgccgccccggcgttgatgtcgttccggtcagcttcgttcccccagttctcctccttcgacggcgccaagaacccggcccctcgtatcctcacgcaccagaggtcgttcggccccgacagcacgcactacgccgccgcgcaccgcacgcagcatgcgctgaacggggctagagtcactccggtctcgtcgccgttcaaccagaacagtccgatgttcagggtccagagctcgcctagccttccgaacggtactgcgttcaagcagccgccttttgccatcaacaacaacgctgcggccagttctactgttggtttctatggaacaagggatgtggtgaggccaaagacagcacaattgacgatcttctatgctggttctgtcaacgtattcgacaacgtctcagctgagaaggctcaggagctcatgctcttagccagcagagggtctcttccaagctcagcccccgtggcccgtaagccagaagctcctattctcgctccagcaaaagtcacagcgcctgaggttttgcatgncacacagatgctgtttcaaaaccacaacacgtt

SEQ ID NO: 5419 - DNA, 6063 bp, Zea mays
  misc_feature (2507)..(2507): n is a, c, g, or t
  misc_feature (5108)..(5108): n is a, c, g, or t
atcttcctctcctcccagccgccgcaaaccccactcccccctcgtgcccccaattcccacctcccagatcccaccgccagatcaccgcaatgcagccgccacgagaccccatcaccgcgcgagccatccccggcgtcgacgcctcctccacggctgtagtcgccaccgcgcccaccgaggtcccgctagcatggcccccgacctcgtcgctcagtgttggtgcgagatcgaggccatcagccccaccacgccgcgatccgccaacactgctgacccgggctcctcgccctctgccttcgactctgacaccggctcgtcgctcggccacatcggctgccttcgctcgatccgtcgtgccgcctctccgtccttattcgtcgcgttcgtcctcggcttcctcttctgccttccccgcgatgcctccccgcgtcatcgcccaccagcgtcatcgcgtaggcctcactcgagacagacatggcagtggattgggtgtttggttctctttgcagcaattggaggcgaacaggaagacactgtagaggcactctcgcgcgctgctcgcgccctggtcaacagaggtggcatcaaggggcaccgatggcggcaacacgctgtcgcagcgtgtggcggagagacagtgtaggtcagacctggcaaacaggacaggggagacggacatgatctccatgcaggagaacatgtctgccaggacactcacgctctctagctccgcgcagcggacaattgtgcggttcgttaagctgccattggttgacaagatccctccgcacaccgcttggatctccctggaaaagttactggtattcttgtgttcatatgttttgcaattggctaaccatgggcattattttgtgatattcatggtcattctaaggagattggactttatgcgtcatgggttgtgcaagtacacttgcgtttatttgcttgattaattcgtgatattgatgaagaaattccagatccagaggaatagaaacactttttcacaaagggagaagatcatttggtatggtagtatcttcattgaaaataatatgaaaaaaataaaaaattaaacagattattcgttgaggcaaacctatgatcaatcatacatcataggttggtcttctcctttgtagcgctacagtgcgacgacgcccagggccaaggtgctgaaggaggtgaggaacgtcgcagtaacgatctccatggagaagggtgcgatggccagaggtagtgggcatcaccagcacggcagccacaggcacgatggctagcagcaacaacaattgctgcttcaacgacaagcgtgcgcgagctctgagcagactcaagcgatcctatcatgtagttcattgtatttcaccattcatttttctttttttacgtccatgtgagatgaggttgtttgttcggcgagtggagcggtgggaaagccacagaggtatacgagatttatgttaatcccccacccccaaagagtcttccctatccatttcactgaaatttggcgacgcttagatatcgtgtcatcatattgggacgcttttattgcacacaacgtgtgatcttatttctcttggctctgtggctgtggatttcgtttctgcttttgggtaaatcagagatatgtgtgggcacatgaatgagttacattattattcacctgattccactttagctgaaaacattttactatgtacaggtaaaaaggaaaacttgatgctgccaggatcgtccatcaagaaggtaccatggtggggtggtggaggtgatatgtcgttggattaaaggagttatctaggtggggttgccacagctgttgttcatgtctcgctattgtcttgcttttttggaacaagactatgactccaatagttagtttgtgttttggaagaataggggaccaccgctcttttatctttgttccatttatcattagcattgtgcaaggagtaagagagacaatcccagctttggttgttattattgtgttataaggtagacattcgaagctactgttttataatggataattgaatatgcatgggcactgctatgatgatcaaaggatattggacactacgattgataatatggtcttatattgcttggactaatagctgaaatgaaacaatagtacaatttttattctaattctagctgtaattggtgacttttaaggcttgcaacagtaattattcaggagcagggcttgacacacgaacatttgatatacaaccttgttggtggctgttctcaagatgtcttcaagctccaatataatgttgcattgtgcaccagtatacaatcaccagtgggtaattcaacacatatttcaaaaagttattttaccattgatgaaattatatatattttatttctatgcattatattttttaccactacctgtaataagagaatctcgaatcagcttggctgatactggactcatgtagtttgaaaggatcaagatgcccatctaatttgactaagacgantgggagtgggggaccatgtcaagaaagggcgtgtgcatgagaccatattgtgcagtctattaaggtgcttcagtttcttctatatcttgtgaccaatcatccatcatcagttgtgcagcatgctactctgctaaacttcggctaaccttaatttggagagcgcatacagagcaaaaatgcaggtttttcgcttggacattgctagaccaaaagattttaacaactaacaacttgattaaaagggcatggccaaacgatctcagaagctggcagggaggtgaaagagattgaggagctggaggagaaggcatcatttttcagaagctggcaggtctcatggaggtgaaacatgatttcatggacttcttgcaggggccgagcaaggaagagatggagttgttggatcagctgaacatggaagcgactgaagttgagaaagtcttcagtcgctcactaccattgaggaagctaaggtagctgtagcaacataggactcagagaaaacaagccatcaagtagtggccgaaatggattctacttgccacagcagaatccacgatagagatcgttaaacagacaacaaacatttcgaattctcttctccttttctttttcccccttttctattctcaaaacacattcctacattagccctatttgtaaagtatcaagagacaaaactttttcgggccaaacagagaaagtaaacaagtatacttgagactacgtttaccagcttttgcatgagaattgtttgttatagtttcatttgacatttcatctaaatttaagtcatttccctatataaaatccaaaatccaaaggaactcttatatttatatgtcctgctaacgcacaggcattgtactattagctaataaggacaagccatattgataaaaaaattatgctttagcagcatagaaaaagtttgaaatggtcactataaatagtacaagttattgctacagttattggggacattgatttatcttattgtatagttattagttttgtttccttgtaaaaacctatttggtggacctacatgtgcttgtacttgtatgcaatgtatgatatcgtgtattataactttctaccgttatttttgtaccttagcacaaggtggatgctgatcattgccctattttagttgctttaggttactagataagattgcttgagtggtcgatgaacattgcattttactgtaaatgatgaatttgttcgatgtgtaaggcttttaaagtatgtaaaaattcttaacttttaaaaaatgctaacaagaacataaatcacaattagtatttttaaatttcaatgtatcttatgataacatgttcactccgtagcaacgcacgggcgttcacctagttgaataaaaaatattaaaggcattggagtttagacctagattcatgatgtcataaaacaaacacaactagaatcaatgtaacttaagctaaattttaacaggactaaatacattatttgttgataaattgaaacatgagatttactaacgtcaagagaatttcactagacagtaactgaaagtctgtttgattttctgtttggtgcctgtgagtcaataattttgggtcaccaagtagtggtgaagtactgaagttagaacatgtgagaaagaggtatacttgtctttcgggtacatatgtctgtcataaagttgtagtgtaaatatggtgaaattgtaatcaaacctactgttttgtatttctcttttggtgcatgtgcagtaacgtgtaactgggtacccactcctactatgtcaaggcagatatccgcgtggttacctataaccgtgtaataaggaattgagcaaccgagtctatgggtttggacccgtctgactgtaccattggccttagtactcgttccctgctcgggagcaagtccgatgcctccacgtgccctacgggtgaaagtgctcagggactatctccatgagtctccggacctcgatgggcggttcctggacttccctgtctggcatccagactctcgacaagcagggcccaagtcttcagccaagcatgcgcccttggtccccactttccgctcggacacgtgtttggtgctgccacatggcccatgggcgcgtggcacaagccttcggctggaagcaagctcgtagcgcacattcaatgcgagcggctgaggcatgccctgctgtgcacacgccatgggggcaatcttttatcaggccgtgctggcttgaatgaccgctccgtgcgttaccgaggcgggtagctgtgtgtcagcgccgcgcgcattggtctcacagtaaaccgcgtgttaccgaggtaggcagttgtgtctaggcgtcgcgcgcgtaggcgacacccatgtcgttggcctgggcaacacaccctctgtagcgtcgaccgaaggtgacgactcgagtctatcgcgaaaactcctgcacacattagcaagactgccccctacatacgtcagcatatcagactccaccctatagccgactcgagctgacaaacagggccaaaagcacgtctggttggaagatctgcataaccgccgacgggaatatctccatctaccgcaaacatttaagactcnatgttgtacatatttaatactatgtcactgggccaacttgtcggggctcaacacccttgtacgtgtctcccttggactataaaaaagagggcacatgcgatatgaggatttgcactccctaaatgtctgagacacacctccatctaagttcaagctcttaagcaatacaactcatagtagacgtactgtattacgttccggcccgaactactttaaatccttatgttcttgtacccatatattaaaccctagacaaccaacttattcttaggattagatgggtatactgcacgaagtttacctgcgatggtggatttgcactccctaaaaacaatgtctttgtccctccatcgagcactcaaaagcaaccaaatagaccagtagacatgagaacgcccaaatcaagagaaccaaaagtgtaggctgtccggcgcccgcatgggttctaccatgttaaaaagggtgggcgtagcctagctaaaggctaagcctgagcccactccaatccacgctcgacatgttttcaggccttgccaattaaagcacagcacagctacaggtgactaaataggacgagctatatggactgccacgaaaacgataattttagtacggcacggtcacgacaccgcactacatgatagtaaccgtgctgggtcggcgcgaggtccatcatgtaccatatttgggcttaggtacaaacccatcgaacaacacgagcatgatctattcatcaaaccgagcatgattcagcacgactcgtttgtgggtcaaccttacttgtcctaatctagcccactatatatctaaatatgaccaactcgacccacactttcaaattatttttgagttctgttacaaaaaatagagaaaaacaaaaatagacaaaattagttatttttttagttctgttacaaggtaagttttaggtcgttcggcatagtagtatgacaca

SEQ ID NO: 5420 - DNA, 2007 bp, Zea mays
tttcccgaaggtggcgagtttggagttggagtcctctggtgcaccggacatgtccggtggcacaccggacagtccggtgcgccataccagaggtgccttcggttgtccctttgctcttttgttgaacccaacacttggtctttttattggctaagtgtgaacctttggcacctgtataacttatacactagagcaaactagttagtccaattatttgtgttgggcaattcaaccaccaaaattatttaggaactaggtgtaagcctaattccctttcaagttcacatacatttctcagtgataaattgctacctattctgcaaggagtccaacctatgtctcattctttccaagtgcaagtggctaatggttctgttgtgtcttgtcagcatcaactattaagagcatcatggacaatacaaggttgtgaattcgtgtctgatatgatatttctgcccctaccgtgttatgacatggtactaggcatggattggttggcatcttttagtcctatgcgagtggattgggaacagaaatggttggctattcccttccaaggatctactgtggtgctacatggtcagtcgtccggaattcctagctgcactgtggtggaactctgtgtgttgaatactgctacggcaccaatgactcagtcagttttgcatccccaaattcacgacattctcattcagttcgctacagtttttgaagatccaacagagctgcctcctagtagggaatgtgatcacacaattcccctcataccgggtgcacaaccaatttcagtcaaaccatatcggtatccccccaaactcaaagacaaaattgagaagcaagtcaaggagatgctgcatcaaggggtgattcaaaagagtactagtgcttttgcctcgccagtattattggtcaagaaaaaagacaacacttggagattctgtgtggattaccgctatttgaatgccttgacagttaagagcaagtatccagttccggtttttgatcagctcatggatgaattaactcatgctaaatggtttagcaagttggatctcaaagcgggggataccaccagatccggttgcaagttggcgaggaacataaaacagcttttcaaactcatatgggacattttgaatttcgtgtcatggctttcggtttgactggtgctcccaacacatttcttggagctatgaatgagatattgaagcccatactacgcaagtgtgttctcattttctttgatgacatattggtatatagtcaatcatttgaagcacaagtgttgcatctgcagactgttttgcaactattgaaggatcatcgatggaaggtcaaaatgtccaagtgtgagtttgcaaaaaaatcaagtagcttatctgggatatgttattactgcacagggtgtagctactgatctggagaagatcaaagttattgagaattggcagactcctactaatgctaaggagcttcgtagttttttgggtctcgcaggtttttatcggaaatttgtcaaaaactttggtgtgattagtagacccttattcaacctgctcaagaagtatgccttattcgtttggacccaggatcatcaaacatcttttgacctgttaaaacaagcccttgtgtcagcaccggttcttgctttaccagattttacaaaacaattctgcatctacacagatgcctgtcagacaggggttggagcggttctgatgcagaatggtcatcctttagcttttctcagcagagctttgggacctaagaaccagggtctatccacatatgagaaagagtatatggctatcctactggctgtaactcagtggcgttcatatcttcagttcgcagagttcatagtttatacagaccaccgtagtttgtcacaattgaatgaacagcggttgaatactccctagcagcaaaaagtgtactctaagttggtcggactgcagtatcgcattgtttacaaatagggcattgacaatggagctgctgacgctt

SEQ ID NO: 5421 - DNA, 1244 bp, Zea mays
actgtgccggtgctcaggtcgaagggtcagccttaaaggattggaagaaacgatgcaaacctaatatgacaatgccaataccaaagggaacaagtgtagaggccatggcagtggttgaagacttcatctacttgaactgcagtagaggtcctagtatcattcagatatggttgagggagaagcagcagaaagtaggaaggctatccgcaggaagcaagataacgagcttgttcactgcaaacgacatggttttctgtggtacagaaactgggttaattaaggcatggataccgttgtgaagtgtagaagcaagaaggagcaggtggaaggcttaatcttgtaaatgtacaggaaagctagagtgtacaggaaacatgaaaaagaggagcataccattgtacaagccctcaggacacaacacagcagccagcgcggttcgttcataaactccatggatcagcaagtttcttcgaaatggatgagtagtaggttcataatgtaaatactaactagtgtgtgcgtgtttgttttagttttgcgaagggatgagttgtggatgttaataaagggtagagtaaatttcttagatctacatatatacttgcctagaactggaaaattaagaggacactaccactataacaaaaaaaagccatgtcattttggacaatgagaagcctccaaagctttattcttttttttcccaccatttatttaattggaaaacgtgatcatgaaataattgttgaaacagataaatttaagcggcagtggccgtagaatcatgaggccaacttacacccagtggcggagcgctcggtatggcgagcctatggcgcttgccataccttactccgccatgaggaacaggtgcttcaggctcaggcggtagtgggcagagaacaccagggccgagagtgaggcggcgagggcgaggcaaagctgtcgatgatgaagcgtgtctcctcactctcccatggcgtcatccgctgcgctcctcctcatgcccttctagtcccgtcgatttactgccttgcgctcaaggtttacacctgcttcctgtccaactcactccacctcccatccgtccacgccgctgtctcactcttcagctctgccacagacgcgccgcaagtctccatcgatggtcctgcactcacgctgctctgcagcctacacccatagcactcatgcctcgcgcgcagctctgcagccccacctaacgacgtgagcgctcctgcctc

SEQ ID NO: 5422 - DNA, 1037 bp, Zea mays
aatgttcttcttccctggttagtactagctagtagtcatcgtggtcgtccctctctctctccccttccctccactactatatatacgagaccattaccggccggccgggaagaccggcaggccatggctcgacgccgcccttgagtcctgcccccaagatgacgatgatccccctcgccggcttcaccgccctatctgccgccggcctcctgctcatcttctcctccttcctgctgcaaactcaaggaggagccagaagcagcgaggaggagcggtacgtgccggtgcgcagggtggtgtaccggtccatgacaccggcggcggcgagtgcggcgacgacggcagaggcagcggcagcggcggcatcgtacgagccgttcgaggtgtgcgaggggtgccggtgctgcgcgccgtcgtcgtcgtcgtccaacggcagcagcagctgcgtggacacgagctgctgctacgccatcgactgcgacctccccggcaagcccttcggcacctgcgccttcaccccgcaaacctgcggctgcggcggcgccagcagcaactgcacccagccctcgtcctgatgatgactcctctttcctgcaacttggctacttcttctggatcatccatcgtcttacgttacgttacgattagatcgcagattagatgactcacgtcacgtactccatcatgatggatagattatccagttaattcccagctagcgttctgcgtgaagttaataatacaatgaataataatgtgtgttcgtttcagagattgtgactgcagttggttccatgcattttcagagtcggcggctgctgttggcttgacaacttgtactgtcagggtcggcggcctaacctgttgtcgtcgtatacctactgtacgttaggtatagattgaaacattattttatactgtatgactattacaaaactataaagcaatacactcatttattattgccaaaaaaaaaaaaaaaatgtagcttgactcgcgggggtgcccggggaatattgcaaaacctactccagttg

SEQ ID NO: 5423 - DNA, 828 bp, Zea mays
aatgttcttcttccctggttagtactagctagtagtcatcgtggtcgtccctctctctctccccttccctccactactatatataccaggcgagttcgggtctctcggggccggcgggggaccggcaggccatggctcgacgccgcccttgagtcctgcccccaagatgacgatgatccccctcgccggcttcaccgccctatctgccgccggcctcctgctcatcttctcctccttcctgctgcaaactcaaggaggagccagaagcagcgaggaggagcggtacgtgccggtgcgcagggtggtgtaccggtccatgacaccggcggcggcgagtgcggcgacgacggcagaggcagcggcagcggcggcatcgtacgagccgttcgaggtgtgcgaggggtgccggtgctgcgcgccgtcgtcgtcgtcgtccaacggcagcagcagctgcgtggacacgagctgctgctacgccatcgactgcgacctccccggcaagcccttcggcacctgcgccttcaccccgcaaacctgcggctgcggcagcaactgcacccagccctcgtcctgatgatgactcatctttcctgcaacttggctacttcttctggatcatccatcgtcttacgttacgttacgacctgatgacagaggatgacatgattagctagcacgcagattagatgactcacgtgtactcgatcatgatggatagattatccagttaattcccagatagagagttctgcatgaagataataatacaatgaataataatgtgtgttcgtttcagaaaaaaaaaaaaaaaaatcggggcccgcggcc

SEQ ID NO: 5424 - DNA, 8594 bp, Zea mays
  misc_feature (236)..(236): n is a, c, g, or t
  misc_feature (463)..(463): n is a, c, g, or t
  misc_feature (5030)..(5030): n is a, c, g, or t
ccgattagattaatatttaataataaacccgttggccaagaaactagcgagttagattataataacaatctggcgtcgtcggctcagttttagacgagctccaacaatgatctataaagagtcctatattctaaatttagaggatgagatcgtcctctacttcctcaagcagcgttatctaaatgatcctctaaatttagagaacgctactgaacactttctatatataaagtttntctaaacagttgtttttgcatttgaatactttaaacaactggtttaacaaaactaaaatatgtataatacatttgagaatatgacaaatacgtatgtaaaaaaatgtctctaatataagtatttgcttatagagtatgtgatttatgacgttgttggagagaaaggagatatagaggatgaaaaatcttttatagaagaatgtaaagtagggataaacatagaaaangttgttggagaccgtcctagtccgtggggattgtttctgtagagaatagtagtgcactgtaactgattcagcgcaggacgatccgtgaagcaataacttcagccctgggcccgccccggcaaggccgctgggtatgtcccttggtcctctctctgacatctcttgtctcctcttcattgcaaatgtttctcttcctctctcccacctctcctctcctctccattgcaaaccttcgggatgaaggttgagagcctgctctgaaacgacgtacgtaaagggagcaaggaaccggagagcgtgcggcgggcttctggattttaggtacgtgcttccgcagatgggtcgacttccccctcccgccttttcgcataacggaaaccgtgtttctttgctgaattgatcatggctcatgggtcaagccgtcaaggtgaagcaaagcaaccaccacatgtccacatcccccccacgcagtagcgtactatatacttcgctaagacttccgaatcgggtgtttttatgtttggacaactttagccaccttatctacatctacacattctatttgtttcgaacttcactaaaccactggctgggttgagatcttgaaacggcacctgacccatagatccaaacagaagctcaagttttcctgataaacagtgcagacctctcctcaggaccgagcaaatatgaaacctgaaaaacagaagggatactcggttgtggtaacccaagaaaaaataaacaaggaggacagtaaaggcctgaatctgtcaaaaactgaacaatacaattttaaaaaatatataggcacagtttccgtgcatgttgattatcaaggattgcgtacgtgttgactgattatcaaagaatcacggcttctgaagtagcgaaaggagaaacgcaccagagccaccgggatcttctacgcctgccgtcgaaagaggccctcgcagagttccttctggatcttggagcagaggatgagtgcaggtgggcctaaacggtggtgacgaagcccaggggagccttctggatcttgaagaaccacggaggagtaacacgtgccggatgcgcagcctacaagcagcggcagccagggtcgagcaagctggagatgcctccaccgccgcgccgccaggggagagatattttggatacctgggtttttgtacccaaacgaatccgatgcggttgggtcatgtgcaatggatatccgcgtctagactacataccgtaccaactccgtaaaggacgtccatttagaagccatgacatgtttgacatgggtctagagcgaaattcaaagaggagttgatccaaaacaccctagcttctgagttataaactcaatgaagttcttggaactgcactataaatttttggagtaactcttttgctactcgaaaaactccaaaaaacaacataaacattaagtttaaagttatctatctgactatcactggttatgagaaagtaatctaaactctggagcagacctgctctatccagaattttggactacaactgctttagagtggagcagagctatgctaaacacgtccttagattttgaactatcaaatccattgtcaggactgcttttggtcaaaggttaatgtggcatacgcctcttataaccaacaccattctttgataataatatataggcaacatatcccatgtaaaaatgattagtgtgctaatatgataatattaaatcttatctattttttttaacgtaatgccaggagctctgcctctcaattaaaaagaatggaattgacccagttttaaggaaaaccgggcccaaaacctagacagagcgcacatctatagctgagtgcattcccatcttgggacggcgtgtcctattctacgaaaacataagttttctttaaaaatagtttgagagaagtgttgatgcgggaaccaactgggggtcgtctagaagacgatacacaaagagccggaaggtgtgctgctgctacgatcatccttccagaacgctacttcgtgtacaaggcattccaggagtgccacactaggcttcacctacagctagaaaaggagtgccagtatgcaaatgtacaacaataagctaaacgcctatagaaacatcttagatccaatttatagaaacagtaaaccatctatagaaacatcttagatccaatttatagaaacagtaaaccatctatagaaacatcttagatccaatctacaccatgtatcatggtggtgatcctaggaatatccgctgctaagacccgatgatcacgcacatgcacgtaaacatggttgagaacatccaaggtagtccaaccatagcaaacaatgagactaagcatgtcagatatgatgccagatgcttatcggtcttccgagttgccgcatgcagatgtacaagttgcatgtcgtagagtatagcaatcgatcaagagatatgcatttggcggtgtaaaattaatttaattacatgaagcttaagagcaaatatatacggaaactacacatggtaactagcagatcttgccaacaacaacaagatctatcagagtaagatggtaataccataccaccctggcatgatctactagagatcgcaccagggcagcatgtcccttaccttggaaaaaacccttgagggaggagtggcgatgcgccgagaggacaacaagcacccgctacttggtgaacaaatggctttccttttattgcgattgtgaccagttacattatatagtcatgtgaactcgaagcgataagcgcttcctaatttaaactttccatctaatctattacttattaacggtacaatgacttattttttattatacacgacccttttcagtctaggccgaataccttctttacaaagtccttcgactagaaaagatagtatcgatctgtttaggatacggtgctaacacatgccccctacttttagtaaaaccatttataccaaaactaccattgccatgcagtgctacatcggtcagggtcattacgtcactagtcatcagcgcttttcaccccatataggctctgtaacacgctatctcctcctagaggactgtgttatgtggcactaatgtttcatgggtcccctctttctccttttaatggtactagttgacattagaggaccctgtctattcagtccttcttggaaaaaactcatttcctattcaattcctcctagtgtcttccacgtgccttttctctttcccaaaccacccaatccacaccgatggggtctagtgatagtccagtgctggtaacttttgcttaacccgtacctcccctagagttttccttttggcttacttgcccttcatgatgaaaatcatgttgatcctattctatcattggcccgtgccttcaactttcctcagccttcaagatagagaaatccctccatgacattacactgatgtttccatgaacttggtacattggagtcaggcaagcgttgctgctagcaacattatcatcagtagctgtggttgcaatgaaatcccttcaccttatcacactgttgtttccatgaactcgtgattgtcaagaagggttgtattccagagatactatttctgaaacttggtcatgtgttactatcattgcgtacccttattttgtgttgcttcttccagactttagatcttggctcctagttgaactttgattttcagcaatccttcatgcgacgacaccaccttcagctccttcgaatgttgccccgtgtctctgccaagaggaggatctactcaataccatcgcagaggagctagtgaacatgctagattctgtatgggatgctttcacgtcagttacttccatagttccatccaccctgagaacttgaagcgtgcctttgaccgtgttattcatctcagcttctttcaagagcgcctaagggtagctaccagccacattgctacacgtcgagcccatgcacctttgggagccacaatctaggagaactgccacgtagcaaacaggcggaaggtcaagcttgatagtttggccacggtgatgggtgtatcttctaaactggaagcccttcgtgctcaagatttagacttggtccgttaggctgaaattcttcagcagcagttgatgtcaagtctagggaagagaggcttgccaaagtttccaaaaaatcagaaaactcttgctgtagactttgtcttgctggttaaggaaattgacactgagcgagtaggttgtaggtgcaacaatgtggatgactatgccaaaatcaatcaattattcgcctttcaagagccttcaagcattgttaaataaagtttgtaaccttccttgatgaaaattgatctgtctgtaggccttttttttgtattagacgtaccccggacatattctcttttgtaatagccctgtcctcggtcaagtcgaattgtttctagcactaagatgatggttgggcatcggaaactcacaattgcttttatttatttttatttttatctaaaggcaatggtggtacattggcttttttggccggagtgtgagctggcctttttatctttttttgtggtgnggatagggatggtaatggaccactatccattcttcacaaaatattagggtactaaataaattttagttcaactttgagctccactttgagcaccccattctccatagaggcgctgccattgaagtcatttagagtgatgttagtcctgatcagatcttgctctgttctttcgatcttgtggcataccgagtacggcatcacgttcaccgtggctccagtatctaccaacgtcctaccaattggtttgccattttagaaccctttgatgtagagcaacttcagatgtctatgctttttctggtggttaggccattgtcaattggagttttatgagagatgtctagacattaattagtgtgccacatatgatttttgatgagatgaaactacacttattatgaaataagtgagactagtttcatcaccataaaactatgttgacccattttcaatgttttggaaagcgtgtgaaaccactattgagggcaatttattttatctccatctatttatattagttatttagatgcaacatttaaatcacatgttagcagttcattgagagagcatatttcattcttcattttatcttactcttattgacatgacaacattagaaattgtgataaaactacaatggccttaggtggatccaatggcatggacacattgatggccttaggtagcgatagtctgacagtatcaaggaaatataagtagctttgtgctgatggatctagcagagtaggcacctgtcgcttggacgtgcttcggagaagtaggtgtccaaaagttgcttacagtggatccagatccttcgaacaacattgctcaagctcatgatatagactgtcatggaggcagctgcagatgaggagaggccactgattcagtacctggctccagaggtgatattccttttttcgttcttgtttttttttcgccactgatacatgtccagaacgttaaaaatgtttcttttgcataaaggcataaagcacagttgaactttagtcggcataaatggaagaagaaaataaattatttttgccctgaactatattatggatctattctttagctaacgcacttactacaagaagagagtcacacagttcttggctgttaattaattcgtgttctgccaatcgttaccattcaggatgatgaagcttcctcacgatacactagcgacggaacgctcgatatcaacaagcagcgtgctctgaagaagagcaccgggaactggagagcatgcttcatgattctgggtaggttcttctgcatgcctagatcccaatccaatccaccagctcacatgtcttgaaaataatgtgctataatatataggtaccgagttcgccgaatgcctggcattttacgcgaccgcaaagaacctggtcacctacctcacggctgagcttggtgagaccaacatcgatgccgcgacgaacgtgtccacctggattggcagctgctacctcacgccgctcatcggcgccttcttggccgacacgtactggggaagatacaagacgatgatagtcttcctcttgctctacatcgttgtaagctgcgcagaaaagagagcactgtgactactgtagtgtcatgtcatattggaaccatctctgacgttcgtcgacaacgaaccctctgcatgcctgcaggggatgcttactctgacagcgtcggcgtggctccccttggccatggaggacgactcacctgacaacagcggacttcggcgtgccacagcgtacctggggctctacctcgtttccctaggcacaggaggcatcaagccctgcacggcggccctcggggccgaccagttcgacggcggcgacgcggcggagcgggtcaccaaggcctccttcttcccctggtactacttctgcaccaacatcggctccctgctgtcggggaccgtgctcgtctgggtgcaggaaaatattggatggggagtcgggtttacggtgcagacggtgttcatgctgttcggcctcgccgtgttcgtcgccggtcgcaaggtgtataggtacaagaagctgggcgggagccctctcacaagggtagcccaggtggttgtcgcggcggtgaggaactgccatctcgtgctgcctgatgatacgtcagccctgtaccacgataagcttctaccaactgaaccaaatttcaggattgagtctgccagacaattcaggtgtccatatatttatttattatttcgaatttcacttaaaagttgctcacttgccgcgagttttaataatgaaaatatatgctgtccagattctttgacaaggctgccataatcaccggcgagaagggtgcagcagcgccgacgagcccgtggagactgtgcacggtgtcccaggtggaggagctgaagatgctgctccggttgctgccggtctgggcatccatggtgctcttcttcgccgtcagtgcgcagacggtaaccacgttcattgagcaggctagggtgatggacaaccgcatcggcccgttcaccattcctccggcgtcgatagcgaccttcgacgtgatcagcgtcatggtctgcgtccccgtctacgacgccgtgctggtgcctctggcccggcgtgccactggcaacgaccgcggcctgtcgcagcggcaccggctctccatcgggatcgcgctgtccgtggtcgtcatggtgtacgcggcgctgctcgagggcaggcgcctggccctcgcgcgggccaacatgcccgccatgaacatcgcgtggcaggcacccatgttcgccgtgcacggcgcggcggcggtcttcgccaccgtcggcgtgctcgagttcttctacgaccagtcgccggacgggatgaagagcctcggcaacgcgctcgcgctgctctccatggcggccgggagctatttcaactcgcttgcgctcagcactgtcggggcgatcacggcgagcagcggggaacgcgggtggctcccggacgacctgaacaagggtcatatggactatttcttctggatgatggccgctctaggaacgctcaacctgctgcacttcttgcactactgcaacagacgatacagaggcaacaacaccaccacttcttgacgtgtgctgttatgctgtgtgcaccatgtttctcaaaataatagtttgacaatactatactttgtaattatcataataatattatagttttagccagctccaagaatactaggttctaagaaacattgcttaaatacaacatcatggcgttaggagcttactcttgagtaagttctcgagttatggataggatctaaatctccagtgttccgaaggaataacaggtgacccaccttcgtcctaacaatatgcatgaagattaagttgaaggccacggtcttacattccaaatacaaagctcttgaccggttggctggttggttggaggaggctttggactggtcagatgaagggaaatcatgaatgcttgttgttagggacttgttctcaaatgctaagagttaagaacaagacaacataaaaaaatgttaaatgttaaagtccttcgtccttcgaaacat

SEQ ID NO: 5425 - DNA, 2291 bp, Zea mays
aatgtcccttggtcctctctctgacatctcttgtctcctcttcattgcaaatgtttctcttcctctctcccacctctcctctcctctccattgcaaaccttcgggatgaaggttgagagcctgctctgaaacgacgtacgtaaagggaacaaggaaccggagagcgtgcggcgggcttctggattttagagtaggcacctgtcgcttggacgtgcttcggaggagtaggtgtccaaaagttgcctacagtgggtccagaggtcatgatatagactgtcatggaggcagctgcagatgaggagaggccactgattcagtacctggctccagaggatgatgaagcttcctcacgatacactagcgacggaacgctcgatatcaacaagcagcgtgctctgaagaagagcaccgggaactggagagcatgcttcatgattctgggtaccgagttcgccgaatgcctggcattttacgcgaccgcaaagaacctggtcacctacctcacggctgagcttggtgagagcaacatcgatgccgcgacgaacgtgtccacctggattggcagctgctacctcacgccgctcatcggcgccttcttggccgacacgtactggggaagatacaagacgatgatagtcttcctcttgctctacatcgttgggatgcttactctgacagcgtcggcgtggctccccttggccatggaggacgactcgcctaacaacagcggacttcggcgtgccacagcgtacctggggctctacctcgtttccctaggcacaggaggcatcaagccctgcacggcggccctcggggccgaccagttcgacggcggcgacgcggcggagcgggtcaccaaggcctccttcttcaactggtactacttctgcaccaacatcggctccctgctgtcggggaccgtgctcgtctgggtgcaggaaaatattggatggggagtcgggtttacggtgcagacggtgttcatgctgttcggcctcgccgtgttcgtcgccggtcgcaaggtgtataggtacaagaagctgggcgggagccctctcacaagggtagcccaggtggttgtcgcggcggtgaggaactgccatctcgtgctgcctgatgatacgtcagccctgtaccacgataagcttctaccaactgaaccaaatttcaggattgagtctgccagacaattcagattctttgacaaggctgccataatcaccggcgagaagggtgcagcagcgccgacgagcccttggagactgtgcacggtgtcccaggtggaggagctgaagatgctgctccggttgctgccggtctgggcatccatggtgctcttcttcgccgtcagtgcgcagacggtaaccacgttcattgagcaggctagggtaatggacaaccgcatcggcccgttcatcattcctccggcgtcgatagcgaccttcgacgtgatcagcgtcatggtctgtgtccccgtctacgacgccgtgctggtgcctctggcccggcgtgccactggcaacgaccgcggcctgtcgcagctgcaccggctctccatcgggatcgcgctgtccgtggtcgtcatggtgtacgcggcgctgctcgagggcaggcgcctggccctcgcgcgggccaacatgcccgccatgaacatcgcgtggcaggcgcccatgttcgccgtgcacggcgcggcggcggtcttcgccaccgtcggcgtgctcgagttcttctacgaccagtcgccggacgggatgaagagcctcggcaacgcgctcgcgctgctctccatggcggccgggagctatttcaactcgcttgcgctcagcactgtcggggtgatcacggcgagcggcggggaacgcgggtggctcccggacgacctgaacaagggtcatatggactatttcttctggatgatggccgctctaggaacgctcaacctgctgcacttcttgcactactgcaacagacgatacacaggcaacaacaacaccacttcttgacgtgtgctgtcatgctgtgtgcaccatgtttctcaaaataatagtttgacaatactacactttgtaattattgttgagtttgtgatctaaattctgaagaaggcggccaagttaatgagcgaagcggaggcccgtcgccgggaggctttccctactcattttagggtttcacctctataaatatctttgtaagccgtaggagataattatctcaattgtaaatctcctgcgatctgtaaccacccgaaaatagtgagaagttgttggccggcaaaaaaaaaaaaaaaa

SEQ ID NO: 5426 - DNA, 1289 bp, Zea mays
cattgggtacctcgaggccggccgggacacaatcggttttccaccacacaaaacaaaaaacagagtagatagttcttgaaactgaaatcttcgccgttccactctcccccagcgatctgctcgtttccttgcaacttgcaacctcggtgctgctgatgacgctcgcgatgagcacactcgcctgccaccgcccactcccctccaaaggttggaaatggaaactgcgaacctcggttgctacatggaaacatatgcggcctgggcgacgtaacgaggccgtggcatgcgcggcgaagaacacaaagaggaaacggagaagttctccgaacgagtcgaaggatttgctgttggtggtaagtgaggaagctgcttcgggcagtggaggaagtgctcctggcacaagcctcgagaccaacggcgaggatgctgctactgacgatgaggtttcaggtgctccgaggagtgctgttcttcaggcttgcgctctcacgtcaggcttgctgcttgccggagggcttctgcttcgcgaggcatcacacctagcatcaataaatggatggccaattgctgaccctacagatgtgtcattcagttttgaaacctggcatcttgagttggttgcgggacttgtcatagtaatctcctctgcccggtacatcctgctacaaacatggccagatttcagagattccagtgaatctgcaaatagacaaatcctcgcatcgctagagcctctggactacattgtcgttgcttgtctcccggggataagtgaggagttgctgtttcgaggggcgatgatgcctaccttgggattgaactggattagcgcccttattattggaaccgtttttggtgttcttcacttgggcaatggcaggaaatattcgtttgcaatctgggcaacatttgttggctttgcctatggtatgggaaccatagcttcctcgagcattgtagttccaatagcttctcactccataaacaatattatcggaggtttactttggcgccttaccaagaactcgcaaaagtagatatacataataccctcaacagtcatccctgttcagtttagactttttagtccttgatccttacaaggttgtcgtcagtattagtgtcgcatgattggttcacccatgtattttcaatagcaaaatgaggacgggactgccgtaaaatcaggacttgcttcatttttctgtgtcaatgtgtccctgtaaatgaattatggagatttatatttcatagcaggtataaaataaaatttaaccgtggggccaaac

SEQ ID NO: 5427 - DNA, 2096 bp, Zea mays
gcacgagaccattacctagaacatccaatcaaaaaagcatgtctcgcgggtcctgccgtctcgtcgccactactgactactgaggagaggagcatggccctgactaacgtcttcgtcgtcctcctgagtaccgcattggctgtgctccccttctcccctgccgatgccggcgtggtgggcgtgagctacggccgattagggaacgacctgccgggcacggcttcggtggtaaagctgctgaagaagagcggcatcacctcggtgaggctctacgacgccaactcaaaggtgctcaaggccctggccaacaccgggatcacggtgatggtaatgctacccaacgacaagctcgccgcggcggccgcggacccgtcgagcgcgcgacggtgggtgcggaggaacgtggcggcgtactaccccgccacgcacatccacgccgtcgccgtcgggaacgaggtgttcgaggaggccaagaacctgaccgggcagctcgtcccggccatgtccaacgtgcacgacgcgctggtgaagcttggcctggacggggccgtgaaggtctcgacgccgatcgcgttcaccgcgctccaggagtcgtggccgccgtccgcgggcaggttccgggacgacatcgcgcggtcggtgatgaagcccatgatcgatttcctggagcggaccgggtcgtacctcaccgtgaacgcctacccgttcttcgcgtacgccgaggagccagacaagatctccctcgactacgccctggggaactccaacgccaccggcgtgcgcgaccccgtgaccgggctcgtgtaccacagcctcctggacgcccagctcgacgccacgtacttcgcgatggagaagctggggacgtccagatccagtgcgcgggggccaaattccgtggcgccagcagcgcacgtttcggagagcgggtggccttccggcggcaaacccaaacgcggcggcaggccgcggccacgcccacgcggcggcgggaggcgtttggagttggagcaggctggaggtgaagcggcttcggtagccaacgcgcaagcgtacaacaactacctgatcaagcgcgtgctgtccggtgacacgggcaccccgtaccaccccgacgccgacatggacgtctacatcttctccctcttcaacgagaaccagaagggcgacggggcggacgacgtcgagcagcacttcgggctgttctacccgaaccggacgaaggtgtacgagttcgacttccggggcggcgcgctggtggccagctggtgcgtggcgaacgcgtccgccggggacgcgcggctgcaggcggcgctggagtacgcgtgcggccacggcgccgactgcggcgccatccagcccggcgcgccgtgcttcgagcccgacaccaggctcgcgcacgcctcgtatgcgttcaacagctactaccagcgcaacggccggggccaaggcggcgtgcgacttcgacggcgccgcctacgtcgtgtatcacgaaccagctggcacctgtgacccgaacgtgagctggtgcgtggcgaatgcggcggccggcgacgcgcggctgctggcagcgctgaactacgcgtgtgccaacggcgcggactgcggcgccatacagcccggcggagcgtgcttcgagcccaacaccgtggtcgcccacgcctcgtacgcgttcaacagctactaccagcggaaggggcggggcagcgggacgtgcgacttcgccggagccggttccgtggtctaccacgcgccaaagattattgggaagtgcgtcctcccgtcgaaagcttggattcaagaaacaacaacagtcaagtctagaggattcaagacaagttcggtttaacctcgtactaggaacgtagaataatgtaaacattggcatctgcacatcaggataactgatgtctttgtgttgctttgcttttcggacactcatgaaccatcgttcctgtttcctgaggcggatctcctgctaggtttggttcccggcttctggctttatcggatactgtagcttttttaaaaatacatctggggtccttaacttttttaaaaaaaaaaaaaaaaaaaaaaaaaaaaaaaaacgctca

SEQ ID NO: 5428 - DNA, 1395 bp, Zea mays
gcgatcgcaaccgcccgagcccggccggtcccatcatcgacgccagtgtgcattattacgccccgcccccacctggccggcaactcgacagggaaaaggaagacgcaccgctagagctgagatgtccttcttcttccgcatggcgtcgcggctgcggccgtcgacgccggaggaggtggtgcgctccatcaaggactccttcctcgcgctccacacgcgcacccacgccaaggctctggaagaggtcgagaaaaatatgtcatccttgagattgttgatctttggtgatggagaagtcgaaccaaatgaagagcaggtcctgcaaataacccttgagatttgcaaggaggacgtcatttccctgatcgtccaggatctgccttccttgggctggggagtaagaaaagatctggctatctgctggtgcatcttgcttaggcagaaggtcgatgaaacttattgctgtgtgcagtatcttgaaaatcatctggagcttttagatttccttgttggttgctacaagaacttggatattgcattgaactgtggaaatatgttaagagaatgcataaagtaccctacacttgcaaaatacatattggaatctggtagctttgagctgttctttgagtatgttgagcttccaaactttgatattgcttcagatgctctgaacaccttcaaggatctgcttaccaagcacgaagttgtagtcgcagagttcttgagttcccactacgagcagttttttgaactctactcaaggctcttgtcatcaactaattatgtaacaagaaggcaggcaatcaagttcctttcagagttcctgctagagactcataactctcaaataatgaagagatacattgtggaagttcgttttttaaatattatgatcaatctactaaaggattcaagcaaaaatatcagaatatgtgccttccatgtttttaaggtatttgttgccaatccgaacaagcctcgatgtatcgttgtagctttgctagacaatcgtagagaagttctgaagctactccacaatcttccttcaagtaaaggcgacgatgaactcgatgaggagaaagacctaatcattcaggaaatccagaagttggcataacacaaaagcatcaagttatcgtttagcaatgcaagactctccttatagaggacatattgccaaggccagaaccatgtatatcacattgcacatgtagccttcaagagttgtatttttggaggttttttcttttcttttggtctcagaaaaccatagcaaagtattctctttttgaaggaattatatacatgattttggtgaccaaggaccgttggattaattgagctagacccataactaatctagcaatgaattaaagaattctaaccatgttg

SEQ ID NO: 5429 - DNA, 2186 bp, Zea mays
caatgtaagactatgtggcccgccgatcactttcctgattgcatcttcacatacatcttcgtccacaatccgctgccgcagcaagttttctggctctgtattctccctgagtccattagccatgcaaaatcattagacgtaactatctttttgttctcataatataagacatgctctctttagacacattaaatcattagagtagtactagaattaaatgtattttttgttttttcactagaactggtttcaccttatataataagacaaagagaatattgtattacattagaattttaaatgacataacataacatttaaaagaaataagttttattgagataaaattagtttcatatagatgaaaacatgacaactcgttttaatgatctttcaaggtcttcgaaaacacgtctattaacatattttagcttgcgttgtttactggtcgcttcgttccacgcgtccagctgccctttgctctttacaaatgtagcaagttacgtattttcgtggtattgggcagcgcagccgcagttactggcaggatggacccaggctcgtcaaacggtaaaatataattaaatatagataaaaactaaacaaagttatatatttatagtatgagtattatttttgttcatattcttcaagatttttctgggtctgtcactagttgctggggccaatatttgatatctatggggaaaatacaaagatgctgagacacaaatgttcatgttttataatttttaaaaatatgtttaatacttttgctagtttaattgtatggaaaagatggagtgcacaccggttttccccttgccgtgtcctgaatccgctccgctcgccgtagcatttcggccctctgcctgccaggcccccccgccgccccatgcagatccgggggccctgcccggtccagcggtcctgccactttcgtctgcctcttgctccttcgcagctccgccccgctcctcgccgctgtggcctggtccctttatataacgcctcccccttccggtccgcgcccctcctccgctgccctcctcgcctccctcgattcagggttcagcgaattcggacagaacccggcgtgtccgtgtcgaccgacccgtccccctgcaagcctgcgacgagtctcctgccgctcttcccggccgggcgaaatccgcgctctgcttttgctgctgcttccgaggtctgcgtgcgtgattcccgctgcctgcttcgcgcccggtggccgtgtcgtcgcctgcgggctgcggcttgcgagcgcgggaatctggtgcctccgggtcggcatggccccccgcgttaggccgccttgctcgattgcggcgtgggatttcgccccgcccgcctagcggtagcggcggggtgggtggaggcctggagccgtgggggtggttggctgccgccttctctggcccatttctcagagaaccccgcccgcacccggtagcttcctgcttcccgtagcattttccctcccatttcacgacaacttgctgcgtgcgccgctctgggtgggacctctgtgccttcctagttccttccttctatatgccgtgccgtgcgtccgtgggattggaacataagggcgaggcaggcagggcagtctttctgccgctattgctctttattatggcgagtggattttatggtagcccgcggcgttgcgattgcttctttcagcgtaagaataagatagattccgttctcaattggcgcttctttgggatggctctgtctgtaggccgggcgaaatggacggtgtcgttgtcaggagggtcatcccttcggataacagttgcctcttcaacgctgtggggtaagtgctcctaccgcacccgttcatggtctaccaaatggagcgatcgcttaccactacagtttgcaacacctgtgctttggtgcagctacgtgatggagcacaaccgaaataaggcttctgagctcagacaggtaactgcttccaccaactcttggaaaacctgcctgcggtggccctcgttgagtcctgcctcttccaaatgtttcttcacaatttgtttgatcccttaaagtaattttagttcaaaattgaatagaaatagatcctgatccttaaattttatagtgtaaagtttagagcccattaccacccctacatatagatagattagtagagctactggatgcta

SEQ ID NO: 5430 - DNA, 1409 bp, Zea mays
tacctcgaggccggccggggctcgccttagcatccgggcgctctgcctgccaggctgccacaccgccccaagcagatccgggggccctgcccggtccagcggtcctgccactttcgtctgcctcttgctccttcgcagctccgccccgctcctcgccgctgtggcctggtccctttatataacgcctcccccttccggtccgcgcccctcctccgctgccctcctcgcctccctcgattcagggttcagcgaattcggacagaacccggcgtgtccgtgtcgaccgacccctccccctgcgagtctgcgacgagtctcctgccgctcttcccggccgggcgaaatggacggtgtcgttgtcaggagggtcatcccttcggataacagttgcctcttcaacgctgtgggctacgtgatggagcacaaccgaaataaggcttctgagctcagacaggtcatagcagcaacagtcgctggtgatcctgagaaattcaatgaagtgtttcttggcaaaccaaatgaagcgtattgtgcttggattttggatcctgaaaagtggggaggagccattgagctctctattctatccgaatactacgggcgtgaaatcgcagcatatgacattcagaccacccgctgtgatctctatggtcaggagaagaattacagtgaaagggccatgctcatttatgatggtttgcattatgatgctctcgctatgtctccggctgaaggtgcacctgaagaatttgaccagacaatcttccccgtcaatcatgaccgttccattggtccagcagaaggccttgccctcaacttagtgagggaggcgcaaaggaagaggagctacactgacacggcaaacttcactctgcgctgcggggtgtgccagatcggcgtcatcggtcaacaggaggctgtggaacatgcgcaagccactggccacgtcaacttccaagaatacaaatgacagtacaagatcagactgttgtgctgtaaacttgaccatcatttggttccaactgatattctcctcccgttggatatggttggcgctacattgtatcacagtgtaattcttacggggcaaacagaataatggtcaccttcgttctggacaatgtctatcttgcctgccaatgtcggttgaaattgaaagagcctacaatccattgtcgttctacatgccagaagaggtttgttggcccatgggccggatctatattgggcggtgtggcccggctgtatcatatctggtttatctattaggctttattcggttatttcaattctatgtggattggagtgtattggaatgtattgagatgtattttgacttgttatggatttaaaccgactcaataccattcaatccacatggtttaacggtgaaaaaaaaaaaaaaaaaa

SEQ ID NO: 5431 - DNA, 1046 bp, Zea mays
cattgggtacctcgaggccggccgggattgggaccctcgaggccggccgggataaagaaagatcaagccaccaccaccgccagcaagagcagagaggcgagaccgcgagagtgtacgtgccaccaggagcagcagcagcaatggccgccgccgccaccacctcctcatcctcccacctgctcctcctctcccgccagcaggcggcctccctacgatgccgcctctccttcctcggccagcccagaaggcccggcagggtcacggcccaggcgccggccgctaaggacgtgcggtgcatggcggccgtggacactactgcggcgtccacggcggcggcggagacgagccccaagtcgagcagctacgagatcgtgacgctcacgacgtggctgctgcagcaggagcggaccggcgcgatcgacaacgagatgaccatcgtgctggccagcatatccacggcgtgcaagcagatcgccgcgctggtgcagcgcgcgcccatctccaacctcacgggcgttcagggcgccgtcaacgtgcagggcgaggaccagaagaagctcgatgtcgtctccaacgaggtgttctccaactgcctcaagtcgagcgggcgcaccggcgtgatcgcctcggaggaggaggacgtgcccgtagcggtggagcagagctactccggcaactacatcgtcgtgttcgaccctctcgatggctcctccaacatcgacgccgccgtctccactggctccatcttcggcatctacaaccccaacgacgagtgcctcgccgacgtcgacgacaatgacacccttgattcggtggagcagaggtgcatcgtgaacgtgtgccagccggggagcaacctgctggccgccggctactgcatgtactcgagctccgtgatcttcgtgctcaccgtcggcaccgggggtgtacgtgttcacgctggaccccatgtacggcgagttcgtgctgacgcaggagaaggtgcagatccccaaggcgggcaagatctacgccttccacgagggcaactacgccctctgggacga

SEQ ID NO: 5432 - DNA, 1244 bp, Zea mays
tgcagcctttgcgccttagctccgagcgcgagcagagcagggcagcgagcggccgccggcgtccgttccaagtcccacagcacttagctgtagctccgacccccagcatccctacatgagattagctgatttgtgatgtgcttcgatctaaaattttgttccattttatctttgttactagttcgagtagatggccccgcgtaacgaacgtgctgaacatgttgatgaccttattaagttgtgaaacaccttgtatatactgccttgctggtactagaaatatactgtttttttggaggatagcctatctgcgtatctgatgggtaccgtatccgtatgtatgtaaacaacatagggtgcagccatgcaagtctgatactctgatgatggctacaacgtaaagctggtgaagcaacgccgtcctcacaattcttccccccctcgacctcgcctgggagtctcccaaaaccacacaaacctcaacccgaaaaaagacaagatcaagccaccaccaccgccagcaagagcagagaggcgagaccgcgagagtgtacgtgccaccagcagcagcagcaatggccgccgccgccaccacctcctcatcctcccacctgctcctcctctcccgccagcaggcggcctccctacgatgccgcctctccttcctcggccagcccgccagaaggcccggcagggtcacggcccaggcgccggccgctaaggacgtgcggtgcatggcggccgtggacactgcggcgtccgcggcggcggcggagacgagccccaagtcgagcagcagctacgagatcgtgacgctcacgacgtggctgctgcagcaggagcggaccggcgcgatcgacaacgagatgaccatcgtgctggccagcatatccacggcgtgcaagcagatcgccgcgctggtgcagcgcgcgcccatctccaacctcacgggcgttcagggcgccgtcaacgtgcagggcgaggaccagaagaagctcgatgtcgtctccaacgaggtgttctccaactgcctcaagtcgagcgggcgcaccggcgtgatcgcctcggagggaggaggacgtgccccgtagcggtggagcagagctactccggcaactacatcgtcgtgttcgaccctctcgacggctcctccaacattcgacgccgccgtctccactggctccatcttcggcatctacaacccccacgacgagtggctcgccgacgtcgacgacaatgacacc

SEQ ID NO: 5433 - DNA, 2386 bp, Zea mays
cagccccggccgtaaatcctcccctgatgcgaagcgtcttgaagcgacggcagctccacgcgctggcatagccgtctgttctcagcaaacccacccgtctgttctcgtcgtggcggccgccctgtccccattccccaatccctgtcgccgtgtccctaatccggctccgacaatcccacgcccagcagtccagctccagcgccgccctgccccacgcggccacacccaggacccagcggccagcactactgccaggctggcagcgcgcggaggtccagcgccagccgccagcaccaggcttccaggtctctagtgactcgatctcaaggtactcagcgcgctggcagccgatctaggtctctatgtgtcctttgagtcttctctccgtataaattcatcataaaagctcaagacctagatcggcttttcccccttgttcagcaaaggcgtttcgggatgtttatcatggatcgatcgatcatggcggatggggagacatcggcggaggaaaagaggaggtggacggggccaccagaggcgcaggagttggaggagacaaagaggaggcggacggggccaccagaggcgcaggagttggaggagcgcctggactctctcagggacaaaattgcggccgcaagtcttgtcgctggcagccgattcggcgaggagcagcgacggtccttgttgcaggagtggttgcgcctcgcatctgccaagttggatctggatctctcaggcataagcgagtttgacctatcagcagaggcgttgccttggttgatgccgccggaggaggcagacaagaggacgacgcacacgcggcaagaggcgcaggagttggaggagcgcatgacctgtctgcggttgctattcgaggacgcagcagatgacagaattctcgccagaagggagcttggagcagcagccgacgagttcctgctccgcttgacgacgcgtcaacaggccttgacgcgcgagtactcgcgcctcgccaacctgaagaggcctctggatctctccggcatgactgaggccgaccgggcggcggaggcggagaggctgagggaggagaagctgcagaaggcgcgtcaactccaggaccagggggacatgagcggcgcccgcgagtgtgaaggtctggcacgcatcatcgacttcgatgtcaagcagggcggcgaatacctcaacagtatctgctgtgtcggcaacatctacaccttcgaccacacagaggagtgtaagttcctcaagcagtcacagtaattcttaactgactcatgttcttgactgcatgtcagcatgtgtgatttgttcctgcttattggttccattatacatatatcattagttcattacatgtgcttcctcacagcgcccgttggtccgatgagatttaccaacagaccctggcaagacaagatgtgtgtgaattgtgcgtcgataaacatcctatctgtcaagattgcatgctcggatatcgacttccccatccaagtctatggcaccgttgttgccagggactgcatcgactacaagtgtgtttacctcttccgccgaggcaatgaccattgccaactcatcagctctaatgtacgtacctacaacttcttccttccctccctccctaatcgcatcattcctgttatttcaggttgctagctagctctccttttttttcatatgtatgactgtatgcaaagggagagggagggaggctaagatctatatactcttgacctgcaattgatttatactagtaacttgctcgcgcctagcgcgagtcttcgatcaatgctgaacacatttaaaagcgtgttgttttagatatatggagcaaagcatatgtggatatatctaaacaaacaattgtccacggtagtagaacaattaagtctacaaatgtagcagcatcagcaatctagatgtcaacattctaagtttcagattaatgatcttaaggacaacataatagaggctgataactctattgtgtgtaatagatgaatttaaggttaatttactattatttacatcatggctagcaaatatacaaattaaaaggtgcatatttagaaaaacaaacaggaaatgtgttaagcatacatgttttcctcggagtgatgacttttggaaagtgaagttgtgatgtctccatgcaatggaccgatatgtggaatcagtaaaaaaaaaggttaaaatccacataaatcggtgtacaattaatagaaaatggggaaaagtacatgtgttagttatctatatcttctgcactgaaattaacatggagaattaggtagggcatagattgttaattgcttggtaatatctatgaacaaaattaatggtgtctttaagaaatgcatacgtatacaaggacgacaca

SEQ ID NO: 5434 - DNA, 2252 bp, Zea mays
  misc_feature (2196)..(2196): n is a, c, g, or t
  misc_feature (2217)..(2217): n is a, c, g, or t
atttcggagatcttggcaaacccgcccgtctgttctcgtcgtggcggccgccctgtcgccgtgtccccaatccggctccgacaatcccacgcccagcagtccagctccagcaccatcagcgccgccctgcccctgtccctaatcccacgcggccacacccaggacccagcggcctgcgggctgcggcagtgcggctagcacaccacccgtccagccgtccagccgatctaggtctctatgtgtcctttgagtcttctctccatataaattcatcataaaagctcaaaagacctagatcggctttttcccccttgttcggcaaaggcgtttcggggtgttcatcgtggattgatcgatcatggcggagggggagacatcggcggaggaaaagaggaggcggacggggccaccagaggcgcaggagttggaggagacaaagaggaggcggacggggccaccagaggcgcaggagttggaggagcgcctggactctctcagggacaaaattgcggccgcaggcttgtcgctggcagccgattcggcgaggagcagcgacggtccttgttgcgggagtggttgcgcctcgcatctgccaagttggatctggatctctcaggcatgagcgagttggaccgatcggcagaggcgttgccttggttggtgccgccggaggaggcagacaagaggacgacacacacgcggcaagaggtgcaggagttggaggagcgcatgacctgtctgcagttgctatccgaggacgcagcagatgacaggattctcgccagaagggagcttggagcagcagccgacgagttcctgctccgcttgacgacgcgtcaacgggccttggcgcgcgagtactcgcgcctcgccaacctgaagaggcctcccgatctctccggcatgactgaggccgaccgggcggcggaggcggagaggctgagggaggagatgttgcagaaggcgcgtcaactccaggaccagggggacatgagcggcgcccgcgagtctgaaggtctggcacgcatcatcgacttcgatgtcaagcagggtggcgaatacctcaacagtatctgctgtgtcggcaacatctacaccttcgaccacacagaggagtcgcccgttggtccgatgagatttaccaacagaccctggcaagacaagatgtgtgtgaattgtgcgtcgataaacatcctatctgtcaagattgcatgctcggatatcgacttccccatccaagtctatggcaccgttgttgccagggactgcatcgactacaagtgtgtttacctcttccgccgagataatgaccattgccaactcatcagctctaatgaagaatcattgatcttgactggcccaaaacggggacttgcattgtggtacgatgctgattatgttcagactgatctctgggtcaaggatcgtcaagggcattgcaaacaattcagtaaggggatcgtgaggatcccaggcaatcaagtgtttgacaaatgtgagcctgaaacagtatctcttgctaccaggctcagtactgtggatgtgacatatgacgttgtggaatgtgcggtggaggcaactgttgcagctgaagttacacagggggaattctatggagcaatgactgcccacaccaccagaagcaagaggaggattgtgctgtttgatagccaagtaggaggtgataaatgtcatggtttgattcaattgatgcgacctgttgtatcggtctctgtgatggacaagctgaaaattttcgcaacgaccgctgctggtgtctctacaggcgttgaagttactcctagatggaacggtggacacgaattcgtactcactttaggtgacgctacgatttgtgtgaaggttacttggtcgatggtagatccacggctttaaatgggttcgcctgttcgttgttaagcatcatcggtggaagtgtagtagtgttgcattggaagggtttattctactcttgttatttgtctaaatgcatcattttttttgtgtggtggtggtggggttgtgttgctgggttctcaggtaatattttaaataaaacctgaaaatccaggcagagctcaccttttggtgcggccatggtggtcttcaccttttgctgggttctcatgcttgtttgaggcagatatgatgagtggctacaaacagactggagcgttcaggtgtgcgagcatccanagctgaacggaattgtgattntaactgactagaaactgagaaaaaaaaaaaaaaaa

SEQ ID NO: 5435 - DNA, 2131 bp, Zea mays
aagcggccccccaggccggcccggcccggagtattttaagctagaacactatacaagtactgattgccttgtacgtttgacataagactctcatttgttcctctcatactttcccatctaatggagaaactacttgagatagttctagttgtttcgaccatacttcttggcttagctctagtttatttatatgaaatcctatggctgaggcttgagaagataaggaagaagttaaggaggcaaggcataaacggtcctaaacctacgtttctctacggcaacacccaggagatgaagagaatccgacaagaactcaagtttgtgcagaggcaagacaaagacatgaatggctacatatccaccatcttccctcatttccttttctggaggaagacatatgggcccgtgttcctttactcaacaggagtgttggagatattgcatgttgctcagccagaaatggtgaaagacatgggccactggactccatcagagctcgggaagccacaacatataatgaaatcacgaaaacctctcttcggattaggtatactagcagcaaatggcgacctttgggcctatgagaagaagatcctggcaccacagttctttgtagaaaaaattaagggtatgatagggctaattgtggatgcaaccattccactgttacaatcatgggagaatatgctcgatggcacaggaggtagtaaggagatctatgttgatggatacctgaggaacttttcagcggatgtgattgctagagcatgtttcgggagcaatttcgtagaaggaaaagacatattttgcaagctcagacagctccaaaagttgatttctgaacaggatacacttgttgggctgtctgcagtgtggaaatacttgcctaccaagagaaaccgggagatacaaaagctagatcaagaagtccggttactaatcctggatctctcaagggaagacaggagccgaagccccggcaataatgccggcacgcatgtgtccacatacgacaaccttctgcatgccattgtcgatggtgcaaaccagagccccagctactgcagtgcccctgaagatttcatcgtcgacaactgcaagaacatctactttgctgggcacgaaactacagcggtcactgccacctggtgcctgatgctccttgctgcacacccagactggcaggaccgtgctcgggctgaggtcctagaagtgtgccgtggacaggcagcgatggacatcgacgtccttcgtcagctgaaaatagtaagagactctctcctggttcctgtggctacaaacaaatcattcttttggtgacgcacactaactaacagtggcatttccttaaccactttgtctttgcaggtaatccatgtttcattaattcatttctcatcttgccatttatgaagtgcggttagttttgttctaatgtaggagaattatattgatgacccaatgaaatttttattggtagaaaattttatcaaaagtaaatttagaaacagcctttgtatggtttgtggtatctgttattgccttattggcagtgaatgacctgaagaacacacaacatttaaagctgcaatagacttttttcagcttattgaccttttcatctaatagtgtgctatgctttttaggtgtatcactatttggagcccttgggtttgttctctatggaggaaggtaacattttttactctactttgccataaaaaagtgttgctattctcctgaaaatcaagaaacattctttgctctctttaatgggtgttatgtgtgcagctccatgatcttgctatgccatttccttatagagtagaccaaatgccttcttttgcttagatggtagtagagttctgaccaatttttttcactaaaagatgcagagcaagactttctttctgtaaccactattttacaagcataatcaaaatgagtagaagtggttttcaatgctagccatagaccacccattgctaggatgctgaaaactaaaattatgcacaaacatggatttgaatcctggttgttggctccaaagccacattcacaaccatagccaacaaaaaatgcatatgtctttgtgttctatgatctatatatactcatgtataaatggaaa

SEQ ID NO: 5436 - DNA, 2248 bp, Zea mays
  misc_feature (5)..(5): n is a, c, g, or t
attcncgggccgacccacgcgtccacaaaattaatggtgtctttaagaaatgcatacgtatacaaggacaacgcatgaatagcagctgcacaaaaatatagtaaggctgcactgacatttaacacttaccatgaaagaaagcaaaatcatgtaatccttcgtcagctcaaagagaagcaatattgaagtcaatgggaatgaatagactgaagctagtgtagcagccattctgacctacagaaaaatagagatagtgcacatcattacttatcgcatcaggaaaagtgagttgcaaagcaacttaccagagcctaggcttgtggcagtgcaacgacaacattaccctcagtaaagttgaaattattaaataagctaccgacgccctccaaaacagttccagcagcagctccaatcataagacttagagcatatagcctgtctaaaaggtcagagtccttgcagagggcaattgtaactacctttgcagctgctatttgagttagctatcaggtagttggagcagaagcactttcgttagtatgcaatatgtcctcgacatttgtgaaaccctagtataaaatcactgaatattttagagctatggtagcagctcctagcccacccaaagcagggtacccgcccgggcggcaagttttatacgcctaaaagaatcttgaaaaccatcctaccaatccatcaaataacacactgatgacacgtctaccttagaactcgtctacctttaccttacttgtcaatcaatgcaaaaaaacaacgatgtccaaagcctactcctaacaaaaacaatggtgagaaattatatcatcatccgtgtttgatttcaacaacgattcgcttcctcacaaagtcacaacaacagctttacctgtaggattggaggcagcagtagatgcttgtcgtcacacccacactcatcgttgttgtgcttctcgtctcagcatggccgccatctgtatcagtcgtcgcgtcactaccagcgtcgtacggaaacgcctcctgccatcagcggtgcggcgacctgcacatccatactcgttcagcatcgggttccatggaggcagccccatggaggtggcgtgcagaagggatgacgccctcggagagtgggagcaagcggcggagcggtgaaccgaaagattcgtcagtggagggggcgaaaagctccacaacagcggatacgcgtgcgccggagactgggcaaacgatagagaagatgggtgagaaggacacggcgaggaggaggatggcgtcggttcgctagatcagattgtccacatggaggcggtgtggggaagggatgacgccatcggggagttggagtagcggcggagtaaggggtggagcagcaaagatgacacgaaagttttctggaactatctcatcacttagaggaggcgcgtgagaatacgtatttctggtcgtccgacaacgatcctgtggttgatattaaacaggtgacgtggctgcacctggattcagctttgctccctgctctttattataagaattctagcatggaagagctagcagcgcccagaggagagtgatgagctccccagtccccactgtggaattgggtcgggccggaccggtccgatctaagcctattgtgcttcgtgttaaacgggtttggaccaagaaagtctaaaaaaaattatgctttgtcgtgtcagcccaaagtgtaaaaacaggggtccaacctaaccctaaattacgtcgttccttcattggatcgtgttgccccaagcccggtccatatatttgaccacataaaattaaaatattataaccacgtaaagtccatagcttactaaattaaggatattaaacaatgctaacatcatttggccatatgaaatccaaacatcacaacaatataaagtctataacttactaaattcaataaattaaacaatatgggtttaattgggccgggacggccaaagcctggcccatttatgtgggtcgtgctaggggcccgacgattcgaaatttgaggcccagctcaggcccatctttgggccatgctttgggctcatgtttttcggtcatgcttgtgttggcccaaaaagcctggcccatttatgtgggtcatgccaggggcccaacgattcgaaatttgaggcccaacccaggcccatcttccggtcgtgctttggtctcatgttttccggtcgtgcttgtgttggcccaaaaagcctggcccatttcccagcactgtccccac

SEQ ID NO: 5437 - DNA, 1822 bp, Zea mays
ctctcaggcataagcgagtttgacctatcagcagaggcgttgccttggttgatgccgccggaggaggcagacaagaggacgacgcacacgcggcaagaggcgcaggagttggacggccccacgacctgtctgcggttgctattccaggacgcagcagatgacagaattctcgccagaagggagcttggagcagcagccgacgagttcctgctccgcttgacgacgcgtcaacaggccttgacgcgcgagtactcgcgcctcgccaacctgaagaggcctctggatctctccggcatgactgaggccgaccgggcggcggaggcggagaggctgagggaggagaagctgcagaaggcgcgtcaactccaggaccagggggacatgagcggcgcccgcgagtgtgaaggtctggcacgcatcatcgacttcgatgtcaagcagggcggcgaatacctcaacagtatctgctgtgtcggcaacatctacaccttcgaccacacagaggagtcgcccgttggtccgatgagatttaccaacagaccctggcaagacaagatgtgtgtgaattgtgcgtcgataaacatcctatctgtcaagattgcatgctcggatatcgacttccccatccaagtctatggcaccgttgttgccagggactgcatcgactacaagtgtgtttacctcttccgccgagataatgaccattgccaactcatcagctctaatgaagaatcattgatcttgactggcccaaaacggggacttgcattgtggtacggtgctgattatgttcagactgatctctgggtcaaggatcgtcaagggcattgcaaacaattcagtaaggggatcgtgaggatcccaggcacagcaaatcaagtgtttgacaaatgtgagcctgaaacagtatctcttgctaccaggctcagtactgtggatgtgacatatgacgttgtggaatgtgcggtggaggcaactgttgcagctgaagttacacagggggaattctatggagcaatgactgcccacaccactagaagcaagaggaggattgtgctgtttgatagccaagtaggaggtgataaatgtcatggtatgattcaattgatgcgacctgttgtatcggtctctgtgatggacaagctgaaaattttcgtaacgaccgctgctggtgtctctacaggcattgaagttactcctagatggaatggtggacacgaatttgtactcactttaggtgacgctacgatttgtgtgaaggttacttggtcgatggtagatccacggctttaaatgggttcgcctgttcgttgttaagcatcatcggtggaagtgtagtagtgctcttgctctggtttgttgtctgaggctgttggagtctagataagtataacagtgttcacactatcatgcccgtcctgttatttagtgaaccttaatttgtctaatgttgctactcttgttatttattgaaccttagtttattctagttgcattggaagggtttattctactcttgttatttgtctaagtgcatcaattttttgtgtggtggtggtggggttctgttgctgggttctcaggtaatattttaaataaaacctgaaaatccaggcagatctcaccttttggtgcggccatggtggtcttcaccttttgctggattctcatgcttgtttgaggcagatatgatgagtggctacaaacaaactggagcgttcaggtgtgcgagcatccagagctgaacggaattgtgattctaacccaacttttttggattttagccctttttggggtttttttgcacaactatgccctttac

SEQ ID NO: 5438 - DNA, 1017 bp, Zea mays
gggggcctcccccgggcccgcccggcacacggccacacacacttcacttcataggcgccccagcagagctcatctctgcctcctgtgtccttctccatgacagagaatctccactccaggaaaatggtacagccaaagaagtttcgtggagtccggcagcgccactggggctcctgggtctctgagatcaggcatcccctccttaagaggagggtctggctgggtacctttgagacggctgaggaggcagcgagagcatatgatgaggctgctgtgctgatgagcggacgcaacgccaagaccaacttcccaatccaaagaagcagcacaggggagcctaccccagctgcgggaagggacgcccgcagcaacttcagcagcggctcctctaccaccaacctgtcccagattctcagtgcgaagctccgcaaatgctgcaaggcgccatcaccgtccctgacctgtctccgccttgaccctgagaagtcccacattggtgtttggcagaagcgtgcaggagcccgtgctgactccaactgggtcatgacagtggagctcaacaaagatgcagcatccactgatgctgcatcacagtccacatcagcaacaactgctccaccagccacgccgatggatgaggaggagaggatcgcactgcaaatgatcgaagagttgctgagcagcagcagcccagcttcaccctcaaacggagatgaccaaggtcgcttcatcatctgaaaagcatggatcaaacagcacaagtcaccatcccagatcagagtttcgctaggtcggttggtacacaagcagttcaggttgcttcagtaatatagatatatgtctattactaaatccaacttacaagaactataaagtttgcaattgtgtgcagttctatgtacgtgaaaagctctacatacacatgttcctatcaagatactttgttacacatcaatgtcagtgatataattgcttataaaagaaataaatagattatgattgtgttactgctcaaaa

SEQ ID NO: 5439 - DNA, 1138 bp, Zea mays
atcagatagcgcgctcccagtctaatcgaaaaatcggacacacctgctctcggctcgtggttcgcggcttcgcgcacgcgcagcaatggcgctccggccgcagctgcttcgcctcctcctcccatcgcctccccaccggaaccctccgcctccgccctcctccccgtccgtcgcacccattggccgccgcaccgccgcagcagccgtcctcctgctcgccgcgggcgtctccgccccgcccccgcgcgccgcccgcgccgagcccgacggcgaggacgtcgacgaggcccgcatcgtccgcctattccaggaggcgtcgccgtcggtcgtgttcatcaaggacctcgtcgtcgcggggccgcaggggcggagagttggtgaggatgaggacggggacgaggagggcggcggtgctaaggtggagggcacaggctcgggattcgtgtgggactccacgggccacattgtcacgaattaccacgtggttgcgaagttagctggagacggatctgcatctcatcgctgcaaggtgtttttggagggttctggtggcaaaagttactcaaaggaagcgaggctaatagggtgtgatccagcatatgatcttgcggttctgaagatagatgctgacagggaccagctgaggcctgctctgattggcacatcacggagtttgcgagttgggcaaagctgctttgccattgggaacccttatggatatgaacacactctaactactggggttattagtggattggggagggaaataccatctcccaatgggagagcgatccgtggggctatacagacagatactgctataaatgctggtaactcaggaggcccacttattgactcttatggccatgtaattggtgtcaatactgctacattcacacgtaaaggatctgggatctcgtccggggtgaacttcgccatccccatcgacacggtggtgcagtcggtccccaacctgatagtgtacgggacctccgtgagcaacaggttttattaactgtgttgtacatcatcatgatccgttccagtgcgtgtcctcactctgtctttgctacgctctcgttactccatatatgcgtacttgtgtgtgttaattactaccactcatttgaaaaaaagc

SEQ ID NO: 5440 - DNA, 771 bp, Zea mays
gcggctgagggggtggagggggccgtggcgaagggaggagaacacgtccggtggtggaagctgccgctcgacgcgctgcgtgtttgggcgatgcgcgcggcgaggagcgcctgttcggtgccgttcgccgtcgcgctgctcggattcgctgtgctcgggcgccggctgtacaggatgcgccgccagagcaaagccgccgcgcgcgtccgcctcgtattcgacgaaaagaaggcctcccaattcaacggccaatcgtcacgtctgaatgaatccacgacgatgatgcgccgaactcctttcataaaacctatgcttcctgccaatggagtgactccatggcctgtgctggggcacctgtgagatgtgtgatcagtgacgtgatagagctaataatacagctgccccaagccctgcagagacgctcacacttgctacaggccggcatattatgcaatgcccagcagcagatgtactggctgcttgtaattcgaaaccacgcacttgtggaagaccttgcaagcttccgttcatgcagaatgatatttaggcctgatctagcttatgcttcttttgtgtatagccacccatgtttatatttctattttctgaatccttgtatcatcgacttatgtgctggagatgtaaacgatcgagtactgagtacccaactatctatatgtagtgtgatgtatcatgtatatgacgattacccttacccataaatcaatacacaagtgaaagttagactcgcccacgcgtccgaaagcggcc

SEQ ID NO: 5441 - DNA, 2046 bp, Zea mays
ttgcgtttcctactgaggccaacccatgtggaaaaaatgttttttttttttttttgtaaaatttgctggtttactcgcgaccaaccgaatcgctgttgatgactcgtgcacaaacaaaaaaaggaatcgaattcctgcccccttcttccccacacacgctaaactccaagcaatcaagcaagcaagcgcgaaataaccaccgtttccttgcagctcgcgaatctgcggcccccgttccccgacccgacacggcacaccactcgctccagtccgccttcatccaacggttcccctcctatttgccctcggaatcccgcccgcgaaccctagccggcctccgcgagatggacgaggactgggagctcctcctcgcgtcccccaaggcggcgccggccgagccgtacgccggcggcggaggagacggggaggtcgacgccggcgccatcaagcacgactacttcgacctcggctccgacgccaagtacccccggagggcgtcgccgtcgaagggaagcgaggaggagtgtgcggaggaggggcctttcgcggcgtcggacaacgcgggctgggtggagccggaccccgacgaccttctcttccccggccgcgaccgcgcggcgctctggtcgcactcgtcctccgacggggagaggcccgaggtcgaggtcgaggttgaggccgccgatcaggtggaacgggccggggtcacggcggcggctgacgcgggcgagggggccgtggcgaagggaggagggccggcccagtggtggaggctgccgctggacgtgctgcgggtgtgggcgctgcgcgcggccaggagcgtctggtcggtgccgctcgccgtcgcgctgctcgggttcgccgtgctcgggcgccggctgtaccggatgcgccgccagagcaaggccgtcgcgcgcgtccgcctcgtcctcgacgagaaggtgacgccttcccatcatcttccctgcacgcgtcttgctcctcacctgtggatctcgccttcttcacgcgcttgttggttcttccacagtcgtctgtagaaactgatacatactctcagcttacagcttagcgatgactagcttgggtacttgcgaccttagctgctcgttgcatttttttttccttcactgaataaacgatgtcatgcctcacggtcacggtagctgactgtctttggagatgcccttgtgctgtttgtgctgaagccaaatcacagaaaagaaacaaaatactcctacaattgcatctgcggttgcttcaacttataggacttcgttgtagaacgtgaacagattatgaatggcagagcagatgtaatatcagagtattcctagatcgacgattcaacgagtcattggttggaatgctggggttagatgctctaattgatccttatccatgtttcccatcctttattgattacctctgtttcggtttgcaatgcttattctcccttactgactgaaacttttttccccctgggcttgtgcgtctctgcagaaggtctcccaattcaagggccaaggatcacgtctgaatgaatccatttttcgggcgcggcgaactcctatcataaaacctatgcttcctgccaacggagtgactccatggcctgtgctgggacacctgtgagatgacgtgatcgagctagtagtacaagtacaactgccccagcccacgttgccacaggcgggcatattatgcgatgcccagcagcagatgtactactggctgcttgtaatttggaactacacacttgtggaagaccttgtaagtttaggacctgatctagtttatgccccttctgtgtatacccatgcttatatttttatttcctgaatccttatgtcatcgatcttgtgtgctggagttgtaaatgattggatactcagtacccatggtactatggtagtgtgatgtatatgactattacccataaatcaatgcacgagtggaagcttgattatgttatgggcaaaaaaaaaaaaagtgttctgggcattcatcgccttctatccagttttcagtcattacatctacatt

SEQ ID NO: 5442 - DNA, 7088 bp, Zea mays
  misc_feature (2437)..(2437): n is a, c, g, or t
  misc_feature (3736)..(3736): n is a, c, g, or t
  misc_feature (3852)..(3852): n is a, c, g, or t
  misc_feature (5086)..(5086): n is a, c, g, or t
gcacgaggcaaggtgtacgcgttgctctcactacgtagcaggcagcagattgcagtcgagaaaacgtgtgcccgacactactgcttttgcattggctgatctgatctgatctggtctggtgtggtcgctgcaggatctacttgcctgagctcctggtcgcgttctacctgttgctatgcgcgtcgtacgatgtcgtgctccgagccgggcactactacccgtacatcttcctccaggccttcgctttcctcgtgctggggtttggcttcgccggcaccgtgacgccctgctcttgttcataagccatcgcgcgcatagcgctagcgcccatggctattttgctgcattcttccctgattcgcctcctccaaagtctgtcactagaaaagagaaagcgattctttctgtaaatcgcacagaataaaccctgcacgcgtgtgcagcatttgaccagtaacttggtttttttgcgctgactgcatgtcattttcacggtcgctgcaggccggtaagcaagaatagcagtagccctggctttgggtgcctgtgtgggtacgtgggtatgggcctggagtggaccagaggctatcagatcagccagtgccagcccatctgcccatgagaggtttgtctgaactctgaagtgatcgagtgaacccgtcgctgcaatggacagcacagtacggagtacggtacagttccacggagtcacggactcatctccagcgaggcgtcgccgatcgcttttcatcgaccacaggacggcacagataatgtaacccatgacacgaccacacggtccctctgctttttttttcctttccttgcgagaagaagcacgaggggctctcacggaaaaggcaggcgagtaacctaaagagccactcgctttcaatctgactctaaagtctactgtcctctaaataggggagctcctataccctccaagctccaatagcgcgccttttaaagcatcctttcttccatcatttatatttcaggacatcgaattttacaagaaaagcataatggttcgggacatcagcacatccgtgtcgatcgaatcatcagaatgaacatcaacagcactttttacatttgtaggtgagccgcaaaaggctcaatccacacacaaaagtattctataattttaacaacagacgcaccataccaaggactcttcttgatggcagaaaactcatgtaagccaaaaatgcatgaatacattgctccaactaccccacggctgcaggaagaaccagaggaggttttcaacttttcatgactcgtatatgggtaccggtaggaaagggaatggagccacagaagcgtaggaaactggagggcgtgattgcacacgagaaggtttcgtgtcttggcgtttctgtcttgctctttcttcgtcctgcagatcagccccgaacagaactccgtccagctcatttttctcagccaggttgtgcgccttttgttcacttggtagccgatgtaacagaagtccggacatgaaggcagggagatacagcaggctaccatagaacattctcctcgcggtcttcgggcttggttccaggacgaatgatagagctccgatggtaaggcctaatgttaggattgaagcttcaaaactgaaccactcggatgtgagcccccagttgtacctggtgccccatttaagatcccaaattgacaaaaaaaaaacacatcaagacaaggacagtagaaatccaatatgtttagtacttacagttgtacgcaaataaccccaaaggtagcatgtacagacaatttcttagcgacacccatgcagttcttctaccggtagggtcagcaaaagaaaacattcgatacctgcagcaaacagccagtcacatggccacaactttcatttagactctttacagatagatctgctagtaacgaactgggataagttaattaccctccagcaaggtaatcatttcgacataagtacgcgagagccataaaatgaggtatttgccaaaagtacaatgcggcagggagtatcatcgcgtttagtgacagttcagttgaagctgctgcccacctgtccagaggacacaataaaggatcacatcttacaaaacatgtacacaactctactgacatattcaacgtatcaaataggataagaacaaaaatactctacagcaataatcgatcaatatcaaacacacttgaaggtttccagaaaccttttatacgatctagtggaaaatgcagtgcatcatggatgggtggatattgctcaaggatagatgcaaagagtgatcaatatcacaattttgtacagatatttagtcattcacattgtaggcatcaaacttacttaatgcagtcatgatatgcccttgactaacaatagacaacttgatccttaggagagagcatatcgaatgcatcccatacttccacncgtacccctgtgtagctcagcccatagtctcatgctccaagcaccccagagaaactagttcaactagtagggaccaatgttttcaagtcgtccgattaatcgcgattaatcgtccaagtcggtttggaccaactgcaattaatcgccaagtcatcagactaatcatgattaatcgcgattaatcgcccaagtcggtcaacaagaacgaccagcaagtcgtccgacttgatagcattggtagggactgtgcttcatgcatttacaaagtggaatcaacttcacaatttgactgctactgagagaaccttcccttctatatagaccaactattgtcaactatgtatgtactttcatgcagaaaacatatacagtgccattagacaaacaactactcgaattgcacctaagaataccaaaaatggccagtaacttaccccagaagtggtgggatggcaccaacgactgccccaacccatgtattaacagggtgtatttgcttcaacggcgtatacacaaatgcatacagaacaagattagaagctgcaagcccagctgccaagccattagcctgcacaaaccttgccaattttttgcatgtttagttccagtgtcagctttctgactacctcacagcttagtaaatttcaaaagaaagtagaatatgcatctatagatgcaaagagaaagcaagaaccttccaggccagcaaagctgttcctgcaactccaacacttgtagcccacatcgcagcatgtgcaggactaatgcgaccagatggcaggggccgtcgcattgtccttttcattttagcatcattttttatctcaaacacctgaaagtacgtgttaatgatcagaaagaatacagagttgttttggcctggggcagctgaagtaagtacagcaagttcaaacagagttattcatatttggtgtaatgtgtgggaaagaggacacattaagaaaattactattttgtgcaggatcacaaagaaacgaagatttacatgcatgttagtacaacatatgttgatttagcaatgtcaaaaagtaagaaatgtacctggttgagggtatttgcagatgctgcaaccatcattgtaccggcacatgtgcaacaaaggccggcaatgtccacgatgttgccactaccaagcacatagccagcccccgaagttgccacaacaagagcactacatacaaatattggatccatgattacaaagtagaacctattctaagtgagatgccacactgctatacgatatctagagacattaggcgaatcaacaatacttgngctgcatgaaaaggttgtaaaactgaaaattttgacacccatatagcaatctgggattgacaatcccacctcactgaaaagtgataatgtcccaaggacttaaatatcagtaaganaaggagtggtgaatcctacagtgctgctggaagaaataatgaatcaccattcttagcaaaagaaggctagttgcaaaaggtctggacaaaagatggactgtccaagaaagaaatttgacttacaatctatggatttcaaaacaaagaggcaaagaagtgattgtaaccatgagcggtggaacgaagagcacagagccgaacatagcaggttagtaagttcagtgccagggattacatttgaattggaagtttgtatagattaaacaaatgaggatctacaccacatatgtgatatgtatccaaagttccaaaccatgcgaaactcaacacatagaaccatagatttgaagcaaataatcctttgttatcttaaaattctttttcccctgggaaacatcctgctggcctgtccacgaccagtaccaaatacctcagttataccaaaatgacacttaaccttcttagcactatatggatgtccgctctataccataataacagtgctttacatagctatctgtatatgtagacgacaagcagacacgaactccctctgtcccaaagagtgacattctagtattgtcataagtgaaactatcttaaggtttgaccaagtttatggagaagcttaacagtatttatagcaccaatatgaaaatacatttcattatttatctaaatatacttatttttgtaacataaattttggtattttttagtagaaacttgtttcaaagtcaagattgtttgactttggacaaagctagaatggcaccttttgggggaggggaggggtatttctttctagagaaaataccatttttacatacaatggatgttattctggttccatggtgctgaattagcattttttttaacaggaacagtgacaagtttgcactgccacagattgaattttgaacaattgtctcaattaaatttaaacactctaactagaaaagggtggagcggtattatttaatgttctaagactatctctaacagcactcctatttcatcccctatttcaaactccactctgcaaacaatatcatctacagtgcaaatctcttaatttacacggtctgttatggacagcacaagggtttagtaatgtaacagttttttactaatggaatcggacatagtagagattagctagtgcaatatgctcatgtaggattagtatcagaagaaataacatttagtattcatgctcatgtagaatgcctancacaaatgtaagaagcatattattcaaagttcctagctaacttagaatacaattaaagatcaaatgtttgcagaaaaaagcatcacaagggttaagttagcacagatagcatcagacacaacagaattctcacttagcaacaagtccatgcaaaactgagcatatggattatacacggtatgacggtatatacatcaaatacccatcaataggtttttgctcaattttgataaacatgtgccaaagatgtgcatacaaaattctaattctaattttcctagaattcaagagaagtactaaagatatccacactctataatggttgattgttaacaaggaaagaaaaccgaagaatccgttttcaaacttttgtccttaaaaatctacatatccatagttccatacgactctaggacttgtgatagttacttagttagatatacgacaacgatcgagtgaagcagcacctatccttgtgatatagtcacattataaaatgatggcttgttattcaatatatatattcggaatttatttcgagaaacgttacaacagatccatggggctggggggatcgcgcacctgaggcgggctttcgagagctcccagtagcacttcccgtagtgccgcagcgagtcggagatggatccggtatgctgagaaacggataccgctgccgccgcttcttccacgatggtgttcgccgcggcggtggacggggtggaagaggaggaggtacgcgccgaagcgattggagcgagcgacgtggccgggtggtggatggggtcgaggaggaggcgcgagcggagagccctcgcggcggaggcggctgtagagccgcccctccacatggcggctgcaggtgcgggcggcggcagcgacgaaacccggtggtggccggtgggaatggaaacacggcgtgtggggcaggtcaagatggtaagctaggctgagattcatgagaaagatagagaccgattgtttcggtttttttctgacgatcttttcttataatttaattatctgataatttaattatcataatgattaggtgcggagaaaggtaaagagattcatagaatttggatttacaaagtgatgaatttctaattttgtgacgactcgtcgattttgtagtcacgttggttttgtacggtttttaccaaaactattctcacataagcggacttaaaaactgagtgtttgcccgtttgcaaaatctgcgaagcaaaatcagttatggttctaaatttatagcaggatcacttagagttctgaatttctagcagtatttgttagcaaaatctgtgggattaactcgaaaccggcttataacgggtccagtcctcccctttatatagacgaagggttacggccattaaaacccctcataatctatccaatcaaatctacttataattttaccttatttacatcgttctttcaattcttaggagtaggagtactccagccttatgtttagatctagtttagtcttacacaaaaatctctcttcaactttacgccgattggagacgcatcgggtggcatgccgacccgaagcaacgtcttggaactctttccctcgatgggatctctcccgggggcgagttttaggattcttcgcggagaagaagacctacgccatcatggacagtccggccccgcgtggaccgtccggaagtgtgaagaggaggattcgctcctgcgtccaggtcgcggaccgtccgcgcttccgcatagagcaccgctaagtggttcgttccagtgtttggcgcccaaatatgcgctaataattataaatagatcttatggctggccttagctactcccagcatctcccatgtttgtgacgaccctttgatagatggtatcgtcactacaatcacctagccactcttagcacctttttcacatttgtgaaaaccctttgagagatgataatgtcactctagtcacttgtactcggattttgtatttggttgagattgaagagcctcta

SEQ ID NO: 5443 - DNA, 1713 bp, Zea mays
aaagcatcctttcttccatcatttatatttcaggacatcgaattttacaagaaaagcgtaatgtttcgggatttttttttttccgttgcgatcgaatcatcagaatgaacatcaacatcactttttacatttgtaggtgagccgcaaaaggctcaatccacacacacaaaaacgtattctataattttaacaacagacgcaccataccaaggactcttcttgatggcggaaaactcatgtaagccaaaaatgcatgaatacattgctccaactaccccacggctgcaggaagaaccagaggaggttttcaacttttcatgactcgtatatgggtaccggtaggaaagggaatggagccacagaagcataggaaactggagggagtgattgcacacgagaaggtttcgtgtcttggcgtttctgtcttgctcgttcttcgtcctgcagatcagccccgtacagaactccgtccagctcattgttctcagccaggttgtgcgccttttgttcacttggtagccgatgtaacagaagtccggacatgaaggcagggagatacagcaggctaccatagaacattctcctcgcagtcttcgggcttggttctaggacgaatgatagagctccgatggtaaggcctaatgttaggagtgaagcttcaaaactgaaccactcggatgtgagcccccagttgtacgcaaataaccccaaaggtagcatgtacagacaatttcttagcgacacccatgcagttcttctaccggtagggtcagcaaaagaaaacattcgataccctccagcaaggtaatcatttcgacataagtacgcgagagccataaaatgaggtatttgccaaaagtacaatgcggcagggagtatcatcgcgtttagtgacagttcagttgaagctgctgcccaccccagaagtggtgggatggcaccaacgactgccccaacccatgtattaacagggtgtatttgcttcaacggcgtatacacaaatgcatacagaacaagattagaagctgcaagcccagctgccaagccattagccttccaggccagcaaagctgttcctgcaactccaacacttgtagcccacatcgcagcatgtgcaggactaatgcgaccagatggcagggggccgtcgcattgtccttttcattttagcatcattttttatctcaaacacctggttgagggtatttgcagatgctgcaaccatcattgtaccggcacatgtgcaacaaaggccggcaatgtccacgatgttgccactaccaagcacatagccagcccccgaagttgccacaacaagagcactgaggcgggctttcgagagctcccagtagcacttcccgtagtgccgcagcgagtcggagatggatccggtatgctgagaaacggataccgctgccgctgcttcttccacgatggtgttcgccgcggcggtggacggggtggaagaggaggaggtacgcgccgaagcgattggagcgagcgacgtggccgggtggtggatggggtcgaggaggaggcgcgagcggagagccctcgcggcggaggcggctgtagagccgcccctccacatggcggctgcaggtgcgggcggcggcagcgacgaaacccggtggtggccggtgggaatggaaacacggcgtgtgagggtaagcgtggcccggccgcccgcgagggatagagaccgattgtttc

SEQ ID NO: 5444 - DNA, 1731 bp, Zea mays
acatgaaacttaaatgtccattaccatgttacttctgtctattttttttttttttttgcttccggacatcgaatcttacaagaaaagcacaagagtacatcagcatatccaattacccgaggcatcagaacgagtgtccacagcacttttttacatttaggtgagccgcaaaaagctcaatccattaaaaaaaaactatcctataattttaacaacagacccaccaaagaactcttggtggcagaaattcatgtaagccaaaagtgcatgaatacattgctctgactgtcccactgatgcaggaagaaccagggaaacttttcatgagtcatgactcatgagtcatatatgggcaccggtaggaaagggaatggagccacagaagcatatgcaaccggagggcgtgattgcatgctggaaggattcctgtcttggcgtttctgtgtggctctttctttgtcctgcagatcggccccgtacagaactccgtccagttcacttttctcagccaagttgtgcgccttttgttcatttggcagccgatgcaacagaagcccagccatgaaagcagggagatacagcaggctaccatagaacattctcctcgcagtctttggacttggttccagcacaaatgatagagatccaatggtaaggcctaatgttaggagtgaagcttcaaaactaaaccactcagatgtgaggccccagttgtatgcaaataaacccaaaggtagcatgtacagacaatttcttagcgacacccatgcagttcttttaccagtaggatcagcaaaagaaaacattcgataccctccagcaaggtaatcatttcgacataagtacgcaagagccataaaatgaggtatttgccaatagtacaatgcggcagggagtatcatggcatttagtgacagttcagttgaagctgccgcccaccccaaaagtggtggaatggcaccaacgattgccccaacccatgtattaacagggtgtatttgcttcaacggcgtatacacaaatgcgtacagaacaaggttagaagctgcaagcccagctgccaagccattagccttccaggccaacaaagctgttcctgcaactccaacacttgtagcccacattgcagcatgtgcaggactgatgcgaccagatggcaggggacgtcgcattgtccttttcattttagcatcattttttatctcgaacacctggttgagggtatttgcagatgctgcaaccatcattgtaccagcacatgtgcaacaaagtccagcaatatccacgatgttgccactaccaagcacataaccagcccccgaagttgccacaacaagagcactgaggcggactttcgagagctcccggtagcacttcccatagtgccgtagcgcgtcggagatggatccggtatgctgcgaaacggatacagccgccaccgccgccgcttcttccacgatggtgttcgccgcggcagtggacgaggtggaagaggaagaggtacgcgccgaagaaataggagcgagcgacgtgaccgggtggtggatggggtcgaggaggaggcgcgagcggagggccctagcgacgaaggcggtggtggcgccgcccctccacatggcggctgcaggtgcgggctgcggcgacgacgaggcacggtgggtggccgactggccggtgggaatgcgctccgggcccggcgtccctctttgttttcgcacgcgtgcatgcgac

SEQ ID NO: 5445 - DNA, 2287 bp, Zea mays
gaagccacagcagctgcaagctttgcttcgtccgtccgtccgcccgcccgtccccgcatcatcctgaagtcccagcatggattggaggggccgtgggcgcgggtgctgcacctgcagcacgatgcgtgcgagtggggccgggcggtgcgggcgcgcgcggtggcgccggcgctggaggccgcggcgtgggcgtgcctcgccatgtcggtcatgctcgtgctcgaggtgtgctacatgagcgtctccagcttcgtcgccgtcaacctgctgcgccggaccccacagcggcggtacagctgggagcccatgccctccgggaccgggaccgggaccgcgcggggggacgacgaggaggcagcggtgggcgatggaggcggcgaggcgtacccgatggtactcgtgcagatccccatgtacaacgagagggaggtctacaagatctctatcggagcggcatgtgccctcacatggccgcccgaccgtattataatccaagtcttggatgattccaccgatccattcattaaggaacttgtggaagtttgaatgccaaggattgggccagcaagaaaatcaacttaaaatatgaaaattcggggaaaagtaggcaaggtatacaaagcaggagccctgaagaagggcatggaacatagttacgcccaagaatgtgattttgttgccatctttgatgcagattttcaacctgatcctgacttccttttaagaactataccgtttcttgtgcataacccgaagattgctctagtacagacacgttgggagtttgtgaactacaatatttgcctactgacaaggatacagaagatgtcgctagattatcattttaaggtagagcaggaatcagggtcatctatgcatgccttctttggtttcaacggtacggctggcgtgtggcgggtatcagctatcggtgaagcaggaggatggaaggatcgcaccactgtggaagacatggacttggctgtgcgggcaagcctcaagggatggcaattcctgtacgttggggacctcggggccggccgggaactcccaagtactttcaaggcataccgtcatcaacagcacaggtggacttgtggtgctgccaacctcttcaggaaaatggccggggacattgttataagcaagggggcgactgtatggaagaagcttcaccttctgtacagcttcttcttcgtccgaagggtcatcgctcccatcctaacgttcctgttctactgcgtcgtgatcccactgtctgtcatggtccccgaagtcagcatccctgcctggggaatgttctacattcccactgccatcaccatcatgacagccatcaggagtccttggtctatccatctggtgccaatatggatcctgttcgagaacgtcatgtccatgcaccgaatgcgcgcggcgctgacggggctgctggagaccacgtacgtggacgagtgggtggtcaccgagaaggtgggcgatcatgtgaaggacaagctcgaggtccctctccttacaccggtgaagccaaccgagtgcgtcgagaggatctacttgcctgagctcctggtcgcgttctacctgttgctatgcgcgtcgtacgatgtcgtgctcggagccgggcactactacccgtacatcttcctccaggccttcgctttcctcgtgctggggtttggcttcgccggcaccgtgacgccctgctcttgttcataggccatcgcgcgcatagcgcccatggctattttgctgcattcttccctgattcgcctcctctaaagtctgtaactagaaaagagaaagcgattctttctgtaaatcgaacagaataaacgctgcacgcgtgtgcagcatttgagcagtaacttggtttttttgagctgactgcatgtcattttcacggtcgctgcaggggacagcgcggcggtgggcgagaggaggaactcccgcggctcgaactccatcgccgccgggtgcgagggccccgccgcggcggcggcggcgtcgaattgggcctgcgaggtggagcccgggccggtgaggcgctggaccagcgccatgaagtcccccggcttggtgtggatcaccttgggcgaggcgtcgtagatgatgaccggctgccgcgcctgctgctgctgctgctgctgctggtggtactggtgctgctgctgctgctgctgcgcggccggctgctgctgctggtggtgccgctgcggcgcgacgggcggcttcctgaccttgtgcgagtccttgctgacggcgagccgcggcgggcgcgggccctgca

SEQ ID NO: 5446 - DNA, 6148 bp, Zea mays
  misc_feature (2302)..(2302): n is a, c, g, or t
  misc_feature (4842)..(4842): n is a, c, g, or t
  misc_feature (5358)..(5358): n is a, c, g, or t
gcaaaacccgtcaaaagcgccagcgtgcatgaaagacgccactcgcggtaccagcgcggtggaggaggcactggcggcccatcgtccgcgccgagcgatggcgtccccgctcctgtgcgtcctcctctacctactccgccaccttacggcctgccacgccgccagggacaccatcacgccggaccgcccgctggcgggcaacgagacgctggtctcgggcggcgagggcaacttcgcgctcggcttcttcaccccgccgggcgccaacagcacctacctcggcgtgtggtacaacaaggtctccctccgcaccgtggtgtgggtggccaaccgcgaggccccgatcgcgggcgccgtcggggacaaccccggcgccacgctctccgtctccgccggcggcacgctcgccattgccgcggggaacaggaccgtcgtgtggtccgtggagccggcgtccaggctggcgagcccggccgcccagatcctggacaacggcaacctggtgctcaaggacggtgccggcggcgtggcgtgggaggggttcgactacccgacggacacgctgctcccggagatgaagctggggatcgactacgtgaaagggaagaacaggacgctgacgtcgtggaaaagcccgtcggacccctccccgggccccgtggccatggtgatggacaccagcggcgacccgcaggtgttcatctggaacggcggcgagaaggtctggcggtccgggccctgggacggcgtccagttcaccggcgtgccggacacggccacctactccggcttcaccttcagcttcgtaaacagcgcgcgggaggtgacgtacagcttccaggtgcacaacgtgtccatcatctcgcacctgggcgtcgtgagcacggggaactacgggcgcctgcagcgctcgacgtgggtggaggcggcgcgggcgtggaacctgtactggtacgcccccaaggaccagtgcgacgcggtgtcgccgtgcgggcccaacggcgtgtgcgacaccaacaacatgccggtctgctcctgcctccgcggcttcaccccgaggacccccgccgcgtgggcgctgcgggacggccgcgacgggtgcgtgcggtccacgccgctggactgccgcaacggcaccgacggcttcgtcacggtgcgccacgccaaggtgcccgacacggagcggagcgcggtggactggagcctgacgctggaccagtgccggcaggcgtgcctccgcaactgctcctgcaccgcgtacgccagcgccaacgtcagcggcggcgccggcggtgggcgccgcgccggcgccggctcgggctgcgtcatgtggaccacggggctcaccgacctgcgcgtgtaccccgacttcggccaggacctcttcgtccgcctcgccgccgtggatctcggtacgtacgaacgaacgaacgccgccgccccacttttgtacactgtatatgcattggtagtagcacatacgtactccgtattatcatatcgtcgttcagtgatccgtccaaaacagagttccccccggcccggccgcctcttttttttttccacgaacataatcgccgtcggtgacccctgccccgtccggcaaattaaagacgacggcgagaggcactgaggaaggcgtcacccctcattcagctgatggagagatggatggaggccatgtgttatccgtttttttttaatatatattgtaggggctgctgcgatcgtctttacgctttaacccgtcctcgttaattaaagtacccctcaactccttttatctccaatatgagaccgttagatgccgaggtcgtgcaataatagtcgagagggagaaaggtgaacaaaaaaaaagagcttttcctgagcgagacagcggccccgttgagtgagtgtcctctcctctctagagcagagagcagcactgcctaaagcggtaagctttggctgcagccagccaagcccaaaaagtcaaatgataataggacaggactgttgattgttgtcggttgttgctgcagctgcaatgtacgtgcatcaccggaggcacgactcttgacgtgctacttcaccgtgcagctgcagcacctgccagcttactgctgcattatgtgaagatcaaactgcttgtgaccctctatagtttatagcctcatttaattcaaaattagtttttttgagggatcattcaatggttggagacaaagggttccgagcttactacaaaagccttcattattgcatctgacaatcacagacattttacgactttgctttgtctcgacgtatttttttcgtngtgatgctaactctaactaggtttagcctaaacccaaaaaaacgtccacctaaaccaccaaaaccctcataaataccatatttggtacattccctccacaatctcaacacaacacctccagcatcgtccgcctgatcaaagtcctcgagcggctctgcttgacttggtcaacggttatcctaacttgatcaatggtctactcctccaagtattattattacatttgttaatatccacatgtgtcagtcacaagctatcaatcttcgtcctctttggtccctcggtctaagccttatgacatcgtcattcacacctagtctatcggagtgaacctgcttatcctttatcatagtcgccaataatctttctagctttttcacacatgttcaccaagccaaaaaaagacatattacataatactgtggaacatgtgggtatatgtcaacattgggtttaagcccttttctctcttcttactattctatatactacttttgttcacaaatatatgacactgttgacttttttcgagaactttgaccattcttcttattcaaaatatttattcaagaacgtgatttttttagtcaagcataagctaccttaagtgataaaacaaatcacaaaaaataaataataactcattattttgttgaataagacgagtgattaaagtttttttaaaaaatcaacggtgttatttatttataaatgagagtagtatagttttagaaaattatataacattgtatgagactgggacagagaccgtcggattcgtggtcacgctcgcgtcgaccatgctaaatttgcgtggttgcgatggcaaatctcccgagcgctgcaagcctgtaactgtcgcgcgcagcctgacacgttattagaatgcggaaaccgtccacgccagttgccccgtgaaaaaaatattataaaaacacatggtttctgacgcagtgacgtgtaccgccttttttcatccactgatcaatccaaagcggggaaagcgacaggcaagtctcccttttccgggtgtgctcaagcctcaagcacaaagaaggacgaccgttgcatagtacttgtacgaatggcgagactggagccaccgtttcctccgtggagcccgaaccgatagggacgcgcgcgcttgtgcagcatactgggcccgcaccgaagtgaaaacggccgtatgggcccggcccgccgcccgcgagaagcaaagcacatgcgcagccgcaccgcgggtccgtccagggcaaagcaaaccccacggcccacgggtcggtccccgccatctctgtcgtcggcgtgcaggcctgatctagctagctagctagcatctcacgaagacgaagcagcagaagcaccccaaatcacaaaaaagttagcaaaccattggatcgtattcctctaggtcagtatgctgaggattactgctgtgaaccgctaaactactaacattcacgcatgatttcctgtactacagatgtagaagctaaatcaagggaggcgcgcatcaaaatcgcagtcggcgccagcgtctcggcgctggcgcttcttctagcagtcgctggtctcctcatctggtcatggaggagaaggctaacaagaacagacggtacgtaacacgatcatcacactctgtcagaacggcacaaatgcctcaatgcagcagaagggacagacggcttgatcttgtcctgacgtttacactgacgataacacaggatcaagtaaatggagtagctcccgccccaccggccgccggtacgagggaagcagccacggtgacgacctggagctgccaatatttgatgtggggacgattgcagctgccacggatggttactcgatcgaaaacaagcttggcgagggtggatttggaccagtgtacaaggtgggcactctgcaatctacatgaacagagtcagatatgcatatacatgctagcatttcttttcaaaatgccttcttttgagttctctctactagtatcccaagtcccaagcaagtcctgaagaatccagctcctgtgtggctaactagggtggttcccatcgatgttgcagggtaagctcgaggacggaatggaaatcgcagtgaagacactctcgaagacgtctgcacaagggcttgacgagttcaagaacgaggtcttgttgatagccaagctccagcatcgcaatcttgtccggcttcttgggtgcagcgtcagtgggcaagaaaggatgcttgtttacgagtacatggcaaacaagagcctggactatttcctgtttggtacaagtcacaaactagcctttctatgctttcaagaaaacagcctagcttttctaaccatgagaatttcatgatgcttccatagtttttttttaaaaaaaactaactaacctgctcctgtacgtcaacagagaaggacaacgttgtgctcgattggcaagtgcggtaccgtataatagaaggcattactcgaggtctactctacctccaccaggactcgagatacaggatcatccacagagatctgaaggcagctaatgtcnttctggacaaggagatgacgcccaaaatctcagactttggcatggcgaggatatttggcaacgaagagacagaaatcaatacccgaaaagtggtcggcacgtagtaagttctgaattgatacaggaacgcaattgatgttcatcatacaaattcatctttgcagtactgatcgagttcatgtgcgtggctctttattttacagcggttatatgtctccggagtatgcaatggatgggatcttctctgtcaagtcggacgtattcagctatggagtattgctgctggaaatcgtcagcggtaggaggaacagaggagtgtattcctattcaaacaaccaaagccttctaggccatgtaagtgacaacttgcctcgtctagtgaacaaataccagttgtatgaaacttctgaaacctggtaaccgttttcccccccgcaggcatggagcttgtggaacgaggagaagagcatagagctagcagacggaaagaaatgaatgggtcgttccaactcggancgaagtgcacaagtgcatcagagttgggctcttgtgcgtgcaggagaacccagacgaccgtccgctgatgtctcaggtgcttctgatgctggctagtaccgatgccacctcactgccaactcctaagcaacctggcttcgccgctaggagagttctgatggaaacagacacgtcgtcaaccaagccagactgcagcatatttgacagtgcaacaattaccatgcttgaaggtcgatagtagtagttatgagttatgactgaaatgaaacttaaactgctagggaaatgtgtattgtagagtaaatttggcggcctcttcagtatcttgtgtgcttaagcagcagaaaattatatgaatattgaataatagcaggcagcagctggtagaaactttgttgcttttagcgccgattagtgatacataatgctggacactaagaaatttataaattttgctaatgttacaaagcacttctgttatgatcggacgccactgcaggcggcggacaacaggagaggcggcggcgaccaacaataagtatgcagattagtctgataaggattagaagatttaggagataaggtttgttagaaagaaaagagaagatctcatacagattagttagatgatgtttaggagattaaagacataaagtttgttagagagaaaagagaggatcttagatttaatctctttagaaaaggactagaaggaagtataaatacttgtaaccccccctctatatgaattaagtagaaaattatttagcataaaaaaaaaaaaaaaaaa

SEQ ID NO: 5447 - DNA, 1602 bp, Zea mays
gactagttctagatcgcgagccggatccagcaaatggagcggctcacgcggcaccggccgtcggtacgaggggagcagccatggtgacgatctggagctgccaatatttgatctgggcacaattgcagccgctacggatggtttctccatcaacaacaagcttggcgagggtggctttggaccagtatacaagggtaaactcgaggatggaatggagatcgcagtgaaaacactctcgaagacatccgcacaaggtcttgacgagttcaagaacgaggttttgctgatagccaagctccagcaccggaatcttgttcgccttctcggatgcagcattagcggacaggaaaggatgcttgtttacgagtacatggcaaacaagagcctggacttcttcctgtttgagaaagacactgtggtgcttgactggcaagtgcggtatcgtataatagaaggcatcactcgaggtttactctacctccaccaggactcgaggtacagaatcatccatagagatctgaaggcggccaatgttctcctagacaaggagatgactcccaagatttcagactttggcatggcaagaatatttggcaacgaagagacggaaattaacaccttaaaagtggttggcacatatggttacatgtctccggagtacgcaatggatgggatcttctctgtcaagtcggacgtgttcagctatggagtactattgctggagatcgttagtggcaggaggaacaggggagtgtattccagttcaaacaaccaaagccttctaggccatgcatggagcttgtggaacgaggagaagagcatagagctagcagatgagagaatgaacggacaattcaactcagacgaagtgcagaagtgcgtcagggttgggctactgtgcgtgcaagagaatccagacgaccgtccgctgatgtctcaggtgcttctgatgttagctagtcctgatgccgcatcactgccgactcctaagcaacctggcttcgcagctaggagagttctaatggaaacagacacatcatcgaccaagcccgactgcagcgtgtttgacagtgcgacaaccatcatgcttgaaggtcgatagaagttactcgatcactcgcctcagaataagtgtcgtgtcagtcaagttttttttaaagttttgactaggtttgtagaaatattagcatcttcaaataagtttattaaaaatagatttaatgatctatctatcatatatactataaatattaatatttttatatatttagttacatttaaaattatttgatttctagaaagcgagacagctcttattttcggacggaaggaacatgactaacacaccttgttgaaactgaaactagtagaaaattttgtattctagactaaatttcgtggcatcttcagtatatcttgtatgattaggcagcaaaaaagttatatggatattagataatagtagtaagtagaatcttcgttgcttttatcacagacaagtgacacatcgtctgaaaattgagaaaaaaatgacttcattggtcacaaatgacactccttattgctctgtaacgatcgtaacggcgtaatcggttggcggta

SEQ ID NO: 5448 - DNA, 2489 bp, Zea mays
aattctgacaagcaccgcggccgccgcacacgcaacacacacgcgcacagtcaccaggacagcaggctgccaggcaggcaacacgcggacacccaattattcacccaagacccaacacccgcccaggcagcaagacaaggacaagggtctccaccgcttcccctcccctcccctgctctgctcctcgcctcctccctcccgaatcccgatcccagcttccctccttcctcccgcccacgccgccaaatcgagccccagccgcgatgagttggtggtggacgggcgcgatcggcgcggtcaagaagcgccaggacgagcaggcggccgccgccgagccctcctaccagagcgtcgccctcgtcgtcggatccaccggcatcgtcggcacctccctcctcgacatcctcccgctcgccgacacccccgccgggccgtggaaggtctacgccgtctcgcgccgcccgctcccgccctggtccccggcgccctccccggccgtcacccacctccacctcgacctcgccgactccgccgccgtcgccgaggctctccagcccctcaccgacatcacccacgtcttcttcgtcgcctggaccagccgccccaccgaggcggagaaccgggaggccaactccgccatgctccgtaacgtcctctccgtcgtcgtcccgaactgccccgcgctcgtccacgtctgcctccagaccggccgcaagcactacgtcggccccttcgaggccatcggcaaggtcgccgccccggacccgcccttcaccgaggacatgccgcgcctcgactgccccaacttctactacgacatggaggacatcctcttccacgaggtctcccgccgagacggcgccgtcagctggtccgtgcaccgccccaccaccgtcttcggatactcccctcgcagcgccatgaacctcgtcggcagcctctgcgtctacgccgccatctgccggaaggagggcacgacgctccggtggcccggctctcgggtcacttgggagggcttcagcgacgcctccgacgccgaccttatcgccgagcacgagatctgggccgccgtggatccgttcgccaagaacgaggccttcaattgcagcaacggggatctcttcaagtggaagcagctgtggccgatactcgccgaccatttcggcctggaatgggctggctacgaaggtgaggagaacaggttcaagctcgaggaggccatggccgggaaggaagctgtctgggcagagattgtcagggaaaacgaccttatagccacggagcttgacgagatcacgaattggtggttcgtcgatgccatgtttgctgtggagacccagcttctggacagcatgaacaaaagcaaggagcatggcttcctcggcttcaggaacactgtcagctctttcaacacatggatcgagaagctgaaggtcttcaagattgttccctaataataattcatccttgctattcacttctatactgttgttctgcatccttattatcctgctcatttatcagcaccagttctcctgtaattcaaacatcttgctatctgtgccaggtttgcatgttatatactagggaccaataaggatcaacacattgcaaaataggttattcttgtccagcatgggtttgattgaaattgtttgtgtattgaattactagctgaaaccgttcttgtttactagcattgctttatctgtgaatcggttggtgcatcaatcaattatctcccatctgtggtgcattcttgtataaggctctgcttctttcattacaaacattttgagaagccacttaaatctttttattttggcattaataatcactgcactgcatgctttgatatctttatgctttttggtgattatactttataccttcatgcttcttggtgatatcatacgggaggaaatgaatacactaacagccttacatgaaaagatagacaaacgagcaagaaccaaagccttgctacacattttcctggaacttggtctctacaatgtctcagactctctcggtcatcagtcatatacaaggccagttttgcctcggatgccccatctttttgctgcagtttttcttttgcatcggatgggatggaaaacctgttgcacaaagtttttcttttgctgagctctggattggttagtaattgaagctcaaggaaggcacgtcttctttgtgctcttattctggtggttgtgggcatctttgacaagtcactgattggctctgcaaaatctgatttgggttctgcaaccgaaacccaccttgcgtgtatatcgatgactcatcccgattttagatgacggaggtggttatgtgaagaatttcgccgcggccgggaggtgcgtcttttctgcatagtgaaatgatttgcgtaaacagattggactggattgcttcatggtgtaaactgtgattatagataaataccccacttcggattgattcatgctgtaaagggatgggta

SEQ ID NO: 5449 - DNA, 4586 bp, Zea mays
  misc_feature (1674)..(1674): n is a, c, g, or t
  misc_feature (1840)..(1840): n is a, c, g, or t
  misc_feature (2258)..(2258): n is a, c, g, or t
  misc_feature (2344)..(2344): n is a, c, g, or t
  misc_feature (2594)..(2594): n is a, c, g, or t
  misc_feature (3324)..(3324): n is a, c, g, or t
tcaatatatatctagaacagagaattatagagctaatagcttggcgcaagaagatttatggtatcagataatcaaaggaaaattccatatttctaagaatccgataatcagtgccagaaggcagcggctacatgtttcgtaccatccacagatcaggcatcggaccatccggatgtggtcactagaccgcccacagttgatagaagcatcgcggtaatggcttaggccaatttggctgatgatgtggccgatacgttagattggaggatacccctaattacttattttcaaatcctaatgttagggaacataagagtattcgacgaacatcttttaagtataaatgatctcactgataatgaactttattgttgaactcctagtgatgttatgtttagatgcttggttcttgatgatgctatattagccatggttgaagtacatgaaggcatttgtggtacttaccaatcggcttcaaaaatgaagttgcttttaagaagggctgggttttattggcccaatatgattgcggattgttttaagtactataaaggatataaagtgtgtcaaaaatcagtgatttatagatggttcctattgtcgaattacatcacattatcaagtttgggccctttagaggctggggttttgactttgtgggcgaaattcatccatcatcgtccaaggagcataggtttgtatcagcaactacatactatttcaccaaatgcaccgaagttgttgccttgaagaatatgacacataaggaggtgattgagtttgttactaggcatattatccatagatttggcattccaaaactttgactacagattaggggacttcttttatttccaaagaggttcgtgagtttgctggatcatataggattaagttgctcatttcatctccatatcatgcttaagccaatggtcagaccgagttaagtaataggatattgattagccttattaagaagaaaatatctgatcatcctaggcattggattgaagttttgtctgaggccttgtgggatcatagaataagcattatgctactaaggtttctccttttgagcttgtgtatgggcaggaatctgttttgcctgtggatataataagcttgaattctatcagatttgctaggcaaaatgatctatctattgatgaatatcatgacttgatgatggataatattaatgaggtgaccgacaagaggatgatgactctaaaggagattgagaaagacaagcttatagttgccaaagcctacaataagaaggtaaaggctaagtcatttcaggtcgaagatctggtctgcaagacaatcttgtagggactagaagtttagcaaatagtccccaaaatgggaaatgccttatagagtcacacatgtaatatctagtaaatgtgtacatgctggaaacattgcaaggtgagaagttacctaaggcattaaatggtccttatctaaagcaataacatcctagtgtatgacaagatacttaattagaaggccgatgttctcacatcgagttgtattgattagaaagcttgtaccaggtgcttttggtttgctaagatccaccaaaaggcatgaggcatgtgttgagcaccatatttggcacatggacgaccgatcggtccagccttatggcctaggcggtccaaactntgggcgttccacaagataacccggatggtgtgcaactattaattctggctagaatccttatctcttgtgtgattatcctaacaaaaccattggaaaccgcttaagaatgggtctagatccccctatatatatgaaggggtacgatcgattaaaacacacaataatnaatgtatcaaccaaattttaccatatatattgggagtatgagtaatttagctttagacctaaatattcacctctcttcggttctatatcatctagagacatcttgggtgacccgacgatctcaaggcaactctaggatctttcctccctgcggggtccaaccgggaggcaagatctagggtctgcaggagattcacgaagccctctacaccctcacggacggaccacgacctccacgctaacggtacgcgcgcctgcagagaagagcggagctccttacacagagtcgcgcgcccgtagagaagagcgaaactccctacacagagtcgcggatgatctggtaacctatcgtggatagtccatgatcccacagaaggtctcgtccccagcacgcggggtttagggatcgttggtgtttngtccaaaaagacgctaacacccgctatttaaaactttgctttctaaaccgtagagtatacaatataaaatactctctctccatttnaatttataatttatttgacttttttaccttaactatgaccggctcgttttattaaaaaaaattcataattattgttaatttttgatgtgatattatttagcatataatatactttaaatgtgaatatgaacttatcattttttcgcaaaaaataaataaatagaacgagccggtcaaacgtggcacaaaaagtcaaacggattctatggccccctttggcagagctctgactcataaaaaaacagtttcnatttaggctccttggtttctctagagaagccgatagaagccatatttttggtgctctggattacagtaataaaacggctctggctctcgaaggactctcaacaagaaacccttttttgtgatagtttggtaaggacgtaaggctttgcaataagctcgaccctcaaaagagacatgccaaaagagccctaattttaggctgaaggagcagtgttttgtacgaccatccgttgaggacgtacattacgtggacaagagaggcggccagatataaataagataacatatctggtgcacatagaatattggtgcacatggtgtacatattaaatcatcaccactcattttaaatctaacgtcttctagttgtttgatatattttgctaaggacaccctataacttggtggtgtgtagtggtggaagatgttatttgtaaattgaataatcaactaaagacattaaatctaaaattagtggtgatgatttaatatatgcaccagtcttttatgtgcaccagatatatcctctataaataaatgttgtagacctgcacgctgcacctgcaatacctgctcccccttgagtctgcaggttttttggccggcgtacagcaatgagcttgagctggtggtggacacggtctgtcggcgcagacagggagcgcaaggatgagcttgccgccgtgcctgagcattccttccagagcgtggccctcgtcgttggctccacnggcatagtaggcgcctccctcgtggacatcatcccgcgggcggatacccccggcgggccatggaaggtatacgcgctctcccgccgtccacccccgccctggtccctgccgtcatcctcctcgctgacacacataaacgtcgatctcaccgactccgccaccgtcgccgaggccctcacgccgctcaccgacatcacgcacgtcttctacgtcgcctggtccccgcgcgccactgaggcggagaaccgggaggccaactccgccatgctccgcaacgtcctctccgtcgtcgtccccaactgccccgccctcgcccacgtctccctccagacgggcaccaagcactacctgggacccttcgagctcattggcaagatccccactccggacccgccctacaccgaggacgtgccgcgcctggactgcccaaacttctactacgaccaagaggacgtcctcttcgccgcagtctcccggcgcggcggcgccgtgagctggtccgtgcaccgccccaacctcatcctcggcttctctccgcggagcttcttcaacgtcgtgtgcagcctgtgcgtgtacgccgccatctgccgcaaggagggggtcgctctgcgctggccggggtgccttggctcctgggagagcttcagcaacgcctccgacgcggacctcatcgccgagcagcacatctgggcggccgtcgaccccatggccaagaaccaggcgttcaacagcaacaacggagacctttacaactggaagacgctgtggccggtactcgccgctcgtttcgggctggagtggaccgggtacgacggcgaggagaagcagttcaaggtgtcggaggccatggccgggaaagaggcggtgtgggcggagattgtcagggagaacgggctcgtggagacatgcctccgcggcgttgccgattggtggcttatcgacgtcgtggtctatgagcatggcgccaactggaagcttttggatagcatgaacaagagcaaggagcacggattcctcggcttccgcgacacagtgaagtccttcaacaagtggattgacaagatgaaggcctacaagattgttccttgaatgtaccttggattggatgtttattctggtcagtttctttgataacgctggctgcgacatcttttcagtatcaggtatatatcaaactgttcccgaggaatcaaataaagatgaatacgtttgttcttctgtcccttgtattgtgaaataaacatgaatctattcacatgtgt

SEQ ID NO: 5450 - DNA, 1495 bp, Zea mays
  misc_feature (1480)..(1480): n is a, c, g, or t
ggaccctcgagttcgccgggttaggcacgagaccattacggccggcacggacctcaggccagaaaaaggcttcgccttggtccttggatccccccacacaacgcagcacccgcactctccaggcgtctgccaatccgaaacgaaacccacccgtaggcaaaccaggactgagattgagcggagagcagcacagtcatggcggggcaggaggtggcgaacaagcgggtggtactgaagcgctacgtgacggggttccccggcgcggacgacatggaggtggtcaccggcaccgcgcgcgtggccgtgccgccggggtcgacggccatggtgctcaagaacctctacgtgtcgtgcgacccttacatgcgcggccgtatgaccaagcacgagaggcccagctacgtcccggacttcgtcgtgggggaggttttggaaaactttggcgtctgcaaggtgatagcatctgggcaccaggatttcaaggttggggatcttgtgtgggggatgaccggatgggaggagtacactctcatccataacccggagtcatttttcaagatcaatcatcctgaattgcctctgtcctactacacaggcgttcttggcatgccgggccttactgcttgggctggatttttcgatgtgggcaagcccaagaaaggcgataatgtcttcgtctcagcagcatcaggagccgttggtcagcttgttgggcagtttgctaagctcacaggatgttatgttgtcggcagtgctggttctgacgagaaggttaatcttctgaaaacaaagtttggcttcgatgaagcattcaactacaagaaagagcaggacctcgatgccgccttgagaaggtacttcccagagggcattgacatctacttcgagaacgtgggtggcagcacactggaagccgtgcttcccaacatgcgtatccatggtcggatccctacctgcggaatgatctcgcagtacaatctggaggagccagagggtgtgcacaacctattcgaaatcatcgctaagcgcctgcgcatggagggtttcatggtcttcgactactacggccagtaccacaagttcgagcaagagatggccgggtacctcaaggcggggaagatagcctacgtcgaggacattgctgaggggctagagaaggcgccggaggcactcatcgggctcttcaccgggcgcaacgtcggcaagcaactggtcgccattgcgcgggaatgaatgctggacatccatattatatctacgttgagaataatgtcagcatgcgtgttcagatgtgttaggaattgatgatttgtagtgcttgcagttttgtgctgttcgtgtgaaatgtttcgattttctgccgtttgttttctgggcgatatgcgtgtgaaaactcagcacacgcgcttcttctgaggagaaatagacaagcagtttgccgaaaaaaaaaaaaaaaaaaaaaaaaaaaaaaaaggaattnaaaaaaaaaaaaaaa

SEQ ID NO: 5451 - DNA, 2303 bp, Zea mays
  misc_feature (650)..(650): n is a, c, g, or t
ctccccttggatccttgtttgcttcctgctgcctggccttctctcctccccaaaatcaatccctcgcccacaaaggagagccagccaaaccttccacctcctccatttccagccccgtccccacaccagctcgcgtaacctcctccccatggctggaggcggcggcgcaggcgcgggctcgtcgtccggcggcggcggagggggcggcagggagggcgattgggactgcggcagctgcggcaaccgcaactacgccttccgctcgctttgcaaccgctgcaagcatccgcgcctcctcgtcgaccccaacaccccgcgcgactccaagtggctaccccgcgccggggactggatctgcaccggtaacacctctcctgccacgctacccttcattattacccagccctgaatcacccgtcacttgttgtagatgcaggctctcatccatccctatgcagcgcattgatagtctagtgaatctagcatttctccttcatcccttgtgttcgctctaggtttagtatgttggtatagccctggttattattgtagactttgggtctgtttggattcaagatctaattactagctagctaaaattagctaaaattgattctagtgcatccaaacaagagggctaatagacgtgntaattttttagccaagtttttaactagctgttagccaactagctagccaaactcagctagattttaacccatctagtagccctaactcatccaaacatgatcttttctagtcatgcagacaacattttaataaggtaagttagttgcatttgaaatgatgagtgtttattttttaaaacagagcaggtgtaaataaaggaactagaaacttcattcaaactaagaaaggaaactctacaaattatttgaccaccgctccttaagctttccatgcaaatcagttcattcaccctctttgatctatatttttttttgaccaaactgtatacctctcttataagcgcgggtacccgccgggtttgcccggccttatgttctgaaagtatcttggatgatctttgtttgtgttttaattgttgctactacctattagaaatattttcattattccttctgtttattttgttcattgaatgctgctatatgtagataatattagaaaaaaaactttaccaatgagtgtgctaagtaatgactagtgtgcgtgtgtctattcctttctatgggtttgtgcgtgatggctggtcatggtggtggtgggtgtgggtgtgcttcggtgcgttttgctgcctactgtgctggtgggtttatgcggcaaatggatgaataggttgcagtaacaataattatgcatccagaaagaactgcaaaaagtgtggcttgcccaaggaggaagcagcaatgccagcattgcaaatggcagggatgactatgccagcttatgcaacttatattgcaagactacaaagccttgctgcttctgcttctgcctataacatgaactttgggatggctgccaattcacctttgcagcagcaactacttgcaaatgcaaactggccctatgggatggctggtagatatgggatgcaatcttctggttggccatttggcaacggcaacccaaatcagtttttaggtgttccaaaggattggcgtaatgggagattggctctgcagctgtggatctcataactattcatctcgtactcagtgcaaaagagtgtggtgcacctgtaccatcgagcattccctccacaacaatgaaagctacatctgatgcctcttccacattaggaacctaagcggttgggcttcagaggacctggccaatgactgggaataataaaaggctaaatccaggaaatgacaattatccactttcaacaggagctgcaaataatttatttttgggtattgagcaaggagctggaagcagcaatggccagtctgcctttcccaaatttgacaatgggagctcaatggcattaccatctgggcagggaatgtctggtcttatgggaaaagggtgcaaaactcagaaagaatctgcagttccccctggtgtgttatagcttgctgttggattattttgttccaggatatgttgctgcctgttctagctccttcctcaaggctgcggtttgagttttttcgattctgcagtgtttttgctgctctcaaatgtttgcctcgatatttcattagtgcttgttgaagttccccatttgtttatggtatgggcgcttgaataaaaaaaaaaaaaaaaaaaaaaaaaaaagaaaaaaaaaaaaaaaaaaggaccctagggcc

SEQ ID NO: 5452 - DNA, 1539 bp, Zea mays
agtctggtcacaccccttcggatccttgttcgcttccggcttccctcgttctctgcgtccgcccctgccgggccttgtcttctcccccaaatcaatccctcgcccacggacccaaccaaatcctcctccacctcctccatctccagccccgtccctacccagctcgtgtaacctcccgatgtccgggggcggaggcggcgcaggcgcgggctcgtcgtccggcggcggcggcggaggtggagggggcggcagggagggcgactgggactgcggcagctgcggcaaccggaactacgccttccgctcgctctgcaaccgttgcaagcagccgcgcctcctcgtcgaccctaacaccccgcgcgactccaagtggctaccccgtgccggggactggatctgcaccggttgcagtaacaataattatgcatccagaaagaactgcaaaaagtgtggcctatccaaggaggaagcagcaatgccagcattgcaaatggcagggatggctatgccagcttatgcaacttatatcgcaagactacagagccttgctgcttctgcttctgcatataagatgaactttggggtggctgccaactcacctttgcagcagcaactacttgcaaatgcaaactggtcctatgggatggctggtagatatgggatgcagtcttctggttggccacttggcaacagcagcccaaatcagtttccaggtgttccaaaggattggcgtaatggagactggctctgcagctgtggatttcataattattcatctcgtactcagtgcaaagagtgtggtgcacctataccatcaggcattccctccacaacaatgaaagctacgacatctgatgcctcttccacattaggaactaagcggttagcctcagaggagctggcaaacgactgtgataataaaaggctaaatccaggaaatgacaattatccactttcaacagcaggtgcaaataatttgtttttgggtattgagcaaggagctggaagcagcaatggccaggctgctttttcgaaatttgactatgggagctcaatgtcattaccatctgggcagggaatgtctggtcttatcgtaaaaggggcaaaatggcgcgacggggactggttgtgcaacaactgcaacaaccacaactacgcatctcgtgcgttttgcaacaggtgcaaaactcagaaagaatctgcagttcaccctggtgtgctatagcttgcttttgctggttcatattgttggactcgtttgttgcagggtcgtgcgtatggttgtggaaaacactattttgcagctgcaatggttagagatttgaaatatgagggaaaatatgagatgagcctcatgctgttgtgcatcatcgatcagaccactataagtaggactggaaatggatgtctggagatccgaattattcgtatttgctgaaaccgttaatatggatatccgtatctttattcgatttcaatatggatgtcaaatgtatacattcgaatttgatttataatacttttcttttatccgattcg

SEQ ID NO: 5453 - DNA, 1574 bp, Zea mays
cccggttgctcccccttggatccttgtttgcccccgcctccccccccttctctcctccccaaaatcaatcgcccacaaaggagagccaggcagccagccaaatcttccacctcctccatttccagccccgtccccacaccagctcgcgtaacctcctgcccatggctggaggcggcggcgcaggcgcgggctcgtcgtccggcggcggcggagggggcggcagggagggcgactgggactgcggcagctgcggcaaccgcaactacgccttccgctcgctctgcaaccgctgcaagcagccgcgcctcctcgtcgaccccaacaccccgcgcgactccaagtggctaccccgcgccggggactggatctgcaccggttgcagtaacaataattatgcatccagaaagaactgcaaaaagtgtggcttgcccaaggaggaagcagcaatgccagcattgcaaatggcagggatgactatgccaacttatgcaacttatattgcaagactacaaagccttgctgcttctgcttctgcctataagatgaactttgggatggctgccaattcacctttgcagcagcaactacttgcaaatgcaaactggccctatgggatggctggtagatatgggatgcaatcttctggttggccatttggcaacggcaacccaaatcagtttttaggtgttccaaaggattggcgtaatggagattggctctgcagctgtggatttcataactattcatctcgtactcagtgcaaagagtgtggtgcacctgtaccatcgggcattccctccacaacaatgaaagctacatctgatgcctcttccacattaggaactaagcggttggcttcagaggacctggccaatgactgggataataaaaggctaaatccaggaaatgacaattatccactttcaacaggagctgcaaataatttatttttgggtattgagcaaggagctggaagcagcaatggccagtctgcctttcccaagtttgacaatgggagctcaatggcattaccatctgggcagggaatgtctggtcttatgggaaaaggggcaaaatggcgtgacggggactggttgtgcaacaactgcaacaatcacaactatgcatctcgtgcgttttgcaacaggtgcaaaactcagaaagaatctgcagttcaccctggtgtgttatagcttgctgttggattattttgttccaggatatgttgctgcctgttctagctccttcctcaaggctgcggtttgagttttttcgattctgcagtgtttttgctgctctcaaatgtttgtctcgatatttcattagtgcttgttgaagttcccccatttgtttatggtataagcgcttgaataaaatgtttctggaaagtaccggcctacaatctggattttggcaaaataattgaattagttgttgtacaatgaagctgtacaatgaagcaaattgtcttacgttgtactttatgaactctggagtattatcactcgtcgggttgaaagggggaactatacaatgtaatttcagtacagattattattttttcctgagactcc

SEQ ID NO: 5454 - DNA, 792 bp, Zea mays
ccacacgtcccgcctcagaggagctggcaaacgactgtgataataaaaggctaaatccaggaaatgacaattatccactttcaacagcaggtgcaaataatttgtttttgggtattgagcaaggagctggaagcagcaatggccaggctgctttttcgaaatttgactatgggagctcaatgtcattaccatctgggcagggaatgtctggtcttatcgtaaaaggggcaaaatggcgcgacggggactggttgtgcaacaactgcaacaaccacaactacgcatctcgtgcgttttgcaacaggtgcaaaactcagaaagaatctgcagttcaccctggtgtgctatagcttgcttttgctggttcatattgttggactcgtttgttgcagggtatgttgctgcctgttctagctgcttcctcaagactgcagtttgagttttttcggttctgctgggtttttgctgctctcaaatgtttgtctcgatattccattagtgcttgttgaagttcccgatttatttatggtataagcgcttgaataaaatatctctggaaagtactggcctaccgcctaccatctgtttttttccaaatatttttattagttgttgtacaatgaggcaaatggtgatatacttatgttgtactttatgaactctgtaggattagtgcaccaaattaaggttttgtggccatgtttcagtcgtcgggttgaaaaagggaactataccatgtaatttcattacagattattattttttccgagaactccaaaaaaaaaaaaaaaa

SEQ ID NO: 5455 - DNA, 1375 bp, Zea mays
cggacgcgtgggggaatatacccggttgctcccccttggatccttgtttgcttcctgctgcctggccttctctcctccccaaaatcaatccctcgccgacaaaggagagccagccaaatcttccacctcctccatttccagccccgtccccacaccagctcgcgtaacctcctccccatggctggaggcggcggcgcaggcgcaggctcgtcgtccggcggcggcggaggggcggcagggagggcgactgggactgcggcagctgcggcaaccgcaactacgccttccgctcgctttgcaaccgctgcaagcatccgcgcctcctcgtcgaccccaacaccccgcgcgactccaagtggctaccccgcgccggggactggatctgcaccgcagcaactacttgcaaatgcaaactggccctatgggatggctggtagatatgggatgcaatcttctggttggccatttggcaacggcaacccaaatcagtttttaggtgttccaaaggattggcgtaatggagattggttctgcagctgtggatctcataactattcatctcgtactcagtgcaaagagtgtggtgcacctgtaccatcgggcattccctccacaacaatgaaagctacatctgatgcctcttccacattaggaactaagcggttggcttcagaggacctggccaatgactgggataataaagggctaaatccaggaaatgacaattatccactttcaacaggagctgcaaataatttatttttgggtattgagcaaggagctggaagcagcaatggccagtctgcctttcccaagtttgacaacgggagctcaatggcattaccatctgggcagggaatgtctggtcttatgggaaaaggggcaaaatggcgtgacggggactggttgtgcaacaactgcaacaatcacaactatgcatctcgtgcgttttgcaacaggtgcaaaactcagaaagaatctgcagttcaccctggtgtgttatagcttgctgttggattattttgttccaggatatgttgctgcctgttctagctccttcctcaaggctgcggtttgagttttttcgattctgcagtgtttttgctgctctcaaatgtttgtctcgatatttcattagtgcttgttgaagttccccatttgtttatggtataagcgcttgaataaaatgtttctggaaagtaccggcctacaatctggattttggcaaaataattgaattagttgttgtacaatgaggcaaattgtcttacgttgtactttatgaactctggagtattatcactcgtcgggttgaaaaggggaactatacaatgtaatttcagtacagattattattttttcctgagaactccag

SEQ ID NO: 5456 - DNA, 2717 bp, Zea mays
cttcgaagtataggctcccttgcactctacgggtgggacagcaggtaggacacgtcgccgcctcgcccctatcctggcgagtggggtaggtcagatgggtccacatggcagcgagcgggatgatgagaggtggggtttgatttttctcgcgtttgcgtgccaggacaaccattggcgcggcgtgcccaatcgggccgcggcctttcacgtgcctaccgctgcggtgagccgccacgtggtggctcgcagccggccaatgatagcgcactgcgcgcctcggcctctccacacgtacgtgtcccgacgcgtgtcccttcgcctccccaggcgctgtattaaagcgccgggcctcaagccgcacccgggtcgtcggcgtcctggtggtggtcgtatcttatctctctcactgccatagtgccatcgtgcgagcggcgagaaagtagaaggaagtgtgtcgtactcgtactcataccgggttggttggtttttgagacgtgtgcggtcgggagaggggatggagagaaagggagggtgctgcctcgcgccgaggtacgccgccaccgcggccgcgcagcaggcaggcgcggcctggcagatggggaggatcatgctcaagttccgcccgattgcgcctaagccggcggccatggcgcccgcgccggcaccggcatcggcaccggtgaccggatcagccgccggtgccgggagagggaagcgaaaggccgcgtgcggaggcggcgggaggaggggccggaagcccaagaaggcggccaaagttgcgatggtgactgcagcgcctgcggcgacggcggcggcgcaagatgtgggcgactgccgggagcactgcgacaaggagaagtcgtcttcgtcgccgtcctcgtcctcgtcggggacgtcatccgtggactcgtcgccgccaccccggccgcagcagcgccagctcgcaacgctgccgctcatgcccgtgacggcggcggaggataaggccgctgcttgtcctgcgacagtggggccggatcagctcgtgccgtctcaggtggctacggcggcacggccgttggctccgcgcgcgatgcgccccgctgctgctgcagcttacttggtgacggtggaagaggtgaccgcgacgtggcgcgacggcgaggcgccggcctccgcgacgggcgcagacgaggccccggcgttcgtgtcggaccagtgggggcgcgtcacgtggtggaacgccgcgtttgtccgcgctgcatccgcggacgacggcgacgaggcggcggcgcccgtcgtgctcggcggagccctcccggcgtggggcacctgcgcgggattcacgtgccgcgtccgcgcccggcactggagcgcccggcgcgtcggttcccccgtggtggcgccctgcgatgtgtggcgtctggacgccgccggcagctacctttggcggctggacctgcaggccgcgctcactctcggcggctgcctgtgaaccgtacaccactgtcaagagcaagcaacgaatatgctgtgctactcctctacgtgcggagacgtgttgtattttattctatgagcgttatttactgacgtaaggtatggtttaatcgacggattgctatcctggtcgggcttaattaaggacgttgaagcctggtaaggtatactaacttagcgtccttcggaatgggagtgagttgggaggacttgaaaatgtaagaagaagaaaacaaagcatgtgatggatgcttctggatgtgcaagctcagtcttcattcttcagcagcgcggaaattggctctaataacattggtttatgttgacagtgctagcgaggacaatgagtcattcgatgtgaaataataccatctgttctttatgatagtctatttagtataatatgatggcatgccctcttaggcagtagccggccagcatttgaaacatggtacttcgttttatttaaaaaataataagttattatttattatttatttgttttatcatttaaggtagtttatatttaacttaaaatttatatttttttaataaatattttgaataatataactggtcaaagtttttgataaaaaatcaacgatgtcatatatttatgaaagaagatagtatttaaaattactaaggactaatttgaaagctccattgttttaagaaatttttattttccttataaaatgaacaaatttttcttaaaaatgcggttcccaaattaactctaagagataaaataattagcatatataatatctataaagtcttaacatattcatattcacgtatcaactactttataactggtaaaaaatggaattattttttattttttatagaaatcttgggtattcatttgaatatgcttgtcactatattgggcccgcctctcctcttggggcctcttggtccattttttatagtctaaggaggagtgcggttacatgtttaagtcagttacatgacacaagtctaggtcggttaagagatataaacagtaaccaacctaaactaagcaagtatagatcagttaagagatatgaacagtaagaagcctagacttagcctatcctgaattatcagggatcatatacttatgggtgcatgaattgctatatttataagataccagtcttatttcccaatctggtcagatcttgccatcttcattatcttaaggtttccttgtcgatgaggacaacttgttacatgggctaagtccc

SEQ ID NO: 5457 - DNA, 3339 bp, Zea mays
acatgtattgtgcgtggatcggcaaaataaaacgccttaacttattcttctgccttgaatccttgcattttgtttttctctttcttgttttccatgttgagcatttgattacattgtggctaccatcgtcacttttaagtgtcacccttgcttaatctaggtgtgaacttaacctatctaaatcacaatactaaagtaaaagttagtctactattacccaaaaaatatgtttttcacaggcacaatagagtcatatgatacatgtgttgccatagatatactagaattctagcctaaatgaatcgagtctagtgatattactctctaaaaattaaatgcacgatttggcatgttgaggctttcaaaagtacactttgactgctaatttctctttaatatataagttatggtaacataagtttgatcactagatagtatttgtaaatacaaatacgatgtaattattattgtaacatgatatttttatcttattaaacgaattgttggttaaaaacaataaggtttgaattttattatttgttctcatcttattttttttattggacggagtaaatcgcaggactttgcgtatgcaggctttatccctaactttctctagtctagaaaaaaaaatgctgcccgtatttcgtttccggtcaaaggatccttgaaaagttctagtgtgcaacgagcaactgagatctattttgactgttataaatgatttctgtaaattactatacagcctgcaaatatttgaagtgctttattaggcatgtttaggacaactctagattcaaaaaacttggtggagttaatagagcaaataattagataatctagaaaatcgtggacctgaaactataagtgtttagaagacaattacataagttactttgtttattacttagattaaaaatatttttaaagctatttaaattaattctataaactacagctctataatagagatgaactagccatcccaaacacctctacgtgtcttagtcgaccagataaggacactgaaagcatgaccagacttttcaaacctttattcatccgcaacagaattggataaaacaaaacccacttgagacaccaccagccatccttgtccgtaggagatattccttctcgaagcctttccgacaggtggaccccacacttcaaacacgtccccaccacgaccgacctcgcaggcttgcaccacgttggatgagaacgagacggatcacgggactcctcgtcaccgtgacccactcttgaccccttcaacgacgggccaggccaattgtcggctgttccacttacttagatccaaataattatttacaattcttcacaaaatagtagagctctaaataaattttagtttagaaataaataaaaataggattaaatctgatctaatacttaaattttattttgtagtgtaaaatttagagtctattgtcacacttagttccacttccatatcgccgtgagtcttacaagaagttttatcgtaatactatgtatatttaataaattattatataaatatcttcatgatttaatagtatatttaaaaataaagatacataaattttacagaaataaaaaaccttgacacgattatacaactatatgtaagtaataaaaattaataactataacaatataaaatatgttttttaccaaaaacaaatgcttattataattttatgatacactctatcccgtacagttcgttaacgtcagctccgccgtcaccgcacgtgaccccgcactatgcccctgccccgccccgcgtccacactttgtctggttggctacagcccatcaggagggcaaaaccgggacagaaaagaagggaaaacagagcgcattacgcgcacgtttcacacgtttactttgcgctgctgagggcgccattagcagcagcagcagcagcttgctcccactaaaaaaatcagcgcgcttctctgtccgcttctccgcgtactccgcgacgtcaaccccgtataaaacctgccccctctccagttcccgccctcagttcaaagcagcgcctcgccaccggacgaacacacagatcgctacagcccgcatgaccaacctctccgccatggcagcgagccaatcctacgtgatccgattcgacggccacttcgacgagccgtcgccgagctccgcgggcgccgagccgccgggcccgcagccgccgttcgcagggaggatgatctcgctcgagcgggagcaccaagtcattgtcgccgccctgctgcacgtcgtctccgggtacgccacgccgccgccgcaggtcttcacgccgccgccggcagcggcgcgctgccaggtgtgcgggatggagcggtgcctcggctgcgagttcttcgccgccggggagggcgcattgggcggcggcgcggagaaggcggccgcgacaggaggcgcggcggcggggcagaggaggcggaggaagaagaagaacaagtaccgcggcgtgcggcagcggccgtgggggaagtgggcggcggagatccgcgacccgcgccgcgcggtgcgcaagtggctgggcacgttcgacaccgccgaggaggccgccagggcctacgaccaggccgccatcgagttccgcggcccgcgcgccaagctcaacttcccgttccccgagcagccgccgacggggcacgacgagcccatcagcagcaacggcgacgcgagcgcggccgccaggtcgtcggacaccacgccgtcgccgtcgctctgcagcgcggacgccgaggagcgcgggcagccggagtggccgagcgccgggcaggaggcaggggaccaactgctctgggaaggcctgcaggacctgatgaggctggacgaaggcgagccctggctccatccagcctcaagcgcttggaattgaaatttgaaacgcccgcgatcagatcccagccgttcaactagtttgaaataggagcatcctagcctttcgctatgcttctttttttttcttccctccttaactcttctttttctaacctctgttgtacttatttggacaaagcagagttttgaaaaaaaaaaaaaaaaccgccctaccagtgtattgaacaggcaattttggagtgtaatttctactggaaagcgattaacacgagcttactactgacttgtcaaccaatcgaatacacgacgacttggataaaaaaaattgattgaggaagtatttcgtactttactggcgtatagtaggattgagacgagcccatcatagtttctgagtaataatattcagctaccaatatgatccacgtgataatcgcgccggggttggcaaattaagtattgttaggtttg

SEQ ID NO: 5458 - DNA, 1149 bp, Zea mays
  misc_feature (722)..(722): n is a, c, g, or t
  misc_feature (749)..(749): n is a, c, g, or t
cagttcaaagcagcgcctcgccaccggacgaacacacagatcgctacagcccgcatgaccaacctctccgccatggcagcgagccaatcctacgtgatccgattcgacggccacttcgacgagccgtcgccgagctccgcgggcgccgagccgccgggcccgcagccgccgttcgcagggaggatgatctcgctcgagcgggagcaccaagtcattgtcgccgccctgctgcacgtcgtctccgggtacgccacgccgccgccgcaggtcttcacgccgccgccggcagcggcgcgctgccaggtgtgcgggatggagcggtgcctcggctgcgagttcttcgccgccggggagggcgcattgggcggcggcgcggagaaggcagccgcgacaggaggcgcggcggcgctggcggcggggcaaaggaggcggaggaagaagaagaacaagtaccgcggcgtgcggcagcggccgtgggggaagtgggcggcggagatccgcgacccgcgccgcgcggtgcgcaagtggctgggcacgttcgacaccgccgaggaggccgccagggcctacgaccaggccgccatcgagttccgcggcccgcgcgccaagctcaacttcccgttccccgagcagccgccgacggggcacgacgagcccatcagcagcaacggcgacgcgagcgcggccgccaggtcgtcggacaccacgccgtcgccgtcgcntctgcagcgcggacgccgaggagcgcngggcagccggagtggccgagcgccgggcaggaggcaggggaccaactgctctgggaaggcctgcaggacctgatgaggctggacgaaggcgagccctggctccatccagcctcaagcgcttggaattgaaatttgaaacgcccgcgatcagatcccagccgttcaactagtttgaaataggagcatcctagcctttcgctatgcttctttttttttcttccctccttaactcttctttttctaacctctgttgtacttatttggacaaagcagagttttgtaaattacagcggagcccgccctaccagtgtattgaacaggcaattttggagtgtaatttctactggaaagcgattaacacgacctcgcgtccgaaaaaaaaaaaaaaaaaaaaaaaaaa

SEQ ID NO: 5459 - DNA, 1043 bp, Zea mays
aagacacctgagtacctgacacacagcgaaacgccgaaaccgcgtcaagttccccttcttcgatcccccaatcgccgtaaccctagactcgccaccgccgccgcgatgctccgctcgccgggcaattcgccccgccgcctctcaccgtcgcccacacccgcgccctccacccctcgcccggcctccccgcccccctccaacgccccctcctcgaagcgccgccggtcggaggtgctcgacgaggacacctacgtcgccgccatcgagcgcatcatcgagcgcgactacttccccgacctgccccgcctccgggaccgcctcgactggctgcaggccgtgcggtcccacgacccgctcatcctacgcgacgcgcagctcaagatcctagaccgccgccgccgcgcccagcgccacgcggcggggcccgtccccacgccgacgccggccacctccaccgcgctccgctccccgtcctttctcaccacccccgccggatccgtcgccggcggcgtgggaggtcccgacgccgaccacgacgacgacgtcgcggccgcggtctccctcgacggcttcttccgccgcttcaccagcgaggacaacgactccttctcgcgcatcctagacaaggtgaaccagcgccgccgcgagcgctacgcgcacctgctggagccgccgccgcctgccgaggcggggagcaaaccgtcagaggacgccaagcgcaacaggatcacggacgggtacggtacatcggggcagccaccgagcacgctcgagggcgccaagttcacggcaaagaacctgctcatgtactacccggctgaccagggggaagcgcccctcacggaggaggagcgcgcagagcggctcagggggatgaccaaggagataaacaagtcgaacaccaggctacatggcagagccacggctgatgacgcgaggcccaaggaggaggagggggccgccatactgtacgcgctggttgcaggctctactccgggagggatggcctaccacgaccctgacaagttgaagaagtacgatct

SEQ ID NO: 5460 - DNA, 5379 bp, Zea mays
  misc_feature (2336)..(2336): n is a, c, g, or t
  misc_feature (3095)..(3095): n is a, c, g, or t
  misc_feature (3449)..(3449): n is a, c, g, or t
cccctatttttttctttagtagctaaactttagcaaaaattgcagtgctaaagtttagcaaggagaaacaaacgggcccttagttcacgagaaaaggaaaaaaaatcacatcagaagcaatgtgtgcctgtctatgcgtcgtgtgttgttgtgccttgcctgccaggccggccaccaggatacacaaactctggtggctgcggtatgctcacctgccaaccatgctagatcgcgtctccaatagactatttgacatgtctgagctttaataaaatttgaagtgggtatttaaatagtatgcatgctccctatgattatttattccatagaacaatacacacttcaaattattttttacacacaaccatttaaattactactatggataattggcacacctaattgatctgaagttaattttgcatgataggatataactgaaggaagtagaactgactttgctaagcttatcatgaatggcaagaataatcttacatgggctgacgactgcaagtttcatctggatatgacgcaactaagaaagaaaattgtttcgtctaggaccgaatgacattgacgtgcaactttatgagagagcaaatgtttccatctttcttagatgataaatcaaactagacttgaagatagagtatatagaggtaaaagactctcttctattatggacaaagctgcgtgaacgctttgttgtgcaggagcatgtgatgcttttgtgggagcagcatgaatgggccgctatcctcttcatcaacttcaagacaataaaggcttacaatgtcgtatccatcgtgttgttgctcatctatgcttttatggccagatattcatataaatacatatgactgagaaaacactacaacccctcaaatatagtgctccagtagaagtaccacaacaatcagtacacaaaatactatgatctcatcaatatgttacttgacatcgagcctcaaaacgagctcctaatgtagaactaccaaaagtgctatattggcactacgattgtctctgaagcacatgcccacttatagtcttagaaaaaaggagtcccctctagaggaaggggccatatgcaccacaataattaggtgaccagaagaagatatttcgaaaaggcaccatagaatggtagcagcagtagcgctaatggtcatggcaatgaaaaaaagcaaaggcaaaggtaacccctagaaggacgatgtaagtgcttcaaagcacggtggcaaaaactactttaggtgtgggttctagtagcactggtcccatcaatacactacgaagaaacacctaattgacatgtatcaggagaagaataaatgtcaaagctcagaggctcactttgtctatgcgtctatagatgctaaagactggagagcctctccttaagctaactaagactgttgaatagtctagtcctactgccatggatgttgatgccatcgttgagagcaacaccctattagataataatgattttagcttcaataatgatgatctaatggagtagatcaagccatcaaccattagctctataagtattttcttagctaatattttaattttagaagaatatttatttggttgtgatgtaataaatgctactaccaaacatacttggttcaaatattaatattgattgcttggtgtttttatttgttcccctatatggtttagttgtgctcgccctactatatgttatcatcatgaatgatgaattaaatcaatattatctttattgtaaacaagacttccgttttctacaatggaggcaaataatgaactatacttgatcgatagtgccctcacaaatccaataattagagaggcaaaatattttaaacactctagaaaaagactgaaattattactacaaccacaaatagtaatggccacattataggctctagtcgtaccattggcatccccgtagttcatcttttccaaattatgtcctttctagttgagtttttgagccatagtttagatttaaatcttctatttctattcttatgaactggtaaccactcacttagtgtcggtgtttcgagtaagcaccagtgagtaaatgtatgtattcgcgttttaggcctgaatagtgtgctcggtggacgcaatggttatactggttcggactaaatgtccttactccagtattcgacgactcgcactactggcacctgattgtttgtagtaggagattataaacatataagagaaggaaagttcccaagtcttttatggggtgtgagtacttctatcgtattgtgtgtgttgtgttctgcatgaggctggctccaccttttataggacaaggaggnggcctcttacaatggcttcttccgaaagggagagtaaaaaaggtaaaaaaaatatcactctttggtaacttgccatgcttcactgcccttccttgagtgggtcctcaatcctatcctagagatcttgcggagatggcgcgatctatatcattgatgtgtgccctaggtggtctacaatatggggtttttcccatatctttctcctatgttgaccttccttcttagtagcttgtaggtcctatttcgcatgcaggggtcgtagagccccttagtaggcttagacctaaggggtgtaggtcatgagtggagaaggaatgggttatgcccatgccgtaccttattggccaacgtgataatgagatgtacgtaaagctagcagtgcaattggtctgagttcgccgaatccacttgagtggaccttgactggctcgttcgacccccctgctagttttccgtctcgtccgaccccacggttcgacccgtggagcgacctatgggcaaggtgaaggtcagtggctcaagaatggtttgctcagaacgtcactccttgctgactcatgggctcagggccctagggttttgtactcgacacttagcaaacagttagtctataaatgttgtgatggtcatcaaagcaccaaaatcaatatagaaatggcttaaaacccatttcccttcaatagccatgtatactaagggtctatttggttcagctatagacttctaaaaatctgattctagttgtgaattgtgagaaanctgctatgggtgatagttatgagagaactaaaagttgtttggttgaaacatctgtgaactataaatttgataaaacatgatggcttggcaacatggaaggaggagtgtcgtctagcctcttggacaagtcaagccgacagcatgccatcgttggcaaggaggcagtatgccatgcccatgccacggggccctgcgcttgcagcactaggcccaagcatcgtggatgtagtcatgcccaattcaacacatatatagcaccctacatgagtagcgcgtatgacagtggcaacaactaaaacgatagatgttggacaatgagcaacatcgaaggattaacgaggaagagacataatngtttaaggatgactaagccacgtcattgacctccgaattcagacatacctgaagggtttctaaatagaaaataaaatgattcgataattagataaacttttgattttttgggataagagaagattaactagaagaatgtatagaattcagatttttttagattatgtactcttttggtaattgaattttggctacaagcaattccttccgagttccgaaccatccagcgaaccttgtaaccttctagaaccctcaattcccctccgtgtccgatgcctctcatcgccagaagaccttcccggtacgacgccaccgcaccacggaattaacacgagcactgcatcggtgaatctgcaagcccgcccgcccgtcgctcgccaccgccatgttcggcatcgtcttcccggaccacacctttcccctcgacgccaccgctttcgcgcaggtggcgcccaattcctgggtcctcgatctctccactctcgcgctcgccgccgcgccgcgctcggcagtcgtcttcctgctccccgctgccgtgacagcgctgccgcccggcaaggccgtctccgtctacttccaggccgccaccaaccgccccttcgcattcttaggtgcgctcgggcccacgcgcccctcggccagcttcccgcttccggaggccggcgacgagccggagcctgctgtgggccccgctaaactgggtgtcgccgtggaggacgcggccgcgttaccgccgccccctgacgagcagcgtgccgagcgtgtggcgctccgtgtcggcgagaacctgttcaacttcatgcaatcgttctgcggtgccgacggcggcaagctggtagtgcccacggacatcctggaccggtggttccgcaagttccaggagcgagccaagaaagatccagcgtacctcaagagcttcgacttttgagagcaaaggtatcaccgtcctgggattcactgattatctgcactattgggttctgactggtgtgaactgattctgttactgttacaagtcatcttgtgttatcgtgatagactatacagtgcagtgctcgtttcactgcagtaggacagaaagctgtcacttagcagtttcagatggtgatagttttttttttgttttttttggcgaaggtgataaatactactgctacaacaataaaactttttactcccaaacaagttaagttagagtatgctagagttaaaaagctaactgaacctataaggttcagacatatggataactgttttcacaatttaaggttcaggcttatggataactgttttcatgtgtttctaacaaaggctaaatctttggttatatttcattcttaagtctctccttactgtcttcttccatgtcaactccggttctcctatttccctgttctcattgctatccattgctatcgtggcgcctctagaagtctccgatggacatgccgatgttggacaatcttttcttgatcagtgttacccctagcctatcacgtatatcataattatattcttttttccttcttgtatggtcacaaatctaatgcaacacacacattcccgtaatacttagctgctaaacatgttgtatttttatagaccaacattctgcatcataagatacttgtggtgaggcatctactttgctcttgtctttgttctagatcttcttttcttcgatggcctcatctatctgtcttcgaagttgagcagcctgaagcagtttctgcttttgtatcttcatgtgcctctggatggcttccagccccttactctctgcatcgacatcatcctgaaccaggagctccggagcttttctcttttcctgccttcggtttctagcttcgatccggttgatgcctttgttacaatcttattctttggggttgttggcactattggttataccaacaactctcttcttgcg

SEQ ID NO: 5461 - DNA, 3158 bp, Zea mays
tcgcagacaagagaaattcattttttttttcttttctcattcatcaaatggtgttttttattatttttcatggtaactctatttagcacatgacacacagacattatagcctcacctatcattagggcttgttcgattagctctcaattcatgtggattgagtgggattgggtgaaattaaatctcaagtaagttaaactccttaaatttttctaatctcatccaatacatggataacgggattaaccgaataagaccttagttggagagtctcgatgtttctaacatagcgctaaccatctccattagaattctgttattactttacacaatcctattggtatgtggagaatagggacgttccttttcatgaatgatatcatgttcctcgcagaatgagttaaattcgtttggcaaatactctccatcatgatcagatctcaggcgtttaatcattctttcaaactgattttttaattttgtttttatagattttgaaatagataagatacacatctcttattttaaacaagtacacatcgatatcaatatcatgaaatatcttgtcccttcttttgtcaatattccatttctctcgaaaaaatcaatgtgaactagttctaatgattctaaactcgtcgcctctgttgtcttgttaaattatttagattgcacatatattttatatttagatatttttgacaaaagtaaattttaggattaagctcatgtacatgttaggacatatacaaactattgccattggttttaatttttaagtataagagaccgtatgaaaaactaaatcttctacatcataaatataagagttaagggataatatataaagaattgtgtagaaacggactcttcaaaaaaaacacatcttaatttttgttcacttaacccctatagaccttttaagggctggttagtgaccatgaaattggataacaatagaattcctttctcacgaatactttccaattctccgatcactaaattagcttaaaaaatctataattaatggggttgtagtaactgctgtgcagtatgtgactggacaaaccgcggatcctcttcggatcttccttcccatggcaaaattcaggttccggccgactcctatacataggcagccagccttttcacctttttcccttccccctccccaaccccccacacagactagcaagccgcgcgcggaggcgaggcgttcgcacacctcgccgcgcgtccttggcctctccccgcgccaccaccgttccgttgcgcccgctaacgatcacgcgtttccggtgggagagagagtaggtagggagaggacgggacaggatgctcgggttcaggcagatgtcgtggtcgtcggcggaggcgcaggcgccgtcggagcagctgtgcgaaggggtggcggccgtcgtggcggcgcgccaggggatggagacgccgctgacggcggtggccgaggcgttcgaggagctggtgcgcgggatggacgccgacggcggcgagctccgcgtcgcgcccttcagcgacacctgtgccctcgtctccgtgctcttcagcagcctcgggatggccttcaggttcgccgagatggagtacgtcaccaaggtgagcgcctgatcgatccgaaagttctgcgcgatctctcctctcttttttttctctctctctcgcccctgccgggatcgtttgcttcgctttgtagttcgtaccgttgttgcgatctctctgtgtcaggaatccaagattttacacggctggcgaggtgaaatccaacgagtgatgcctggataacatggcgccatattatttattactttcatcagatcttccttctttctagaaaagaacacacgtcaccgaaaaaaaaacgaactttgcaatcttctccttcaaggaagctccaggaaagaaagttgtcgcgttgatttgactcgcggtcgattgcgtgcagactctttcagtatttcaatggtcggcgttattagcaccactgcaccaatcaaaattgctcccgcgtactcccggcaacggaacgtaacgccgcttctccgcgtgaatactgcgtactcataccacccatctatccttccaggtgaacgatctcatcggtgccggcaagtcgtaccgcacgctgagcgacatcctcgacaaggacatccagaacgactgcgtgaagaagcagggaagccactcccggaacctgcgcagggtccgtctcggactcggcctcatcaaggccctcttcgagcaattcctcgccaccgagtaagtctcctttacattgagccaaacgcaaacatctcgtcactgaagtctggacatttcaggccagataggccgtcttgactgaatctcaaggcgtctatctgtcctgtatacagcttctgatgtccttttgtgagatggcaacttctgatggcgacgaatgcatgatccagaactggctatctttcggataaatatgtttaccaaattgccagctagtgctcataagctatttaaagccaaattgccagctagtgctcataagctatttaaaaacacagtgtggctgtcaagtgctatgattgacactttgacaggtagatgttttgttctaaaaaggtgtatattgacaggtcgctctgttctctggcacttgattttttcaggggttcattgtatgatgctgctacgatagcttacgggcaggtctgcgcgccgtttcatagctgggcgatcaggaaggctgttggcgctggcatgtacacccttccaaccagggagcagttggtagtgcggctgaacgaaactggtaagcaaacatgaacacccaccaccacgtttttaagcattacattacaagtttaccaagcttcgaatcttggtgccccggaagaaaacgccttgatttctccaggggctgatcaagtgttgacagcgtcctttattgatcgttgacgcagatctctcggtgcagaagcagatgaggagatacattgacgcttctagtcctatcatagagtacatcgataaccttttcctctcgaggaacattagtctagattggtgaactagtttttctgagctgtactgaaagtcaagtttgtaacttgttcacaagctgttgttggtaccatcgatttatttcttcatagttgtttactagg

SEQ ID NO: 5462 - DNA, 1072 bp, Zea mays
cccctcccccccccaaccccccacacagactagcaagccgcgcgcggaggcgaggcgttcgcacacctcgccgcgcgtccttggcctctccccgcgccaccaccgttccgttgcgcccgctaacgatcacgcgtttccggtgggagagagagtaggtagggagaggacgggacaggatgctcgggttcaggcagatgtcgtggtcgtcggcggaggcgcaggcgccgtcggagcagctgtgcgaaggggtggcggccgtcgtggcggcgcgccaggggatggagacgccgctgacggcggtggccgaggcgttcgaggagctggtgcgcgggatggacgccgacggcggcgagctccgcgtcgcgcccttcagcgacacctgtgccctcgtctccgtgctcttcagcagcctcgggatggccttcaggttcgccgagatggagtacgtcaccaaggtgaacgatctcatcggtgccggcaagtcgtaccgcacgctgagcgacatcctcgacaaggacatccagaacgactgcgtgaagaagcagggaagccactcccggaacctgcgcagggtccgtctcggcctcggcctcatcaaggccctcttcgagcaattcctcgccaccgagggttcattgtatgatgctgctacgacagcttacgggcaggtgtgcgcgccgtttcatagctgggcgatcaggaaggctgttggcgctggcatgtacacccttccaaccagggagcagttggtagtgcggctgaacgaaactgatctctcggtgcagaagcagatgaggagatacattgacgcttctagtcctatcatagagtacatcgataaccttttcctctcgaggaacattagtctagattggtgaactagtctttctgaactgtactgaaagtcaagtttgtaacttgttcacaagctgttgttggtaccatcgatttattctcttcatagttgtttactaggtaaaaaaaaaaaaaaaaaaatgtgctcgtgcgttgcgaaataagtaaaaaatttatattaaacatataacgaaacgaaaacatcactatgatatgc

SEQ ID NO: 5463 - DNA, 1267 bp, Zea mays
  misc_feature (1261)..(1262): n is a, c, g, or t
tctccccccacggcagaattccgattccggccgcctcctatacatagccagccttccaccctctcccctcccccaacacagagcagcgagccgcgcgcggaggcgaggcgttcgcacacctcgcccgcgccaccaccaccgctccgttgcgcccgccagccgtcacgcgtgacgtttcccggggggccgggggagagagaggcagaaggaggaggcacggagaggacgagacaggatgctcgggttcaggcagatgccgtggtcgtcggcgcaggagcaggagcaggcgccgtcggagcagctgtgcgagggggtgtcggccgtcgtggcggcgcgccaggggatggagaagccgctgacggctgtggcggaggcgttcgaggagctggcgcgcggcatggaggccgatggcggggagctccgcctcgctcccttcagcgactcctgcgctctcgtctccgtgctcttcagcagcctcgggatggccttcaggttcgccgagatcgagtacgtcaccaaggtgaacgatctcatcggtgccggcaagtcgtaccgcacgttgagcgacatcctcgacaaggacatccagaatgactgcgtgaagaagcagggaagccactcccggaacttacgcagggtccgtctcggcctcggcctcattaaagccctcttcgagcaattcctcgataccgaggggacattgtatgatgctgctacgatagcttacgggcaggtctgcgcgccgtttcatagctgggcgatcaggaaggctgttggtgctggcatgtacactcttccaactagggagcagttgatagtgcggctgaatgaaactgatttctccgtgcagaaggagatgaggagatacattgatgcttctagtcctatcatagagtacatcgacaaccttttcctctcgaggaacattagcctagattggtgagctgatctgaactggactggactgaagatcaagtctgcagcttgttcacaaagccgttgttggtaccatcgatttattgttcatagttatttattcagccttgttgggtggtggatggatgctcccttttcttcctttgttgcacgcacgggtctcgtgcatgtgttgtacaactgcatgataattctagcatggacattgatgttcttgccgactgtccatatagaaactgatggataatgcaaacgactattcagatatcaaaaaaaaaaaaaaacctcgggggggggcccggtccccaattccccctatagaggnnaattt

SEQ ID NO: 5464 - DNA, 1663 bp, Zea mays
cgatgccgagcgggtggagctctagccacgcccacgctcccgcctccccggcaaacacactcacgcccgccgaggccacatcctagcacgttgtagacgccgccaccgccaccgcctgacgccatgcaggagttccagtccatccctggcctggccgggcggctgttcggcggggccgcggcacccggcgacctccggcgcgcgcaggcggcgcagcatggccccggcggggcgcgatgcggcggtgcctcgcccgcggcgcccgaggcggtgaagtgcccgcggtgcgagtctaccaacaccaagttctgctactacaacaactacaacctgtcgcagccgcgccacttctgcaagagctgccgccggtactggaccaagggcggcgtcctgcgcaacgtccccgtgggcggcggctgccgcaaggcgaagcgcgcctcgccgtcggcgtcggcgtcggcgtcctcgcccgcctcgtcgtcggcgccgtccacgcccgcgtcggccgacgcggccaagaacccgcgccgcgcctcggcctcgccccgctccaacagcggcagcgcgagccccacggccgccgccgcgacgaccccgaccccgaccgatccgagcacctccgccacgccgtcgtcgaacggcgtcgccttcacgggcagccaccactcgtcgaaccccttctccacgatcgacgtggcggccgcgccaccggcgccgatattcgccgaccaggcggcggcgctggcgtccctcttcgcgcctccccctccgccgccgctcccggtgttcagcttcgcggcggcgcagccgaaggaggaggaagcgcccccccgttcgccccccccccaacacctcgccgcacaggcggcgccgccgccgtcgtcggtctccgaggacatcatggcgccgttcgcatccctggacgccgctgggatattcgagctcggcgacgccgcgtcagccgcggcgtactggagcgccgggagctgctgggcggacgtccaggacccgagcttgtacctaccctagcgtacgtgcttgtttagttacctatcgcgatcgctagattaaagccgcggttagatcttaacgacggcacggccacgagctccgtctctctagctattactccatgtcctccctgcctctctctctctcttgtttattggcgatttggcttcacaggctgcgtgtctagaaagctaacatctgtgtttcgtgtctgcatgcaccctgcgagtgtggcggatcattgcgctgctgcgatgaattaatcgcattattatttcttgtttactcttcgtaatagtaacttgtatgaatacatgcatgtttggggggaagcaacgtaaccacgagtgtccgtgtgttatgttgtgatgcacggtcaaagccgatggtcaggtctatcgccaacgccaggggatgatggaacaatggtgcgtgtcattttggttagcggttggtttgttaatttcggctggtggcccgcccgtacatgcctatgcctctcgctctccggggggtttgtgctgatggcgacgccagttgctagctggctcttacgtacattgcttctctgtacgcctgttcgttggcccagcatggcctcctcctgcctcctgacataacacacttccgtgcctgctcacgcgagcttggt

SEQ ID NO: 5465 - DNA, 1737 bp, Zea mays
ccctcggcctcccggccggctgttggtaagaccagatatcagtactcgtcaagccaaggttagtaaaggccacgggtgcgctgtccactttgcaggcaagctcacggcctcacgtgaggccgacgaagtcgtagcagagatccgatacatgggagaggaagagggcgcgcccaccgtggcagcagcggcagagagcgctccgccgcacctgctcctgatatgcttcccggggcagggccacgtgaacccgatgctccgcctggccaagcgcatcgcggccaagggcctcctggtgaccttctcctcgatctccagagtcggggcgatgctcgccgcgtccgtgggcgtgtcggccggcggtgacggcgtgcctgtgggccggggccgcgtccggttcgagttcatggacgatgaagaccccgggcctgacctggacgacctcttgcggcacctcgcgaaggacggcccgccggcgtttgccgagctgctggagcggcaggcggacgccgggcggcctgtggcgtgcgtggtggtaaacccgttcatgccgtgggcggtcgacgtggccgccgacgcggggatcccttcggcggtgctgtgggtgcagtcgtgcgcggtgttctccctctactaccaccacgtgcacggcctcgtggagttccctcccgaggacgacctggacgcgcggttcacgctgcctggcctccccgagatgtccgtcgccgacgttccgtcgttcctgctcccgtccaacccgtacaagctgctggtggacgcgatcatcgcccagttccacaccatcgaccgcgcgtcgtgggtgctcgtcaactccttcacggagctggaacccgacgtggcggcggcgctcccgggcgtgacgccgcggccgccagagctcatccccgtgggcccgctcatcgaggtcgacgagcagcacgacggcgacggcgacggcgcggggtcgggcgcggtgcgtggcgacctgatgaaggccgcggacgactgcgtggagtggctagacgcgcaggcgccgcgctccatggtgtacgcatcggtgggcagcgtggtacggctcaacgcggaggaggtgggcgagatggcgcacgggctcgcgtccacggggcggcccttcctgtgggttgtccgtcccgatacccgggccgctcctcccagagggattcctggactccgtggccgggcgcggcacggtggtgccgtggagcccccaggaccgcgtgctggcgcacccgtccatcgcctgcttcctgacgcactgcggctggaactctaccctggagaccatcgcagcgggcgtaccagtggtggccttcccgcagtggggcgaccagttgcactgacgccaagttcctggtggaggaactcaggattggggtccgcctccgcgggccgctgcggcgggacgccgtgcgggaggcggtagacgccgccgtggcggggcccgaggccgacgcgatgctcgccaacgccaggaggtggagcgcggcggcgcgggaggccgtggcgctcggcgggtcctcggacgcgcatatccaagcgttcgtggacgaggtggcccggcgagcatgtgtcgtgccgccgtcgtcagagattcctagtcctagttgaggtcgaggagcttcagcagtcaccctcaccggacaaagtgagtcgaaagctgaaagtgaagaataatcatgttcttacagttttaccaaaaaaaaaaaaaaaaagggcggc

SEQ ID NO: 5466 - DNA, 2216 bp, Zea mays
ctcatcttctcttcctcgaggccggccgggcttcccccagtcctcccccccgttcccggcccctcttcggcctctctcgctcagctcgctcttcattaagcgagctcacgtcgttcctcccttcttcctcttcttcttcttatccgttgtgcgattccccctcgcgggccggcccgagatcgagcatcatctccatcatcgatcgatccatctcatctctttctcttcttctattctatgtcgtcgtcgtcccagattagatcgaagctgctagcagtctatccagtctctagctagctagatcaagcccgcagactatataatataatacaagctagctacgtgcttattgctttattagtctagaagaataatctagatatatacgatcgaacatatatctcgatctccaccgatacacacccggccctatccatgcttgaggtgtcgacgctgcgcggccctactagcagcggcagcaaggcggagcagcactgcggcggcggcggcggcttcgtcggcgaccaccatgtggtgttcccgacgtccggcgactgcttcgccatggtggacgacaacctcctggactacatcgacttcagctgcgacgtgcccttcttcgacgccgacggggacatcctccccgacctggaggtagacaccacggagctcctcgccgagttctcgtccacccctcctccggacgacctgctggcagtggcagtattcggcgccgacgaccagccggcggcggcagtagcacaagagaagccgtcgtcgtcgttggagcaaacatgtggtgacgacaaaggtgtagcagtagccgccgccagaagaaagctgcagacgacgacgacgacgacgacgacggaggaggaggattcttctcctgccgggtccggggccaacaagtcgtcggcgtcggcagagggccacagcagcaagaagaagtcggcgggcaagaactccaacggcggcaagcgcaaggtgaaggtggactggacgccggagctgcaccggcggttcgtgcaggcggtggagcagctgggcatcgacaaggccgtgccgtccaggatcctggagatcatgggcacggactgcctcacaaggcacaacattgccagccacctccagaagtaccggtcgcacagaaagcacctgatggcgcgggaggcggaggccgccacctgggcgcagaagcgccacatgtacgcgccgccagctccaaggacgacgacgacgacggacgccgccaggccgccgtgggtggtgccgacgaccatcgggttcccgccgccgcgcttctgccgcccgctgcacgtgtggggccacccgccgccgcacgccgccgcggctgaagcagcagcggcgactcccatgctgcccgtgtggccgcgtcacctggcgccgccccggcacctggcgccgtgggcgcacccgacgccggtggacccggcgttctggcaccagcagtacagcgctgccaggaaatggggcccacaggcagccgccgtgacgcaagggacgccatgcgtgccgctgccgaggtttccggtgcctcaccccatctacagcagaccggcgatggtacctccgccgccaagcaccaccaagctagctcaactgcatctggagctccaagcgcacccgtccaaggagagcatcgacgcagccatcggagatgttttagtgaagccatggctgccgcttccactggggctcaagccgccgtcgctcgacagcgtcatgtcggagctgcacaagcaaggcgtaccaaaaatcccaccggcggctgccaccaccaccggcgccaccggatgacatactatctcgtcgacaatacatgcatgtacaatagacggatgtctagtagtatagtagattgctgctagctagctagccgctagagtgtagtagcatatgcatgccttttttttcttcttctttttttgcccttattattaagctggctaatagcgattgagatggagcttgacacagatctgctagctagctatttgagggtttctcttgtatgctacctattgctgctgcttgctgctgagacaagtaatgtacgtacgcctgtgcaaacgacacatcggattgtattgtattactagttatatgaacaacaacaataataataggcacatgcatgcctgcctagttcgtgtgccgctagctagctgcggccgtgttgcgcattcctttcc

SEQ ID NO: 5467 - DNA, 3058 bp, Zea mays
  misc_feature (3024)..(3024): n is a, c, g, or t
  misc_feature (3032)..(3032): n is a, c, g, or t
  misc_feature (3035)..(3035): n is a, c, g, or t
  misc_feature (3053)..(3053): n is a, c, g, or t
aattcggcacgaggaaaaaacaacaaacacttctcgggttcctttcttcgtgcgcactccactttcgccggcgccgccctggccgccaacgtcgtgcagcgctgcctcgaggccggcggccgcgacttcctcttccaccatacctcttcccctccctctccgacctccgcctctgccgctgcatcctcctccatcctccaatctctccccctccacgtgtccttcgaccgcgggtattacctcctcgtcaaggcgatccaggagctgcgtgcgcgcaaggacggccacgtcgttaccggcggcatcggcggacccactggctcgggcaagaccagcttggctgagaaggtggcgtcggtgctagggtgcgtcgtgatcgtctccatggaggactaccgcacggcacctggtgtcgacgacggcatcagcgacgtcaatgccggcgatttcgacgcacttgctcgcaacctccaggatcttgtgaagggtaaagatacaatggtgccactagttgattttcaagagaagaaacgcaccggatggagggaactgagaatttcttcatctggagtggtgattgtcgatggtgcgtatgctctgcattcaacactacgatcattgcttgatatccgagttgctgtggttggcggcgttcattttagcctgctttctaaagttcagcatgatattggagattcttgctcattggactatctaatcgacagtatatttccattgtttagaaagcatattgagccagacctgcatcatgcccaaattaggattgataacagctttgtctgctcatttcgagacccgtactacaagctgaagtgcaaaaatgagtcatcagatggcaagaagttatattcttttgaacaaaataaagtggaaactgagaactttattgagatgtaccttaggccgcctttgcttctgaagaaatgaagattgatgattggattaaggttaggcaatgtggaataagatactatctatctctcggagaccaaaggattgttgacaagtacttcataatccgtccaaaagctgagtttgaggttgggcgaacaactcttggaggattgttggccttggggtacaatgttgttgttagctttaagcgtacatgcacatctgtcaatatagatcaattactgatagctgcagagaccattgacactctaaatgagacctttttggtattaaaaggtccaagcagaaagattgttgcagcagaggcttcaaagcttggtataaagggaccatggatcacaaaatcatacttagaaatgatcttggagagcaaaggggttccacgacttaatacaccaccaccggtatcaagcaaactgctaactgaaagtcaagaaaagaaaattgctgcacctaaacctattcgtgtttctgctgaaaacattacaaatcttgatgacttgatgcaaccgtggacgagatccccgcccaagaagttggaacaagaacacgtattggcaaaatggcagtttatctcagattcttcttcaagaagtaacatccagctggctcctctgccagattcttatgacctggataggggccttctcctatcagttcaagcaattcaggcattgttggagaacagaggataccctatcattgttgggattggtggtcctagtggatcgggaaagacaagtttagctcagaagatggcgacagcaacgggctgtgaagttgtaagcttggaaagttattacaagcctgaacaagtgagagattataagtatgatgattatagctcattggatattgctttgctcactgagaacattatggacataaaaaagaggcataaagcggaagttccttgcttcgactttgaaaattttagccgaaaggggttcaaggagcttcaagtatccgaggaaagtggagtggtcatctttgaaggtgtgtacactttacatcctgctataaggaaatttctggatttgtggattgcagttgttggtggagttcattcacaccttattgcaagaatacagagagacaagaatcgtgctggcttttctatttctcagactgaaatcatgaccactgtgtttccactgtttcagcaatacattgaaccacatcttgtccatgctcatcttaagattcaaaacgattttgatcctgtgctctctcctgaaagctcactttttgtgttaaaaagtaaaaaacagttaccaagctgttgcatatattgaagcttctgcggtgatttaccaagatggaaagattttaatagaagttgaccatctacaaggagtgtcgactccatatcttcaaattaaagggacaaataaagaaattgttacctctgctggttctgcactctgcttggatggttcatacacaacaaagagttatcttcaaattattttggagagcttaccagctgatggtaatgtatctattggtattcacaatcaacaagctgcaaggctgcaggaactggttgagttcatccagtcacagggagggagctttaattcagatttatcgtcaccaatacgagaaacttcctctacagatagtgtgattgatgatatgcagtccaggataaggaagcttgagagatggaatacgataaacatggttttgtggactatattattgtctgctcttgttggatattccctataccagaaaaaacgtcactaggttctctggcagttttactgatagggtaggacgcatacctcattcatggcgtctgcagaactgacttgcacgcttcaggcacaaagttgtaagtgctagagaaaatgaaaagcagcatgtagatacaagatctaagacgtgagagatggcctgcgctcatgccatccctgatggcagtcttatttgtttgatcactcaatgtctgtaataatcttctcgtatgagatccatcaaaaaaatttgtgcagttaatgtgtatgaagcactaacgttgataatcttctcatatggtccatgggcgtttatgtattgtcatccccccttaagtaggaaaanaaaaaagnaanaaaaaaaggggcggccgntctag

SEQ ID NO: 5468 - DNA, 3936 bp, Zea mays
gggggtccccctgcctaagacctcttctgtgatgaataatatccccaggctctccattaaccaagaccctagtagtggaagaactcaggacccttgagactattccacaccacagaggaccaaaacccaaatgtctaagaacctcaaaaaggaaggtccaagagacagagtcaaaagcctttccaatgtccaacttcaataagattctagacattttttgcccataaatagccttggctgtttgctgcaccatgacaaaattatcatgtatacttctacctttcacaaacgcactttggttcacagagaccaagtcagggagcttaggagcaagtctattagccaaaatcttggtaacaatttttgcaaaactgtgaattaggcttattggcctgaaatccttcacctcaatggcctcactcttctttggcaacaaagtaacataggctgagttgagcagatataatctagaagcatccccctgccaaactttcttcaaggctgccataaaatccattttgatgataggccaaacctttttgtaaaatcgacctgtgtacccatctggccccggggccttgtcagaaggaagcgacctgatggtgtgccaaacctcctcctcggtgatcatctgctcaagttcttggaggttcaacggacatctatgaaaggcttccagatttagggctgaagctctgggagggaccattccaagcagcgaattataaaaatcccaaacagcctccttcttctccttttgatcaacgattaatctgttttggacctggatttttccaataaaattcttctttttcctatatctggcgtgctggtgaaagtattcagtgttggcgtcaccttctttcatccacaacagcccactcctcaaacgggctatggttctctcaagggaaaccaaagccaaagaatgatgttttaatcgttgtcttagccactcttcctgtggggatagagatctagaatctcttgcaatttccagcttatgaagaatttctttagccatcaacatctgtttttttatgttgcccacctttttctgactccaggaatgcagatgtttggacagcctcattagtttcccagcaaaacgctgtagagggcagcagccctccaaaggttgcagccaagactgctgcacttcatccataaaaccctccattcttgtccaaaaactttcaaaatgaaaccttctttttccttgtacgagttcatgcaaaccaagcaaaaggggacagtgatcagaaatcaaggaagctgagctttgaaggacagagtttggatataaggtttcccaatctgcagtatggaacaccctgtccaaacggaccagggtgggggaagatctctcattggaccaagtgtatttccttccaagtaaaggcagctccttcagattcagctcgtttaacagacgtctaaatcttcccatcatggctctgtttaggttgccattgtttttatcttcaactctgtaaataaggttgaaatcccccccaatcatccacgggccattgcacaaattacgaatcagttgcaattcctgcaggaatagaatcttgaggttatccaattggggaccataaactccagtgagccaccagagggtgccatcggtgtgctggaactgagctgagactgaaaaggtgtcaattctatattgagtaaccttgcacgaagaacttttccaggccaataaaattccccccctagtgccaactgccgggagcgttacaaattcatcaaaaacaactcccaggagagacgcaaccatgaaacgagaaatagaactcttctttgtttcttgcaaacataccacgtcaggacaagtattattgaccaaagcacgaaccccatcccttctgacttttctattcaaacctctaacattccaaaaaagaatttttgaaggacccataggaaacaaagtcatcaagaactacatagccatgggagatggctcacaatatatcctctggacctaggacagcaggcagcacctggacatcctggagatggatatcgacaggcactgaccaaccgaacaaagcagccaaggctttaatatgtgattcagacaggggagagttgaacagcctgccatatttttcaagagctttatcgctgaacgcctcatccgcatcaccaatatccattgttcttaataattcaaattggatctgcctggttgcgtcattaggggtcctctgtcttgccaatctgctacttcggcgagggataaaatcaggcggtaactgcttacatccccttctgagaggcaccggcggggggagcagaccatctgtcttctttgtcaccaaggcaacgaaatcacaaaccggagttgtgtctttaacatgatcaggttccactgaagtatcttccagtgggctaggcgtctgctgtaagggatccctctgccttcttctgctgtaaaccttcaatgttggacagcccagacctgcaggcccgcactggcctatttcttctgcagttccagccaaagaggacagacaacggggcgagactagcccgtcaagggcccgtcccagcgactcgtcagcttgtctgtcggggatcagctcttcagcttctttagttggcagcaactcttcggcttgtctgtctggcataccatccgtcacacgcgcttcccccacattgagctccgcgccctcagtggaagggcgcagcaccgacggtaggacttatgccgcttcacccaccgcgccattgatagtctccccaggcgcgatcaccaggtcattgccaactcttcgggagggctgctgcgaccctaggcgagaaaaggccgagcgacgcccgccatccgagccgcgtgactgacgtgaggaagaaggcctggaagaaaggtcttggctgccaccaggctagtgtccgccgccacctctcggggagtggccgccatcgccatcggggggagcaccatcaccatcatccgcagggagggcgccatcttcaaccgggacaggggtagccaatatgttcaatttgtaggataaacatctcttctcaccagagccaggacctttctccgtgataaggagatccatattacgatgaagcttcgccggtttgatacaccacgctctcaacatgaaggatgagtaatccgacttcaacacggtcgtcgggtgtaattcatcgataatacatgagtcacgcagcagctgttcggcggtagctcttgaccacgcatgtgccggaatacccctaatctccacatccactagcgctggtaatgtcgctgcagaagcattcgcataacacgtccacctctcgaaaacaagatcaaactatggccctctaaagatccttcctccattgaacacccttgaaaccataacttcatctgggagaaacagcaagaaatcttctggcatggcccgatgaatagacatgttatatgtattgacgttgaagctttgagctatttcttcgatgatgtcaactgctagaacctccagtctggtaccaacaactgtgacgaacagggccctccgcagtgctgcctcttcccttgccatctcagcggagaattccatcacacatgaatggggcttcatggaatcagcatgttgcacagccccctccgagaccaaccctccagaggaggcagaagcaggtgactgccatcgctaatcatggacatcgccaaccgcagcccaccgacgtttttcccaacgcctcttcctctcccctccaatgaccagtggaatagactctccggggccctgggccatgaacggtggtgaaaggagttctcccccggtggtcggctgtgatggagcaatcggcctccatatcgattcctttcgcttgaaaccttgagagactcctccatgcagaaagggatcctgcatctttccgagacgctgccacgccggaacacggcca

SEQ ID NO: 5469 - DNA, 1673 bp, Zea mays
cgacctgcagccaccgccccccgatcaggatgcactggaggctgactcgcgggcccgtttggatttgtcaaaaggggcggcgccctatccaaaatttccgaactgctacctctactctttctcttctccaaaaggagcttgggacaacgaacggataagcagataagtatttttcttctttttgatttgaaaagtcaccgcgcctttcagcctttgcgctgcgcggccgctgcacgggcatgcccgcctttggaatcaggcccgtgggccgtaacgtgcgtggagccgtcgttgactagcctagtagccaggcacggcaagacccgggggagccggactcttggttgggcccgggccgactgccagcgccgacgtggcggcatccggccggtcggatcggtttgaaatttccccgaggagccgggcttcgctctctatctttgggcccctcgaggccggccgggctacccatctccctctgctccgggcgcaccgtcaccggggtgaggctgtattgcgtcgacagcaacacctgctttcgctacgacgggagcaccagaggctaggatatattgcttcatcagtgacagggagccaagatgccggccggagggttctcggtctcggcgccgtccggcgtcgagttcgaggctaagatcacgccgatcgtcatcatctcctgcatcatggctgccacaggcggtttgatgttcggctacgacgtcggcatctcaggtggtgtgacgtcgatggacgacttcctgggcaagttcttcccggcggtgctgcggaagaaactggaggacaaggagagtaactactgcaagtacgataaccagccgctgcagctgttcacgtcgtcgctgtacctcgcggggctgacggccaccttcttcgcctcgtacacgacgcggcgcctcggccggcgcctcaccatgctggtcgccggcgtcttcttcatcgtgggggtgatcttcaacggcgccgcccagaacctcgccatgctcatcgtcggcaggatcttgctcggctgcggcgtcggcttcgccaaccaggccgttcccctgttcctgtctgagatcgcgccgacgaggatccgcggcgggctcaacatcctgttccagctcaacgtcaccatcggcatcctgttcgccaacctcgtcaactacggcacgtccaagatccacccgtgggggtggaggctgtcgctgtcgctggcaggcatcccggcggcgctgctcaccctgggcgcgctcttcgtgacggacacgcccaacagcctcatcgagcgcggccgcctggacgagggcaaggccgtgctcaagaggatccggggcaccgacaacgtggagccggagttcaacgagatcgtggaggcgagccgcgtggcgcaggaggtcaagcacccgttccgcaacctcctgcagcgccgcaaccgcccgcagctcgtcatcgccgtcctcctccagatcttccagcagttcacggggatcaacgccatcatgttctacgcgccggtgctgttcaacacgctggggttcaagagcgacgcgtcgctctactccgccgtcatcccgggccccctcggccgccgtcaacgtcctctccacgctcgtctccgtctactccgtcgaccgcgtcggccgccggatgctgctgctggaggccggcgt

SEQ ID NO: 5470 - DNA, 959 bp, Zea mays
cccgggctccagggcaagggccgtgctcaagaggatccggggcaccgacaacgtggagccggagttcaacgagatcgtggaggcgagccgcgtggcgcaggaggtcaagcacccgttccgcaacctcctgcagcgccgcaaccgcccgcagctcgtcatcgccgtcctcctccagatcttccagcagttcacggggatcaacgccatcatgttctacgcgccggtgctgttcaacacgctggggttcaagagcgacgcgtcgctctactcggccgtcatcacgggcgccgtcaacgtcctctccacgctcgtctccgtctactccgtcgaccgcgtcggccgccggatgctgctgctggaggccggcgtgcagatgttcctgtcgcaggtggccatcgccatcgtgctgggcatcaaggtcaccgaccactccgacaacctgggccacggctgggccatcatggtcgtcgtcatggtctgcaccttcgtctcctccttcgcctggtcctgggggcccctgggctggctcatccccagcgagaccttcccgctggagaccaggtcggcggggcagagcgtcaccgtctgcgtcaacctgctcttcaccttcgtcatcgcgcaggccttcctctccatgctctgccacctcaagtacgccatcttcgtcttcttctccgcctgggtcctccccatgtcgctcttccccctcctctttctgccggagaccaaaacgtgcccatcgaggaaaagaccgaaaggtgttgaagcagcactgggtctggaagccctacatggacgacgacaaccatccaatcgtaaccgtcagcttaaccgccccccccggttaaatcccccgcctgccctgttatgccccaaaattccttggccggcctattgaccttatacttggaagcccgttctcgcaccccccagggctactgcccccaccggcactgtca

SEQ ID NO: 5471 - DNA, 907 bp, Zea mays
  misc_feature (811)..(811): n is a, c, g, or t
atccctccgtccccttcctttggctgctctcctcgtgtggcttctgcggagaaacactcgctgcttgtctagcttccattatatcggcgtagcttgaccggccggcttgcgaggatgccgggcggagggttcgctgtgtcggcgccgtccggcgtggagttcgaggccaagatcacgcccatcgtcatcatctcctgcatcatggcggccaccggcggcctcatgttcggctacgatgtcggcatctcaggcggagtgacatcgatggacgatttcctgcgtgagttcttcccggcggtgctgcgccggaagaaccaggacaaggagagcaactactgcaagtacgacaaccagggcctgcagctcttcacctcatcgctctacctcgccggcctcaccgccaccttcttcgcctcctacactacccgccgcctcggccgccgcctcaccatgctcatcgccggcgtcttcttcatcatcggcgtcatcttcaacggggccgcccagaacctcgctatgcttatcatcggcaggatcctgctcggctgcggcgtcggtttcgccaaccaggccgttcccctgttcctgtctgagatcgcgccgacgaggatccgcggcgggctcaacatcctgttccagttgaacgtgaccatcggcatcctgttcgcaaacctggtcaactacggcaccagcaagatccacccgtggggctggcggctgtcgctgtcgctggctggcatcccggcggcgatgctcaccctgggcgcgctcttcgtcaccgaacacccccaacagcctcatcgagcgcggncacctggaggagggcaaggcggtgcccaagcggatccgcggcaccgacaacgtggagccggagttcaacgagatcgtggagcaagccgcatcgcgc

SEQ ID NO: 5472 - DNA, 835 bp, Zea mays
gccgggccgggaagaacccagaggcgtcctcctccgcccgtctataaattccccgtctttatataggaggcatccgacccaaagaggaggaagaacaccaaggactcactaccagcgcctctccgcgatccaaatcctcccgggaaagttcttggttgatctcttcctcctcgaccgcctcccaggttcttggtgtagcttttgccactctcaccaggagatttcatgtctgatcttgacgttcagatcccaactgcctttgacccctttgccgaggcgaatgctggggacgctggtgcagctgccggatcaaaagactacgttcatgtacgcatccagcagcgtaatggtcgcaagagcctgaccactgtccagggtctgaagaaggagttcagctacagcaagatcctcaaagacctcaagaaagagttttgctgcaatggtacagttgtccaggacacagaacttggacaggtcattcaactccagggtgatcagaggaagaacgtctcaaacttccttgtccaggccggcattgtgaagaaggaacacatcaagattcatggtttctgagcaactgccagctccatatcagagtctacatgcaaagcagctatatattggtggtgcggtatatttagttgtgtgctagcgctagcaggcgtcaccagcttgcgcgctccgagtatacagaaaatctagcatagcccacctctctgcgtgtatgcttgttaccgttgtgttgaaactttgtaaggagcaccatcgttagatggcttgttaccctctcccatcaaggttggataataatatatgctttctgaagcgtgacacc

SEQ ID NO: 5473 - DNA, 838 bp, Zea mays
ccccccccttcccggattcccaccctccacctccaaacgcgcacgcacgcgtccacgaataaaggccgagggcggcgaagccaggcccaatcgccaaaaaccctagcgccgatccgatccgatcgagctctgcttcccctcccatggcggcccccccgagccaggcgagcctcctgctccagaagcagctccgagatctagcgaagaaccccgtggacgggttctcggcggggctggtggacgacggcaacgtgtttgagtggcaggtcaccatcatcggcccgcccgagacattatatgatggaggctacttcaatgcagtaatgacctttcctcaggattatcccaacagtcctccatcagtaaggtttacttctgagatgtggcatccaaacgtctatcctgatgggcgtgtgtgcatttctattcttcatccacctggtgatgatcccaatggttacgagcttgcaagtgaacggtggacaccagtgcacacagttgagagtatagttttgagcattatttcgatgctctctagtccaaacgatgagtctccagcaaatattgaagcggctaaggactggagagaaaagagggccgagttcaagaaaaaggtgaggagccttgttcgcaaatctcaggaaatgctctgaaaaaggaggatcatatgggggagtccacaagcgctgcaattctcttgctttcaccaaatggggcacctgatgccagcacttgcacttctcccctgtttattttccattcagcgtcggtcgaatggtgatgttggtcttgtctctcgagacactttgggtgctgcctattatgaactctcgattga

SEQ ID NO: 5474 - DNA, 1180 bp, Zea mays
  misc_feature (2)..(2): n is a, c, g, or t
  misc_feature (4)..(5): n is a, c, g, or t
tntnnttcgtgcccgccccgccccggccgggccgggctctctaaaaccctagcactccgctcccctacactccctccttgcctctacgccgccagcggtccatgggcaagtcaagcaagaagtccgcggcccctactgtcgtggcgccggcggccgtccttaccaaggggaaggccgggaagaagcgcgaagccgatgacgagatcaagaaggctgtaagcgcaaagaaacagaaggctgcgccggcaaaggcggtgcccgggcccaaagaggccgccaagaaggccaagaagcagccgccgcccaagaaggttgagagcagcagctctgaggagcagtcatccgagtccgaggaggaggaggttcctaagaagactgcaaagcctgtcaaacacgagtcttcagatgatagcagcgacgattcctcctctgacgaggaacctgcaaagaagccttctgctaaacctgtgaccccagctgccagcaacggctcaaagaaaggcaagcctgagagcagctcttctagttctgaggatgagtccgatgatgacgagaaacctgctgctctggtaaagaaaacaccagtcatcgaatctgacagctccgaaagtgactcagatgatagctcagatgaggatgttcctgccaagactcctgctgctgctgccaagaaggtagattcttcagacagttctgagtcggagagtgaatctgaggatgaggagaagtcaaagaaagccgcacaggccaccaagatagctcctgcagctgctaaaaggaaggaggagcccagtgattcctcagacagtgatgagagtgatgaagagcctccccagaaaaagctgaaggatgctgcgaaggttactcctaagtctgccaaaaaggacagcagcagtgatgatgacagtttctgatgaaaagctctgatgatgaaccttaaaaagaaattacaacttgcccaaaatcccagaaaggaaaagcctaatactccttgttaacaacaaagggtcgggaaacaggggcgaaaaaccctttgggatgggggaacctttcccttcaatatttgagttggaaccaggggacacaattttttttccccaaatttggaaagaggcgttttataggtccccccgtgtttcccccatgcaaaaatggccctctcccaaggggaatttggccc

SEQ ID NO: 5475 - DNA, 976 bp, Zea mays
ggcccgggccgggctctctaaaccctagaacacttaggcacagccgccgccgccgctgctcccaggacagcagccaaggaagaggaatccaagcctccgccatgccgaaatccaagcgcaatcgctcagtcaccttgtcaaagaccaagaagaagccggggctagagcgtaagggcaaggtggtcacggagatcaaagacgcgattgagcgccacagcagcgcctatgtcttcacctacaacaatatgaggaatcagaagctcaaggacctcagggaccaactcaagtcctctagccggatattccttgctggaaagaaggtcatgcagatagcattggggcggtcacctgctgatgaagctaagacaggcctgcataaactctccaagttccttcaaggtgcttctggattgttatttacaaatctcccaagggatgatgtcgagagattattccgagaatttgaggcgaatgattttgcgaggacaggaagtattgcgactcaaacggttgagctaaaggaaggccctctggaacagttttcacatgaaatggaaccctttctgcgcaaacaaggactgccagttcgcctaaacaaaggtgttgttgaattggttgcagatcatgtagtatgtgaagaaggaaagcccctttcaccagaagcagcacacactctgcgcgtgcttgggaggaagatggcgacgttccgactgtaccttgtctgccgctggtcgtccgatgactttgaagtgtacaaggaaggcttggcgcacctgggaggtgaggaagctgacgagtcttcttaaggttgttggatcatggtggcgtgcttgttgtctagctgtgttcagacggttttgtgccatgcctttgtacccttaatccgacaggaatctcaaatatatgatctgacccagttgggcatattgttgagtgccagtatttttgcgagctactattaaaaggttgatctttc

SEQ ID NO: 5476 - DNA, 946 bp, Zea mays
cgggccggaaagcactcaccatggcttcctcttcctcattgtttctccttgcagccctccttgcgctggcctcatggcaggccactgcctatgatcctagccctcttcaggacttctgcattgccgacatgaaggcgcctgtgcgagtaaatgggtttgcttgcaaggacccaatggccgcgaccccggaagacttcttcaacgcagccatgctcgatcagcctagggatactaaggccagcaaggtcaggtctaacgtcaccaacatcaatgtcataaatttccctggcctcaacaccctcggcatctcgctggctcgcatcgactatggaccattaggtgtgaacacgccacacatacacccccgtgccactgagctcctcacagtgcttgaggggacactctaccttggatttgtcacatccaacccaaacaggctcttctccaagatagttaagaagggcgatgtattcgtattcccaaaagcaatgatccacttccaaatgaacctagcgcatgacaagccagcagccgcgttgtcctcgctcagcagccaaaaccctggagttatttctattgccaatgcagtatttggatcaaagccaccgatttcggatgatgtcttagccacggcatttcaggtggagaaggatctcattcactggctccaatctcagttctgggggaacaccaactactaaatattctcttttatctgggcatatgggaagttaatatgtaatgatatatagaataaatgacatgcaatacgtatgcatgcatggttgcgagctgtgaatttttattttctttttgaatcgtgacaagatatgttttttgtcagattcatgtcataatgtgctggtgatgttttcactgtttgatgaatggaatacagaggtgctccctcccctctaaaaaaaaaaaaaaaaaaaaggcccctaag

SEQ ID NO: 5477 - DNA, 1198 bp, Zea mays
gaagaaaagaaacgccaccaaatccaatctcgagcccccctctcccgtccgcccgtcccaacccgatccgatcccctcctccgtcgccatgggccgcaagttcttcgtcggcggcaactggaaatgcaatggaactgtcgaacaggtagagagtatcgtcaatactctgaacgctggacagatcgcctctacggatgttgtcgaggttgttgtcagcccaccctatgtcttccttcccaccgtcaaggctaagctgcgcccagagatccaagttgctgctcagaactgctgggtgaagaagggcggtgctttcaccggtgaagtcagtgctgagatgcttgtcaacctcggcgttccctgggtcattcttggacactctgaaaggaggagcttgatgggagaatcaagtgagtttgttggagagaaggttgcatatgcactcgctcagggcttgaaggtcattgcatgtgttggtgagactcttgagcagcgagaagctggatcaaccatggaagttgtcgctgaacagacaaaagcaattactggcaagatcaaggactggactaacgtggttgtcgcgtatgaaccagtgtgggccattggcaccggtaaagttgcgacaccggctcaggcgcaggaagtccatgccaatctgagggactggctcaagaccaatgtgagccctgaggttgctgcatccacacggatcatctatggaggatctgtaactggcgcaagctgcaaggagttggccgcgcagcccgacgtcgatggtttcctcgttggtggagcttccttgaagcctgagttcatcgacatcatcaacgccgccaccgtgaagtctgcctaagcaagatctcgacgtgtggctcctctgggcgtggaggaagacagcaacgatgaaaaagcccccttttttctctcctgggtttattaatgggactatgctagaaatttgcgggggaaccgttgcttactggggttcctccccctgacttgaacttggaaagccaaaagggaaatggttaaatacccgaaaaaaaaaaaaaaaaaaaaaaggcccctaagggcccccaagccgcccgccctttctggaaacccctccccccctattctagcgtttttttgggggggcggggggggggcccgcaaaaccacctttaaaatctcaaagcccccctaaaaggggaatcctccc

SEQ ID NO: 5478 - DNA, 1057 bp, Zea mays
  misc_feature (801)..(801): n is a, c, g, or t
cgggcaagaagaaaagaaacgccaccaaatccaatctcgagcccccctctcccgtccgcccgtcccaacccgatccgatctcccccctcctcctccgtcgccatgggccgcaagttcttcgtcggcggcaactggaaatgcaatggaactgtcgaacaggtagagagcatcgtcaatactctgaacgctggacagatcgcctctacggatgttgtcgaggttgtcgttagcccgccctatgtcttccttcccaccgtcaagggtaagctgcgcccagagatccaagttgctgctcagaactgctgggtgaagaagggcggtgctttcaccggtgaagtcagtgctgagatgcttgtcaacctcggcgttccctgggtcatccttggacactctgaaaggaggagcttgatgggagaatcaagcgagtttgttggagagaaggttgcatatgcactcgctcagggcttgaaggtcattgcatgtgttggtgagactcttgagcagcgagaagctggatcaaccatggcggttgtcgctgaacagacaaaagcaattgctgacaagatcaaggactggaccaacgtggtcgtcgcctatgaaccagtgtgggccattggcaccggtaaagttgcatcaccggctcaggcacaggaagtccatgccaatctgagggactggctcaagaccaatgtgagccccgaggttgctgaatccacgcggatcatctatggaggatctgtaactggcgcaagctgcaaggagttggccgcgcagccccgacgtcgatgggtttccctcgtntggtggagcttccttgaagcctgagttcatcgacatcatcaccgccgccaccgtgaagtctgcctaagcaagatcttcgacgtggctcctttcggcgtggagtaagacagcgaagatgaaaaaactcccttttttctctcctgtggttattatgtggacaatgcaagtaattttggggggggacaacttgctacggtgtttcctccccccggaattgaaccttggaaaccaaataatgaaaatggttggttactgg

SEQ ID NO: 5479 - DNA, 960 bp, Zea mays
ggcgggggctacatagcaagctccttctctgctaaccgagcgagagcagctgtagcctacactctacagctagcgcaactaacgaccatccacctgaaagagggagaaggcattgggggttcttgaagtgcagtgcaggtccaggcagctagcagtgaccgagagtgagggacagggcaatggcgtcctcactgctccactgccccgacaagctcccgttcttggacgtggaggccatcctccacatgaaagaggggctcggcgagaccagctacgcgcagaactcctcgcttcagaagcgaggcatggacacgctgaggagcctcatcaccagcaccgcgacggacgtgtacgtctcgcagatgccggagcggttcacggtggccgacctcggctgctcctcggggcccaacgcgctgtgcctggcggaggacatcgtggggagcatcggcagggcgtgcggccggtcgtcgcggccgccgcccgagttctcggtgctgctcaacgacctgcccaccaacgacttcaacaccatcttcttcagcctgccggagttcgccgaccggctcgaggccgcggccaggacggacgagtggggccggccgatggtgttcctgtccggggtcccgggctcgttctacgggcggctgttccccaggacgagcgtgcacttcatctgctcctgctccagcctgcactggctctcccaggtccctccggggctcttcgacgagacggacaacaggccggtgaacaaggggaagatgtacatctcgagcaccagccccgcggccgtgccgctggcctacctgaggcagttccggagagacttcggcgtgttcctcaggtcgcgcgcggccgaggtcgtccccggcggccggatggtcctcgccatgcttggccggcagaccgaaggctacgtcgaccggcggacgaccttcctctgggagctcctctccg

SEQ ID NO: 5480 - DNA, 870 bp, Zea mays
  misc_feature (812)..(812): n is a, c, g, or t
cggccgctcgaggcggcactcccccagctcaaggccttctccagtcgatcacacacgctctcctcgccgccaagatgttcgggttcgggcaccaccacaaggaccaggcgccggcggcgtcgggccccaaccagatcttcaagatctactgccgggcctcggaggactactgcctcgccgtccgcgacggcgaggtggtgctcgcccccgtcaaccccaaggacgagacccagcactggctcaaggacatgcgcttcagcaccaccgtcaaggacgaggagggcatgccggccttcgcgctcgtcaacaaggccaccggcctcgccgtcaagcactccatcggccagtcccaccccgtgaagctggtgccgttcaacccggcgtacgaggacgcgtcggtgctgtggacggagagcaaggacgtgggcaagggtttccgctgcatccgcatggtcaacaacacccgcctcaacttcgacgccctcaacggcgacaaggaccacggcggcgtgcacgacggcaccaccgtcgtgctctgggagtggtgcaagggggacaaccagtgctggaagatctggccgtgggccgaggcgcacgccgccgtcgagtccggcgccaccatgggcaacaacgcccacgccatgggcggcgggccccccgtgcacgccgtgcgcatcttctgcaagggcggcgaggactacagcctcaccgcccgcaacggcaccgtctgcctcgcccccaccaaccccagggacgactaccagcactggatcaaggacatgaggcacagcaacaagatcaggggacgaggnaagggtacccctgccttcgcaatagtgaacaaggtcaccggcgaatgcatcaagcact

SEQ ID NO: 5481 - DNA, 838 bp, Zea mays
cgggacatctcagcatcgatcacatcacacatattcatcgagttctttcccgctctctcatcagtctctgtagtcagcttcgagctagccacactctgttcttcgaccacgaccgcaagtcctctgaaatggcattcgtttgtgcgaaggcagagctgcttgcagcggtgatgcttgcgagcgccgcacaactttgcatgggcgcgaggcggcgcatggagctgtaccggccggacccggccaacatgctctcctaccacaacggtgccgtgctccacggcgacatttccgtgtccgtcctctggtacggcgacttcaagccggcgcagaaggcggtgatcctcgacttcctcctctcgctcaccgccgagcctcaggccgcatcgccgtcggtcgcgcagtggtggagcaccatcgaccagcagtacctgtcccccgcgagcgccaaatccaacggcgcgagcgagaagacccgtgtcctgctcgcggaccagctctcggacggcgagtgctccatgggcaagtccctcaccctcgagcagatcaccgccctggccgcgacggctagccccaagaaaggcggcgtcgcagtggtgttcacggcgcaggacgtgacggtggagggcttcggcatgggccgatgcagcctgcacggctccgacgccagctccggcacgaccccacatctgggtcggcaaccccggagacgcagtggtcccgggcgcgtgcgcgtggcccttccatcagcccgcctatggcccccaggaccgcgcccctcgtggcgccccaatgccgacgtcggggcggacgccatggtcatgaacttcgcgagcatgct

SEQ ID NO: 5482 - DNA, 1206 bp, Zea mays
gttgaatcggagatcggtcctgtaatctgtgcttgccgcggtatgtttgtgtttgcggtggttccaaaaaaaaaaaaaaaaaaaaaaaaaaatcgaggggccggccgggcccgggaacacaaccaacaatcactgcaactaactagaagaagaagaagaagaagaagaagcagaaacgatggcgttccgacgcccttcatgtgtaatactaggagctcttctcgccgtctccttcctcgccgccacggcagccgcctgtgaccacggcctgacggtcttctggggccggaacaaggacgagggctccctcggggaggcctgcgacaccggcatctacaacaccgtcatcatctccttctacagcgtcttcggccacggcaagtactggggcgacctctccggccacccgctctacggcatcggcgccgacatcaaacaatgccggggcaagggcatcgtcgtcctcctctccatcggcggcggcggcacccagtactccctgccgtcatcacagtccgcggccgacgtcgccgacaacctgtggaacgcgcacctcgggggcggccgccgcggcgtgttccgcccgttcggcgacgccgtgctcgacggcatcgacttcttcatcgaccagggcgcgccggaccactacgacgagctggccaggcgcctgtccggatacaaccggtactaccgcggcgcgcccggggtgcggctgacggcgacggcgcggtgcgtttacccggactggcacgtccagagggcgctggacacggggctgttcgagcggatccacgtcaggttctacggcgaggaccggtgctcgtacaaccacgtgtacaaagacggggtgatggcgcagtggagcaagtggacggcgaggtacccccggagcaaggtgtacatcgggctgccggcggcgaacgtgccgggggaggaacgacaaggtcggcctgccgtcgatgaactacgacctaatgcccagcggggagcaaggcggcaaacttacggcgggggccatgttcttggaacaggactaacaacaatcagaacggaatacgggccgcgacctccaaaaacgggcggcatcaactaaataaataaaaggggaattgccttggcatggcataataagggggggggggcggcccgaaaaaaacacaaaaataaacaacttggaggggaacggagggggatattgattttttc

SEQ ID NO: 5483 - DNA, 1026 bp, Zea mays
cggccgctcgagcggcgggcgggaattcaaaaacgggacaaacaacaaccaacaatcactgcaactaactagaagaagaagaagaagaagaagaagcagtaacgatggcgttccgacgcccttcatgtgtactactaggagctcttctcgccgtctccttcctcgccgccacggcagccgccggtgaccacggcctgacggtcttctggggccggaacaaggacgagggctccctcggggaggcctgcgacaccggcatctacaacaccgtcatcatctccttctacagcgtcttcggccacggcaggtactggggcgacctctccggccacccgctctacggcatcggcgccgacatcaagcactgccggggcaagggcatcgtcgtcctcctctccatcggcggcggcggcacccagtactccctgccctcctcacagtccgcggccgacgtcgccgacaacctgtggaacgcgcacctcggcggcggccgccccggcgtgttccgcccgttcggcgacgccgtgctcgacggcatcgacttcttcatcgaccagggcgcgccggaccactacgacgagctggccaggcgcctctccggatacaaccggtactaccgcggcggcgcccggggtgcggctgacggcgacgccgcggtgcgtgtacccggactggcacgtccagagggcgctggacacggggctgttcgagcggatccacgtcaggttctacggcgacgaccggtgctcctacaaccacgtgcacaaagacggggtgaatggcgcagtggagcaagtggacggcgaggtacccccggagcaaggtgtacatcgggctgccggcggcgaagtgccgggggaggacgacaaggtcggcctgccgtcgatgaactacgacctaatgcccagcgtgaagcaggcggcaacttacgcggggtcatgctctgggacaggtactacgacaagcagaccggatacggccgcgacctctacaacggcggcatcaactaataatcaacgggcatgc

SEQ ID NO: 5484 - DNA, 1018 bp, Zea mays
gggcgcttaaggcggcgggccggcctcctcccacaccaccctcccccatccgccgccgcctccacctccgcaggggaaggaagggaagatgtcgcaccgtaagttcgagcacccgaggcacggatccctcggtttcctccccaggaagcggtgctcgcgccaccgcggaaaggtgaaggcctttcccagagatgaccaatccaagaaatgccaccttactgccttccttggctacaaggctgggatgacccacattgtgcgtgaggttgagaagcctggttccaagctacacaagaaggagacatgtgaggctgtcaccattgttgagacacccccgattgttattgttggactggttgcctatgtgaagactcctcgtggccttcgtactctcaactctgtctgggcacagcatctcagcgaagatgtcaggagaaggttctacaagaactggtgcaagagcaagaagaaggccttcaccaagtatgctctgaagtatgacagtgatgctggcaagaaagaaatccagatgcagcttgagaagatgaagaagtatgctactgttgtccgtgttatcgcccatacccagatcaggaagatgaagggtttgaagcagaagaaggctcacctcatggagatccagatcaatggcggcaccattgccgataaggtcgactatggttacaacttctttgagaaggaagtccccattgatgcagtcttccaaaaggatgagatgattgacatcatcggagttaccaagggtaagggttacgaaggtgttgtgacacgttggggtgtcacccgtcttccccgcaagacccacagaggtcttcgcaaggttgcctgtattggtgcctggcatcctgctagggtgtcctacactgttgctcgtgctggtcagaatggttaccaccaccgaactgagatgaaccagaaggtctacaagattggggcaaggttggacagggaactcatgatgcctctacccgagttcgacaggactgagaaggacatc

SEQ ID NO: 5485 - DNA, 886 bp, Zea mays
ctcccatcccgcacccctccgccccccactcctccctattcctatccccccagcctccccccacgaacccacagcgcgcacccgagatccgcagccgaagcccgtgagaacagcgaagcgcgagaggaaaggcactgaactagtttgcaacaaagaagagggaaaatgtctaccgctgaggcaacccgtgaggagaatgtgtacatggccaagctcgccgagcaggctgagcgttacgaggaaatggttgagttcatggagaaggtggcaaagaccgctgatgttggtgagctcactgttgaggagcgcaacctgctctctgtggcttacaagaatgtgattggtgcccggagggcttcctggaggatcatctcctccattgagcagaaggaggagagccgtgggaacgaggcctatgttgcttcaatcaaggagtaccgtaccaggattgaaaccgagctcagcaagatctgtgatggcatcctcaagcttctggactcccaccttgtcccctctgccactgcagcagagtccaaggtgttctatctgaaaatgaagggtgactaccacaggtaccttgcggagttcaaggcgggtgctgagaggaaagaagcagctgagaacactcttgtagcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagccattgctgagctggactccctcggcgaggaatcctacaaggacagcaccttgatcatgcaacttcttcgtgacaacttgactctctggacctctgata

SEQ ID NO: 5486 - DNA, 830 bp, Zea mays
  misc_feature (818)..(818): n is a, c, g, or t
atctcccacagcgccacctctcccttccagtcatctgacatctgctcccgtcctctcctctcctcttcccccgaggcagcagcgtccctcctctccgcccggatcgcgatggccgccgccgccgtcgccgccgactccaagatcgacaacctccgcgacgccgtcgccaagctcggcgagatcagcgagaacgagaaggccgggttcatcagcctcgtctcgcgttacctcagcggcgaggcggagcagatcgagtggagcaagatccagacccccaccgatgaggtggtggtgccctacgacaccctcgcgccccctcccgaagatctcgacgccatgaaggccctgctcgacaagctcgtggtgctcaagctcaacggaggcctcggcaccaccatgggctgcaccggccccaagtctgtcattgaagttcgcaatgggtttacatttcttgaccttattgtgattcagattgagtccctgaacaagaagtatggatgcagtgttcctttgcttctaatgaactctttcaacactcatgatgacacacagaagattgttgagaagtactccaactccaacattgaaattcacactttcaaccagagccaataccctcgcattgttactgaagacttcttgccacttccaagcaaagggcagacagggaaggatggctggtaccccccaggccacggtgatgtgttcccctctttgaacacagtggaaaactcgataccttgctgtcacaggggaaaggagtatgtcttcgtggcgaactcagacacttgggtgctattgttgacatcaggttttanacacctgatcct

SEQ ID NO: 5487 - DNA, 971 bp, Zea mays
atctatatagtatccccaattcgccgcccagcgcgcaataccgcgtcccaaccgaaatccccaattccccaccccagagcgtcggcgagagagatggcgtcggcgacggagatgcagccgctggcaccgtcgggctaccgccgggcgccggagatgaaggagaaggtggaggcgtcgtcgatcgacctggaggcggggaacggggagacgctctacccggggatctcgcgcggggagaacgccctccgctggggcttcatccgcaaggtctacggcatcctctgcgcgcagctggtcctcaccaccgtcgtctccgccatcaccgtcttccaccccaccctcaacgccacgctctccaactcgcccgtcctcgcgctcgtgctcgctgtcctccccttcatcctgatgatcccattgtacatctatcagcacagacaccctcacaatcttgctatcttgggtttgttcactctgtgcttgagcttcagcattggtgtggcttgtgcaaacactgaaggaactattgtgcttcaagcattggtactgacctcagctgtggttgtctctctgactgcatacacattctgggccgcaaagaagggcaaggaatttagttaccttggaccatttctgttttctgctctcaccatcctggtcgtgataagctttacccagatcttcttcccattcggacctgcatcgaatgctgtgattggcgggtttggagctctagtcttctcaggcttcatcgtctacgacactgagaacttgataaagcgccacacttacgacgagtacattctgggcgtctgttgggctttacctcgacattctcaacctgttcctgaccatcctacagatgctcaggcagaatgacaactgatgggtcctgtctgaaccaccaggaaccctgtgccaacccaggcatatgtcctacatttatcaagtcttttgaattgctatctacataa

SEQ ID NO: 5488 - DNA, 863 bp, Zea mays
ggcctccctctctctctccatttctctcctcctcctcctgccaccgatcccgaaccagggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctctgcgccagcgacactggtacatccagagcacatgtgctacctctgggagaggggttgtacgagggccttgactggctgtccaacaacattgccaacaaggcttgaagcatctcggcaggggcttctatggatctggataagctggatattcggactaatactgcctttacgtattataaactatatagtcttgacagataaaggggggtggttttggaaagataaagctctctgtcaagagctagctatcagattgttttc

SEQ ID NO: 5489 - DNA, 1145 bp, Zea mays
cggccgcccgaggcggcagacctaagcagagtggggaaaggcgtcttcgtactcgcctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctgtactgcctcgagcatggcattcagcctgatggccagatgcccggtgacaagaccgttgggggaggtgatgatgctttcaacaccttcttcagcgagactggggctgggaagcacgtcccccgtgctgtcttcgtagatctcgagcccactgtgattgatgaggtgaggactggcgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtcttcaacgctgttggaggtggaactggctctggccttggttctcttctgctggagcgcctctctgttgactatggaaagaagtccaagcttgggttcacagtgtacccatcaccccaggtctccacctctgttgttgagccatacaacagtgtcctgtccacccactccctccttgagcacactgatgtgtctatccttcttgacaatgaggccatctatgacatctgccgccgctcccttgacattgagcgcccaacatacaccaacctcaacaggcttgtttctcaggtcatttcatcgctgacagcttccctgaggtttgatggtgctctgaatgttgatgtcaatgaattccagaccaacttggtgccctacccgaggatccacttcatgctttcctcctatgccccagtgatctcagctgagaaggcctaccatgagcagctgtctgttgctgagatcaccaacagcgcctttgagccttcatctatgatggccaagtgtgacccccgccacggcaagtacatggcctgctgtctcatgtaccgtggtgatgttgttcccaaggatgtcaacgctgctgtggccaccatca

SEQ ID NO: 5490 - DNA, 870 bp, Zea mays
ggagacccccccctccaaactttccccagtccaatctcccaatccaatcttccctctcctctcctggaaccctaagcctcctcaggtacatgacccacccttcctcgtcctcctcctccgccccggcggccgcgccggatgacccgacctcccttgccccgggcttccgcttccacccaacagacgaggagctcgtctcctactacctcaagcgcaaggtgctcggtcgcccgctcaaggtcgacgccatcgctgaggtagacctctacaaggtcgagccatgggacctcccggcaaggtcgcgcctccgcagccgcgactcccagtggtacttcttcagccgcctcgaccgcaagcacgccaaccgcgcgcgcaccaaccgcgccactgcaggaggctactggaagaccaccggcaaggacagggaggtccgccatggagctagggttgtcgggatgaagaagacgctcgtcttccacgctggccgcgcgcccaagggcgagcgcaccaactgggtcatgcacgagtatcgccttgagggcgatggcgcagccgggatcccacaggattcatttgtagtgtgccgaatcttccagaaggctgggcctggtcctcaaaacggggcacagtatggagctcccttcgtcgaggaggagtgggaggcggatgaggatgatgattttggtcctctgccagtgcagagggacgtttttggtgagcatgaggctcctggtgctatggagaaaggatatcttcagatgaatgatctcattcaggacttggctggtcaaatgagaaatggcagtgttgttttgccagtttctgacacttcaaacacagcagccattctgaagacgaaaagggaaattc

SEQ ID NO: 5491 - DNA, 882 bp, Zea mays
cggccgctcgaggcggccgggcgggctccgccttgcgagaccaaccaagctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctggacagtgtggcagagctgatgggtacatcctggagggcaaggagctggagttctacatgaggaagctccagaagaagaaagggccagggtgccacagctttaggccgaagagctgctgcatgggtcccgttggattttcttagatgttgcgtccatgtcatgtttgcagacatactgaacaccattttctgtaaact

SEQ ID NO: 5492 - DNA, 855 bp, Zea mays
ggccagtcgcgagcccccgcttccattctaatccgccccctcccgagacgccaaagccccaaacccctcgccctcccaaaccctaaccctaaaacctccgccctcccgccgccgccgccgcccgattcccctccccagcctccgcatcccccgtccggcttgaacgatgtcgtccgacgaggaggtcagggaggagaaggagctcgacctctcctccaacgaggtcgtcaccaagtacaagaccgccgccgagatcatcaacaaggctctgaagttggtattgtcggagtgcaagccgaaagccaagattgttgacatttgtgagaagggtgacaatttcataacagagcaaactgggaatgtctacaagaacgtgaagaggaagattgaaaggggcattgctttcccgacatgtgtatctgtgaacaacacagtctgtcatttctccccactggcaactgacgattctgtactcgaagaaaatgacatggtgaagatcgatatggcttgccatattgatggttttattgctgtggtggctcatacacatgtcatcagagctgggccggttactggaagagcagctaatgttcttgctgctgcaaacacagcagcagaagttgcaatgaggcttgttagacctggcaagaagaataaggatgtcactgaagcaatccagaaagttgctgctgcttatgattgtaaaattgttgaaggagttcttagccatcagctgaaacaattcgtcatcgatggtaacaaagtggtacttagtgtttcaaacgctgatacaaaggtggatgatgctgaatttgaagaaatgaagtgtatgcaattgatattgtcaccagcact

SEQ ID NO: 5493 - DNA, 854 bp, Zea mays
ctctcccctccaccctcctcccccctcgtcttattttaccgagcgatccccccagcgagctaaaccctagatcctccgcccaaccgctaaaaccctagcaggccaagagctgctgcgtcggggacgataggatggccgagccctccagggtgatccacatccggaacgtcgggcatgagatctccgagactgacctgctccaggtggtgcagccgtttggcgcggtcgccaagctcgtcatgctgcgcaccaagaaccaggcccttgtccagatggaggacctgtctgcttcaatcagcgccatccaatactacactacaattcaacctagcgtgaggggaagaaacgtatacttgcagtactcatctcaccaggaactgactactgatcagagctctcatggacggaatcctgatcaggatgaacccaaccgaattctcttagttaccgttcatcatatgctctatcctatgaccgtcgaagtgcttcatcaagtgttttccccttatggatttgtggagaagattgtcacatttcaaaagactgctggttttcaagcccttatacagtttcagtcacgccagagtgcaatacaagcagctggtgctttgcatggacggaacatttatgatggttgctgccagctagatattcagtactcaaatctcagcgagttgcaagttcactacaacaatgatagatctagagatttcacaaatccttctttgcccacagagcaacgtccaagatcctctcagcttggttataatgatccctagccccttttggtttccccacagcctggagctgcatatggacagggctgcagtgattgctgctgcatttggcggaac

SEQ ID NO: 5494 - DNA, 1157 bp, Zea mays
gccccccacttccgtcccatccggacggccgaccttggttccgtcctctcgcatccgcccgcctactaccggcgccgtcgccggtgacctctccagcggggcgcctccgagttcccgacgcaggccacctcactgtcgaacatggcctcgccggcgccggttccggcctcgccggggtcctcctctcagaaaaaacgaggtgcaacggaatcaattggcctgtatgctgtccagtgttgtgaatgtcataaatggcgtacagtttcaacgaaagatgaatttgagacaattcgtgagaacttcactgaagacccatggttctgcagtaaaagacctgagtgctcgtgtgaagaccctccagacattgagtatgacagcagccgcatatgggtcatcgacaagcccaacataccaaagcctccgcccaagaccgagagacttgtgatcatgagaggtgatctgtctaaaatggacatctactatgtcctgccaaacgggaagcgtgcaaggggcatcggggacgtgcagaagttccttgacacaaacccagagtacaaggaccgcatatcagctgaaagcttcagttttacggtgcccaagattgttgaggagaccgtttcacagagctctttgtggaagactaaaaaggctaaaaagcaggacaagataaatgcttcaagcagcaagaaggacaaggcaaatgcttcaagcagtgagaactagccatgtcagcaaatgcaaaactgtcgcctgcctgcttggatgatcctacctcatctaccttgaagttaggcatcaagtcggttctctctctctctctctgcgaggttcctctgagcgctcccatgcactgaatctcttcctttttatgcatgagtttcttggtaaaattctggagatgctcgagaaagggctgtagccttgttcttcttctaataaaaaagaactaagttataagaaaaaaaaaaaaaaaaaaaaaagggcccctaaggggccttcgagcgggcccgcacttaacgtggaaccaattcccccctaaatccaagtttttttttgggggggcggaaggggggccggaaaaaggcacttaaaatccgaaaaccccataagaggggaaccccccccaaattttaaaaaccttttggaggggggaaaaa

SEQ ID NO: 5495 - DNA, 1523 bp, Zea mays
agtgagggttggtgcggccgctcgagccgccctcagccgcacgcaaactcgttgcacaagaattcctcccacccccaccgtctcgccgccgccaccacagctagataagaaaaaaagagagagcagaactcgttgggagtgctcgagatctgtgtcgggagagggggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccccttcccgtagtttaggatttttatgcaattttattctgactcttttctcccaccaatctctctggcctgcttcacgataatcgaccagttctctagtcttactccctctgttcctctctgctctgctttctgactcaaactgcaacaatggctgccccgacctctgcaatcgggttcgagggctacgagaagcgcctcgagatcaccttctccgaggcatcgatctttgccgaccctcatggtcgtggcctgcgcgccctctctagggcccagattgactctgttcttgatcttgcacggtgcaccattgtgtccgagctctccaacaaggacttcgactcgtatgtgctatctgagtccagcctgttcatctattctcagaagattgtgatcaagacctgtgggactaccatgctcctgctcaccattcctaggattcttgagcttgctgaagagctgtgcatgccgcttgctgccgtcaagtactctcgtgggatgttcatcttccccggcgcacagcctgctccccacaggagcttctctgaggaggttgatgtcctgaaccgctacttcggccacctgaagtctggtggcaatgcttatgtgatcggagacccagcgaagcctggccagaagtggcacatctactatgccaccgagcaacctgagcagcccatggtcaccctggagatgtgcatgactgggctggacaagaagaaggcctctgtcttcttcaagactcaagctgatggccacgtttcctgtgccaaggagatgaccaagctctctggaatctctgacattatccctgagatggaggtctgtgacttcgacttcgagccctgcggctactccatgaacgccatcaacggatctgccgtctccaccatccatgtgacccccgaggacggcttcagctacgcgagctacgaggtcatgggcatggacgcctccgccctggcctacggcgacatcgtcaagagggtcctccggtgctttggcccttcagagttctctgtggcggtcaccatctttggtggccgtggccacgccgccacctggggcaagaagctcgaagctgaggcatacgactgcaac

SEQ ID NO: 5496 - DNA, 1363 bp, Zea mays
aggactcagccgcacgcaaactcgttgcacaagaattcctcccacccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgcaacaatggctgccccgacctctgcgatcgggtttgagggctacgagaagcgcctcgagatcaccttctccgaggcatcaatctttgccgaccctcatggtcgtggcctgcgcgccctctccagggcccagattgactctgttcttgatcttgcacggtgcaccattgtgtccgagctctccaacaaggacttcgactcctatgtgctatctgagtcgagcctgttcatctactctcagaagattgtgatcaagacctgtgggactaccatgctcctgctcaccattcctaggattctcgagctggctgaagagctgtgcatgtcgcttgctgctgtgaagtactcccgtgggatgttcatcttccccggtgcacagcctgctccccacaggagcttctctgaggaggttgatgtcctgaaccgctactttggccacctgaagtctggtggcaatgcctatgtgattggagacccagcgaagcctggccagaagtggcacatctactatgccaccgagcaacctgagcagcccatggtcaccctggagatgtgcatgactgggctcgacaagaagaaggcctctgtgttcttcaagacttctgctgatggccatgtctcctgtgctaaggagatgaccaagctctctggtatctctgacatcatccctgagatggaggtctgtgacttcgacttcgagccctgcggctactccatgaacgccatcaacggatctgccttctccaccatccatgtgacccccgaggacggcttcagttacgcgagctacgaggtcatgggcatggacgcttc

SEQ ID NO: 5497 - DNA, 855 bp, Zea mays
ccctcagctgcacgctaactcgttgcacaagaattcctcccaccctcgccgtctcgccgccgtcaccaccgcagctagataagagaaaaaaagagagagaagaactcgtcgggagggctcgagatctgtgttcggagaggggaattcttgaggtcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccccttcccgtagtttaggatttttatgcaattttattctgactcttttctcccaccaatctctctggcttgctgcttcacgataatcgaccagttctctagtctttctccctctgttcctctctgctctgctttctgactcaaaactgcaacaatggctgccccgacctctgcgatcggatttgagggctacgagaagcgccttgatatcaccttctctgaggcatcaatctttgctgaccctcatggtcgtggcctgcgcgccctctccagggcccagattgactctgttcttgatcttgcacggtgcaccattgtgtccgagctctccaacaaggactttgactcgtacgtgctatccgagtcgagcttgtttatctactctcagaagattgtgatcaagacctgtgggactaccatgctcctgctcaccattcccaggattctcgagctggctg

SEQ ID NO: 5498 - DNA, 806 bp, Zea mays
ccttccgtctacccgagtcgcccgaaaagccagcactttcttcccttccgatttcgcacgatggcgactctcctccgccgatccgccgcccccgcgcggcagcttctcctccttccccgccagctcggcgccgcccgctccatgtcccgctactacgcccgtgacgaggtttcacggttcgacgcgctgagcacgccggtgaactggggcgtgagcatcgtgccggagaagaaggccttcgtgattgagcgcttcggcaagtacctcaagacgctcgactccgggatccacgggctcgtccccctcgtcgaccgcatcgcctacgtgcactctctcaaggaggaagccatccccatccccgaccagtccgctatcaccaaggataacgtggtcatccagatcgacggcgtcctctacgtcaagattgttgatccctaccgtgcttcatatggcgtggagaatcccatttttgcagtcattcaacttgcgcagacaactatgagaagtgagcttggaaagataaccttggacaagacttttgaagagagagacacattgaatgagaagattgtgaggtccataaatgaggcttcgacagactggggcttgaagtgtcttcgttacgagatcagggacatttctcctccaccgggcgtgaagaatgctatggagatgcaagcagaggcagaaaggagaaagcgtgctcaaattctccagtcagaaggggctatgttggatcaggcaaaccgcgcaaaaggtgaggctgaagcgattctttccagtcacaagctaccgccgaagggatt

SEQ ID NO: 5499 - DNA, 1105 bp, Zea mays
actcccctgcgccgccataaagccgcccccccgtccccgccgggccgccctctcttcccaccctcgcccgctgaggtttccgccgcgatctcgtctcgatccgcactctctatctgagatttggaatcgggcgaggcctgcagctcctgccgacatggcgctcgttttgcattcgggcagtggcaacaagaatgccttcaaggcacttattgctgcagagtactgtggggtcaaggttgagctgaccaagaactttgagatgggtgtctcaaacaaaacccctgaattcatcaagatgaacccccttggcaaggttcctgttcttgagactcctgatggtgctgtttttgagagcaatgctattgcacgctatgttgctcgctcaaagggtgacaacctgctttggggtggttctcttattgaatatgcgcgtgttgagcaatggatggactttggtgccacagaggttgatcccaatatcgcaaggtggctgtacccaaggcttggttatatgccttacaatgcccaggctgaggaattcggcattgctggattaaagagggcccttgaagcattgaacacacacctggcatcaaacacattccttgttgggcattctgtcactctggctgatattgtcatgacatgcaacctctaccatggttttgctcggatcttgaccaagactttcacatctgagttccctcatgttgagaggtacttctggaccatggttaaccagcctaacttcaagaaggtcattggcgatttcaagcaggcagaggttgtacctcctgttcagaagaaggctgctcctgctaaacaaaaggaggccaagaaagaggctcccaaggcggccccaaagccagcagaggttgaggcaccagaggaagaggcaccaaagccaaagcccaaaaatccccttgatctactgccaccaagcaagatggtacttgatgactggaagaggctatactcaaacactaagagcaacttccatgatggtgctggtaaaggtttctgggggatgtatgacccagagggctactctctctggttctgtgactacaagtaccaggaagagaacaccgtgtcctacgtgacc

SEQ ID NO: 5500 - DNA, 818 bp, Zea mays
atcacaacacaaacaaacaatcaaacggagtacacatcttacaaggttagtaagaaggttgttcatagtcgaccaatatggctggcgtctccaccaatgccattgcccttgtgcttgtgacactcctctccgtgcttgtcacgtccgtccgttctgcggccaactacgacaccgccaccgctagatcctacaactccggctggctccccgccaaggccacctggtacggtgcgcccaccggcgccggccccatggacaacggcggtgcttgcggcttcaagaacgtgaacaagtaccccttctcctccatggcgtcctgcggcaacgagcctctgttcgacggcggcgcaggctgcggcagttgctacgagattcgatgcatcgccgccaacaacccttcctgctccggccagccgaggacggtcgtcatcaccgacatgaactactaccccgtggccaggtaccacttcgacctcagcggcactgcgttcggggccatggccaaatacggcctcaacgacaagctccgccacgccggcatcatcgacatgcagttcaggagggtgcgctgcaacttcccgggcatgaaggtcaccttccacgtccagcgtggatccaaccccaactacctcgcagtcctcgtggagtacgccaacgtcgacggcaccgtggtccgcatggagctcatgcaaaccaggaacgggcgcccaacggggtcctgggagccaatgcgccgctcctggggatccatctggcggatggacaccagccgcccgctgcaggggcccttctccatgcgtatcacagcgactcccgga

SEQ ID NO: 5501 - DNA, 1000 bp, Zea mays
attgcaaaggaagcgaaccccccgcccccttcctatcgtgcactcttcttcctccttcccccaaatatccagagagaaggcaggaggaccaaaccctagccgccgccgccccgatccgatggcgccgtcgccgtccccgccgccgccggcgagcggagcgcagtacgcgcaccagttcctcaacaccgccctctcccagcgcggtccctcggcgctcccctacgcggaggacgtcaagtggctcatccgcaaccacctcgtcgccctcgccgacgccttcccctcgctccaccccaaggcggccctcttcacccacaacgacggccgcgccgcgcacctgctccaggccgacggcaccgtccccatccaccacgccggggcaacctacaacctgcccgccgtcatctggctgcccgagacctacccgcgctccccgcccctcgtcttcctctcccccacccgcgacatgctcatcaagccccaccacccgctcgtcgaccgctccggcctcgtcgccaacgccccctacctccgctcctgggtcttcccctcctccaacctcctcgacctcgtcagatccctctcccacctcttcggcctcgacccgccgctcttcaccagatccgtcgcagccccgtctcccactcctcctcccgctcatcctgctcctcctcccgccgccgcctcccccgccatgcgccccgaggccgtctacgctcctgtccctcgcccgtacaggttcccggcatcgccccagctcgccgcgcgcccagccgccccccaaaggaccccaagctgaggtcttcagcgcaacgccatctccaagcttggcgacaccgcctaagcggaccgctgccgccctgccgcaccgcccgcgaagggaaagtcgacttccttcttccccgggaaggcgaagctggcggggccgaagggaaggggtgaacaatggggtttcgaggaaccccgaggaaaaggaaaccttcgagccccggttttaaga

SEQ ID NO: 5502 - DNA, 835 bp, Zea mays
ctccaccagttccaggacaagcagcagcggccgccacttcgtccagctccggctccagaaggatcacttcgctgtcaaatcgctcgtcgacggcgggatgggggaggcgtcatctccggcgatcgccaaggatgtcaccgagctgatcgggaacacgccgctggtgtacctcaacaaggtgaccgacgggtgcgtggggcgcgtcgccgccaagctcgagtccatggagccctgctccagcgtcaaggacaggattggatacagcatgatcaccgacgcggaggagaaggggttcatcgtcccaggcaagagtgtcctgattgagccaaccagtggcaacacaggcattgggctggccttcatggctgctgccaagggttacagacttgtactcacaatgcccgcatccatgagtatggagaggagaatcatcttgaaggcttttggtgctgagctggtcctcaccgacccactcttgggaatgaaaggagctgtccaaaaggcggaagagctggcagcaaagacacctaactcatacatccttcagcagttcgagaatgctgccaacccaaagattcactatgagacaactgggcctgaaatctggaaaggcacaggaggaaagatcgatggccttgtttctggcatcgggacaggtggtaccattactggatctggaaaatacctcaaagagcaaaatcctaacatcaagctctacggtgtggagcctaccgagagtgctgtcttaaatggtggaaagcctggaccacacaagatccagggaattggagctggttttatcctggtgcccttgcatggtgacatcattgatgaa

SEQ ID NO: 5503 - DNA, 903 bp, Zea mays
ggccgggccgagctgtctgccctcatttcggtttcccccattccccttcgcacccccgcggcggcggagccttcccgggcgctcaccggacacgcgcaacaacactatgaggaggtacagccccccacaccgtagtcccccgaggaggggatatggtggcagccccgcgcatcgtagtcccccaaggaggggatatggtggcagccccccgcaccgcagccccccaaggaggggatatggtggcagaggaagaagcccccctaggaggggtggatatggaggacgaaaggagcagggttctggaagtctcttggtccgcaacatcccattaagcgccagagcggaggatctccgtgttccttttgaaaggtttggtcctgttagggatgtttaccttccaaaggattattacagcggggagccccgagggtttgcgtttgtggagtttgttgacccttatgatgcctctgaggcccaataccacatgaatcgccaggtattttttggccgggagataactgttgtgcttgctgctgagtcacggaaaaggccagaggatatgcgcactagaactagagtcagggggtactctggaggtcatgaagggcgccgttcctctcattatgggaggtctcgttcccgttcacgctccgcctctccccgccctcgtggcggtggccgtgctcggtcaaggtcatactctcctgctcccagacggcgagatgactactctgcttccccacggggaagggagtctcatcgcacgaaatctcctgtgcgtcatccaaaagaacatgaggaggacaaaaggagatcctactctccccctggtagagatggtgaccaacgtgatgctgataacggggaatgagaagaggtccccacccggccgacagtgatgga

SEQ ID NO: 5504 - DNA, 1299 bp, Zea mays
  misc_feature (932)..(933): n is a, c, g, or t
  misc_feature (1027)..(1027): n is a, c, g, or t
aactgcgggccccctcctgcgccgtcgtcctcctcctcctcctcgcctccccgcggccacacctcgactcgctccctcgagtagatcatctgttccatccttttgaggcgagatggcggctaccttcaatgttaacgctgaggcaggccttaaaaagcttgatggctaccttctgtctcgcagttacatctctggataccaagcttccaaggatgacttggctgtgtattctgaattctcagttgctccaccatcaacttgcaccaatgttgcaaggtggtacaatcacattgatgcactcctgaagctgagtggagttactgcccctggtcaaggtgtgaaggttctgtcatcagttgtccctgagacctcaactactgatgtggctgaggctcctgcagctgatgatgacgatgacagcgatgttgacctttttggagaggaaaccgaagaggagaagaaggcagctgaagagcgtgctgccaaagctaaggcttctaccaagaagaaagaatctggcaagtcatcagttttgcttgatgttaagccatgggacgatgagactgacatggtcaagctggaggaagctgtccgaagcatcaagatggagggccttctgtggggtgcttccaagctcatgccagttggatatggcatcaagaagctccagattatgatgaccatcattgatgacctcgtctctgtcgacactcttattgaagaccatctctgcgttgaaccagccaacgagtacatccagagctgtgacattgttgccttcaacaaaatctaaatcttcctgaggcaggtgatggcggtgggtggacaatgcagcagcacaatatatctacagttttccgttgcccgtgatgggtgtcgtagctaaagcaagcataacatatctgcccctgggaaggttttttggaccttanngtcgagtttgagtcgtagtgttatttactgaggtgttattttgctttcgtatgaaaatgaggacaatggtgggttggatttcaaaaaaaaaaanaaaaaaaaaagggcccttaagggcccttcgagccgggccgcacctaccgtggaaccatcacccctaaatcaaagttttttttggggggtcgaagttgcccgtaaaagcaccttaaaatccggaaaccccccaaaaggggaggccccccccaatttttaaaaacttttgaaccgggggaaaaaaacccccgccgaaaaaaccggggggcggaaaaaaaaaaagaaaagggggagaaaaaaaaaaaaaaaaaaaaaaaggaaaaaagggggggg

SEQ ID NO: 5505 - DNA, 838 bp, Zea mays
cccaccctccaagagcaggaggatcactcccagaatcaccggctaagcttaagctccctcgtgatctcaaaaaccatctttttttcctctttccacctcgtgcttaccgacggggtccctccctgccatggagtccgtcggcgtcgcccctgcccccgcggcggtggcggtggcggagcagaagatgaagcttctcgagccgaggaaggagcccctcgcctccgccgccgccgccgccgccaaggcgccgtgcaagtgggcgatgaagaagaagctcgtgggcggcgacgccggctacgtgctcgaggacgtgccccacctcaccgactacatgcccgagctcccgacgtacccgaatcccctccaggacaaccctgcctactcggtcgtcaagcagtacttcgtcaacacggacgacaccgtcacgcaaaagattgttgttcgtaagaacagtgcgagaggcacccacttccggcgcgccgggccgcggcagagggtgtacttccagcccgacgacgtgaacgcggccatcgtcacctgcggcggcctttgccccgggctcaacacggtcatccgcgagcttgtgtgcgggttgtacgacatgtacggtgtcaccagtgttgttggcatagagggtggatacaagggtttctattctcgaaacaccgttacattgacacccaaatcagtgaacgacatccacaagagaggggggaccattcttggaacttcaaggggtgggcatgacactgccaaaattgtggatagtcttcaggaccgtggcattaaccaggtctacatcattgggaggtgatggtactcagcaaggcgcttccgt

SEQ ID NO: 5506 - DNA, 855 bp, Zea mays
  misc_feature (837)..(837): n is a, c, g, or t
atcatacccctcaccggcggcggctcctctcccccctccaccgtctcgtcgccccccgcgtccccgggatctcggctcgcaggcgaccatgtatcgcgccgctgggagccattttcgctctctcaagaatcatggtgctagtagatttgctagcacaagtgtagtgaagcagtcttcaggtggtctgtttagctggcttcttggcggaggctcaagccaactaccccctcttgatgttccgctcccaggcattaccattcctccacccctaccagattttgttgagcaatccaagacaaaaatcactactcttccaaatggcatcaagattgcatcagagacatcaccgggcgcggctgcatcagtgggtttgtacattgactgtggttctatttatgaaacacctgcttcatctggagcatcgcatctattggagagaatggccttcaggagcacaacaaatcggagtcacttgcggctagttcgtgaggtagaagccatcggcggaaatgtctctgcatctgcttctcgtgaacaaatgagctatacctatgacgcactgaagagttatgcaccagagatggttgaagttctcgttgacagtgtgaggaatccagcattcttagagtgggaggtcaaagagcagctccagaagataaagtctgaaatatctgaagtgtctagtaatccacaaggtctacttttggaggcacttcattcggctgggtattctggggcactggcgaaacctttgatggctacagaatctgctataaacagattggatattagtacccctggaggaattcatccattgaaattacactgctccccagnatgggtcttgcagcatca

SEQ ID NO: 5507 - DNA, 866 bp, Zea mays
agttcctctataaataggggcatctcgttgacgtgaggaagccacactccattgcagctagtgccaaagtagcactagtactctgcaggcactgagctcatcaaggtagcttagctaggatcaatggcgtcgagcaggacagcagcgatgctggtcctcgtggccgcggtgctgtgccctgcagccttgtccaagccgtcggcggcgttcatctctatgcccaccgaccacgtcggtggccgtattcctcccgtctcccccgccgatggactcgccttcgacttccatgccgactcctgcccgcagttgcaggacgtggtgcgctccgccatggagaccgcgctccacagcgagatcgccctcgccgccggcctccttcgcatcttcttccacgactgcttccctcagggctgtgacgcgtcggtccttctgacgggagacggcagcgagctccagttgccgccgaatctgacgctccaaccgcgggcgctgcagctcattgagtccatccgtgcccaggtgcacgccgcctgcggacccgtcgtctcctgcgccgacatcacggccctcgccacccgcgatgccgttgccttctccgggggtcagggctacgacgtgccgctcggcaggctcgacagcctcgcgccggcgccgagctcggccgtcttcgatctcccccaggccagctccaacgcctccacgctcatcgacgtcttcgatacccgcaacctcgacaatgtcgacctcgtcgcgctctcaggtggccacacccatcgggaagggccactgcagctccttctccaaccgcttctccgaggactccgacttcgtccgaagcctcgcctccaactgcctcagcgacttca

SEQ ID NO: 5508 - DNA, 847 bp, Zea mays
aaaaaaaaaaaaaaacggccgggcaactcaaccaccggcatcagtcactcctcttcactcctaaccagcgagtaacactccaagcagccaatggcgttctccaagcccctggcggctctcctcctcgccgtggcgctggcagcgactgccatgtccgccgccggtcaggatccccaaaactgcaagccgagccgcaaggtgacggtgcagaacctgtgcggcaaggacctctacctcggtatcgagccgctggccaacagcaagctcctctacagccctggcttcctgctccgccacggcacccacgtgtcgtacgacgtgtgctcgtggacggggcgcgtgaaggtgcaggacgccgtggtgacggagttccacatcgggtacgacggcggggcgtggtaccaggtgagcaccgcccagtcgcacatgcccatccgtgtctccatcaccccccacggccaccccctgaaagaccactgccccaccgccggctgcaacagcggcggccactgcttcgagcactccgtccccggcggcaagtgccacggcgtcgacgagatcaagatcgtcttctacaacccctagatccagctgatgggtgtgtttaataagtttgtagctcggtgatcctagtcgtattgcagctgctagttagttaatcatctgctccaacgagctattgtcgtgtcgtgtcgtcgatttgctgttcaattagtaggtgcgtggtgaatgtgtgactagagatgtttcattgtcgtgcaatgaactgcatgtcgtcagctctgtggccgtccttggtgtgttgtgtgtgttccagtttgaatctactttaaaatttggctgggtc

SEQ ID NO: 5509 - DNA, 2854 bp, Zea mays
tatgtatgtggaattccaattttaattaagtaatttcatatcttccataaagagttacgtaacataggttccatacctatcaactaagctagagagataaagcacacaatcaagatacacaatataaatgtggaagcttaagtgcgatagagatataaactcttgttgataactctggtaaaatactgaggtatcgagaaccacgtaagttttcccttaatccttgttggagcccctcacaaggatgcccacgcgagggccaagctcccagtccgataacttcacgggtgagtgggtcttcggtgtggtctccctcagatgctatctgttgtcttcactattgagttttcggttgaatcgttgttgacttcgttcccttaaagtacacggcggaagccacaccataaacgcagctagtgttatctccaaagactacaagcctcttcggtacaactacaatgatatgcacaagcaccaaaggataggaaatgttctaacctcaaacattaagtctaaacttagagcaagggctatagtctttgttgctagagtcgtaaggtaagttggtggttgtctcagtctcttcataagataaattgtggaaactggcattatcttctttcagctgagcacgtgtgaatgagcgtcaatagctaattcttgatttattcgcggatgttgcagggtgcatggctgcattggacgctgagcactacctgcaggagatcggtgcacaggagggaaagtctgattgactatatttaggtgtagcaaccagcaatccatcgaatagtcagttgccggtgctgaaagccgctctctgatgcgcgtttatgccatgggttgtcatgagctcacgattgagatacctgatgatttatgctgcttagtagcatgctattcttatcgttaggatccagaaagtatgtctgaactctgaactatttactggatacctattcgtgattactgccttgaagtttttccttagatatctctattgctcaagtctcacattattgtgttaattgtggtgttatgctgaactcatttgcatcgatgtctagcctcccagctgcaggtcagtttctttctttctttcttttcagagtaaattgatgtctttttaatgcgatcattgatgttgtttctagatggtcacatataatgctacctaattttagaacttgtttggtttgagggactaaagatctctctaaattgtgaaacagtgcgactaaagagagactgaacggctttagtccttagtctctcaagggagaagtaatgcgggagaatgataaagggcattatgattaaagtcatttaatgagttctgaacacagtctttgaactatactttagtttttgaactaaaacaaccaccaaacaggctcttagatttctgcgcaatgttgtcttttaggttgtagtgtattactcataataacgatgaatagaatggtacataagctgtctcgtaattctaaattttgcttttatacgaggcagttgttttataaaacttaaagctaatctctcacctcgtgtgttaccgaaagtcctatgatgctgtttggatcgtaaaaaatataaagttacactgttcacgcaggaaaatagaaagtgttacttgcgtctggttaagatcgggccgtaaggcataattggacctttgattcctcctctacccaagcgttaccgcattactggctgccgctgctcaagcactttttgctttacttgactccacgatagcgttaccatgcccaaccaaacagttcatgtaatcactgatcccactcctgccccttccgcgatccattcctaaaatcatttacgttaccagtgagtgaaccaaacaccgtgtgcattttatcaggatacattttatcagatactcctcatggtcctagcgatccgtcttgcttaatcttggtaatggtacgcgcatttgctttgtgtttttctgtcagggccttttaatgatgctgtctttcgttacagatgggagaaccacgaacacgcgcataggaacacgcggccgactgcccagcgcccaccaccaaccatccttttggctcatgcttcatggtaaaagcagagacagaagaccgcttcggcgcttctctttttctgttcgcagagatggttcggctgcagcgttttgttccagtggactggaataaagaagacgatcgcgtggcccattggttgatttcactgatccacatccgagccatgctgggcttttctatcggctatggacaaaccgatgtccagggtaatttccatcacgagtagactagtctgactgtatatgtaccatgtgtacaaatgtaccatgagctagagaaacggctgtggatgtggctgcaaactctctcacagagcactgtagcaacagcagcagccggacaacgtcttaaacttttaggttgaattgactgaaagatacaactaggattggtaatagatcatgacttttttcataaaatgttaggacgctaaataaattttagttaaaaaattaatataaataaagttcgattctaacccgacttgatccttaaatcttatagtgtaaaatttagagttcattgtcacccttagatacaactcaatagccaccatatgaaaacatggtactagtacagtaggattttttttgaatgatacaatggcagtcacgccaaaccgccaaccagaatcgtgatatgtatgtacccgaggccgagggaccaatacagagtagctaagaccaatgacaaaccagcgttatccacaccactccaactaatccttcagctgtgtaaccgataagggcatgtacagtggtgtttaatgtgggggc

SEQ ID NO: 5510 - DNA, 1754 bp, Zea mays
gactaaaattagttcctagaaaccaaacaccctttagtctttgcgtttgataatttagggactaaaatagagagaccaaaaattagttcataaaaaccgaacactctctaataattagctagctaattttacgagaagatttttccagtcaaataaccattagctctttcattcaaacaggcagacgtatcaaaaatgttagtttaattgtttgatacatgttacattattatcactttcatgttttttagggctagtttgggaaccataatttctcaaaggatttctattttgcataaaaaaatgaactaatttcttttaagaaaataaaaatcctaaaaaaattggggttctcaaactagcccttagaaatataaagaagcaacgcggtcaccgttggttggtcagctggtgtgtaactttttggttttttttttttctttgtccgtaagacaaccatagaccgacgaggtgtgaactgtaatttcagatttcagagcgcgcaagaaccctcttgaccaccgccgccgccgccgcgaagccaagccaaactgagtaagcagctatggagggatccgccgccgctccgctccgcacgcgcatctgcatcatcgggagcggtcccgctgcgcacacggcagccatctacgcggcccgcgcggagctcaagcctgtgctcttcgagggctggatggccaacgacatcgccgcgggcgggcagctcaccaccaccaccgacgtcgagaacttcccgggcttccccaacggcatcatgggcgccgacctcatggacaactgccgcgcgcagtccctgcgctttggcaccaacatcctctccgagaccgtcaccgccgtcgacttttcggcctgcccattccgagttagtgcagactccacaaccgtcctcgccgatgcggttatcgttgccacgggagccgtcgcgcggcgcctccacttccccgggtccgatgcatactggaaccgcggcatctccgcctgtgccgtctgtgacggtgccgcccccatcttccgtaacaagcccatcgccgtcataggcggcggcgactccgctatggaggagtccaatttcctcaccaagtacggctcccacgtctacatcatccaccgccgcaataccttccgtgcttccaagatcatgcaggccagggcgcttgagaaccccaaaattaaggtcctctgggactcggaagttgtcgaggcctatggcggcgcaaacggcggcccattggctggcgtaaaggttaagaacctactgaatggtgaggtctcggatcttcaggtgtctggcctcttcttcgccatcgggcatgagccggcgaccaaattcctgggcggacagcttgaactcgattcagatggttatgtggaaaccaagccaggttccactcacaccagtgtaaagggtgtatttgctgctggcgacgtgcaggacaagaagtaccgtcaggccattactgccgctggatcaggttttactctactcctcatgattaatgttcatacatatcaatcaggggagcttctattcccctgtgagtttcagtagaaaccatgaatgttcagtgctaggctcagtttttgttagcaatgtagtgagactgagagtatgaggcttcaaagaggaaattggttaaggcataataggttatattcttactttccagtaacaccagatgcattccttgatgatttgaagcaatttattctcagtatctatatcacaacgttatcca

SEQ ID NO: 5511 - DNA, 1416 bp, Zea mays
gtccggaagacaaccatagaccgacgaggtgtgaactgtaatttcagatttcagagcgcgcaagaaccctcttgaccaccgccgccgccgccgcgaagccaagccaaactgagtaagcagctatggagggatccgccgccgctccgctccgcacgcgcatctgcatcatcgggagcggtcccgctgcgcacacggcagccatctacgcggcccgcgcggagctcaagcctgtgctcttcgagggctggatggccaacgacatcgccgcgggcgggcagctcaccaccaccaccgacgtcgagaacttcccgggcttccccaacggcatcatgggcgccgacctcatggacaactgccgcgcgcagtccctgcgctttggcaccaacatcctctccgagaccgtcaccgccgtcgacttttcggcctgcccattccgagttagtgcagactccacaaccgtcctcgccgatgcggttatcgttgccacgggagccgtcgcgcggcgcctccacttccccgggtccgatgcatactggaaccgcggcatctccgcctgtgccgtctgtgacggtgccgcccccatcttccgtaacaagcccatcgccgtcataggcggcggcgactccgctatggaggagtccaatttcctcaccaagtacggctcccacgtctacatcatccaccgccgcaataccttccgtgcttccaagatcatgcaggccagggcgcttgagaaccccaaaattaaggtcctctgggactcggaagttgtcgaggcctatggcggcgcaaacggcggcccattggctggcgtaaaggttaagaacctactgaatggtgaggtctcggatcttcaggtgtctggcctcttcttcgccatcgggcatgagccggcgaccaaattcctgggcggacagcttgaactcgattcagatggttatgtggaaaccaagccaggttccactcacaccagtgtaaagggtgtatttgctgctggcgacgtgcaggacaagaagtaccgtcaggccattactgccgctggatcagggtgcatggctgcattggacgctgagcactacctgcaggagatcggtgcacaggagggaaagtctgattgactatatttaggtgtagcaaccagcaatccatcgaatagtcagttgtcggtgctgaaagccgctctctgatgcgcgtttatgccatgggttgtcatgagctcacgattgagatacctgatgatttatgctgcttagtagcatgctattcttatcgttaggatccagaagtatgtctgaactctgaactatttactggatacctattcgtgattactgccttgaagtttttccttagataaaaaaaaaaaaaaaaaacaaaagagaaaaaaaaaagaaaaaaaaaaaaaaaaaagcggcc

SEQ ID NO: 5512 - DNA, 856 bp, Zea mays
cggccgctcaccccccgcccggtctccccccaaatctacccgaacgggcgcgctcccggcattttctccacagccctcgtcgcggacgaaggcagtagatccggcggacggcggcccggcgcatctcctcgcctgcgaaggtgcataatttgctggcttgtgttagttcgggggaccaacaaagttactgaaaatggtggttcttgctgcttccatcatctcaaaatctggaaaagcacttgtttcaagacagtatgttgacatgtctcgaattaggatcgaaggattacttgcagcattcccaaaacttgttggaactgggaagcagcacacttatcttgagactgaaagtgtccgttatgtttatcaacctattgaaggcctatatctgctgcttattacaaacaagcagagtaacattctcgaagatctggacacactgaggctactatccaagcttgtgcctgagtactcttctctggatgaggatagtatctgtaaaacagcatttgagcttatatttgcatttgatgaggcaatctctctcggaaacaaggaaaatgtgacggtgcaacaagtcaagcaatactgtgagatggaaagccatgaagagaaggcgcataagctgatgatgcagagcaagatcaatgaaactaaagatgtcatgaagaagagagctagtgagcttgacaaaatcaggatggagaaaggcaaacttgacaaaggaggatactcatcaatatctggtccccgtgttattgaaaaaactttcagtgacatgaacatcagtggtactggcctttgggagtgggtctggattaagtggataggcgctgatatggactcgtttgcgaga

SEQ ID NO: 5513 - DNA, 1119 bp, Zea mays
cggccgctcgagccggcgggcgggccgctcgagccggcgggccaactaccatccggcgtcttccaaacgccggctcgctccccatccttttccgtgctccgcctccccgccccgcgccctccgccgccagatcccgtcgagccccccgcgcccccgcgtcgaagatgagggagtgcatctcgatccacatcgggcaggccggcatccaggtcggcaacgcgtgctgggaactttactgcctcgagcacggcatccagcctgatggccagacgaacggtgacaagaccatcggaggtggtgatgacgccttcaacaccttcttcagcgagaccggagccggcaagtacgtgccccgtgcggtcttcgttgatctcgagcccaccgtgattgacgaggtccgcaccagcgcctaccgccagctcttccaccccgagcagctcatcagcggcaaggaggacgcagccaacaacttcgcccgtggtcactacacaatcggcaaggagattgtggatctctgcctcgaccgcatccgcaagctggccgacaactgcactggactgcagggcttcctggtcttcaacgccgtcggcggtggaaccgggtctgggcttgggtcgctcctcctcgagcgcctgtccgtggactatggaaagaagtccaagctcgggttcaccgtgtacccatctcctcaggtgtcgacctctgtggtcgagccctacaacagtgtgctgtccacccactccctgctggagcacaccgatgtctccatcctgctcgacaacgaggccatctacgacatctgcaggcgctccctggacatcgagaggcccacctacaccaacctgaaccgcctcgtctctcaggtgatctcatcgctgaccacccccctgaaggttcgaccgtggccctgaacggggaccgggccgagttcccgaccaacctggtcccgtaccctcggatccacttcatgctctcgtcctacgcgccggtcatctcggcggagaaggcgtaccacgagcagctgtctgtgtcggagatcaccaacagcgcgttcgagccgtcgtccatgatggccaagtgcgaccctcgccacggcaagtacatggcgtgctgcctcat

SEQ ID NO: 5514 - DNA, 856 bp, Zea mays
aaattcatccctagccctttcgctcgcccgcccgcccgcgccgccgccgccgcctccttccgcaggagctccctcctcgcaggcgcgatggtgtacatcaagaaccagaagacaagggcgtactccaagcgtttccaagtcaagttcaagagaaggcgccaggggaagaccgactacagggccaggctgaggctcacaaaccaggacaagaacaaatacaatacccccaagtaccgttttgttgtgcgatttaccaacaaggatgtcactgcacaaattgtgtatgctaccattgctggtgatattgtgatggccgctgcctactcccatgagttgcctcgctatggtcttgaagttggcctcaccaactatgctgcagcctactgcactggtctgcttttggctcgtcgtgtgctcaagaaccgtgatcttgatgaggagtatgaaggcaatgttgaggccactggtgaggacttctctgttgagccttctgatgagaggaggcctttccgtgcgcttttggatgttggtcttattaggaccaccactggaaaccgtgtgtttggtgcccttaagggagctttggatggtggccttgacattccccacagtgacaagagatttgctggtttcaaaaaggacgagaagtcgctggatgctgagattcaccgcaagtacatctttggagggcatgttgctgactacatgaggtcactagcagatgaggaaccagagaagttccaaactcatttcagtgagtacatcaagaggggaatctcagctgaggacatggaagcagtttacaagaaggttcatgctgccatccgtgctgatcccacatgggcaaatcaccaag

SEQ ID NO: 5515 - DNA, 1170 bp, Zea mays
cggattctaagagagatgttaatcaagtagcctcgaaaagaatcccaggtttcgcgagaaaggtgattccgatgatgaagacgacgactacgataagaaacgccggcgccgaacccgagaagcaaattactcgccatattcaaacgcacaatagtagtattatctatccgtttgtatcgccatatgacttgattttccctcgagccattcacattttgcctgcattttagtatcagttcatcaacacagtgcagccttcgcctcgactcgcaccccctgaaactctcgcatcgtgtatgctgctgattaagattattagttttaagaaaaccgaccaaaaaaaaaaaaaaaaacgttttgcgacgtcttatccctccgctcctcacaaaaacgcgcttctcgccgccaccaccctaaccctagttcccccgccgccatggccgacgaccactactcctccaagcgcaagtacgacgactccccgccgccgcgccggacgggattctcctccggcccgccgcccgcctcgccgccggttgccggtgccccggtgccatcttcgtacaacactgtgccgccgcctcccgacgagatccagctcgcgaagcagcgcgcgcaggagatcgcagctcggctcttcagcgccgctgaggcgaagcgtccccgcgtcgacaatggcgatgacgacgtgggcaccgctggtggaggaggttccctggggggcggtggccgtatcggcggcggcggccttggattctcgtcctcagccggtggtggccatggttcctccatcccacccttatcttctcaaggaaactcacatcagtattcttcatatggtggtggataccagagtggtagtacaacaaaaaagattgacatcccaaatggaagggttggtgttatcattggaaaagctggagaaactataaagcatctccaagctcagtcaggggcgaagatccaagtaacaggggacatggatgttcaacccggttcacagacaagatcagttgatctttcgggcactcctgatcagataaacagagctgagcagttgataattgatgttcttgcagaggctgatgctggatcatctggcactatctctaatcggaagtacaacgcacctcaacctggtgctgagcaattcccaatgcaattgctaac

SEQ ID NO: 5516 - DNA, 782 bp, Zea mays
  misc_feature (25)..(25): n is a, c, g, or t
gggcggcttaagggcggccgggccngacttccccccatccgccgccgccgcgcctcctcctcgcccaaggtaggagcttgtgaaagttctctaaggctgagaagatggttctgaagaccgagctttgccgttttagcggccagaagatttacccagggaagggtatcaggttcattcgttcggattcgcaggttttcctctttgccaactcaaaatgcaagcgctacttccacaaccgcctgaagcctgcaaagctttgctggacagcaatgtacaggaagcagcacaagaaggacatccatgctgaggctgccaagaagaggcgccgcaccaccaagaagccgtactcacggtcgattgttggtgccactctggaagttatccagaagaagagggccgagaagcctgaagtccgtgatgctgcccgagaagccgctctccgtgagatcaaggagcgtatcaagaagaccaaggatgagaagaaggccaagaaggcagaggtgaccaagtcccagaagtcacaggggggcaagggcgccgtgcagaagggttccaagggcccaaagattggcggtggcggcgggaagcgttgaaagttgattacgccatagacatagagttgtgctgcctagccttgtttcctatcctactatcatagacctttgtcaagttattaccccgccctcttgaatttgcaccttatctctgaggctgaatggtgttaacgttttggattgtcttgatgagtttatttataatgaatggttcttatgttggttcct

SEQ ID NO: 5517 - DNA, 869 bp, Zea mays
atctataagaggagcctccgtgcccgcccccgtcctctttgttactccccccctctgcaccgccgccgccgccacgccaaaatccggcgtcaactgatcggcggcagccatgagtaagctccaaagtgacgctgtcaaggatgctatcacccagattgttggggaggccagagaaaagaagcgcaagttcactgagactgtggagcttcagatcggtctcaaaaactatgacccacaaaaggacaaacgtttcagcggctcagtgaagctgccccatatcccccgcccaaagatgagggtgtgcatgcttggtgatgcccagcatgtcgaccaggctgagaaaatgggacttgactacatggatgttgaaagtctcaagaagatgaacaagaacaagaagcttgttaagaagctagccaagaagtaccatgctttcttggcatcagaggccataatcaagcagatccctcgtctccttggccctggtcttaacaaggcaggcaagtttcccactctggttagtcaccaggaatctcttgaagccaaggtcaacgagacaaaagctacagtcaagttccagctaaagaaggttctttgcatgggtgttgctgtaggcaacttgtcgatggacgagaagcagatccaacaaaacatccaaatgagcgtcaacttccttgtgtccctcctgaagaagaattggcagaatgtgaggtgcctgtacgtgaagagcaccatggggaagcgtgtacgtgtgttctaagtgtgtgcgctccagtgaagttgataagatactgggctgtcctgccgacccctgcttgtctttggattagatctgtttcactgataccaattttctgtttgcctagccg

SEQ ID NO: 5518 - DNA, 840 bp, Zea mays
  misc_feature (2)..(2): n is a, c, g, or t
gnatacaattttcgccgtcggtctcctccctttatccacatccacccatcgccatggcgatctccccccgcctcctcctcccgctcctcctcgcggcggcggccgcctccgccttcgccggcgccaacgacctggtcggcgagctccagtccctccgctcccgctcccccgccggcgtgatccacctcaccgacacctccgtcacccgcttcctctcctcgccggccccgcgcccctactccgtcctcgtcttcttcgacgccacctcgctccactccaagaccgacctccacctcccccagctccgccgcgagttcgcgctcctctccgcctccttccacgccaacaaccccgactcctccgacctcttcttcgccgacatcgagttctccgagtcgcagcactccttctcccagttcggcgtcaactccctcccccacgtccgcctcatccgcccggagcactcccgcctcgccgactcggagcagatggaccagtcccacttctcccgcctcgccgactccatggtcgagttcgtggaggcccgcaccggcctcgaggtcggccccatcgtccgcccgcctctcgtctcccgcaaccagatgatcctgctcggcctcctgttcctgatctccatcccgttcgggatcaagaggatcatggaaggggacaccctgcttcatgaccgcaagctttggatggccggggcgctgttcgtctacttcttcagcgtctcagggggcatgtacgggatcatcaggcatacgcccatgttcatcacccgaccgggaggatccaaacaagctcgtcttcttctaccagggttcggggatgcagctc

SEQ ID NO: 5519 - DNA, 1064 bp, Zea mays
agccgcaccttccacctcacctcacctacccgctccctctccctctccctctcccactccacggctgcaccgcacctgctccgttggaagggagcaaaccctccgtcgcctatttagccgagaccccgagcgtggagactgcacacatcccatcccatccgcagcggctttacctaccgagaagaagagagaaaaaaggttcgagtgcgttccagagtgaggagtgagaagagatggctccggtgaagctgtacggcgcgaccctgtcgtggaacgtcaccaggtgcgtggcggcgctggaggaggccggcgtcgagtacgagatcgtacccatcaacttcggcaccggcgagcacaagagccccgaccacctcgccaggaaccccttcggccaggtgccagctttgcaggatggtgacttatacgtcttcgaatcacgtgctatttgcaagtacgcgtgccgcaagaacaagccagagctgttgaaggagggcgacatcaaggagtcagcaatggtggatgtgtggctcgaggtggaggcccatcagtacactgccgctctgagccccattctcttcgagtgccttatccatcctatgcttgggggagccactgaccagaaggtcatcgacgacaaccttgttaagatcaagaacgtgctggcggtgtacgaggcgcacctgagcaagtccaagtacctggctggagacttcctcagtcttgcggaccttaaccatgtgtctgtcaccctgtgcttggcggctacaccctacgcgtctctgttcgacgcgtacccgcatgtgaaggcctggtggactgacctgttggcgaggccgtccgtccagaaggtcgctgtgctgatgaagccatgatcttagtttctggcgctcgttcgtcgcgaaataagccgaggtgtgtcccccctgatgtgtgcctgtacgagtgtgtgttcttgtgatgtctcctcgtgttgattgttcaggcttgtgcttgcgatcctgtctaatcttgtactgaaatgagcattcctgtgctctggtttaataataaattgtgcccaggtt

SEQ ID NO: 5520 - DNA, 816 bp, Zea mays
  misc_feature (735)..(735): n is a, c, g, or t
cccgccccggcccgaatccctggtcgctaggtagttcctgcgcctccatcccgatcccctgtctgatccaatcgtaatcaggatgctgccaggatcagagccggcggccggcggcaccggtatgttcgtgccggcggcgacggcgggcacggtgctctgctgcatgtgtggtgtgtccatgcagcccaacccggccaacatgtgcgcgcgctgcctgcgcgcgcgcgtcgacatcaccgagggcgtcccgcgccacgccgccgtggtctactgccccgactgctcctcctacctccagccgccgcggtcctggctccgcgccgcacccgagtcgcccgagctcatgcagatcctgctccgccgaatcaaccgcccgctcgcgcggctccgcgtctccctctccggcgccgagttcgtcttctccgagccccactccaagcgcctccgcctcaagctccgcctccgccgcgaggtgctccacggcatcgtcctcgagcagacgcacccagtggagttcgtcgtccacgaccggttgtgcgactcctgctcccgcgcgcaggccaaccccgaccagtgggttgccgtcgtccagctgcgccagcacgtgccccaccgccgcactttcctctacctcgagcagctcctcctcaagcacggccaggcttccctcgcgatccgagtcgcggcggcccccggcggcctcgacttcttcttcggctcgcgttcccatgccgnccgcctggtcgacttccttgccaccgtcgctcctatgcaaactcagacagcgaagcagctcgtctcgcacgacaccaagag

SEQ ID NO: 5521 - DNA, 1073 bp, Zea mays
taatttcttttgagtaaatgaggttctcaaactagctttaaaaaggtaggaaaacacttttgtttaaggaaggcaaaaactttttgaagaatcgaattctgcaaatctgtagacaattggtttatttgttcgcggctccgttccattccttttctaccgctatggcgacgggtcacgggagtcgagaaggaaggaagaggcagtacagacttcacggcccatgaattcacgtagtctaaaagcccatagcatcaggattcaggaggcatcgcagcccttaatcgacatgcccacccgcccggccgccccggcatcgtattcgtcaccaccgctctcgcctcgccgccgccttcctccttcccctgcgattacaaaaccctaggaccattctccaccaattcctctaatccctcgtcgctaggtagttcctgcgtctccatcccgatccccttgtcgattcagtcgtaatcaggatgcagcccggatcggccccggcggccggcggcaccggcatgttcgtgccggcggcgacggctggcacggtgctctgctgcatgtgcggcgtgtccatgcagcccaacccggccaacatgtgcgcgcgatgcctgcgcgcgcgcgtcgacatcaccgagggcgtcccgcgccacgccgccgtggtctactgccccgactgctcctcctacctccagccgccgcggtcctggctccgcgccgcacccgagtcgcccgagctcatgcagatcctgctccgccgaatcaaccgcccgctcgcgcggctccgcgtctccctctccggcgccgagttcgtcttctccgagccccactccaagcgcctccgcctcaagctccgcctccgccgcgaggtgctccacggcatcgtcctcgagcagacgcacccagtggagttcgtcgtccacgaccggttgtgcgactcctgctcccgcgcgcaggccaaccccgaccagtgggttgccgtcgtccagctgcgccagcacgtgccccaccgccgcactttcctctacctcgagcagctcctcctcaagcacggccaggcttccctcgcgatccgagtc

SEQ ID NO: 5522 - DNA, 900 bp, Zea mays
gtgcacgtgccagtaatgtgcaaccgtacgtttctccctccacgtcgtaccacccacccagcccccgttgagagtcgagagagttccaccgctcccggcccgatcccttatcttctccgacggcgacgccggccggagcggagacgggagaggtgcatggcgttgtcctatgtatatagagtctaggtataggttgaggtcgagtagtgcccatgtggtgtatggctgtatgccgatgtggagagcgccgccgccgcgtacgagcagcggctggtggctcacggcggctgcgtctcaggcaaggctggctggcggccggtcgctgccgaggggcgtgctgctggctcatccaccaataagctcgtctggtcccctgttctggaggctctccgctacttctctagctcgtggcgtcgccgtggtggtgaagacgaagagtagaagagatggagaaccagatcgggtcagtgctcttatccggtggctgtttgggagtggccttggcgccagctacggcgttcggcggccggccggctccatcacgtcatcgtacatgctggccgaagggcggcctttctacttcttcctcccggccaagatgcctaaagggaggcagctcatcttctgcacggagtctatggcgtggtgccatggaagcttagttgtcccaagtggcaatgtccccggcgacggcgaagttacggccgtgcagaagatgtcaaggacccgattgcttttcttatctggttgttggggtcctctttgtaaaagacagggaccagtgtgttatttgcagctagttctgggtccgtctgtagactgctgtgtacttctcgttccgtgttaatgcagcatcagggtccttctggaaccgtctttttgttccaaaaataaaacaaa

SEQ ID NO: 5523 - DNA, 1027 bp, Zea mays
  misc_feature (976)..(976): n is a, c, g, or t
  misc_feature (1002)..(1002): n is a, c, g, or t
actctacactccgccatcccccgctcaaaaccccccaccccgcctcgccggaaccctaaccctagccccgccgccgccccctccctcccgacgccatgagggagatcctccacatccagggcggccagtgcggcaaccagatcggggccaagttctgggaggtgatctgcgacgagcacggcatcgaccagacgggcaagtacgcgggcgactccgacctccagctcgagcgcatcaacgtctactacaacgaggccagcggcggccgctacgtgccccgcgccgtgctcatggacctcgagcccggcaccatggactcgctccgctccgggccctacggccagatcttccgccccgacaacttcgtcttcggccagtccggcgccggcaacaactgggccaagggccactacaccgagggcgccgagctcatcgactccgtcctcgacgtcgtccgcaaggaggccgagaactgcgactgcctccagggattccaggtgtgccactcgctgggaggaggcactggctccggaatgggtaccctgctcatctccaagatcagggaggagtaccctgaccggatgatgatgacattctcggtgttcccatcgcccaaggtgtctgatactgttgtggagccatacaatgctaccctctctgtgcaccagcttgttgagaatgcggatgagtgcatggttcttgataacgaggctctctacgacatctgcttccggacgctcaagcttaccactcccaccttcggtgatctgaaccaccttatctctgcaaccatgagtggtgttacctgctgtctccgcttccctggtcagctgaattcagacctccggaagcttgctgtgaacctgatcccattccacgtctgcacttcttcatgggtggattcgctccgctaacctcgcggggttcacagatgtaccgtgccctcactgtgcccgagctcacccagcagatgtgngactccaagaacatgatgtgcgccgnccgacccaggcacggtcgctacctc

SEQ ID NO: 5524 - DNA, 732 bp, Zea mays
tcccccccctcctccccccccccgccgccgctccccagatcccgccgccatgtcgacggagaagaagcagctgaaccccatgcgggatatcaaggtgcagaagctcgtcctcaacatctccgtcggtgagagcggagatcgcctcacccgcgcctccaaggtgctggagcagctgagcggacagtcaccagtgttctccaaggctaggtacactgtcaggtcgttcggtatcaggcgtaatgagaagattgcgtgctacgtgactatcaggggtgagaaggcgatgcagctgctggagagtggcctgaaggtgaaggagtacgagctgctcaggaggaacttcagcgacaccggctgctttggcttcggtatccaggagcacatcgatctcggcatgaagtatgatccatctaccggcatctacggtatggacttctttgtggtgctcgagcgtgctgggtaccgcgtctcccgccgccgcaggtgcaaggcccgcgtcggtatccaccagagggtcaccaaggaggacgccatgaagtggttccaggtcaagtacgagggtgtcatcctcaacaagtcccatgcgagctaagaaggatgtagctctcgttagaccttgagttaattaagttcacctggttgctggatatgtatgttacctagaaaccaaatcctttgtcagttttgcctgtactcaagctggatgatttctgtttgatctgcactttcgtc

SEQ ID NO: 5525 - DNA, 832 bp, Zea mays
  misc_feature (707)..(707): n is a, c, g, or t
ggtccaaccctttgttaccaaccgcactgccgccgtccccgtctgcctccggccagcagccatggcgaggggttccatggccgcggtgctcgccgtcctggccgtggcggcgctccggtccgcgccggccgccgcggagctcccgctggtggagcacccggccaagaacgacgggtcgctcagcctgctcgtcgtcggggactggggccgcaacggcacctacaaccaatccagggtcgcggagcagatggggaaggtcggggagaggctggacatcgacttcgtggtctccaccggcgacaacttctacgagaacggcctcaccggcgtccatgaccagcagtttgaagaatccttcaccaatatctacaccgcccagagcttgcagaagccgtggtacctcgttctcggaaaccatgactaccggggcgatgcgctcgcacagcttgacccggtcctgcgcaagctcgatgagcgattcgtttgcatgagatcatttcttgtcaatgcagagatcgtggagttcttcttcatcgacaccactccattccaactcaagtactggactcaccccaaagacagtcactacgactgggagaggagtggcgcctcgagaggactacatagctaatctgctgaaggatttggacgaggcaatgaagaaatcaactgcaaagtggaagattgctgttgggcatcataccatngaggagtgtcagtgaccatggggacaccgaggagctcctgcaattgcttcttccagtcctcgaggttaacggcatcgacttctacatcaatgggcacgaccactgcttgggacacattaccagca

SEQ ID NO: 5526 - DNA, 797 bp, Zea mays
cgggccgactgagcccgaagccaaaggtaatccaatccgcacagaaatccccatctcaaaaccctagccctcatccccgatcccggcgagagagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggcggcgagtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgactgcggccagctctagatccgcccgcccgccggtcgcctttcgccgtcgtcgccgtcgccccgtgtgtcccgtgtcgtgtcgtcgatctaaataagagagtcgtgtgtcgtgtgtcgtgtcttcccctggtccgtccggtgagatctccgtggttggtttaggaggggttttggggggactctttggggcgctggatctgcgt

SEQ ID NO: 5527 - DNA, 577 bp, Zea mays
aaaccctccgccaaatgcagatcttcgtcaagaccctcacggggaagaccatcaccctcgaggttgagagcagcgataccatcgacaatgtcaaggccaagatccaggacaaggaggggatcccgccggaccagcagcggctgatcttcgccggaaagcagttggaggacggccgcacccttgccgactacaacatccagaaggagtccaccctccatctcgtcctcaggctccgtggaggcatcatcgagccgtccttgcaggctcttgcccgcaagtacaaccaggagaagatgatctgccgcaaatgctacgcgcgcctgcatccaagggctgtcaactgccgcaagaagaagtgtggccacagcaaccagctgaggcccaagaagaagatcaagaactagagtgctgctagtcagtttcatggaccggttgaatccatcactgtgtcagagtttatgctattatcgtctcggttgtcgttgaaccttattttactttgctttcagcctcctatcgttgtggtgatgataagtgacagtattggtatatggtagcaaacctataattttgccgg

SEQ ID NO: 5528 - DNA, 832 bp, Zea mays
ggtccatcagacacagaccagagtccacagcacagcagagcaccaccactactaccacccccagtggcaaccctgacaaggctctagcagcttagctgaagatggccgggctactctctgtcaaggccgtcgcgctcgccgccgtgcttgctgccgcgtatgcctcttgcgccgccgccgagcagccgggggcggcggacctcgacgcctccgccgtgtcttacagctccgcgtggcttccggccagagcgacctggtacggagcgcccaacggcgccgggcccgacgacaacggcggcgcgtgcggcttcaagcacgtgaaccagtaccccttctcctccatgacctcctgcggcaaccagcccctgttcaaggacggcaagggctgcggctcctgctaccagatacggtgcagcggcgacaaatcctgctccggcaaaatcgagacggtgatgatcacggacatgaactactacccggtggcgcagtaccacttcgacctgagcggcacggccttcggcgcgctggccaagccggggctcaacgagaagctgcgccactcgggcatcatcgacatccagttccggcgggtgccctgcaacttcccgggcctcaagatcaacttccacgtggtggacggctccaacgcggtgtacctggcggtgctgatcgagtacgaggacatggacggcgacgtgatccaggtggacatgaaggaggccaactccgggtcgtggacgccgatgcgcgagtcctggggctccatctggcggatggactccaaccatcgcctccagggggcccttctccatgcgcatcaccagcgactccg

SEQ ID NO: 5529 - DNA, 1061 bp, Zea mays
acaatcttcgacaagtgaacctgcacagagaactgctgtagcggaatccgttgacgaagacgatgatgatctagaaaagataagagaaaggctcgccaaagtgaggtcgtaaaagagaatcgatgtgctgacgtgccggcggttctccatccgatcagaccacagctgccgacttacttgacaagtactactggctactagtgcaagtatggctcgggtctctgccaatgccgttgcacttgttgcactcgtctccgttcttctcacgtatggctgctgcgcccactcggcgctcaactacaccggctccttggccaaagcctccaaggctagctggtcatggctccctgccaaggccacatggtacggcgcgcctaccggcgccggccccgatgacaacggtggtgcttgcggctacaagcacactaaccagtacccgttcatgtccatgacttcctgcggcaacgagcccctgttcaaggacggcatgggctgcggcgcctgctaccagatacgatgcgtcaataacaaggcctgctccggcaagccggagacggtcatgatcaccgacatgaactactaccctgtggccaagtaccattttgacctcagcggcacggcgttcggcgccatggcgaagcccggccagaacgacaagctccgccacgccggcattatcgacatccagttccaaagggtgccatgcaatcatccgggcttgaacgtcaacttccacgtcgagcggggctccaaccccaactacctcgccgtgctggtggagttcgcgaatcgggagggcaccgtggtgcagatggacctcatggagtcaaggaacggccgcccgacggggtactggacggcgatgcgccactcgtggggcgccatctggcggatggactccaggcggccggctgcagggccccttctctctcgcatccgcagcgaatccggcaagacgctggtggccaaacaagtcatcccggccaactggaagcccgacacaaactaccgttccaacgtccagtttccgttgatcgctccgagcttccgatcgatcaacg

SEQ ID NO: 5530 - DNA, 983 bp, Zea mays
gggccgggatttgaaaagaaaattgccctctcgacttttcctcaaaaacaagaggacaaagcaaccactaataatcccctcaccaaccctcgtctcctcctctttcccagtcccgcaatccacccggcgcgccccaccgtcgccggcggcgcggagcaccgtcttctccccggcatcctccagggcggagcgctggagatccgactccgctcggttccttctcgcgtcggacataatggcggatatccagttaggatgttacactataaagtcccatggagccaaagtggcaagactccacatgtatgactggataatacttctcctccttgctgtcatagatggactgttgaatataattgagccttttcaccgcttcattgggaaggacatgatgactgacttgagatatccattaaagggcaatactgtgcccttttgggctgttccgctcattggaattgtcttgccatgtgtcatctttggtggaatttacttcaagaagaagaatatctatgatttgcaccatggcatactgggtattctttattcggtgctcataactgcggtgattactgatgcaattaaggatggagttggccgaccacgtcctgatttcttctggcgctgtttcccagatggaaaggatctttatgataatgtcactactggtgttctgtgccatggagagaagagtgtcatcaaagaaggtcacaaaagcttcccaagtggacactcatcatggtcttttgccggcctaggcttccttacgtggtacttgactgggaaaatcgcagtttttgaccgtaaaggtcatattgcaaagctttgtattattgttctgcctctacttactgctgcacttgttgctgtttctcgagtggatgactactggcatcactggcaagatgtggttggcaggagctgttttaggtctcacagtggcttcattttgctacctgcaatttttcccatacccttat

SEQ ID NO: 5531 - DNA, 872 bp, Zea mays
  misc_feature (804)..(804): n is a, c, g, or t
agtctctagggtttccactccgccgcgccgccccctcctcccaccctgcctcgtcgcggaacagtgctcccaccgccggcgccatgagtaagttgcagagcgacgccctgagggaggcaatcacaaacattatcaatgactgccgtgagaagaaccgcaagttcgttgaaaccattgagctgcagattggtctgaagaactatgacccgcaaaaggacaagcgtttcagtggttctgttaagcttcctcacatccctcgcccaaagatgagggtttgcatgcttggtgatgcccagcatgttgaagaggcagggaaaatgggcctagactgcatggatgtggaatcccttaagaagatgaacaaaaacaagaagctggtcaagaagcttgcaaagaagtatcatgctttccttgcatctgaggctatcattaagcagattccccgtcttcttggacctggtcttaacaaggcaggaaagtttccaactttggtgtctcaccaggaatcccttgagtccaaggttaatgagaccaaggccacagtcaagttccagttgaaaaaggtgctttgcatgggtgttgccgttggccacctgggtatggaggagaagcagatcttccagaacgtgcagatgagcgtcaacttcctcgtctctctgttgaagaagaattggcaaaacgtgagatgcttgtacctgaagagcacgatgggaaaggtgtaccggttgttctaggctctagtcttctaggatttccaggagattgacaacttggaacttttgttgctttctcaatatcaaattntcgtgcgcgacgagtgacaattattgtcttgtaccgagatggtttggtctattgtctggaacttgatg

SEQ ID NO: 5532 - DNA, 913 bp, Zea mays
cgggccgctctcatcacccacacagcctacacaacacaaacacaagcacagatcggtcgagattcaaggcaaccgggagcaatggcgggcgagaaggggctggtgctgctggacttctgggtgagcccgttcgggcagcgcgtgcgcatcgcgctggccgagaagggcctgccctacgagtacgcggaggaggacctgatggccggcaagagcgaccgcctcctccgcgccaacccggtgcataagaagatcccggtgctcctccacgacggccgtgccgtcaacgagtccctcatcatcctccagtacctggaggaggccttcccggacgcgcccgctctgctcccctccgacccctacgcgcgcgcgcaggcccgcttctgggccgactacgtcgacaagaaggtctacgactgcggctcccgcctctggaagctcaagggcgagccgcaggcgcaggcgcgcgccgagatgctggacatcctcaagaccctcgacggcgcgctcggggacaagcccttcttcggcggtgagaaattcgggttcgtcgacgccgccttcgcgcccttcaccgcctggttccacagctacgagaggtacggcgagttcagcctgccggaggtggcgcccaagatcgccgcgtgggccaagcgctgcggcgagcgggagagcgtcgccaagagcctctactcgccggacaaggtctacgacttcatcggcctgctcaagaagaagtacggcatcgagtaggcgcgccgaggggaaggggacggacgggccatgcaggcgacagccggcccgccgtccgggagggaaacaacaaataaatcagggagcgatttgggtggcctacaatgcgtacgtctgggaatagagtatttctttctttctttcttcgtggaataaagtgctc

SEQ ID NO: 5533 - DNA, 837 bp, Zea mays
ccgggctcactcatcacccacacagcgtgcacaacacaaacacaaacacagaccgatcgagatccagagcaaccaggagcaatggcgggcgagaagggcctggtgctgctggacttctgggtgagcccgttcgggcagcgcgtccgcatcgcgctggccgagaagggcctgccctacgagtacgcggaggaggacctgatggccggcaagagcgaccgcctcctccgcgccaacccggtgcacaagaagatcccggtgctcctccacgacggccgccccgtcaacgagtccctcatcatcctccagtacctcgaggacgccttcccggacgccccggccctcctcccctccgacccctacgcgcgcgcgcaggcccgcttctgggccgactacgtcgacaagaaggtctacgactgcggctcccgcctctggaagctcaagggcgagccgcaggcgcaggcgcgcgccgagatgctggacatcctcaagaccctcgacggcgcgctcggggacaagcccttcttcggcggcgacaagttcgggttcgtcgacgccgccttcgcgcccttcaccgcgtggttccacagctacgagaggtacggcgagttcagcctgccggaggtggcgcccaagatcgcggcgtgggccaagcgctgcggcgagcgggagagcgtcgccaagagcctctactcgccggacaaggtgtacgacttcatcggcctgctcaagaagaagtacggcatcgagtagccgcgcggacggacgggcggccatgcatgcgccatcccgccggccggtcaataaatcacggagcgtttggctggcctacagagcgta

SEQ ID NO: 5534 - DNA, 1161 bp, Zea mays
cgggccgggggccctaccagacgacgctcgattcccctcgctcctagggttagcatccgcccccggctccgccgccgccgggtaccaccccctcttccagatgtcgaagcgagggcgcggaggttccgctggtaacaagttccggatgtcgctgggtctgccggtggcagccactgtcaactgcgctgacaacactggtgccaagaacctgtacatcatctccgtcaagggaatcaaggggcgcctcaacaggcttccttccgcctgcgttggtgacatggttatggccactgtcaagaagggaaagcctgacctcaggaagaaggtcatgccggctgtcatcgtcaggcagcgcaagccgtggcgccgaaaggacggtgtcttcatgtactttgaagacaatgctggagtcattgtgaacccaaagggagagatgaaaggttctgccatcactggaccgatcgggaaggagtgcgccgacctgtggcccaggattgccagcgccgcgaacgccatcgtctgatctgatcgccggagcagctagatgatcaaagcttttgatagcatgtccctcttttcttctagtttattacttgtggcccttgaggatgagtttcctggattatgtaatgctgctggattattgtctgttaggtttaagattttgcactgtggtttggctgctaagatttgttcagtttgaacctgaaagagcttttgatcggattgcaaaaaaaaacgaaaaaaagtaaaacgacaataaaaaaataaagaaagaccaccaaaaaaggaaaaaagaagtcacaaaagaccataagtgaaatgaatcaagaccggggctccctgccggtaaaagggccttgccaaagaaaaccaccttctgagaatcaaggaggagctggggacacttcaaatgtatgtggtccccaaattcccccacccggggggaagccctaattaaacggtactttcccaatttttttaaaaatgggggggttaaaccccccgaaataattccggttaaaacttttaaaattagaacaaaaatggcccgcatagtctattgggaaacaaaacggaatttaccccccccaactgttctccaattttttggtctttgggggattaatactttaattcgggcccccaaaacctttttgg

SEQ ID NO: 5535 - DNA, 846 bp, Zea mays
cggccgctccacccggccgcgcccccctctagtcttgtcccctcccgcggctagggtttcctccgcttcgctctcgcagaatgcctcgctacgatgagcgtgatcgttatggcggcaacacaaggctgtacgtgggtcgtcttccctcgcgcacccgcacaagggaccttgaagacctcttcggcagatatgggagagtgcgacatgtggatatgaagcacgagtttgcatttgttgagtttagtgatcccagggatgctgatgaagcaaggtacaatcttgatggtcgtgactttgatggaagccgcatgattgttgagtttgctaaaggggttccgcgtggccaaggaggaggaggtgaccgtgaccgtggccgtggtggtgaccgtgaatatatgggtcggggacctcctcctggttctggccgttgctttaactgtgggattgatgggcattgggctcgtgactgcaaagctggcgactggaaaaataggtgctatcgttgtggagatagtggccacatagaaagggattgccagaacagccctaagaacctcaagcgtggaaagagttactccagatctccatctcctcgccgcggaagggtgcgtgataggagctacagcaggagccgcagtaggagctacagccgctctgtttccccaaggagggatgaaaggcgatcaaggagccctcgcgacagtcgcagcccaaggaggagcccccgtgacagtcgcagcccaaggaggagcccccgagacagtcgcagccctatgaagagcccccgtggcagtcgcagccctatgaggagcccccgtgacagccgcagccctaggaggagcgctt

SEQ ID NO: 5536 - DNA, 882 bp, Zea mays
agttcctcaagagacagaccagcttcttctccaagtccagttccttctacccattgggccggccgccattgagagtttgcttcctccgctccgtctcatctctgcaggaaatccgccatcgctcgcccgggtgtactgaccatgtctgcgatgcaatcatcgtatcttcctgctaccactgagtcaattgcaatggctcaggaagctaaggatgcttcagagtccattttaatcctctaccgtgtgcttgaagacccgtcttcttcttcagatgcagttagaacaaaagaagttgccattacaaatctgacaaactatctcacaaaagagaacagagcccaggagcttaggaatctgttgacccagctcaggccatttttcgcactgattcccaaggcaaagaccgcaaagattgtacgtggcatcattgatgccgtttccaagatacctggaacatctgatcttcagatctcactctgcaaggagatggtggaatggacacgtgcagagaaacgtaccttcctcaggcagcgtgtggaagcaagactagcagcccttcttttggaaagtcaggagtacactgaagctcttacccttctttctggtcttatcaaggaagtgaggaggctggatgacaaattgcttcttgttgacattgaccttctggagagcaaactccatttctctctaaggaaccttccaaaggccaaggcttctctgactgccgcaagaactgcagcgaatgccatttatgttccgccagcgcagcagggcactattgacctgcagagtggaatccttcatgccgaagagaaggattacagactgcctacagttacttctttgaagcgtttgaagggttaatgcactgggcggccccta

SEQ ID NO: 5537 - DNA, 905 bp, Zea mays
cagctcacggtctcacgtcgccatgcattgctctaccagaccaccaccatgtccaaatttgactggattcgagcaggccacactatattatccccgttcccggtgggtttgtttgcagggcggcagagcagaggcacaacacacaaaccaacccaaaaccatttcctactagctagaagagtgaagtgaagcgatgaagaagaccgtggtcctgtaccctggcctcggcgtcggccacctggtgccgatggtggaggtcgccaagctgttcctcaagcacggcctcgccgtcaccgtggcgctcgtcgagccgcaggtcgagtccacggacttctccgccgcggtcgcccgcgcgagggcctccaacccctccgtcgccttccacgtcctgccgtcgccgcccgcagattccaaccccgacggcgcgcccaggcaccacgtcgtcaaggttatccaatcgctcgccgccatgaatgcgcccctccgcgacttcctccgctcgctgcccgccgtccacgcgctcgtcctcgacatgttctgcgtcgacgcccaggacgtcgcggccgagctcaagctgccggtctactactcgttcgcctccgctgccgccgacctcgccatctttctcaacctgccgagcaagttcgccagcaatacggccaaggtaaaagagctcggcgactccatcattacccttcccgggtgttcctcctttcaaggcttcggagctgccctccgaagttatcggcgacgatgaagcgctcgtgtacgtcttacgcatgtttgagcgaatgccagaggcgaaaggaattcttatcaattccttcgattcgttggaagagcccgcactgagcgctctcaacgacggactttgcgtccctggtcgtgcgacgccgccggtatac

SEQ ID NO: 5538 - DNA, 866 bp, Zea mays
tcccccccccgagcccgcccggccgccacggatttgttgatcctgtgaagtgagagatcagttctcgatttcgattccggttccgctcagagaattccccaggcgagcgagcgagatggcgaccgccgggaaggtgatcaagtgcaaagccgcggtggcgtgggaggcggggaagccgctgtccatggaggaggtggaggtggcgccgccgcaggccatggaggtgcgcgtcaagatcctcttcacctccctctgccacaccgacgtctacttctgggaggccaaggggcagactcccatgttccctcggatcttcggtcatgaagctggaggcatagtggagagtgttggagagggtgtgactgagcttgcccctggtgaccatgtcctccctgtgttcactggggagtgtaaggaatgcccacattgcaagtctgcagagagcaacatgtgtgatctgctcaggatcaacaccgacagaggtgtcatgatcggggatggcaagtcacgcttctctattgacgggaagccgatttaccatttcgtagggacttccaccttcagtgagtatactgtcatgcatgttggttgtgttgccaagatcaaccctgaggctccccttgacaaagtctgcgttcttagctgtggtatttccactggtcttggcgcatccattaatgttgcaaaaccaccaaagggttcgacagtggcgatatttgggctaggagctgttggccttgctgctgcagaaggtgcaaggattgcaggtgcatcagggatcattggtgttgacttgaacgccagcagatttgaagaagctagaaaatttggctgcacggaatttgtgaacccgaaagatcccccaa

SEQ ID NO: 5539 - DNA, 966 bp, Zea mays
ccaagctccatcgagctcaagttggccctccaccaccccaatggcgcacgcccaagcctcctcactcacgcctactggtccttctgctactatacaaacacgcacggcgaccaaaaccttgcaacagtagctatagtggtactggtagagtggtagtagctcaccaaggtttagcaaatcgtgtgccgtgccatgtcactacgccgcagctcagcggctgcgctcgcggcgctgctggcgctggcggtgctgctgggcacgtcggcggacgatggcggccagggccaaccaatcgtggcgcgcgtgagcaaggacgcctccacctccctctacaccatcgccatcaaggtcggcggcgtgccgctcctcgtcgacctcgccggcccgatgctctggctcgccaactgccccaccccgcaccgcatcatcccctgcgtctcccacgactgcgacgacgtctccactacgtaccgcccgcctggctgcccgaagcccaaccttcgtggagacgggccgtgcgcctgccccgcatacccgcgcaacccggtcgacgggcgctgccgctctgacgacgccaccacgatcaccctcgccgccaatgccacggacggtcagaacccgctctacccggtcaccttccgcgccgtcgggtcctgcgcgccaggggagctcctggagtcgctcccggcgggagcggccggcgtcgcgggcctctcaaggctaccgctgtcgctaccgacccagttcgcgtccttgctcaaggtagcgaacgagttcgcgttgtgcctgcccagcggcggcgacggcgtggcagtcttcggcggcggcccgttccagctcctggcggcgccgcccgtggagctcgccgagcgcctccgcgagaacccgctcccgctcctcaagcacccctacaacggcggctactacttcggcatccccgccattcgccggaaccagcagcccgtg

SEQ ID NO: 5540 - DNA, 1202 bp, Zea mays
gcacgagaccattacctaaaaaaacagtatccacactaatccacatcacaaaccccatcccaattcccaggccccgccgcgtgcttgtggccgccgccgccgccgccgcgagagagagatgtcgctctgctgctgctgcagcaccgccaccggccgcggcgttctcctccctagcctcctcctcggccgacgccactggacgggtcaccacctcctcaacctccgggccaccacgaccgtcgtatcctcctcctccgcggccgccacctcctccctctcgccgccgcagcagcgccagatcaccgtctacgtggacactctccttgaatggaaccagagaatgaacctcaccgccgtcaccgacgaggccgaggtcatggcgcgccacgtggccgactctctcgccatgctgcccccgctggagcgtgtgtaccgcggccgttccacctccgctggtggcgctatcgacggagtcaggcttattgacgtcggctctggcgctgggctcccgggtctgatccttgccgttgcgcggccgagctggaagtttacgctgttggagtcgatgcggaagcggtgcacgttcttggagcatgctgttgaagccatgaacttgtcaaatgtggatgtggtgtgtgaccgagctgagaaagttggccaaagtcttgatttcagagaaagttatgatatagtagctgcaagagccgttgctgaactgaaagttctagcggagtactgcatcccattggttcgcattggtggtttgtttatagctgcaaaaggacatgatccccatgaagaagtcagaaatgcagaaggtgcaataaagaaattgggtgcttcaatgcttgagttatgtaatgttgaatcaatgtgacctcatggtcaacgaacagctgttctatacgtcaaagaacgtgccactccaaaaaagtacccgcgccttccaggtactccttccaaggcgccattatgaggagcatgtagactttttctatcaattaaagaccgataattgtgattgacctagttagtaggccgtcttgctttacaaggatggcagggtatcttggaatcgaatatctgctaagggtttcaggtatatctatgtatggctcatcgtgcttcgtgccaaacaagtttgtacaggaaagcctaaaaaacttttggttcgtgctaaaaaaaaaaaaaaaaaagcggcc

SEQ ID NO: 5541 - DNA, 1509 bp, Zea mays
ttttttttttttttttcttttttttttttttttttttttttttttttttttgatctccaagtgtgttaactttatttctgaaagatctatctgaagttctgaacccaacaaattacaatatttcacagatataaactctatgcagatcaaactaagcaagatttctttccacatattaaccaaatatcagaaagtgaaacccatattaaaatgatgtaccaaaacacacaaacatgaagccccagtgtgccagctctgtcgacaccctcctccacttggctaatcgacagaagaacagcccagatttcatctccgtcacttggaacctggttcgtgcagtgggatctcgtcatgggactccccgccatttgccactggagctgctgtagaggtgatcacttcctcttccttctcctcatccgaatccagtgtgaactgtgacatcatcggcatcccctccatctggacctccttgtccagagcactgtacccgctcggaggtcggtttgacctggataggactgctgcgtaagcggccgcgccggcgatcacaagcagtgcgaggtgtccgttgaactgcagcgtggcgacggaccgcgcgcggtggtaatcctcgtgggtgcggcacttaatggtgtagtcagcgcggctggcggcgtggagcgcacagccctgcgcgatggcgctggtgaagaaggagaagcccatctgcagcatccacgtaccctgcagcgccaggcccgccgcgcgggcgatccgcggcgcgggctcccctggccggtgcgcggcgagcagcgtggcgccgaggcagagcgcaatggggacgaggagcaggtcgaagtaccggttctcgatcccagccgcggtggaggggcggcggtgcgcgaagagaagcagctcctgcgcgaaggcggcggcgaggaggagatcgaggaggggggagggcagcggcgccgcgagcggcgcgaagggtgcgagggaatagaggaggaagagggccgaggcggcgagcgtggggagcgagaggtggtgcgcggagacgagagcggagatgaggcagagcgcggagacggccgcggcgaggagatggcggaggtgcagcggcgtggtgaggcggcgtgggagggaccggagcggcgggacgcggaggggcagtgactcgagcgcggcgagggccaggaggcctagaccgaggcccgagtaggcgaccagacccggcatggtgcgaagggtgtgagctagccgcgcgccgggctgcttgtctgtcgtggttgctgccggcgcgggagggtgctgcggggcggcggatctgagcgccggcaggggaggtaggcgaagggggtggcccggctggcgacttgtgcaagtcgcttctgggtgggcccacccgttagttgctcttgctcgtggttgtccaaatgtggcgatctcgatttatttttaggtctttatttgactttctatttactttttcataaaaaccacactatatatatatataacatctca

SEQ ID NO: 5542 - DNA, 859 bp, Zea mays
cggtccctcccgcccgccgggccgggactcagtggtgcccacagctaaagccttgtgcaaaattatcattaagctgtcatcaatcatcatggctgccattacggcaggtctgctggtactcctcgctgctgccgtcgccgctccggcgcacgccacggactacacggtcggcgactcgtccgggtggagcagcggcgtggactacgccacctgggcgagcggcaagaccttcgctgctggggacaacctagtgttccagtacagcgcgatgcacacggtggtggaggtgagctccgcggactacggcgcgtgctcggccagcaactccatccagtcctacagcgaccagaacaccaagatcgcgctcacagcgcccggcacgcgctacttcatctgcggcaccccgggccactgcggcaacggcatgaagctcgccgtcacggtcgccgctgggaccgccaccaccaccccggcgtcatccccgcccgccgctgactcgcctccagagacagccacgccgtccgggtctacgcccacggcaacgacgtcgccgtcggcgcccacgacgaagcccacctcgagcagcactggcgctgcctgcggtggggaggcccggctcgctatgggcgttttggcctgggccgcgggcctcgccgggctcgccctgatgggttaggcaagaggcagtgctgtttccgttccatgcttttcctgttgcaggcttttgtggcccgttgtgtttaatctgaattcacgtctatggtctatgctcgattctggcttgttcgagactcccgctgtatacatgtacggctatccgcccctccggcatgctggacctgtcccagcggtctgcaat

SEQ ID NO: 5543 - DNA, 1463 bp, Zea mays
ctgcagaaatggcccagcaatcgccttctagctcatctgcttggcacttttttgagatagagagataaaacctgcttgactatggaaagctaatcaatcatcgatgtggaattagagtcaaagtaggtccgcgcaaggtacgaagcagatatcatgagcatggtttgttcaacgactcaaccaaaacttgctgtctacgtacgtgcatccttcgagctgtacctttcatgtagtatgagcctggttcggactagaggtcggagacctcaagcggcggaacaagtgctttctgagttctgaccaagatagctctcaggctatatataatcaggcgtttaagtgaagcaagccgatgcccacgaaacaggcacacgaggcatgagctagggtcacatgtttcacgcaatgctcgtctactgatctcaggctttgcgacttcgcgtcaatgctcagcagtgttttcgcctcgcgggtgtaggcgtatatagttcagatttgttggttttggtcctgcatcaccatgaattgtccagggaatgaatctgggggcgccagagcagcagagttggtgacgagcataactgaaccaactccaccaaaacttaccaaatcgcctttagctagcacctgcatcgcaaccctatatataaccactgatcactccgacccgccgcactcagcggtccgtgttcttgatcgattaagctgtcctcaaccatcatggctgccattatggcggcaggtctggtagtactggcactcctcgctgccgtcgccgctccggcgcacgccacggactacgtggtgggcgactcggccgggtgggccagcggcgtggactacgccacctgggcgagcggcaaaaccttcgctgctggggacaacctagtgttccagtacagcgcgatgcacacggtggcggaggtgagctccgcggactacagcgcctgctcggccagcaactccatccagtcctacagcgaccagaacaccaaggtcgcgcttacggcgcccggcacgcgctacttcatctgcggcgccccgggtcactgcggcaacggcatgaagctcaccgtcacggtcgccgccgcggccgccaccaccaccccggagacgtccacgtctacgcccgccgcaacgacgccgcccaccacgaccaacgccacgtccacctcgagcactagcagcactggtgctgcctgcggtggggaggcccggctcggtatgggcattttggccgcggccgcgggcctcgccgggctcgccctgatgggctaggctaggcaagaggcagtgctgtttcggttttccttatgtcccctgcttttcctgttggttgcagccctgtagcccattgtgtttactgtctacgcaccctcctccattcacgtttatgctcacgatggcttgttcgaggctcctgctgaatacatgtacgatcattctcaaaaaaaaaaaaaaaa

SEQ ID NO: 5544 - DNA, 1086 bp, Zea mays
ctcctaagcagagtggggaaaggcgtcttcgtactcgcctctctccgcgcaaccgagccttcgccctcctccttccccatttcgccagcggcgcagcccaccaaccacccccacccgccgccatgagggagtgcatctcgatccacatcggccaggccggcatccaggtcgggaacgcgtgctgggagctctattgcctcgagcatggcattcagcctgatggccagatgcccggtgacaagaccgttgggggaggtgatgatgctttcaacaccttcttcagcgagactggtgctgggaagcacgtcccccgtgctgtcttcgtagatctcgagcccactgtgattgatgaggtgaggactggcgcttaccgccagctcttccaccctgagcagcttatcagtggcaaggaggatgcagccaacaacttcgcccgtggtcattacaccattggcaaggagattgttgatctctgcctagatcgtatcaggaagctttcagacaactgcactggtctgcagggattccttgtcttcaacgctgttggaggtggaactggctctggccttggttcgcttctcctggagcgtctctctgttgactatggaaagaagtccaagcttgggttcacagtttacccatctccccaggtctccacttctgttgttgagccatacaacagtgtcctgtccacccactcactccttgagcacaccgatgtctctatccttcttgacaatgaggccatctatgacatctgccgccgctcccttgacattgagcgcccaacatacaccaacctcaacagggcttgtttctcaggtcatttcatcattgactgcttccctgagggttgatggtgctctggaatgttgatgtccaaggagttccagaaccaacctgggggccccacccgaggatccaatttaaggttttcccccctatgcccccagtggatctccacccgaaaaaggcttatccatgaaccagctggtctggattgccgaaaattcactaataactggcctttttgagccctctccccccttgcagggccaaacgtcccaaccccccgcccctttggca

SEQ ID NO: 5545 - DNA, 1061 bp, Zea mays
  misc_feature (983)..(983): n is a, c, g, or t
cggccgctcgaggcggcgggcgggatctcccgccacccaccacagcccgccgcgggctaccatgcgcacacagacggcaatggcgaccaccctcctcttcctcgcgctgctcctcgtcccgcacctcgccgcggctacgcccggccaccagcgccggctgctccagagccacggcgccgacgacggcagcgacgtcttggtcgacccgtcctacgccttcgccaacccgcgcctccgcgacgcctacgtcgcgctgcaggcctggaagcgcgccatcctctccgacccgcgcaacctcaccgcctcctggtccggccccgacgtctgctcctactacggcgtcttctgcgcgccgtcccaggcggaccactacctcaccgtcgtcgccgccgtcgacctcaaccacgccgacctcgccggccacctcccggaggcgctcggcaggctcgccgacctctccgtcttccacgtcaactccaaccgcttctgcggcctcgtgccggcctccttccacgccatgcacctcctccacgagctcgacctcagcaacaaccgcctcgtcggcgccttccccgacgtcgtgctccgcctgcccagcctcaggtacctcgacctccgctacaacgagttcgagggccccgtgcccaaagagctcttcgacctcccgctcgacgccatcttcatcaactccaaccgcttccgcttccagatccccgacaacgtcggcaactcgccggcgtctgtcctcgtgctcgccaacaacgacttcggcggctgcctcccggcctccgtcgccaacatgtccggcacgctcaacgagatcatactcatgaacaccgggctcaagtcctgcgtccccccggagctcggcatgctcaccgccctcaccgtgctcgacgtcagccacaaccagctcatgggcgccatccccgccgagctcgccaacctccacagcatcgagcagctcgaccttggtcaaaccngctcaccggcgacgtgcccggaaggggatctgccacctgccgcatctccagaacttcacctactcctacaactacatc

SEQ ID NO: 5546 - DNA, 778 bp, Zea mays
cgggcgggctcccacactcctcccgccccagaaccctagccgccgccgccccaggtaagggagagagcccaccccccgccgccgccatgaagcgcaacccccgcgtcacgagctcccgccggaagtgccgcaaggcgcacttcacggcgccgtcctccgtccgccgcgtgctcatgtccgcggccctctcctccgagctccgccacaaatacaatgtccgctccatccccatccgcaaggatgacgaggtgcaggtcgtgcgcggcacctacaagggccgcgagggaaaggtggtgcaggtctaccgccgccgctgggtcatccacgtggagcggatcaccagggagaaggtcaatggatccacggtgaacgtcggcatccaccccagcaaggtgatcgtcaccaagctcaagctcgacaaggaccgcaaggccctcctcgaccgcaaggctcgcggccgcgctgctgacaaggccaagggcaagttcacggcggaggacgtcgccgccgccgctgggggcgccacggccaccggtgcctcgctccaggagatcgattaagcttgggatctgccggttgccatactgctcttgatatcctagttttattaccatcaccagttctgttaggatatgctatctgaagactgctttattattcgtatgatgtcgtggatgagcgttttcaaacctttaatgtgcatctttatgggtctgtgccttggattttgatatgaagacttcattatatgtttaatatctggttctttgtttgtcgg

SEQ ID NO: 5547 - DNA, 1267 bp, Zea mays
gcactacagtgagtccggagcggagtcatctaccccccgactcgattcgtgacgagatctctctcctccgaattcctcgatcgattcgtgtcgaaaaaccccagcccctccccaccgcccccccccgtcggaatcccgaatccatccccgatggcgcaaggcaccgtgccctccgcagccggggccggcggcggcggctgcccctcggcccccgccgtctcgacgactcctccgggcacgccccgggctgccccgcctccgccatctaccttcgcgaccggattctactacgccgtggagctctatttcgacccggcgctggagaaccaggtgctcaaagcgtggaacgcgctggcgcggcggcagctaggcagccgcctcatcgacgctgccgcccgcccgcacctcccgctgctccacctccccgccgccgcgctcccgcctcctggcaccggcgcgggcggggatccgctcctccgcctcgcaccctcgctccgcgcgctcgcgtcgcgcctcgacccgctcgcgctcgcgctctcctcgctcgccgcgctcccggcctccgcctcctcttccccgcacgacaacgttctcttcctcgcgcccactccaaccgccgcgctgctcggcctccatgcgcagctctgcgagctgctgcggaaggacgctggcgtcgaggtccccgacgcgttccggcccgaccactggctaccgcggtgcgccgtcgccgtcgacgtgccccgcggccgcatggcggaggccttctgcgtgctccgagagctcaagctgcttcccgtctccgggtacgggatggacatcgcgctcgtcgaggtcggggccaccgttagggagctcgtgtcctacccgctcggcggtggcagcagcgctggagcggactgagaggtcctgttgtattttgtataatatctagatcatggatgaacagccatacttgacgaggacgtaatagtgggacaatttgccttcttctgatgagctacatttggaagaagtctggaccatactgtatcctcacacatacagtattttgttcaatcatttctttagtcttttggttgataatgtgtttgatgtcctctccctccattgtagactcttcacgtagtatcacccgttctcgagtttactgtaatgaattgtcaactgtgttcatgtgcccagagaaccactcgtgctctcttcattcgttcgcttaactgatttgtttacatccaaaaaaaaaaaaaaaaaatcggcccaacacaat

SEQ ID NO: 5548 - DNA, 858 bp, Zea mays
ggccgctcgaggcggcaggccgggaaaccacacacaacacacacacacacacacacacacacacacacacacaaccagtactagatccacaagccagcagaaaggaagaagatgatgagcaccaaggccctcaccctcggcgcggtcgtcgtcctcgccatcgccatggcgggcgcgcacgccgagcagtgcggccacgcggccgacggcatggagtgcccaaacaacctctgctgcagcgcgtgggggtactgcggcatggacgccaactactgcggcgacggctgccagagcggcgcctgctacgagcccaaacgctgcggcgcccaggccgaggggaacgcggtgacgtgccccaacaaccactgctgcagcggcaacgggtactgcggctacggccaggagtactgcggcgacggctgccagaacgggccatgccgcgccaacatcaagtgcagcgccgacaagccgtgcctgagcaacttctgctgcagcaagtacggatactgcgggctcggcgtcgagttctgcggccagggctgccagagcggcgcctgccatgacgccgttggcgccgccgccctgccgctcagctccatagtgcaggggtgatcttgaactgcgcatggctacaagtattgcgacgggatcaggtgaggagatgagttgtggcaatgtcgatcgttgccacgtcttcttcaccggctagtttgcgttttcctcgtctttacaatcgttcccatcatgcatgcacgcatgcatgattagcgttcgggaaccacaaataatgcgtgtggcgccatgcgccgtctttgtaacctttgtgatccaataaatctgaatctcgttgcaattaag

SEQ ID NO: 5549 - DNA, 877 bp, Zea mays
ggcccgctcgagggccggcgggccgggaaatccgtatcgacaagacgtcaaaaccctagaccggcgacgcgttcccctctctcgccgccggattcccctccgcccgcgcgtctcgcggacgtcttcgcgctctccggctgctctccccggttcgcccaccaccagcaatgtcttctcagatggataaccgcatccagtccgctggaaagcgcgcgcgcacagacggtagccggcgtgaggacgactggatttgccccagctgcaacaacgtcaacttcgcgttccgcaccacctgcaacatgcgcaactgcgaccagtccaggcccgccgatcacacggctatgcagactccaccccactactcggtgccggggcggtacatgccgccggggacgcctccgtccatgtacctcaccggggctcctcccccgtatggctccaacctctataatgggcatcccatgccacgctatggcattcctcagctccctccgggctctggatatccgtatggctatggcgggcgagtcccgatggggagcccctatgggccaatgcatatggcggcgccacccccgtattctagtggttctatggttggtgcaggtggaatgtacagcatcagcatgcccatggatagatatggcttgggctcacccgctggtcctggggcaatgggcacaagggctggttcctattctgacgaaggctcacagaagaaatctgctggagctggacgtgataatgattggaagtgtcctaattgcaacaacattaacttcgcctttcggacagtctgtaacatgagaaaatgccacacaccaagacctgacacccagggatcccaaccctgacagttcaagagctccaaaaccaa

SEQ ID NO: 5550 - DNA, 809 bp, Zea mays
  misc_feature (798)..(798): n is a, c, g, or t
cgggactagcccaccaccattgcactcgaaagcttcagctcaagctcaagctccacatcaacaatggcgagcagcagctcaatgctggccgtcctagccaccctggccctgctgctctccccagccgcctcagccctgtcgtccacgctgtccccggacttccacgcggagacgtgcccgcagctggacggcatcgtgcgcgcggcggtgcaggccgccctcacgagcgaaatcgccatcgccgctggcctcgtccgcatctacttccacgactgcttcccgcagggctgcgacgcctccatcctcctcaactccacctccgcccgcgagacggcgctgggccccaacctcagcatccagccgcgcgccatgcagctcgtcgagtccatccgctccacggcgcacgccgcctgcgggcccgttgtctcctgcgccgacatcaccctgctcgccacccgcgccgccatcgtcgcctccggcgggcccaccttccccgtgcccctcggcaacctcgacagcctcgccccggcgtcacaggacaaggtgttcgacctcccgtcgccggccaccgccagcgtcgccgctctggtgcagtccttcggcacccgggggctcggcgacgtggccgacctcgtggcgctctcgggcgcgcacaccattggtcggtcgcagtgtgggtccttctccgaccggtctcagcgcgccgacgacaccttctcgaggaagctcgccgccaactgcagcaagaacccggaccgtctgcagaacctggacgtgatcaccccggacctgttcgancacgggtacta

SEQ ID NO: 5551 - DNA, 858 bp, Zea mays
cccgccccctgtcctctcccctcgcctcgccttctccgccctccgctccattcgtttcgatctatttcggcttcctctccaagcttcggccatggcggcgacgatccagtccgtgaaggcccgccagatcttcgacagccgcggcaaccccaccgtcgaggttgatgtgtgctgctcagatggaaccttcgccagggccgctgttcccagcggtgcatcaactggtgtttatgaagctttggaactgagggacggtggatctgactacttgggaaagggtgtatccaaggctgttgacaatgtgaactcgattatcgcgccagctttgattggcaaggaccctaccgctcaaactgagctcgacaactttatggttcagcagcttgatggaaccaagaacgagtggggttggtgcaagcagaagcttggtgctaatgcaatcctggctgtgtcactagctgtttgcaaagctggagccagcgtcaagaagattccgctgtaccagcacattgccaaccttgctggcaacaagcaattggttttgcctgttcctgcattcaatgtcatcaatggtggatcccatgctggaaacaagcttgctatgcaggagttcatgatccttcctactggagctgcctcattcaaggaggcaatgaagatggggcgttgaagtgtaccacaacttgaagtctgttatcaagaagaagtatgggcaagatgccaccaatgttggagatggaaggtggttttgctcctaacattcaggagaacaaggagggccttgagctcttgaagactgcaattggaaaggctggatcacccggcaaggttgtcttttggaatgggatgttgctgctt

SEQ ID NO: 5552 - DNA, 879 bp, Zea mays
aataagttgcgtctgcatcgtcgctataagagagcaggggccgccccctccgtccgtccatccctctcgctctccgctccattcgattcgatctcggcttcctctccaagccacgcgacgcgagaccagagctccggccatggcggcgacgatccagtccgtgaaggcccgccagatcttcgacagccgcggcaaccccaccgtcgaggttgatgtgtgctgctcagatggaacctttgccagggccgctgttcccagcggtgcatcgactggtgtctatgaagctttggagctgagggacggtggatctgactacttgggcaagggtgtttccaaggctgttaacaatgtgaactccattattgcacccgctttggttggcaaggaccctaccgctcaaactgagctcgacaactttatggttcagcagcttgatggaaccaagaatgagtggggttggtgcaagcaaaagcttggtgctaatgcaatcctggctgtatcactagctgtttgcaaagctggagccagcgtgaagaagattccactgtaccagcacattgccaaccttgctggcaacaagcaattggttttgcccgttcctgcgttcaatgtcatcaatggtggatcccatgctggaaacaagcttgctatgcaggagttcatgatccttcctactggagctgcctcattcaaggaggcaatgaagatgggcgttgaagtgtaccacaacttgaagtctgttatcaagaagaagtacgggcaggatgccaccaatgtcggagatgaaggtggttttgctcctaacattcaggagaataaggagggccttgagctcttgaagactgcaattgaaaaggctggatacaccggcaaggttgt

SEQ ID NO: 5553 - DNA, 808 bp, Zea mays
actcctcagctgctcacacacttcagccagccgctagcaagagatggctctacttgctgccgctaccctgaatcccaccacccaccttagccttagaagccgtgcaggacgcaacagtgagaacctatggctccggtctgctgcttcatcacagaagagcaagggaaggttctgtaacctcaccgtcagggcaggcacaccgtcaaagccagcagagcccattgggcctgtgttcactaagctcaagccctggcaaatccctaaaagggactggttcgacaaggacttcctctttggtgcctccacttcagcgtaccagattgaaggtgcttgggatgaagatggcaaggggccaagcacttgggaccacttctgccacaaatatcctgagcgcatatcggacaggaccaatggggacgttgcagcagactcctaccatctgtatgaagaggatgtcaaagcgctgaaggacatgggcatgaaagtgtataggttctccatctcttggtcgagaatactgccaaatgggacgggggaagtaaaccaggcaggcatcgactactacaataacctgatcaactcgctgataggtcacgacatagtgccatatgttacaatttggcactgggacacccctcaagcactggaagacaagtacggcggcttcttagatctgcagattgtagatgattacaaacaattcgccaaggtgtgctttgagagcttcggcgacagggtgaagaactggttcacctttaacgagccacttacgtattggtgttcctcctatggagagggggatcatggc

SEQ ID NO: 5554 - DNA, 686 bp, Zea mays
acacaccacacaagtgcacaaccagcaccaagaaaacaaaaagcatgaagatgatgagcaccagggccctcgcgctcggcgcggctgccgtcctcgccttcgccgcggcgaccgctcaggcccagaggtgcggcgagcaaggcagcaacatggagtgccccaacaacctctgctgcagccagtacggctactgcgggatgggcggcgactactgcggcaagggctgccagaacggcgcctgctggaccagcaagcgctgcggcagccaggccggcggcgcgacgtgcaccaacaaccagtgctgcagccagtacgggtactgcggcttcggcgccgagtactgcggcgccggctgccagggcggcccctgccgcgccgacatcaagtgcggcagccaggccggcggcaagctgtgcccgaacaacctctgctgcagccagtggggattctgcggcctcggttccgagttctgcggcggcggctgccagagcggtgcttgcagcaccgacaaaccgtgcggcaaggacgccggcggcagggtttgcactaacaactactgctgtagcaagtggggatcctgtggcatcggccccggctactgcggtgcaggctgccagagcggcggcctgcgatggtgtcttcgccgaggccatcgccaccaactccactcttctcgcagaatgatg

SEQ ID NO: 5555 - DNA, 882 bp, Zea mays
agggtcaaaaaagaagataggtgaattgcagataacaaccagcaatggtcacgactgccgtcgcggcggtcgccggcgccgtgccgccagctcggaaagcccaagcggtaactgtggccacaaccacagcactacctcccaccctcactagaaggcagctcctcgccgcggtcgccaccggctccaccctccccacggccgccgcctcagctgcggcccccaggttcgccgagattccgggctccggcggcgtgaaggccctggacctccgggaaggttcgggagagatcccggccgttggcgaccaggttgcggttcactattatgggagattagcagcgaagcaaggatggcgcttcgattcgacgtatgatcacaaggacgagaccggcgatcccatgccgtttgtcttcacccttgggtccggcaaggttatacctggcatggaagcagcagtgaagtccatgagagtcggcggtcttcgccgagtgatcattccaccatcgcagggataccaaaacacgtcacaagaaccggttcctcctaatttctttgatcggcagaggctgttcaccactatattcaacccgacgcgcctcgcaaatggcgagggttccactctcggcacacttatcttcgacatcgagctaatcaacattaggcaacgtccataactgttctgctccatactcttgtgtctaaaagttgttccgtgcaagaatctggttatgctttaagtaactgtcagcgctccttcggtcaatccccaattacatattgtaatgcatactgatcgctgacagacgatatatgaagaaaaatcaattgaatgcggatttgattccgttgttctaaaaaaaaaaaaaaaatccttgccccctg

SEQ ID NO: 5556 - DNA, 706 bp, Zea mays
aaaaaaaaggaccgcagccgccacacacgacgaacaccgggacgaagcagatcggcggcgcgtcactccaatcaccggttaggataaatggcgacggtttcggattctctggtctgggagctcgtcaggaagaacaactgcttcctgatcaagcagttcggcaacagcaatgccaaggtccagttcagcaaggagcccaacaacctctacaatgtccactcctacaagtactctggcctggcaaacaagaagactgtgactgtgcagccagctgctgataaggagatgaccgtggtcctctccacaacgaagtcaaagaagcagaacaagcctgctgccttcacccacaagactgtcatgcgcaaggagttccgcaagatggccaaggctatcaagaaccaggtcagtgacaactactacaggcctgacttgaccaagcctgctcttgcaagactgagcgctgtttaccgcagcctccaggttgccaagtccggtgtcaagaagaagaacaggcagtaagcactgaggggccaatgagcttgttttgtggatccgttggtttatgtttccagctttttagatttgttctaagagtatggagattgaatatgatgaatggtgtgctccgcatactggcacaagttttctcagtaggttctatatctgtacccatgactatgttgtgaagcctcttgaaatcattttc

SEQ ID NO: 5557 - DNA, 770 bp, Zea mays
ccggctcgaggggccggccgggcccgggacatccttcttccattccaaggcagccatggattccctcctctggtccgtggagctcctctccctcctttgcttcttcgtcttctactaccgccacctccagtccaagaaaataagcaaggcggagccgaccgaatggccagtcctgggccatcttttcggcatggtcgccaacctgtcccacttccatgactgggccaccggcatcctggccgccacgcgctacaacttcgaagctcgcgccggcatcaccggcgtccgcttcttcgtcacctgcgaccccgccaacgtgcgccacatcttcacctccaacttcgccaactaccccaagggcgacgacttcgccgagatcttcgacgtcttcggcgacggcatcttcaacgccgacggcgactcctggcgccgccagcgcgccaagtcccagctcatcatggcgggccctcgcttccgcgccttctccgcgcgctacagccgcgacaaggtggagaggagcctcctgcctttcctcgcccacgccgccgaggccgggtccgggaccccctgcgacctgcacgacgtgttcctgcgcctcacgttcgacatgacctgcaacctcgtcttcggcgtcgaccccgggtgcctgcagatcggcctccccgtggtgcccttcgcgcgcgccatggacgacgtgctcgagacgctcttcctccgccacatcatctccccggcgtgctggaagctcatgtacccggtatgaggtcgga

SEQ ID NO: 5558 - DNA, 755 bp, Zea mays
gggccgggcattcttcagaaccctagaagccgcagcttcccattcctcgccgccgccgccgcttcgtacccgctcgaagccgacccgaccatggcggacgtcgacgttgacacggaggtggccgccggcgcgcagccgaagaagaggacgttccgcaagttcagctatcgcggcgtggatctcgatgccctcctcgacatgtccaccgacgaccttgtccagatgttccccgctcgcgcccgcagaaggttcaagaggggtctcaagaggaagcccatggcgctcgtcaagaagctgcgcaaggcgaaaaaggacgctcctgctggtgagaagcctgagccagtgaggacacatcttcgtaacatgatcattgtccctgagatgattggcagccttatcggtgtctacaatggcaagaccttcaaccaggttgagattaagcctgagatgattggccattaccttgcagagttctctatctcctacaagccagtgaagcatggtaggcccggtattggtgccacacactcttcccggttcattcctcttaaatgagttatgccgctttctactttgaaagaattcagtacggaccatctggtggcatgtccatctagctgtctcccttgttttgaaccagttatatatctagtatttggttctgtttagctataatttcgttatgcacaatgagctgttctacctaaatgctctgagaatcttgtttccgttgtgaaggttcattttgatttctt

SEQ ID NO: 5559 - DNA, 909 bp, Zea mays
cggccgctcaagccggccgggccttctgcacacagcctgcgccgccgctgccgccgccgccgtccgctctaccccaggtaaggaagggaggagcggcgatgtcgcaccgcaagttcgagcacccgaggcacggttccctcggcttcctccccaggaagcgctgctctcgccaccgcggaaaggtgaagtccttccccaaggatgaccaacagaagccttgccacctcactgccttcctgggctacaaggctggaatgacccacattgttcgtgaggtcgagaagcccggatccaagctccacaagaaggaaacctgtgaggctgttaccatcattgagacccctcctctggtcattgttggtcttgtggcctatgtgaagacccctcgtggccttcgcactctcaactctgtctgggctcagcaccttagcgaagatgtgaggagaaggttctacaagaactggtgcaagagcaagaagaaggcgttcacaaagtatgccctcaagtatgacagtgatgcaggcaagaaggaaatccagttgcagcttgagaaaatgaagaagtacgccactattgtccgtgttattgcccatactcagattaggaagatgaagggcttgaaacagaagaaggctcacctcatggagatccagattaatggtggcaccatcgcagacaaggttgactatggctacaagttctttgagaaggaagtcccagttgaagcggtcttccagaaagatgaaatggttgacatcattggtgtcaccaagggtaaggggtacgaaggtgtcgtcactcgctggggtgtgacccgccttccccgcaagacccacaggggtctccgaaaggttgcctgtatcggtgcctggcatcctgctagggtttcctacactgttgctcgtgctg

SEQ ID NO: 5560 - DNA, 855 bp, Zea mays
agtatatagggtgcatcacatggagaagcagatacatcttcatttcacatcaaaatttctcctctttctatccatggccacggacgcacagcaccagcgacacagccgcaacggcggcgtgcacaccggccaccacttcctcatcgtggcctacggcatccagagccacctcaacccgtgccgcgtcctcgcgcaccgcctcgcgcgcctccacggcgtcgacggctccggggccgtcctcgccacggtctccctcccggtgtccgctcaccgccgcatgttcccttcgtccggagacgtcgacaatgatgataaagccaccgacggcgtcgtctcttacgctccatactccgacggcctcgacgacggctccatggccagggacggcgaggcgagggcgcgcagccgccaggccacctttgagagcctgtcagccgtcgtcgccaccctcgccgcacgtggccggccggtgacgtgtgtcgtttgcagcatggttctccccgcggcgctggacgtcgcgcgtgagcacggcatcccgctggccgtgtactggatccaaccggccaccgtgctcgccgcgtactaccactacttccacggccacggcgacctcctcgcgtcccacgccgccgaccccgcgtacgaggtgtccctgcccgggctacaccgccctctccggatccgcgacttcccgtccttcctcgtcgacacgacgggcagcgagctggccaaggtcttcaacgaagcggcccgagaactgttcgagcacttgggcgatcacggctgcaccaaggttctcgtgaacactttcgacgagctggagccggcagcgctggcagccatgaaggagcacct

SEQ ID NO: 5561 - DNA, 810 bp, Zea mays
cgggagtgcaagcaagcaagcagcgctcacccagtaagctaacgaacccgaccacccccctctagctcggcagccatgaactgcggaaggggtcccgctccggcgacgatggtgcgctgcaggcagtgcagcgccagcgtcgccgcgccgcccggtgcctgtgccgtccagtgcgcgcagtgctgctgcgtgactcgcgtcggcggggctgggcgacagctcagtgtgatgcgccccatcccgaacttcggcggtggccgcggcaagaagcgcgccgtgctcgtcggtatcaagtacaccaagacgcgtgcctgcgagctgaggggccccatcaacgacgtcaagtgcatgaggtacatcctcaccgagcgcttcggcttcgccaacgactgcgtcctcatcctcaccgatgaggagagggacccgtgcaggcagccgaccaaggccaacatccgcatggccatgcactggctggtgcaggggtgcagctccggcgactccctggtgttccagttctccggcgcgggcgcgcaggtccccgactgcgacggcgacgagcgggacggcatggacgaggccatctgtcccgtggactcgttccagcagggccccatcctggacgacgagatcaaccatgccatcgtccgccccctcgtacacggcgtcaagctccacgccatcgtcgacgcctgccacagtgccaccgtcctcgatctcccataccggtgcaccttctccagcagtacgggtgctttgagctggttggacgagcgccctctgaatgccgcctgcaaaggcaccagcggaggc

SEQ ID NO: 5562 - DNA, 5318 bp, Zea mays
  misc_feature (4416)..(4416): n is a, c, g, or t
  misc_feature (4483)..(4483): n is a, c, g, or t
cgtttttagttttttttttttttttggaaaaatgttacagttttttgttttgcgttacatacataagttcaaattgtattaatatgattgttaccaaaaaaaaaattcttcaattacaatgccacacgttgcatacaagttgaacgttaaaataaaaatgaataaataaggtagttgtgtattgttttgacaatgtagatattgagaaaaaaatagagttatcagactaaacgaaatttagataatgtcgctggacgctggagagagtctctgaaaccaaaaacacaccgcttggttgctggcacgtggcacgggtccctacgcacgtgcgaggccccacgcggaccatcatcctccattcctccagggctgcttcgcggctagctgcccctcttgcagtctcgctgtccatcgactgctgtcgtcaccgactgtagccgaagcctacacggacgaatttcgacgcatttccaaaaaaaaaaaaattgccaggggggaccaattttccttgctgttcctccagctagcgtggcagacgcataaaaaaatatttgcgaaaaagaatcgcactatctacatgacatatgaaggagaagagactagctagggaaggagccgggagcaattccactactcaggccatccacgggacattcctccgctccgcctccgccgccgcccgtccccatccggctccagtaggctcctcgtcgtcgtcctcccccctcgtcgcgccgtcgtcccgagctcgtctggcaagcgcgcgcgcgcggcacgggagacagagtcgctctggcgaggagcgggattgggatccttgcatgcatggatgcggcgcagtggcatcaggtaagccgatctgcacggccgtctcgatcgaaccaaacaaggcgcgcgctagctgcagcgtgcatcggggccgggagccatgagtacgagcagatctctcgcctgccggcttggatcttggtgtcttgttcttggttactctagcggttcttcgcctctctggctgatctgccttggtcctggagcttgctttcttatagtagtagatataggagtgagtgtgtgggcatgatttcgtgttcttgggataccgccatgccgagccttttatattctttgtgtagatctacgcgagcacaccgtcatctcctctctgtgcatgcgcgcgtgccgtcaagctcctctagctccattggcttcgagctggggggcctttaatcctccctgcttgtctcctcccttttaatccttgaaaggagcgtacacacacacggccgggccgcccccttttttccccccctccctttgttcctgcctttctttctatcttatccatcccctcctttccgagctctctcttcccttttatccctcctttttctcatatggaggagagtactagctctactctctccacgccttgcatcaaaagagcggccatgtcttgggtgatggagtgagtagaggtgctactacgccacaagcgcaaccctacaagagcacaaacaaagtggagctttacgtacgtggtgctgtgttgggcttctctctcatcttttgcttgccctttttttcaccttttaatttgcctttcaatctcactttgtatccatttgtttggttcttttgttgcactgcgctgcagttgcgccataagaatccaaagagacctccacgctcataacccccctctgctaagactgctatgtgctatcattctcttcattctccatgttcttgcttcccctagctagataggatccatcattaagttctgcggtagtaacatctaacatgagcaatatgtgtgcatcaccaggggccgctagggctaggcaagcccatggaggagatgctcatggctggaaacgccgcgaatccaaacccaccgccagctgctgcgccctcggcacccggggcccagacccagaggggtggtggcgctcctcctcccgctgcgggtgcggcagcgcctagggctggcgcgaccggaggggcggcgccggcgggcacggagcggcggccgcggccgcagaaggagaaggcgctcaactgcccgcggtgcaactccaccaacaccaagttctgctattacaacaactacagcctgcagcagccgcgctacttctgcaagacctgccgccgctactggaccgagggcggctcgctccgcaacgtcccggtgggcggcggctccaggaagaacaagcgcagctcgtcctcggccgcctcctccacctccgcggcgatgtccggcacggtctccgtgaagaaccccaagctggtgcacgagggcgcgcaccacgacctcaacctggccttccctcaccacaacaacggccgcgctctgcagccaccggagttcccgtcgtcgttcccgagcctggagagcagcagcgtgtgctaccccggacccgccatgctgggcaacggcgccgccggcaggggcatgggcgcgctctcggctatggagctgctcaggagcaccggctgctacgtccccctgcagcacgttcagctagggatgcccgccgagtacgcagcacccgcgggattcacgcttggcgagttccgcattcccccgccgccgcagtctcagagtgtgctcgggttctcgctggacacgcacggcacggggggttacagcgccggcgggttgcaggagagcgcggtgggcaggatgctcttccccttcgaggacttgaagccggcggtgagcgcagctggcggcggtgcaagcaacgacggagctgatcatcgtcaaaacgaccacaggaaagatcaagctgcaggcgacggcagcagcgtcaccggtggccacgagactccaggcgggttctggagcaatagcttgatcggaaatggcagcagcaatggtggtggaggccattggtaaggcggcgcggcatgcatggctcatgcacgcgcgcgccgttgtcagcatgcggagatagggatagagccatggagccaaggttccaagtgggcaagagggtacggtggaggaggtgattagtgttcacatatatggcgtttgatttttctctggttgtttaatttttctcggatcttcgtgttcttgtgtgtaaatcgacttgggggggctaacacagcaggatatacagattgttaaggtggtgaaccggtgatttacagctagcttctcttatccaatggatctcttgtttctgattgtgcaatatataagcggtcaatcccgtgtcaatttgttgtgcattgcatgcatgcatgtagagtatgcatcagcatcactacttgagcagctctgttgcagctctgttgcagtgttgtaagttaaagtcacaccgtacgtgcaccgtacacatacgtagtttttgcttttgtcctgataacacacaattttgttagccatatacaattattatattcttcttgggtttgtttttctgattgcagtgcgtgcatcattcttcattagtaatcgcattgtgatacagttgcttaattggttttgtatagtgaagagtgcatgctagatcagtggtgatcagtgatcatcatgtgaaggagcatacaatgctgtgctgatctatcttgagggtactcggtaacagtcatatttttgtggttggctcatttatggtggtgtttggtttgtgcctcattatcctcaatgtctcattctattatctcaattttaaccaagcatattctgattttttattggattttgtgtcaaaatctcacaatccccaacttatataggcggtatttggttccgggggatagtgcacaaaatccaatacaaatctcattatcaggttatagagagattgtgagattctagcacaaaatccaatgcaaatttcatgagatgtttggtttataatgagattctaaaaataaggtaggaaacaaacagggccataaatcatcgataatgggatatgcattgaatttttgtgcagtatccaacttctcaaaatctgtagtactaggtaataaccaaacaccacctatgtcgtctcatccagcttttaggccttatatattgccctgttctaaattgtagtgccctttaactttgtctaagccaaaatcaagttttttttaatatatgaagataacaaatacactattaatacatatatatatttaaacaaacttccattacatatttaatgaaggatttactgaaactagcagatgccgtttttctttaatagatttgattaaagtcagaaaattttgattcaggatagagataaaaaaactagatatattttggaacggagatatataatactttgtgtctgtattttatgttatttgtgacatccgtcgtctctgtacgtagaccggccggccgatctctccatttgtatagctctgaggagacgccatatctgctgggccatcatcacnaaaccaagaatcttccagccatgaaaagcactaggagctagctagggccgtcgtcgtggagaaaagnagaatgaaggaatatgtatgtatggcaaacaccatgcttttgcacctgcgctgtctgctgtccacatggtactattattatcatatgttaataagccatcttctacaactgcaagggctaccttgtgcaggccattatgctctttgccctctctcatgacctctcatgtcaaggtaatatattgagatgaatactgccagccctgttgttttcttagctagtacgtacgttgatcattcacttgcaaagttcaactgcccgcaccagaaagttgccatcaaattattctctcactcactttaccattttcacgtatatatatggcagcctctggtggcccgtgtctgtgtcttcttcagtggatggactgttacagcaaccttcaccgcacggaagccattcttaatctggcgggcccacaagacattcccctcacgtactaccgaaattcggctcttttccgagtactcgcgactttgctgagtgctttttgttagacgctcgacaaaattctactcgctctcggtaacgaccatatttaccgatagtagaacactcggcatagaccgtgtcaaacactcagcgaaccgcagcactcggtaaatgaccgtctatagcagagggccgttatctttgccgagcgttagacgttgacacttgacaaagatgatactttgccgaatgttgtctatccgacactcggcaaaccatgctttgccgagtgccaaccttagacactcggtaaagtatatttttattttttttccttttcccaaccaaatttttttgtggtttatttctacattatgtagacctatatggttaaatttggcac

SEQ ID NO: 5563 - DNA, 865 bp, Zea mays
attatccccgccgcagcggccccccccctttgagaaaccccttctccgtcactatccaagctctgcctgcaccgccgccattactactagaggaagcttcaactgttgtgctcttgctctctagctaatagtggttgctatcggtgctactaccgccgccgtccaaaccctagccctgatgccgcagcaggaggtgcccgaccagatcgccgtagggtggttcgcggtggaggcgccggagcgaacggggagtctccagaggagcggctccaacagccgcctcaacgcgcaggcgccggaattcgtgccgcgggtcgcggcggtggttccaccgccacagccaccgccggcagtgattcgtgtgtttgcggtgccctcgcctccacctcgcgcggctttctttgcggctcccctgcctccctcgtcgttcgagttcttcgcgccggtgagggttggcggtgcatttgtggccgaggagccagagccggagatggagcgcgcgacgccacctgttgctgagccggcggtggacgggcttactgatgaggtggtgcagaagatcaccaagcaggtggagtactatttcagtgatataaacctggccactacggaacatctgatgagatttattagcaaggatcctcagggatatgtgccaatatcagttattgctggcttcaagaaaataaaagctttagtgcataataacccaatgcttgctgcagctctccgtacctcgtcaaaacttggttgttagtggtgatggaaaaagagtaaaacgccgacatccatttactgaatctgatatgcaggagttccagtccccgattgtagtggcagaaaatcttcctggtgatccttctta

SEQ ID NO: 5564 - DNA, 886 bp, Zea mays
agtttccgcacgacctcgcaccggcctccgcctctatataaggcgcagccgggatcttggtacaacgccgtgcatacattccgcctcttccctccctctcggttcctcggcctcccgatcgagcagtagaagcagcgcaagggcaccgctagcactaaaggaatggcggccgagacgttcctcttcacgtccgagtctgtgaacgagggccatcccgacaagctctgtgaccaggtctccgacgccgtcttggatgcctgcttggcccaggatgccgacagcaaggtcgcctgcgagaccgtcaccaagaccaacatggtcatggtcttgggcgagatcaccaccaaggccaccgtcgactacgagaagatcgtgcgcgacacctgccgcaacatcggcttcatctctgatgacgttggtctcgacgccgaccgttgcaaggtgctcgtcaacatcgagcagcagtcccctgacattgcccagggtgttcacggacacttcaccaagcgtcccgaagaggtcggcgccggtgaccagggcatcatgttcggctatgccaccgacgagacccctgagctgatgcccctcagccacgtgcttgccaccaagctcggagctcgcctcaccgaggtccgcaagaatggcacctgcgcctgggtcaggcctgacggaaagacccaggtcactgtcgagtacctaaacgaggatggtgccatggtacctgttcgtgtgcacaccgtcctcatctccacccagcacgacgagaccgtcaccaacgacgagattgccgcggacctcaaggagcatgtcatcaagccggtgatccccgcgaagtacctcgatgagaacccatcttcaccctgaacccgtctggccgcttctcatc

SEQ ID NO: 5565 - DNA, 750 bp, Zea mays
cggccgctcgagccggccggccgggagcaaacagatcatggcgacccctcagatctaccgcaaaaccctcctccccgtcctcctcctgctcgccgccgcggcgctctacccagccgccgccgacggcgacgaggtgctcgccctcacggagtccaccttcgagaaggaggtcggccaggatcgtggcgcgctcgtcgagttctacgctccctggtgtggccactgcaagaagcttgctccagaatatgagaagcttgctgcaagctttaaaaaggctaaatcagtcttgattgccaaggttgactgcgatgagcacaagagtgtgtgcagcaagtatggagtttctggctaccccacaatccagtggtttcccaaaggttccttggagcccaagaagtatgagggtcaacgcactgccgaagcccttacagagtatgttaactctgaagcagcgaccaatgtgaagatagcagcagttccttcaagtgttgtggttctgaccgaggaaacctttgactcagttgtccttgatgaaaccaaagatgtccttgttgagttctatgccccatggtgtggtcactgcaagagtcttgctccgatatatgagaaggtggcttctgttttcaagcaagatgagggtgttgtgattgctaatcttgatgctgacaaatacacaagccttggctgagaagtatggagtttctggttttcccacattgaagttcttcccgaagggtagcaaggctggtg

SEQ ID NO: 5566 - DNA, 1224 bp, Zea mays
ttgggtacctcgaggccggcacgagaccattacctagaacatcctaatcgaaaaacactcgaacacttccaaagttctagcccctctcgtgagtcctgtccaaataatggccacgcgcagcagtgtcctcctgcttctgacggcgctcgccgcagccacgcctgtgccgtcagcggcgaccaggaagctcatgttcctcgtccagccacagccgaacctcctcacgtaccacaacggcgccgtgctgagcggcgacatccccgtctccatcctctggtatggccgcttcacgccggcgcagaaggctgtggtctccgacttcctcctcgccctctccggcgccgcgccgccgcaggggtcgccgtccgttgcccagtggtggagcagcgtcaaccagctctacctctccaaggcggcggcggcggcggccgtcagcaagaacggcgcgcacggcggcggcggcgccaagagcgcgcgggtggtgctgtccgggcaagcctccgacgagggctgctccctggggaagagcctgaagctgtcgcagcttccggcgctagcggccaaggcacgccccgcggccgcgaggggcggcgtcgcgctggtgctcacggcgcgggacgtggccgtggagggcttctgcacgagccggtgcgggcaccacgggtcgtacggcggcggcgggcgcgcggcgtacgcgtgggtgggcgacgccgccgaccagtgcccgggccagtgcgcgtggccgttccaccagccggcgtacggcccgcaggcgccgccgctggtgccgcccagcggggacgcgggcacggacggcgtggtgatcaacgtggccagcatggtcgccggcgcggtcaccaacccgttcggcgacggcttctaccagggcgaccgcggctcgccgctggaggccgccacggcgtgcgcgggcgtgtacggcagcggcgcgtaccccgggtacgccgggcagctgctcgtggaccgggccacgggcgccagctacaacgcgcacggtgcgcgcgggaggaagtacctgctcccggcgctgttcgaccccgacacgtcggcgtgctccacgctggtgtagtgtagccgatctcacaggctaataaatgttggtatatgtaaatactgaacagtacacagtatgtatcatcgttcgtgacgggcagggcagtgctaaataaacgacctgtgcttgaagctgcaaaaagaaaaaaaaaa

SEQ ID NO: 5567 - DNA, 897 bp, Zea mays
ccttcccctttgcctttatactcgtcgaaggactgaactccctacctccgtcctgcctcgagcaatccccctctccctccttgtgatctccgggttcccgtctcagattcccaggttcgatcttgatccccagctatccccacctgcctctgccgtcctcgaatccttcgtcgcagaggcgccgcttttacctcttcttgccgcgatttgagaagaagactttattgatccgagcaagtcttcttgggcgggaagaaaggagccatgatacctgctgtgaagctctctccggccgccttctctgtcaccaatcaacggtctaaatcagcttttgttccgtcggtgtccattctcaacatgaaaaaatttgcgtcctgctcccttagaccactctacctcacacggctagatgacccacacacttccgagctgaagcctcggaggcagctgcttgacttccggtgtgcagcttcagcggctgatgacaaggagtcaaaggctgaggtggtgccagccagctcagaagcagcacaaaagttgaagatttcaatctattttgcgacttggtgggcgcttaatgtgatctttaacatctataacaagaaggttctcaatgctttcccgtatccctggctcacctccacactatccctcgcctgcggctcagcgatgatgctcttctcatgggtcacctgcctagttgaggcccccaagactgacttagatttctggaaagcacttttcccggttgctgtggctcatacaattggacatgttgctgccacagtgagcatgtcaaaggtggcagtgtcattcacacacattatcaagagtgctgagcctgcattcagtggttttggtgtcaagggtcattctcggagagtcattccgatgcct

SEQ ID NO: 5568 - DNA, 911 bp, Zea mays
aaaaaaaaaaaaaaaaaatgacagaagagagtggacctccaactctccctaaaaccctaacctctcccccgcctccgcccccaaacccctcagccgccgccggcgaagcgcgcggcgagatggcgctctacctgctcttcgagtccgcgtccgggtacgcgctcttccacgcgcacggcatcgacgagattgggcagagcgtcgacgccgtccgctccaccgtgctggacctcaagcggttcagcaaggccgtcaagctcgccgggttcacccccttcctctccgccgtcgacgccctcaaccagtgcaacgccatctccgaagggatcatgactgacgagcttaggaacttcctggagctcaacctgcccaaggtgaaggaggggaagaaggccaagttcaccgtcggcgtcatggagcccaaggtcgggtcccacatcaccgaggccaccggaatcccttgccagtccaacgactatgtccaggaactgcttcgtgcagtgcggctgcatttcgatcaattcattgagcaactcaagccatctgacctggagaaggcccagctaggtctgggacatagctatagcagggccaaggtgaagttcaatgtgaatcgtgtggataatatggtgattcaagctatctttctgttggatacacttgataaggatgtcaattccttctctatgagagtgagggagtggtatggatggcattttcctgagctggtcaagattgtgaatgacaattacctctatgctaagcttgccaagtttgtggtaaacaaatctgacttgtcggagaaggacattccagctttagcggatctaattggagatgaagacaaggcaaaagaaattgttgaggcagcaaaggcatctatgggccaggatcttttcacctggtgattg

SEQ ID NO: 5569 - DNA, 976 bp, Zea mays
  misc_feature (886)..(886): n is a, c, g, or t
  misc_feature (941)..(941): n is a, c, g, or t
aatgaccaaggcttcgagcgtgtgctgtgcctatacgtgagcttcagtgccgagtgagccatagtagcctagcctagctgactcccgcgatgagctggtggtgggcgggcgcggtgggcgccgtcaagaagagccaggaggagcgcaccgagctctccttccagagcgtcgccctcgtcatcggatccaccggcatcgtcggcacatcgctcgtcgacatactcccgcgcgacgacacccccggcgggccctggaaggtgtacgccgtctcccgtcgcccgctccctccctggtccccgcagccctcccccgccgtcacgcatctgctcctggacctggccgaccctgtcgccgtggcggaggccctcaagccgctcaccgacatcacccatgtcttctacgctgcgtggtccagccacccgacggaggctcagaaccgggaggccaactccgccatgctccggaacgtgctctccgtcctcgtcccgggctgccccgcgctcgcccacgtctgcctccagaccggccgcaagcactacatcggcccgtacgaggccatcggcaagatccccgtcccagacccgccctacaccgaggatatgccccgcctcgattaccccaacttctactacgaccaggaggacgtcctctttgaggaggtctcccgccgcgacggcgccgtcagctggtctgtgcaccgtccctccgtggtctttgggttctctccccggagcgccatgaatgtcgtggccagcctatccgtctatgccgccatctgccgcaaggagggcgccatgctgaggtggcctgggagcagggttgcatgggagggcttcagcgacgcctccgacgcggatcttgtcgccgagcaggagatctgggcagncgtcgatccgttggcaaggacgaggctttcaattgtagcaatggagaattatacnagtggaagcagctctggccgatggtggctgaccga

SEQ ID NO: 5570 - DNA, 643 bp, Zea mays
gatatattcccttcttcttcttcttcttgtcctcctccttcgtcttctccatcttcccgtccttcgatccatcaaaagctggccggccgagacgacgtgcatagctataaataatagcccatagcatcctcaacaaccagacaagaagaaccacgccgccggttgtttgttaatttcttccatggagagcacggagctgaaagtggagatggtggcgttgcatgagaagcgggtacgcagatgcctgtccaaagtgaaagggatcgagcgggtggaggtggaggcgagcctgcagaaggtggtggtgacggggtgcgtgaaccggagcaagatcctcaaggcgctccgccgggtggggctgcgcgccgagccgtggtcaccgcacaacgagctgctcagcgcctacgccgccaccaccaccctcgtcttcaacaactcctacgccttcttctgatcaagtcatctcatcctttatagctagatagctactgtaatctctctctctgcgtgcttggcttgcttggagtttgttgggaacgtgaacgacggacggcgttccacatgtacacaacatgaatggcattttaatctctctctcccttctttcttcttgaaaaaaaaaaaaaaaaaggcccctagggcc

SEQ ID NO: 5571 - DNA, 868 bp, Zea mays
aacttctagtgtctccccctctttcccttctcgcagcagcagatcactagctcactccatggtggagagagtggttggtggccactaatggcgcgcctctcccgtcgccgcttcctcctctcgctccacgtcgcgctgctgctgctagtcccctgctcctgccaggtcggggattcgtgctcggcggcccgcgactgcggggtgggcctctactgcggcgattgcgccgccgccggcaggacgcggccgtcctgcatcagggacctggccatccagcccacctccatcgtgaaggggctgccctttaacagatactcatggctggtgacccataattcattctccatcgtcggcgagccgtcacgcaccggggttgagagggttacgttttacaaccaggaggacactgtcaccaaccaactgaggaatggagtgaggggattgatgctggatatgtatgacttcggcggtgatgtctggctctgccactccttgcaagggcaatgctacaacttcaccgctttcgaaccagcaattgacacactgaaagaggtggaagcatttctgtctgagaatcccacagagattgttacaatattcatcgaggattacgtacatgccccgatgagattgagcaaactgtttactgctgctgacttgatgaagtattggtaccctatctcagaaatgccaacgagcgggcaggagtggcccaccgtcacagatatggtcgcaaagaaccacaggttgcttgtgtttacttccgatgcttcaaaggagtctagcgaaggaatagcttaccagtggagttatttgctggagaatgagtctggagatccgggtattgaccctagcacttgtccaaaca

SEQ ID NO: 5572 - DNA, 728 bp, Zea mays
aaaaaaaacaaaatagatcagacacaatgcattgcaaacggcattatttatcacagttgagtttttgcgcttaatacatgcactggaagcactgacaagttgcattctagcacacagaaatccaaacttaaaacgagcgatagacgaacacaagatgaacgctagagaacagtcacattcagaagcttccacttccaagcgcagcaccatatttttatgtagccaaccagcaaccatgaacgttgcccaaagcgcataatcgacagaaaactaacggttgttgttgccatctagcattgaagacttcaggaaatgctcatcttcaggaaacatctgcaggttctttgacttgagcaagaacccaacagcggcgtcctggaaatccagcaagctgccgaacttgataagctcagcgagggaagggatctggtcctccatctcaaagagcaggccctgagagatctcctctgcgaagtatgtcgcgaactcgatcttctctttgtagctgggctcgccgtcgccactctgcacgtacagcttagaatcctccctctcccacctgaccattcggctggacttcacatccacaacctctccggatgacagccttacactataccccagtgtgattggctcgtcactctcttggacagtcacattcagaaggcaggaaaccatccggtgcctctcttagaaaaacaatgtcgagagcggggtcagcgaggaat

SEQ ID NO: 5573 - DNA, 1001 bp, Zea mays
  misc_feature (854)..(854): n is a, c, g, or t
cgggccgggattccggcagatgaaaccctaggacccgatggtctagccaccattcccagacacagcccgcccgccgccgccgccatgccgccgttccggcgctgggcggatctgccggcggacctcctctgccgcatcggcgacagcctcgacctcaagtgctacgccagcgcgcggggcgcctgcacggcctggcgatgcgcgctctcgccgccgtccccgtcgctcctcgtcgtcctcgacgacgccaggtgctgcccgtccgccgcgtcgctccccacccaccgctccttcgagctcaagaacatcctctcggggggccgatgcgtcggctccagcaacggctggctcgccctctccgtctgcctctacggcggccagagcatgttcagcctcttcaaccccatcaccgccacggagatccttctgccgccgctgatctacgagagccgctgggtctccaagctcgtcttcgcgcccaaccccgccagggacgacttcgccgccgccgccatctgcgacatcgacaggctcgcctacgtcaccgcgggggccaggaggtgggccatcctcgatcccgttcgcctctccagcggagatcagctcgccgatgtcgtctaccatgaaaaaggtagggtctactgcctcacccgctatggagatgtccacgtgctccgcctgccggagcgccgccgcaggaagcctatcgtcgtcgaggatccggctggcccatcagagccagagatgcctttagggcgtcccgcactcagtcttcagggaagaagacagcgcaacttgcgcatgctctgctatgaacatcgtagatggagagagcagcagcttccaattgctancatgaaggctgccttctgcccagatgtgtttatgcctcttaggagagttcctcctggatctgtcggaccggatctaaatgcaccggccacagtcgagcccatgttggctgagtgcaacctaccgttcgaccctgctacctgttttgc

SEQ ID NO: 5574 - DNA, 695 bp, Zea mays
aactcgatcgaaccactcattccttcctaccacccccggcgccaccagcccaagcagagccatggcgcccagcggagacaacaccgtggccaacgtccacagcggcatcgacagcaccaacaagacgctgctcaagagcgacgccctctacacctacatcctcgacaccaccgtcttcccccgcgagcacgagtgcatgcgcgacctgcgcctcatcaccgacaagcacccatggggctacatgcagtcgtcctcggacgaggcgcagctgctggggatgctgatcaagatggcgggcgccaagaagacgatcgaggtgggcgtgttcacgggctactcgctgctggccaccgcgctggcgctcccggaggacggcaaggtggtggccatcgacaccgaccgcgagtgctacgaggtgggccgccccttcatcgagaaggccggcatggcgcacaaggtggacttccgcgagggcaccggcctggcgcgcctggacgagctcctcgtcgaggacgacggcgcggccagctacgacttcgcgttcgtggacgcggacaagcccaactacgtgcgctaccacgagcagctgctgaagctggtccgcgtcggcggcaccatcatctacgacaacacgctgtggggcggcacggtggcgctgccggcgggcacgcccatgtccgacctcgacacccgct

SEQ ID NO: 5575 - DNA, 1662 bp, Zea mays
caggcctgcctaaccctaatcatgtaccaaaaccgacggtacggtgcatggggcaaggcaagcaaaggtctgcatgccttgctgtctcagtgtcagccgatcgattagaaatgttgatatatattttttgggggggaccgagatggagatattaattagaggataagcaccataatacatctccactgtgcctcgtggatctcattgcctactgtttgctcagtactcctatactagccgacgactatcgacagggccatatggatctgctcaatccagtacagtgatcatatgaacaagaaacaaccacgtcatccatgaatgcattatattgcatcgcattgttagctcaaaacatagatgcatgcatgtaatcgatctgtcgatccatgcatcgatcgagagcacgagaccattacctagaacatcctaatcgaaaaatagaactagagccagctccttgttgcccatggccatgacgagagcactggccatggtggccatgttggccactgctgccttgttcttcatgtccgctcgcgcacagcagtgcggtatgcaggccggcggcgcgctctgccccgactgcctctgctgcagccagtggggctattgcggctccactcccgactactgtaccggcggctgccagagccagtgcatcggcagcggctgcggcggcggcggcggtggtacccctgctactcccccgagcggcccggtgtctgaaatcatctccgagtccctgttcaacgagatgctgctgcaccgcaacgacgtggcgtgcccggccaccggcttctacacctacgacgcgttcatcgcggccgcgaacgcgttcccgggcttcggcaccacgggcggcgccgacacgcagaagcgcgagctggcggcgttcctggcgcagacgtcgcacgagaccacgggcgggtgggacacggcgcccgacgggccctacacctgggcctactgcttcaaggaggaggtcggcggcgtgtgggggccggactactgccagcccagcccccagtggccgtgcgccgacggccagaagtactacggccgcgggcccatccagctatcctggaactacaactacgggcccgccggggaggccatcggccaggaccttctgggcaacccaggtctggttgccgccgactccactgtctccttcgagacggcgctctggtactggatgacggccgcagccgcccaagccgtcctgccacgacgtcatcacgggccagtgggcgccctcgcccgacgacgtggccgcagggaggctgccggggtatggcgtcctcaccaacatcatcaacggcggcctcgagtgcggccacggcgccgacgctcgtgttgccagccggatcggcttctacaaacgctactgcgacatgtttggtctcagctacggcgacaacttggactgctacgaccagagccccttcggaaacacaatcttaagcaccaccaataataccacctcatatcacgttgacgcctaataagtaacaagagctacctgttactacaactgcaagacacagacatcgtgtagtgcacatgtgcgtcaaatctctaaactttgtacacccagaataaaactctgtaatctgaaactttgcacacccagaataaaagttttcgatttcaaactcc

SEQ ID NO: 5576 - DNA, 956 bp, Zea mays
  misc_feature (686)..(686): n is a, c, g, or t
  misc_feature (727)..(727): n is a, c, g, or t
ggtccggaatcccccgggcagtactcctatactagccgacgactatcgacagggccatatagatctgctcaatccagtacagtgatcatatgaacaagaaacaaccacgtcatccatgaatgcattatattgcatcgcattgttagctcaaaacatagatgcatgcatgtaatcgatctgtcgatccatgcatcgatcgagatgtatatatatcctggttctagatcccatagagatcatagaactagagccagctccttgttgcccatggccatgacgagagcactggccatggtggccatgttggccactgctgccttgttcttcatgtccgctcgcgcacagcagtgcggtatgcaggccggcggcgcgctctgccccgactgcctctgctgcagccagtggggctattgcggctccactcccgactactgtaccggcggctgccagagccagtgcatcggcagcggctgcggcggcggcggcggtggtacccctgctactcccccgagcggcccggtgtctgaaatcatctccgagtccctgttcaacgagatgctgctgcaccgcaacgacgtggcgtgcccggccaccggcttctacacctacgacgcgttcatcgcggccgcgaacgcgttcccgggcttcggcaccacgggcggcgccgacacgcagaagcgcgagcntggcggcgttccttggcgcagacgtcgcacgagaccacggngcgggtgggacacggcgcccgacgggccctacacctgggcctactgcttcaaaggaggaggtcggcggcttgtgggggccggactactgccagccaagcccccattggccgtgcgccgacggccaaaattctacggccgggggcccttccagttttcctggaactacaactacgggcccgccgggaaggccatcggccagaaccttttgggcaacccaggtttggttgc

SEQ ID NO: 5577 - DNA, 848 bp, Zea mays
aggttctcctgcctctgcctggttcgccaccaccgccgccaccaaccccctcatcctcttcctccgctctcggcagctgccgctcatctcggtgggaggccctcaggcgggcaggttcccctagatccccggagtcactcaatcaaatggctgacggtgaggacatccagccccttgtctgcgacaatggaactggcatggtcaaggctggttttgcaggggatgatgcacccagggccgtcttcccaagtatcgttgggcgcccccgccacactggtgtgatggtggggatggggcagaaagatgcatatgttggtgacgaggcccaatccaagaggggtatcctcaccttgaagtacccgatcgagcatggtatcgtcagcaactgggacgacatggagaagatctggcatcacactttctacaacgagctccgtgttgcacctgaggagcacccagtacttctgactgaggcacccctgaaccccaaggctaacagggagaagatgacacaaatcatgtttgagaccttcaatgttccagccatgtatgtggccatccaggctgtgctttccctatatgccagtggacgcacaacaggtatcgtgttggattctggtgatggtgtcagccatactgtgccaatctatgaaggatatgcccttccacatgccatccttcgtcttgacctcgctgggcgcgacctaactgactgtttgatgaagattcttacggagagaggttactccttcacaccaccgccgaacgggaaattgtagggacatcaaggagaagctcgcatatgtggctcttgactatgaacaagagctggaaatggccaagagcag

SEQ ID NO: 5578 - DNA, 850 bp, Zea mays
aaaccctctctccctgcgcctctggctcgagccgtctacgatttcctctcttcgccttcctcccccgccggcccctccaaaccctaggcgccgccggccaggaagcccatttaccagccatgtttggacgcatgccaaggaagaccagcaacaacaccaagtactacgaggtgcttggtgtatccaagacagcaaccccggatgagttgaagaaagcttaccggaaagctgctataaaaaaccatcctgataagggcggagaccctgagaagtttaaagaattggcacaagcttatgatgttctcaatgaccctgaaaagagggagatttatgaccaatatggagaagatgcaatcaaagaagggatgggaggcagcggcggcgctgatatgcatagcccctttgacatattcgaacagctatttgggggtggcggcggcggctttggaggtggtagctcgagaggacgcagacaaaagcgtggtgaagatgtggtgcataccatgaaggtttcgttagaagacttgtacaatggtgctaccaagaagctatctttatcacggaatgttctttgtggaaaatgcaagggaaagggatccaagagcggggcaacggctacttgcagtggttgtcgtggtgcaggaatgaggatgataacaagacagattggacctggcatgatccaacagatgaatactgtttgccctgaatgcagaggatcaggcgagatgataaatgacaaggatagatgcccaagctgcagagggaacaaagtatcccaggagaagaaggtcttggaggtccatgtgggagaagggaatgcaacatggccaaaagattgtattccagg

SEQ ID NO: 5579 - DNA, 1195 bp, Zea mays
cgctcgagggccggcgggccgggctctcgccccccagaagccccgacgctcaagcccccagacgccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcagacactcattgaggctcatgtggatgtgaagaccactgacaactacatgctccgcatgttcgccattggcttcaccaagagacgcccaaaccaggtgaagcgcacttgctatgcccaagcaagtcagatcagacagatccgccgcaagatggttgagatcatggtcaaccaagctgcaagctgtgacttgaaggagcttgtgaacaagttcatccctgaggtgattggaaaggagattgagaaggccacctcaagcatcttccccctccagaacgtgtacgtccgcaaggtgaagatcctgaaggcccccaagtttgacctggggaagctcatggaggtgcacggtgactacaaggaggatgttggtgtgaagcttgacaggcctgctgatggagatgaggtgattcctggagcggaggaggttgctgctgctgagtagaggatagaagtcgctattttgctggttcatatctagaagaagatatatgtgccaccctgcgtgtccgggaattttgtaatcaggttttgatggctgattttcttgaggactttctgtcgaaatttccttaaccagtggttcccttatcttatttttggttcgggttatttttctggaagggaggtttatgaattgaaaaacttaattttttaagttttttcccgggcccgtggttttttatgttttgaattaaaaacttggcccttttgtctatggtaaaaaaaaaaaaaaaaaaaaagggccct

SEQ ID NO: 5580 - DNA, 740 bp, Zea mays
cggccgctcgagccggcccccccaagcccaagccataccggcagccacctccgtcgtcgtcggtactgacgcggcacgagccggcgaatccgacaggccccctacctctcgctcgccgcgagatcccgcgtccatggcggtcggcatcgcgctcctgctcgaccttgcggcccgcgcgccccgctcctccgcctcgctccactcgcacgccgccttctccgccgccgccgccgccgccgccgcggcagccctgtccgcctccggcgtacccctctccgcgcggccattcttcggttttccaggattcactgttgctcattgtgatgctggtgcaacttatggatcgattgatagtcctgatcttgccaatgatcttaatgagaagatacatgactcgattcatgatctccaattaccgataaaagaatacccgttggagctgaagccgcttttgtatgcatttggctttaagcatttgagtatgacgactattagggcctttttattatactatttaccacttctggagcctcgtccgcccactgatgacgatgacgatgacgatctgcttcaagatgattcagagaggccgccggtcgacctggttactccctttcataattcattgaagcaaatcgctcgcgagatttctgttgtaacaacaagaagagcattcgaaaggattgcggttcgtcgtgtttcacaaagaacagcatggaagcttctcaaagatgctgcaa

SEQ ID NO: 5581 - DNA, 5078 bp, Zea mays
gtggcaatacctatcatcaaaaccattcactaaaacctctcaaggggttatttgctcaattttgtaaaattgagcgggttaacagttggttttgaagggtgaagtaaactaccctctaaaaatgaggaggttatatagactttgattgcagcatgtaataataataaatatatatctatatcaaatattatatgttcatctatttttccgtccataacttcctaagtataattctagtgatacatgattcagactcatgactcattctcatacgagttagacctcatatacaactagatgaatacaaagtccggtattaatacaaattggattgtgattaagtatcaggcatgtgaaccacactcatgatcatgacttattatcatacgagttagaacgtatcacatctaacgtagcgatgatatgaagtactacaagtaatgggtttcgttgcaagacaaatatgtgtgctagttagagataaaaagtcctgttctgtaggtatcttaggtttatgacaaattgctaggctacaactaaatgaagatgctgcggttgattatatacttggggttgatgattattgtagaataaagtgaatattgttttgttatgcgaggatgtatatttgggtatattgttatagctgtttaggatcagataaggtttaatattaatatagcgattttttagttttaaaaatagttttatagttgatttatgctactaaggcacatctaaaaataaaaatcaaaattctagagacgatagatttacacaaaccgtcaattcgacagaaccattaaggtttgtttgaaaacaagtgtaacagagaggattgagagggttataatctctaattattgaggggtagaatccccttcaatttcctccgttacactcaaacaagcactcagtctaaaattctcaattttcactcgcctttcgtaccgacaaaaactaaaaacacagtgaatatatgtttaatactggcgttatggagctttcattaaactagtgtcatcagtcagcatcagcatcatgttcagccaggactcatgatgggagacaagggaggcgagcagtgcctgccccccctgcattgtagccttaaaacgagtatatagctccacccctggatatgttagatacatacaccacgtttttgagaaatcggagcagagatacacaataatggaggcggcaggtggagggcagcacgaaacacgacgacgtgcaggcctcgccctcctgggcgtcgtctactcatcgctgctcctgaacgccatcttcgtcgcgcaccacttcctctcgccgtcccggctgctgctccgtgacgacgggtgcgggtgcgggctcacctggtctctgcaggcggccagggaggccgaggcggtggccgccgtggagtgctcgggccacgggcaggtgttcgtcgatggcgtcgccggcgaggacgggcggcccgggtgcgagtgcaacagctgcttcggcgggccggactgctcccttcgcacgcccaactgcaccgccgacgccgacaggcatacgcgcttctccttgccttgcttgcttgtttcagctggggcactcgataagtctctcccggtccacgatggacgcataattatttttccttttctgagtattattaggttgaagcaaattctactttaggttttgtttagatactttacttcagttcacagatattgaggtggatttatgtggaatttaagccaaacatagttgttgtttggttccattccatcacggcaaccttgacacaaatggagcgtcaacggggtcgggaagcagatttttctctcttcttttatcaggatggttcttattaataaggattagtttggagaaaaatatcagaaaggattagaggattaaaatctttttttatttaaaattaaataagaataagattttagcttctttaacccctccgattttgtggcttttaaaccagctctaatagtaagttttcgtggtaaagtaataaacgattgaaatcgaatgagatagagaaggaaacgattaattcggttgctgatttgcttataattctacgcatagcagcaaaggaatctttgcacgtcgcaatttccgggcaccactttacaatcctgttttccgccgattaaaaaagtctgccacctgcaagcttgctccggctaaatagatgcaaacagtttccgctattaaatagtaccagtgctaacagtggtactgtgctgaccatattgtgttgtttgtggcaccagcgggaacccgttgttcctggagccgtactggcggcgtcacgcggcggccagcgccgtggtgttctccgggtggcaccgcatgagctacaccaccacgggcgggttccagtcggtggagctggagcgccagatccggcgcctgcacggggccgtcggtaacgccgtcgcggacgacaagcacctggtcttcgccagcggctccctgcagctcatcaacgcgctggtgcacgcgctgtcgccggacgccacggccgcctcgccaccgtccagagtggtcgcggccgcgccgtactacccggtcggtgttcagccttttgaatcatccatcacactgcatcatcatcaacgggctaaactaaaacttcaagtctgacaagtcattttctgctgctgaatgaatcccatacggatgtgtacatgtgccgtggtgcaggcgtacagacagcaaacctccatgttcgacggccgcgagtacagatgggccggaaccacggccttgtgggccaactcgtcacgggcgaactccaccgacggcaccttcatcgagttcgtcacgtcgcctaacaacccagacgccctgctccgcgagcccgtcctccgcggctcggcggcggcgatcgtcgaccacgcgtactactggccgcacttcacgcacatcccggcgccggccgacgaggacatcatgatgttcaccgtctccaagccatccggacatgctggaagcagattcgggtatgtctgcatatacgaatccatgggcaggccgagtgacattcacctgaccctgacctacctcatgcttgccgcattgcattgcgcaccggccgcagatgggcgctgatcagggacgacgaggtggccaagcgggctttagagtacctgagggacagcaacatgggcgcgtcgcgggacacccagctgcggatgctggggatcttcaagttcatgctggccaacctgcgcggcaaggacgacatcttcgccttcggccacgacgtgatgaggagcaggtggctcaggctgagcgccgccgtgtcgcggacccgccgcatcacgctgcagaagatcgcgccccagtactgcacgtacttcggccgggtcagagagccatccccaggtgagtgagcttatttgggagacaggaacggagctcgatcgaaatcgcacgtctgatgacggcactaacagctagccggtgactgtctgtgaacagcctacgcatgggtcaagtgcgagatggaggaagacgaagcctgctacgaggcgctgctgaaggcgaacatcatcacgcgcagcggcgtccagtatgaggcgagcagcaggtacacgaggatcagcctcctcaagtcggacgacgacttcgacgtgctcatggagaggcttgaagatcttgtcgatgccgacaagtacgacgattccaacggttcgagctcaatgtagcaacggtaatccacggaagttcggaagcttggggcggtttagatccacctctctaaattttaagaacactctagctcacattgtatgaggtgggctaaattaaaatgcatatgatcagctaggcgctgattgttctgcgaatgtagtggaacagtcaactagaagttgactgtgttcccacaataaaactacctatattggattggcgcaaattatgcggtcagtatatcattccatatttatagtacaacttacagtttgttggattatttggttcatgttattacaattattctatctttttaggccagttttaatgaatagttttcgtaacacagttactaactccaaaagagagtcttaaactaggtccaagtccaacacattagcttttgttatgataactataacaatgagatttatctagatgaaattttctgtatttctcttcataactgacgtgccaatgccggctcgacaagtttgttgatgtgtcactcctttgaaaatctcattgagattgtccttactattcatctatttgaaaccatgccattgtaatttgtgttctatctgaagcctgccactatttttccaccagcttagcttaggcagggccgtgccggaagaaaacaaggtcatgtacaaagctattgaataaaaaactcttcttactaaatcattgaaaaactctgtccatctatagtatcgttgacaacatcattattagatgtagcctcaatattattatctatttgcatcgaaccatctataggctcattatcaacattattatcaagtgtagggctttaattaagtgaatgattattaggcgacacttgtgattcttttataataaatttatccatagcttccttctgagactgagttaaatcatctattctttgttttttcttacgttttcctaaccagatttatattttctagatcgattggtcgaagacatgatgttcgatagttgaatcttgaaatactagacatctagtaaattaataaacatacacataaaaatgaaaagaacaattaaactattgtaattattaaaaaacacattaagttttgtgctttctttcttgaagcttgggtgatcgtcacgtggtggtggcagtctagtacaggcagcctcaggacgcaaggattgagttcttcagcagtagagcatgcaactagcagtagcagcaatgccgtccaaaccatgccaccgtgaatccgtgattaggtatagggccagggcgttggacggatggcgcagaggctgatgaaacgtccgaactcgcgagtgatagcagaagtcaaaagatgaagattatgattatctatgacctgatttttatatatatg

SEQ ID NO: 5582 - DNA, 1830 bp, Zea mays
atatacaccacgtttttgagaaatcggagcagagatacacaataatggaggcggcaggtggagggcagcacgaaacacgacgacgtgcaggcctcgccctcctgggcgtcgtctactcatcgctgctcctgaacgccatcttcgtcgcgcaccacttcctctcgccgtcccggctgctgctccgtgacgacgggtgcgggtgcgggctcacctggtctctgcaggcggccagggaggccgaggcggtggccgccgtggagtgctcgggccacgggcaggtgttcgtcgatggcgtcgccggcgaggacgggcggcccgggtgcgagtgcaacagctgcttcggcgggccggactgctcccttcgcacgcccaactgcaccgccgacgccgacagcgggaacccgttgttcctggagccgtactggcggcgtcacgcggcggccagcgccgtggtgttctccgggtggcaccgcatgagctacaccaccacgggcgggttccagtcggtggagctggagcgccagatccggcgcctgcacggggccgtcggtaacgccgtcgcggacgacaagcacctggtcttcgccagcggctccctgcagctcatcaacgcgctggtgcacgcgctgtcgccggacgccacggccgcctcgccaccgtccagagtggtcgcggccgcgccgtactacccggcgtacagacagcaaacctccatgttcgacggccgcgagtacagatgggccggaaccacggccttgtgggccaactcgtcacgggcgaactccaccgacggcaccttcatcgagttcgtcacgtcgcctaacaacccagacgccctgctccgcgagcccgtcctccgcggctcggcggcggcgatcgtcgaccacgcgtactactggccgcacttcacgcacatcccggcgccggccgacgaggacatcatgatgttcaccgtctccaagccatccggacatgctggaagcagattcggatgggcgctgatcagggacgacgaggtggccaagcgggctttagagtacctgagggacagcaacatgggcgcgtcgcgggacacccagctgcggatgctggggatcttcaagttcatgctggccaacctgcgcggcaaggacgacatcttcgccttcggccacgacgtgatgaggagcaggtggctcaggctgagcgccgccgtgtcgcggacccgccgcatcacgctgcagaagatcgcgccccagtactgcacgtacttcggccgggtcagagagccatccccagcctacgcatgggtcaagtgcgagatggaggaagacgaagactgctacgaggcgctgctgaaggcgaacatcatcacgcgcagcggcgtccagtatgaggcgagcagcaggtacacgaggatcagcctcctcaagtcggacgacgacttcgacgtgctcatggagaggcttgaagatcttgtcgatgccgacaagtacgacgattccaacggttcgagctcaatgtagcaacggtaatccacggaagttcggaagcttggggcggtttagatccacctctctaaattttaagaacactctagctcacattgtatgaggtgggctaaattaaaatgcatatgatcagctaggcgctgattgttctgcgaatgtagtggaacagtcaactagaagttgactgtgttcccacaataaaactacctatattggattggcgcaaattatgcggtcagtatatcattccatatttatagtacaacttacagtttgttggattatttggttcatgttattacaattattctatctttttaggccaaaaaaaaaaaaaaaa

SEQ ID NO: 5583 - DNA, 1016 bp, Zea mays
atttctaagccattgcgtgtgtgtctgtgcaactgtgctgcatccaagctaagaccaagatcatcgtcattcgtcagagccttcctaccggcaaccaactccaacgaaagccgcctcaccaactcccagcggttgcgattggcagctgctgcaatggcttccggtggcgcgtcgtcactggccttggccttggccgcgctgctcctcgtgagctgcgcctcggcggcggtggcgaccaagtacaccgtcggggacgcgtccggctggacgaccaccggcgactacgccacctgggccagcggcaagaagttcaaagtcggcgacagtctcgagttcaaatacgccggcggggcgcacacggtggacgaggtgagcgcggcggactacgccgcctgctcctccagcaacgcgctcagcaccgacagcgccggcgccacgaccgtgaccctcaagacggccggcaagcactacttcatctgcggcgtggcgggccattgcagcagcggcatgaagctcgcggtggacgtggccaaggcggtgaccgccccggcgccggccccagccgcggccccggccccggccgcggacacagccccagatgcccccgacaccacgccgtcgaccccgacgtccccctcgagctccggcggccgcacgcccaagagcccagacacgacggtcctctcgccgccggacaagaagtccacctcctccggcgccaccgggctcagcgccgcggcgtgggccggcttgggccttgccgggctcgtggccgtgcacctcggcgcgttctaggccagcccgctggcctggccagggaggagacagtgccgtgtgctgttgttaggctgcacgtcatggattggattggtgtattggttgagggacttgactgcttaccagagagagatctcttttggttcagggaactgtgctgtagacctgtagttggataccttggatgttatgctatcagttttgctgttgttatcacatctctttcgtgattttctttt

SEQ ID NO: 5584 - DNA, 1012 bp, Zea mays
ataaaggggcattggcttgggatcacctctgcatcttacctgggatctgctagcttgatctctcctagtcctagcccattcgcttctcctgttcgtcgctcttaatttgcttgctcgatccctggcagtggcagctgctgcaatggcttccggtggcgcgtcgtcactggccttggcctggcgcgctgctcctcgtgagctgcgcctcggcggcggtggcgaccaagtacaccgtcggggacgcgtccggctggacgaccaccggcgactacgccacctgggccagcggcaagaagttcaaagtcggcgacagtctcgagttcaaatacgccggcggggcgcacacggtggacgaggtgagcgcggcggactacgccgcctgctcctccagcaacgcgctcagcaccgacagcgccggcgccacgaccgtgaccctcaagacggccggcaagcactacttcatctgcggcgtggcgggccattgcagcagcggcatgaagctcgtggtggacgtggccaaggcggtgaccgccccggcgccggccccagccgcggccccggccccggccgcggacaccgccccagacgcccccgacaccacgccgtcgaccccgacgtccccctcgagctccggcggccgcacgcccaagagcccagacacgacggtcctctcgccgccggacaagaagtccacctcctctggcgccaccgggctcagcgccgcagtgtgggccggcttgggccttgccgggctcgtggccgtgcacctcggcgcgttctaggccagcccgctggcctggccagggaggagacagtgccgtgtgttgttgttaggctgcacgtcatgaattggattggtgtattggttgagggacttgactgcttaccagagagagatctctttttggttcagggaacttattgacgatgctttggctgtgctgtagacatgtagttggataccttggatgttatgctatcagttttgctgttgctaaaaaaaaaaaaaaaa

SEQ ID NO: 5585 - DNA, 951 bp, Zea mays
attgctagatcgtccctccatccaccactttgctggctccgtctatacaatagcaacacatcagccccccccgcccggcatctccccttcgcatccgtcgacccagatctcacaggccgcccaagccagccagcgacgatgaggccctcggtgatgagatccgccgcccagctcctccgccgccgcaactactcctccgcgtccgggcagcaggcgcggaaggtggccatcctcggcgcggccggcggcatcgggcagccgctgtctctcctcatgaagctgaaccccctcgtctcctccctctccctctacgatatcgcggccaccccgggcgtcgctgccgacgtttcccacatcaactcccctgccctggtcaagggcttcatggcggacgatcagctcgcggaggcgttggatggggccgacctcgtgatcatcccggccggcgtcccgaggaagcccggcatgaccagggacgacctcttcaacattaacgccggcatcgttaagaacctctgcaccgccatcgccaagtactgcccgaatgctcttgtcaacatgatcagcaaccctgtgaattcaaccgttccgattgctgctgaagttttcaagaaggctggaacctatgatgagaagagattgtttggtgtgaccactcttgatgttgttcgtgccaggactttctatgctgggaaggctaatgtagatgttaatactgtggacgttcctgttgttggtggtcatgctggtattaccatcttgccactgttctcacaggcaactccttcaactaatgcattgtctgctgaagaaatcaaggctctcaccaagaggacacaggagggtggcacagaagtcgttgaggcaaaggctggaaagggatctgcaaccttgtccatggcgtatgctggtgcagttttttggagatgcatgcttgaaagggtctgaacg

SEQ ID NO: 5586 - DNA, 892 bp, Zea mays
  misc_feature (576)..(576): n is a, c, g, or t
  misc_feature (580)..(580): n is a, c, g, or t
  misc_feature (582)..(582): n is a, c, g, or t
  misc_feature (605)..(605): n is a, c, g, or t
  misc_feature (608)..(609): n is a, c, g, or t
  misc_feature (644)..(644): n is a, c, g, or t
  misc_feature (666)..(666): n is a, c, g, or t
  misc_feature (671)..(671): n is a, c, g, or t
  misc_feature (735)..(735): n is a, c, g, or t
  misc_feature (745)..(745): n is a, c, g, or t
  misc_feature (749)..(749): n is a, c, g, or t
  misc_feature (751)..(751): n is a, c, g, or t
  misc_feature (783)..(783): n is a, c, g, or t
  misc_feature (827)..(827): n is a, c, g, or t
  misc_feature (833)..(833): n is a, c, g, or t
  misc_feature (844)..(844): n is a, c, g, or t
  misc_feature (846)..(846): n is a, c, g, or t
  misc_feature (850)..(850): n is a, c, g, or t
ggcttccttggttccttccctccctctcctttgatcctttccggcctggcctccgcctttcccccagcccaaagcgcagcacgaagcaacccttcccttccattccttggccacgtaacccaattacccaacgcatcgaggagcgcacgaaggcaaccgccttcccatcccaccgggcatcggcccatctgatccgatcaggctagatcctgccggtgccggtcttcgcgccgcctatggccgaaggcgacgccgcctccgcccccgccgccgcggcggcggcggcgtccccgcggtcgcccatgccgcaggagacgccggcgatgcagaagcggaggcagcgggggctcgtgtcgcgggtgtggaagggcatcttcggcggccgcgaggacgtcgagaagctgctgcaggcgctgtccaaggaggaggaggccgtgcgggcgcgccttcgccgccgggcccgcgcctcccgccagtccgcgcacaacgtcctcgccctcgccgccgcgctcgaggtgatccgactcgcgccggctggattatctatccgatcatacatagcaaacaccgcacgtntctncncacttcgctgctgtatttctgcnccnncaccgtagaggatgggaattcctttctcgtagggngctgaatccggttccaacagtngaatnaggaacatgatgagcaacctgccaggccatcgtgttacggtagtcagcaatagccgttgttatnattgggcatntatngncgcctcgcatcacacgcgatgcttttcgtaanttcagcgagtagagttagtactgttgctgaatggaatcgcattnggatcngctcatgagtncncctncagatctaggccctttgagcaggagaaaattgttttttgaga

SEQ ID NO: 5587 - DNA, 993 bp, Zea mays
ccgcccgcgccagcccgcgggccggggccacatccatccaaaccaaagccaagcccatcgccactccaatccagcgaccgcctcgcccagatcgccgccgattcgatccggttcctcgacgggatggcgaccaagaggagcgtgggcaccctcggggaggcggatctcaaggggaagaaggtgttcgtgcgcgccgacctcaacgtgccgctcgacgacgcccagaagatcaccgacgacacccgcatccgcgcatccatccccaccatcaagtacctcctcgagaagggcgccaaggtcatcctggccagccatctgggccgcccaaaaggtgtcacccccaagttcagcttgaagcctcttgttccacgcttgtctgagctccttggacttgaagttgtgatggcccctgactgcatcggtgaagaagttgagaaattggctgctgctttgccagatggtggtgttctactcctagagaatgttagattctacaaggaggaagagaagaacgatcctgagtttgctaagaagcttgcatcagttgctgacctttatgtaaatgatgctttcggcactgcacatagggctcatgcttcaaccgagggtgtaaccaagtttttgatgccttctgttgctggcttcctcatgcagaaggaacttgactatcttgtcggagctgttgccaacccaaagaagccatttgctgccattgttggtggatccaaggtctcatctaagattggtgtgatcgagtctctgctggccaaggttgatatcctcatccttggtggtggtatgatcttcacattctacaaggcccagggattagctgttggaaagtctctttgtggaggaagacaaacttgaactggcaacttcactgatcgaaacggcaaagtccaagggtgttaagctcttgctcccgacggatgtcgtttgtggctgacaagtttgcagcagatgccgaaagcaagattgtccctgcactgt

SEQ ID NO: 5588 - DNA, 768 bp, Zea mays
  misc_feature (739)..(739): n is a, c, g, or t
  misc_feature (747)..(747): n is a, c, g, or t
cctgtgaaatggaggaagactatgttgagccgaacccatttccatttcattttgcgaatcaccctcggcgagacccggacccggaccggagcaccatccgtctccggcatcttaacccgccgtccgtgccccgtcgcccaccgctcatccccgccgcgatggggagcgtagacctggtgctgaagccggcgtgcgagggctgcggctccacgtcggacctctacggcactgggtgcaagcacaccacgctctgtagctcctgcggcaagtccatggcgctttcccgcgcccgatgcctcgtctgctctgcgcccatcacgaacctcatccgggaatacaatgtgcgggcaaatgccagcacagataaggcattctctattggaagatttgtaactggtttgccgccattctcaaagaaaaagaatgctgagaacaaatggtctcttcataaagaaggcctgcaaggacggcagcttactgacaaaatgctggagaaatacaacaggaagccatggattttggaagatgaaactggtcaatatcagtttcaaggtcacatggagggatcacagtcagcaacagctacatactatttgttaatgttgcatggcaaggaatttcacgcatttcctgctggttcctggtataacttcagtaaagttgcgcagtacaagcagctgactctggaagaggccgaggagaagatgaacaagagaaagactagtgcaactgggttatngaacgttnggatgatgaaagcagctacaa

SEQ ID NO: 5589 - DNA, 1278 bp, Zea mays
  misc_feature (778)..(778): n is a, c, g, or t
  misc_feature (913)..(913): n is a, c, g, or t
  misc_feature (1014)..(1014): n is a, c, g, or t
  misc_feature (1028)..(1028): n is a, c, g, or t
  misc_feature (1030)..(1030): n is a, c, g, or t
  misc_feature (1258)..(1259): n is a, c, g, or t
atacgtccataccaagggtgtcaagcacgccaatacctaaacacagcacgaagcaatggcgcgagcaatattggcagccgtcgtcgcgttcttcctcgccgcagtcctccttgcttcggcttcggccaccgcagcagtgcccagcgacatcccggccgtgttcgcgttcggggactccacgctagacccgggcaacaacaacggcctagccacgctggtgcgcgcggaccacgcgccctacggctgcggcttcccggggggcacggccacgggccggttctcggacggcaagctcataacggactacatcgtggagtcgctcggcatcaaggatctcctgccggcgtaccgcgccagcggcctcaccgtcgcggaggcctccacggggggtcagcttcgcgtccgggcgggtccggcatcgacgacctgaccgcgcagaccgccatggtgttcacgttcggctcgcagatcagcgacttccgggacctgctcggcaagatcggcatgcccagggccgccgagatcgccggcaggtcgctgtacgtggtctccgccggcaccaacgacgtcgccatgaactacttcatcctgcccgtccgggccgacagcttccccaccatcgaccagtacagcgactacctcatcggcaggctccagggatacattcagagcctgtacaatctgggagcccggaacttcatggtgtccggcctgccgccggtggggtgcctgccggtgacgaagagtctcaataatctggggtcgggaggctgcgtcnccgaccagaacgcggccgccgagcggtacaacgcggcgctgcagcagatgctggccaagctagaggccgcgtcccccggcgccgcgctcgcgtacggtggacgtgtacaccccgctgatggacatggtgacgcanccactgaaatacggtttcaccgaggcgaaccaaggctgctgcgggaacggcctgctggcgatgggggagctgtgcaccgtggacctaccgcattgccagtntccggcggaatttntntttttcgactcggtgcacccgacgcaggccgcctacaaggcgctcgccgaccacgtcgttgagcgccgtcacaccccgtaaagctagattagatgggaacgcaatggcattgtatatgaacgcaattagttcggtttgcttattagggtagtttttttttttactttttttagtcacggatgtttacgtagggaagttttttttaaaatatatacagtggtttatttnngcgaaaaaaaaaaaaaaaa

SEQ ID NO: 5590 - DNA, 1254 bp, Zea mays
ccggccgggacgaacaagcaatggcgcgcaccatggcagccatcgcgatcttgctcgccgccttcttcgtcctcgctccggatctggccaccgcagcggcagcggcagcggcgcagagcgccatcccggccgtgttcgcgttcggggactccacgctggacccgggcaacaacaacggcctggccacgctggtgcgcgccgaccacgcgccctacggccgcggcttcccgggcggcgcggccacgggccgcttctcggacggcaagctcatcaccgactacatcgtcgagtcgctcggcatcaaggacctcctgccggcgtaccgcggcagcggcctcaccgtggcggaggcgtccacgggggtcagcttcgcgtcgggcgggtccggcctcgacgacctgaccgcgcagaccgccatggtgtccacgttcggctcgcagatcaccgacttccaggccctgctcggcaggatcggcatgcccaaggccgccgggatcgccaacaggtcgctctacgtggtctccgccggcaccaacgacgtcaccatgaactacttcgtcctgccggtccggaccatcagcttccccaccgtcgaccagtacagtgcctacctcatcggcaggctccagggatacatccagagcttgtacaagctgggagcccggaacttcatggtgtccggcctgccgccggtggggtgcctgccgatcacgaagagcctccacagtctcgggtcgggaggttgcgtcgccgaccagaacgcggccgcggagcggtacaacgcggcgctgcggcagatgctgaccagggctggaggccgcgtcccccggcgccgcgctcgcgtacgtcgacgtgtacaccccgttgatggacatggtcgcgcagccccagaaatacggtttcaccgagacgagccgaggctgctgcgggaacggtctgccggcgatgggggcgctctgcaccagcgcgctgccgcagtgccggtcgccggcgcagttcatgttcttcgactcggtgcacccgacgcaggccacctacaaggcgctcgccgaccacatcgtccagtcacaaaaacctaagacttagattagcattagattagcattagctgcaggaggaacggcattgcacatgaagctggctacctcggtgctttttgtagatccatttatttgcacatgcagagatggatgtttacatagcgaagtttttaatatacagagagtcgtttattttgcaaaaaaaaaaaaaaaa

SEQ ID NO: 5591 - DNA, 1160 bp, Zea mays
agacattcccgtggaagtagaagcaaacatcgattgcaacggcttatcctggatctcgtcattgatcccagtcagtcccagcagaacgagcaggagaaggcgacgctcggcgcgggattcttgctgtttctacagcccctaggtacgggcgcggcgcagccaccaaggcgggctgcggcctcgcggttgcggggcgcgagcgcgaccccggccgcgaccttgtctatactcgccagccagccgggcgggcgagctgtggcatccgcgcacaacaaagctagctacgtactcgtgaaattcgcggcgcagcgcaagcgcgcgggagccagcgtgccggcgaggcgttccgatgggctcctcggcggcgggctccacctccaccccgacggcgcggcagcagcgcggcgcgggcgcgggcgcgggcgcggcgccgtcgtcgtcgagccccgtcttcctcaacgtgtacgacgtcacccccgccaacggctacgcccggtggctcggcctcggcgtctaccactccggcgtgcaagttcacggggtggagtacgcgtacggcgcgcacgacggcgcgagcagcgggatcttcgaggtggtgccgcggcggtgccccgggtacgcgttccgtgagtcggtggccgtgggcgcgacggagctgagccgcggcgaggtgcgcgcgctgatggcggagctggccgccgagttccccggggacgcctacaacctggtgtcccgcaactgcaaccacttctgcgacgccgcgtgccggcgccttgtcgcgcgcgcccgcatcccgcgctgggtcaaccgcctcgccaagatcggggtcgccttcacctgcgtcatcccgggcaacggccgcgccgcgcgctcgccctccgccgccgcccagagccggagccggagccggtccgcgccgccgcggccgaggaccttcttcaggaccttctccgtcggcccgcgcaggaacatgacggtgccctccccgccggcacacgcctcggcgtcaacgtcgtcggggtccaccacgtaaacggctccgtttctcgagaatttcgttttttttttgttcttcttctttttactacctgattttttaattgaaaaaaactcaactctgtgcatatcattatttgatgggtccaaaaaaaaaaaaaaaa

SEQ ID NO: 5592 - DNA, 972 bp, Zea mays
aaaaaaaaaaaaaaaaaaaaaaaaaaaaggtcatccaagctcaggtgacaacagggactcctctcgtctagccaccgttgagagtcgcacaagaaaagtgtcgcccggctccttggccctcctcctccggcggtgctgccgtcgtgagcgagcatggggaaggtagccaggtctctcctccgtcaagtaggtgtaagattaggtttaggactgagtctaggtttgtctctatggcgtttgacgtgatgtcgagttggagcttcgtccaggcgtcctcgagcagcgcctggcggctggttctctcccgaggtgagcttccatggtggaagttgacagcgggtggtagatctggtgatagcttccctaataagctcgaatctttccctgatctggaggatctccgtcgccttgttccatttgttcgtcgctgtcgtggagatggggacagaaagtggaagaggtggagcgcaagtttgtttcgattgggtttgtgcatattctcatcggtgcttggagtggagctacggcgcccactggagctgccggtctccgccgccttcccggtgacatttctggccgaagggcggcctggtgaagccatgctggcttcgtttcttcctcctggcttgatgccatttgagaggcaactgttcaacttcaacatggagtcctcttcttccatctttgtccggagatggagtagtggcggtccggtgatctcaagtggccacgtccccggtgatggccggactggatctacgctggagttgagtattggacccgatttgtaatcttaatcatcaggatggggtcctcccttgttagtttcaaggactatgatgtaatttccttttctttttcgtccctgctacccccccgcaaagggcacggggaagaaaaccacccaacaccaaatccaccgcccaaaggccaaaacggggaaaaaggacaaaaaaaagcgtcccccccccc

SEQ ID NO: 5593 - DNA, 992 bp, Zea mays
ccaaacagagcatcgcagagaccggcgtcttcgtactcgcctctctctcgcgcttccgagctttggcctccctcccctcctccccgcaatctccccaccagcgtagcgcagcgcgcgcctccgccgctccgacccgcagccatgagggagtgcatctcgatccacatcggccaggccggcatccaggtcgggaacgcgtgctgggagctctactgcctcgagcatggcattcagcctgatggacagatgcctggtgacaagaccgttgggggaggtgatgatgctttcaacaccttcttcagtgagactggtgctgggaagcatgttccccgtgctgtctttgttgatcttgagcccactgtgattgatgaggtgaggactggcacctatcgccagctcttccaccctgagcagcttatcagtggcaaggaggatgcagccaacaactttgcccgtggtcactacaccattggcaaggagattgttgacctatgccttgaccgtatcaggaagcttgcagacaactgcactggtctccagggattccttgtcttcaacgctgttggaggtggaactggctctggccttggttctctcctccttgagcgtctctctgttgactatggaaagaagtccaagcttgggttcacagtgtacccatctcctcaggtctccacctctgttgttgagccatacaacagtgtcctgtccacccactctctccttgagcacactgatgtggctgtccttcttgacaatgaggccatctatgacatctgccgccgctcccttgacattgagcgccccacatacaccaacctcaacaggctcgtttctcaggtcatctcatccctgactgcttcccctgaggtttgatggggtctgaaagttgatgggaacaaattccaaaccaacccgggggccctaacccagggaaccacttcctggttttcctcctaccccccccaggtatttccaggcggaaaaaggct

SEQ ID NO: 5594 - DNA, 1778 bp, Zea mays
  misc_feature (1766)..(1766): n is a, c, g, or t
  misc_feature (1768)..(1768): n is a, c, g, or t
  misc_feature (1774)..(1775): n is a, c, g, or t
ctcgaggccggccgggccgaaggatcccaatgctatatgctactcgactacatactgctgagtacatcagtactcagatagcccgagtcggaccacactgcttgcacagtagaagatgataggcgatgaactggattccgatgtggttgtacgctacttcagaggcaagagcatcctgatcactggatcaacaggtttcctggggaaagtgctcgtggagaagatactgagggttcagccggacgtgaagaagctcttcctcctcgttcgagccgccgatgacgagtctgccaagcagagggtcgagaccgaggtgacaggaaaggagatctttcaggttctgaaagaaaagcacggtaacgggttcgaaggtttcgtccaagaaaaaatctgccctctgccaggagacgtcatgcacgagaacttgggcctaggccctgccaaactgagacaagtgtgcaaggaaatagacatcgttgtaaacggagctgcaactacgaatttctacgaaagatacgatgtggctttcgacacaaatgtcatgggagccaagcacatatgcgagttcgccaagaggtgcagcaaactcaagatgctgctacatgtttcaacagcttatgtagctggtgaacaggaaggggtggtgctggagaagccattccgtttgggcgaaaccctgagggaaggcacgcacctggacatcgagtccgaactaaacctgataaaagagacgaggagagaactgaaggccagccgttgttcagaaaaggctgagaggagaagcatgaaggagcttggcctcaagagggcaagggagttcgggtggcccaacacctatgtgttcaccaaggcaatgggggagatgctgctgggcgcccacctccggggagacgtgccggtcgtcatcgtccggcctagtatcataaccagcatcctcaaggagccattgcctggatggatggaagggatcaggacgattgactcgttcatcatcggctacgccaagcaggctctgtccatcttcttagttgacctcgacctgatcatggacgtgattcccggggacatggtggtgaacgccatgatggtggccatggcggcgcactcggaggagcgggggcagcagactagcatctaccacctgacgtcgtcggtgcggcacccggcgccctacgccgtcctcgcggagtgcggccgccgctacttcctccacaacccactcaggtccgggggcaagaacagcgagcccgtgcggcctagcaggatgcgcttcttccgcaccctccccgggttccgcgcctacatggccatcaagttcaggcttccccttgagatccttcgcctgctcaacattgtcctgtgcggtgctctctcccggcgccacgacgagctcagccgcaagtacagatacgtcatgcatatcgcagagctgtacgcgccttactccttgttcaaaggatgcttcgatgactccaacacggagaggctgagggcggcgatggcgaacaggagcagcggatatgacttgggtttcgatcccatgtgcgtagactgggacgactatttctacagggttcacatccccggtgttgtcaagtacctgtgtggttactaggttaatacatatttaagatccggagagagccaaatgtatcttcgcatgttttaatacacaaatatgtcgctgtagtttgcagattattataaaaaaaaaaaaaaaagttcagtggtacaggttttttaagaatggtacttgttttcctttnanaaaaannaaa

SEQ ID NO: 5595 - DNA, 868 bp, Zea mays
cgggcgggccgggctcctaccccagaacgctcattcgcatcgccaccttcctccctccccccctcgccatctccgacccgacttgcggccaatggcggaccagctcaccgacgaccagatcgccgagttcaaggaggctttcagcctcttcgacaaggatggggacggttgcattaccaccaaggagctgggaactgtcatgcgttccctggggcagaatcccactgaggcagagcttcaagacatgatcaatgaggtggatgctgacggcaatggaacaattgatttccctgaattcctcaaccttatggcccgcaagatgaaggacactgattctgaggaagagctcaaggaggcattccgtgtgtttgacaaggatcaaaatggttttatctctgctgctgaactgcgccatgtcatgaccaaccttggtgagaagttgactgatgaggaggttgacgagatggtccgtgaggctgatgttgatggtgatggccagatcaactatgacgaatttgttaaagtcatgatggccaagtaagttgcattaccatctgagggaagcttcagtaatcaggccaaaatattacctatccaggtgccattttgtgagatggctatcgtattaaaccgaaaacaaatataacactgtgctgtgtcataatgttgtaggcaatgattgtttgccttgaagattttattagatcctgctctggtcttttctggattttgcctgttcccgatttttttatggttggttcaccaacttttcaagagtggtacccccaactctggtaatgagtaaactatatgccccgggtcccgatgtttacccctcagaccacaaataacaaaaaaaaaaggcccc

SEQ ID NO: 5596 - DNA, 512 bp, Zea mays
ctagcgcctccgctcctctcccctgccgccaccccttccccgcatcgtctcccacgccaagaccgccgccgcccgtcaagatggtgctgcagaacgacatcgacctcctcaacccgccggcggagctcgagaagctcaagcacaagaagaagcgcctcgtgcagtcccccaactccttcttcatggatgtcaagtgccagggctgcttcaacataacgactgtgttcagccactctcagaccgtggtggtgtgccctggctgccagacggtgctctgccaacccaccggaggaaaggcgaggctcaccgagggatgctccttccgccggaagggcgactaagctgcacgcctgtttatgggaaaaatgaagccccgctgaaccttacttttcaagtaactagttatccccgatgtgtactggtcaattttttgttaattatgcttgcccgtttgccagcctgaacgttgtagcaacgtgttctatgtcatgcacttttgagtcgcctgttgt

SEQ ID NO: 5597 - DNA, 899 bp, Zea mays
  misc_feature (838)..(838): n is a, c, g, or t
  misc_feature (860)..(860): n is a, c, g, or t
  misc_feature (863)..(863): n is a, c, g, or t
  misc_feature (886)..(886): n is a, c, g, or t
ataatctctcccatttctaaaaaaaaagcagaatctctccggcgcgtaccggaggctgagaggagtcgtggccgccgtgtcaggagattcccgtgtcacaaatccacaccggcgccgcctccccccctctatctccgtctccgtcaccgggaagcggcgaggagccttgcgctgcatcgccgtcgagatggatctcctgaggaaggagctggagaagaagcggaaggcggcgacggccgacttcggcggtaagaactttgtccggcggtcggagctggaggacaagcagctccagaagcgccgccagatccccgccaaggctccttctgtgcccacccccaactcctcctccgcctccgaccctaccaactccaacgccgaccccgcccaggccgggggcgggaaccctaaccctagctcctccgccgccgcggcctctgttcctcccgccctcgcggggaagaaggccacgccggacgatacgctccactccgaggagcgccgcattgatgagctcgtcctcccgcggaacgaggtcatgcggcgactccgggtgctccgcgagccggtcacgttatttggggaggacgacgccgaccgccttgatcgcctcaagctcgtgctcaagtccggggcgatcgacgacattgacgaccttgagatgacagaggggcagaccaacgatttcctccgtgacatgattgagctccgcatgcggcagaaggctggtcgagacgcctacggcaagggtaaaggcaagcgtgtaggtgctggtgatggcggcgagggcggcgccctgggagatgatgtggatgaagggggacggggtgcccggagnagtggggatgatgctgatgcanacnagggactcaagcgaatgaaaganccagtttgaggag

SEQ ID NO: 5598 - DNA, 1148 bp, Zea mays
gggccggggcacctaaatagcctcctccctcgaggttcttagggtttcgcatccgcatcagccgccgccggaaccggggaggcggcgatacgtcgcgatgcagccaacataccagccgccaatgaacggccagcacgcgcctcagccgcaggcctctggggctccgccgcctcctctgcagcaggcccccccgccgcagcagtactaccaggcgccgccgcagtactaccagcagggacccccgccggcgatgtggggccatccgcagcagcatatgcctccgcagtacgcgcccccgccgcagcagtacgcgcctcagcctcctcagcagtacgcgccgccgccgcagcattacgcgccgccgccgccgcagtacggagcgcagatggctggcgggccgcctccgggaggcgaggatatcaggtcgctgtggatcggagatctccagtactggatggatgagacctacctctacaacgcctttgcgcctgtggggccgcagcaggtcacctcagtgaaaattatccgcaacaaacatactgggcagcccgagggttatggttttattgaatttcaatctcgagctgctgcggaatatgctcttgggacctttaatgggcagatgatgcctaatgttgaacaagttttcaagctaaactgggcttcttgtagtgctggtgacaagcggggtgatgatggttctgatcacacaatatttgttggtgatttggctgctgatgttactgacgccatgttggaagagatattcaaagccacctacccatcagttaaaggtgctaatgttgttactgacagggccactggtcgctccaaagatatggttttgtacgctttggaaatctaaatgagcaaacacgtgcttatgactgagatgaatggagggccattgcctacaaaaaaaaaggagaatggggccctgcagcttaacaaaaaaaatatagggaatccaggaaaaaaaatttccactaatggcagggtacccaaaacctctcaaggaaaatggaggcgggcaaatgatccccaacaaataataaaaacctttttgggggcggggttaaaattccccaaaaaaaaaagaaaaaattttcaaaagggctaaggttttttaatccccataaagggggcaa

SEQ ID NO: 5599 - DNA, 1013 bp, Zea mays
gaaaaaaaaggaaacagtaaaaaagcgtggtccccggggataggtacttcgtccggcgcggtatcattgctgagcgatcgctcgctatctggaaatggagtgttagtttcaaatagagattgtgtgggtgtgaagtgtactgaagatcgagcaggaaaaaattcacacccacccacacacccaaagaaagacacgcaaacatgccggccaccgcctcgccgccaccgctgctcctcgccgccgcgctcctcctctccgccgcgttgctctgctcggcctgccccgtgccgctgccgaagcagacggccgacaacagcccgcggctgcagcgcgcgtacgtggcgctgcaggccctcaagcgcgccatcaccgacgaccccaagaacctgacgggcaactggtgcggcccggacgtgtgcgcctacttcggcgtcttctgcgcgccgtcccttgacgacccgtgcgcgcgcgccgtggccggcgtcgacctcaatcacggcgacctcgccggcacgctgccgttcgagctcggccacctcactgacctcgccgtcctccacctcaactccaaccgcttcgcaggggggctcccggactccctccccaagctctccctcctccacgagctggacgtcagcaacaacctcctctccggcggcttcccgcagcacatcctctgcctccccaacgtcaagtacgtggacatcaggttcaacaacctgtgcggccccgtgcccccggccatcttcgacaagaagatcgacgcgctcttcatcaacgacaaccacttcgacttcgagctgccggagaactttggcaactcccccgcctcggtcatcgtgctcgccaacctccgcctccgtggctgcatccccgccagcgtggggcgcatggggggcacgctcaacgagctcgtcatgctcaactccggcatccggtcctgcatcccgccgggagatcgggtggctgcgcgagcttccccgggctggacgtgagcttcaaccagttccaag

SEQ ID NO: 5600 - DNA, 872 bp, Zea mays
ctctcttttccccttcccttcacgacctccgccagaggccagaggtaggacgctagggtttcgccgaccaccaccgtccaccgcgcgccatggccgaggcctcccggtaccagatcctggtgcggctcctcgacggccgcacccactgcctccggttctccacgcccaccgtctccggcgcggcgctcctcgacgccgtttccgcgctctcccgcgtccccgccgcctccctccgcctcgtcaccggccgcctcgacatctcgccctcctccgtcctcgcgtccttccccgacgggcaattcccctccgcgtccgcgctcctccgcctccgcggtggcaagggcgggttcggctccctcctccgtggggccgcctccaaggccggccagaagaagaccagcaacttcgacgcctgccgcgacataaacggccgccggctccgccacgtcaacgccgagcgccgcctcgaggagtggagggccgaggccgcggatcgccagctcgagaagcttgccgaggacttcctcaagaagaaggccaaagagtcaggccgcggcggcgcccgagctgccgaggtcgacaagtaccttgagaagtaccgcaaggatgccgagagctgcgtcaacgccgtggaggagtcggtacgtgcctcccttgcgaagaggaaggctgtccccaagccgcgtgatgcgaagaagcttaaaatctggatgggcaagaaagaaaggagcagatgatgagagtgatagtgacagtgacagtgatgtggacgataatgagggggcagatgcaaaacccatagctcttgatcatgggaattactcaatgaatcaacaaaagtgaggaggaaaaggtgatctggcttcagttct

SEQ ID NO: 5601 - DNA, 933 bp, Zea mays
cccacgcgtcccccaacagatcaagcctagcaggaaataaaaaatctgtaagagagaaccaaaaaaaaaaaggagtcaatcgccggcgacgggtacgggtgtacgcttgaggcgatcggcagagaagaccgagaccgacggctccagtgccgctgtcactgccagtctgccacagctagccgcctagcttgatccgccttttgtgctgtgcggatatgagggccgcgcaggtcgatccgtcccccgcggcgccgcccaagtcgcggctgaagcgcctcttcgagcgccagctgctgcgggtctcgccggccgagcgcctcccgtcggcgcctcccggtggcggggagaaggatgagctgccggagcctagctcgctgtgcctggacggcatggtgcggagcttcctggaggacggcggcggcggcggcgagccgagcgggcggcagcggccgcgcggtgctgcaactgcttccacgccggcgacacctccgacgacgaggacggcccggctgccgccgacgccgcggccgctgacatcgcggagacaatcaaggggctcgtccactgcgccagcctccgggagcgcaacctgctggccgacgtgtcgacgctggtggagcgccaccgcgcgtcgggggcgcgcaagcgcgacctgctccgcctgctggcggggtccctccgcgcggcgggccacgacgccgcggtctgcctctcccgctgggacaggtcgccgtcccaccccgccggggaccacgcgtacctggacgtgctcctcccggccgcgtcggagcgcgccgggcgcgagcgcgtgctggtggacgtcgacttccggtccgccttcgaggtggcgcggcccaccaaggcgtaccgcgccgtgctgcagcgtctgccgccggtcttcgtcgggcgggacgaccgcctgcgcctcctcgt

SEQ ID NO: 5602 - DNA, 744 bp, Zea mays
cctaataacttccccgcctctccctccatgacccttcccgctcccccgaggcggcggcgcgagcgagcgagcgagcaaccggcggcgatgggcaaggcggcgaagagctcgcggaaagggaagaaggcgtggcgctccaacatcagcaccgacgacatcgacgagttctacgagaagcagacgcgcgacgcccacgccggcgccgccgccatcccctccctcccctccggctccctcttcttcgtcgacaagcccgcctccgcgtccacctcctccgccgccaccgcctccgacccggcccccaaagatgttcctgtcaaaaggaagattgagaaaaacagggagaaggtccttcaccatgagagtgtgttgaagcggaacccttatatacagacgatcccatcttctttgatgtcaaagaaggataagaagaagttcaagaaacacgcaaagaaaaaggaattgcaggagtcacgggaagaaaaaagtgttcccatggaagaggattcagctgagaagaacctcgacatctggggtggagatgctaaaggggctgctttgcccaaaaagggaatgaaaaggcttaagaaaaataaatctaccacatctgtgattcctgcggttgaagttgagcctcaaggatgttcatttaatcctccacatgaagcccatcaagacgctctttgctctagcctggttgctgatgaaatgcgcaagatctacacgaaagagttaggccccaca

SEQ ID NO: 5603 - DNA, 1503 bp, Zea mays
tacctcgaccccccccgccgatcttttctttccagcctcaaatcccgtttttcccatcccgtgaagaaccatggcacggtactccccaccgtcgctgcgctgcttcttccgctgcgccgccagctccgcctcccgagccgtaggcagcggcactcggaagaagaaccttgtattcttgggctctccccaggtcgccgcctcggtcctggacaagctgctgggcgcgtccggctccccggaatccgcatttcaggtggctgccgtcgtgacgcagccgccggccgccaagaacagggggaggaagttgatgccgtcggccgtcgcgcagttagcgctcgatcgcgggttcccagaggaactcatcttcacgccagaacgagcccgagaagagtcgttcctgtcggccttgaaggaagtggaaccggatgtttgcataactgctgcttacgggaacattctgccccagaaatttcttgatatcccatcgtgcggcacagttaatatacacccaagtttgttgcctctatatcgtggtgcagctcctgtgcagagggcactgcaggatggtgttgcagaaacaggtgtttcccttgcatatactgtccgtgcattggatgcaggtccagtgattgcgtgtgaaaggttttctgttgatgaatgtattaaggcaccagagctactttctatgctgtttcatttaggatccaagctattgattaatgaacttccatccattcttgatggttcggctaaagataaggcacaaccacaggatgactccaaagctacactggcaccaaagttaaattctgaggagtcatggctatcgtttgacgaagaagctaaagtgctgcataacaaggtgcgggcatttgcaggatggcctgggacgcgcgcaaagctgcaactcataaaccaaaacagtgtacccgatgtactagagattaaggttatcagcacgaaggtttcaacatcatgtgtcaaagttggagatgaaaacgagatactattctctgggagctcgttgctgattccttgcagtggttcgacctggctcgaggtgttggagcttcaactccctggaaagaaagtaacaaaggcacaagatttttggaatggtttgcgtggtcagaagctgatgaaattgccatagggggatatctgcattcgcagcacaggagtgtgcctatatgcatagcaagggttattgaggtcagtcattgcgcgaacataagcagggtagtgctagaagcctatatgcggagatctcggttttatgactaccttttccttctggtaaacttggtgctataaactcgtaactcagttacattaggcatgccatttgtattgcttcctcaatttcagaaaacacactgctgtaactatttcagttattcaatttttcactgtcataactgagctacaaacatttgagaaataatacagttatgtggtgagtaataaggcaataatttgccgtaccaaaaaaaaaaaaaaaaa

SEQ ID NO: 5604 - DNA, 453 bp, Zea mays
  misc_feature (444)..(444): n is a, c, g, or t
agagcagcaaccaccaaccagcaagcggcaagcgcgcgcacacaccaaacgcaactgcaactgcaggtgcaagagcacgccacagcagaaaccaacagttccacacgaagcaagaaaaggggacccccacctctgccgatttccatccgccggggcgtcgtctgtgaccgaccagaccatggacaagatcctggccttctccatcctgagctcgtcgccggcggacatctccgcggccggcctctcctcctcctcgtccgcccggctctcgtggcggcctcggccccaggcggctgcggccgacgcggcgccaacgccgaggcaggagaaggcggccgaccagcgggccccggcggccgagcgccggcgggaggcgcggccgcggttcgcgcccgagttcgacgggctccactgcttcgagtccatcgtctccgcctgaacttngaggggcct

SEQ ID NO: 5605 - DNA, 1071 bp, Zea mays
  misc_feature (963)..(963): n is a, c, g, or t
  misc_feature (978)..(978): n is a, c, g, or t
  misc_feature (985)..(985): n is a, c, g, or t
ccctacaaactcacttcccccgtgcgccttcgtcggccccccctccctcgcgagtccgaagtcaaggcgaaaaccctcgaggcgaagcgagagtcagatagggatacccgcgagagacgagagtcgagtgagagggtggaagggaagccgcgatgaagctcaacgtgaagaccctcaagggcacaagcttcgagatcgaggcgacccccgagtcctcggtgggtgaggtcaagagaatcatcgagagtgctcaggggcagaatgtgtaccctgcggatcagctgatgatcatatatcaaggaaaaattctcaaggatgataccactctggaagctaacaaggttgcagagaacagcttccttgttataatgctgtctaagcctaaggcgtcatcatctagtggtgcttctactgcttcaaaggcacctgctagtcagtctcaacctgctactccacctgcccctgttgcctcagctgcaagatcaccaccttcacaggcacctgttgctgcatctgaaccggcgcctcccagtgcacagccttcagctgtttctgatactccagctcctgcagtaactgcatcaggcgatgctgatgtatacagtcaggctgcatcaaaccttgtctctggcggcagtctagaacagacggtccaacaaattcttgacatgggcggtggcacctgggaacgtgatatggttgtccgtgctttacgtgctgcatataacaaccctgagagggctattgactatctgtattctggaatacctgaatctgtagaggccccacctgtggctcgagcacctgctcctgctcaacaggcaccaaacctgcaggctcctcaggctcaggctgcacctctagcaccagtgcagccattcttggtggcgtctctgcaggccctaatgcaaatcctctaaaccttttcccgcagggtattcccaagtggcggggcaaatgctnggtgctgggtgtggntggccgntgctggcgcccttgatgcattgcgacagcttccacagttccaagcactggcttgcattggtcccagctaatccccaaatcctgcag

SEQ ID NO: 5606 - DNA, 876 bp, Zea mays
ggcacttgcaggttccaaaccctactcccctccgcctccctccttccggatccttccttcccacccctccccgccgctccgatccgccgccggccggccagccgccgccatgtcgatccgcatgctgaaccagaacgcggaggtgatgaacaagtcggcggccctcgccatgaacatcggcgccgccaagggcctccaggacgtcctcaagaccaacctcggccccaagggcaccatcaagatgctcgtgggcggagctggcgacatcaagctgaccaaggacgggaacaccctcttgaaagaaatgcaaatccagaacccgacggcaatcatgattgcgaggacggcggtggcgcaggacgacacgagcggcgatggcaccacgtccacggtgcttttcatcggggagcttatgaagatgtctgagcgatgcatcgaagaaggtactcatccacggtttttggttgatggctttgaggttgccaagaaagcaactcttgaatttctcgagacattcaagacagcagtcgttatcggtgatcaacctgacagggagatcttgaaaatggtagcaagaacaactcttaggacaaagctgtatgaatcattggctgatcagttgaccgatattgttgtgaatgcggtcctatgcatccgccagagtgatcaaccaattgatctttttatggtggaaataatgcatatgcgccacaaattcgatgtcgacacacgtctgattgagggtctggtccttggccatggttctcggcaccctgacatgaagcgcagagcagagaattggtacatcctgacagctaatgtgtcactgggaatacgagaaagtgaaaatcatgcagggattctctactcaacgca

SEQ ID NO: 5607 - DNA, 949 bp, Zea mays
gaaatcggccgctcgagccggcaagcctaagcagagtggggaaaggcgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaagtccaagcttgggttcacggtgtacccatctccccaggtctccacctctgttgttgagccatacaacagtgtcctgtccacccactcactccttgagcacactgatgtctctatccttcttgacaatgaggccatctatgacatctgccgccgctcccttgacattgagcgcccaacatacaccaaccctcaacaggccttgtttctcaggtcatttcatcactgacagcttccctgagggttgatggggctctgaatgttgatgccaatgaattccagaacaaattgggggccctacccccaaggatccccc

SEQ ID NO: 5608 - DNA, 953 bp, Zea mays
taccccgccggccggtccgggaggagtaggtcagatcagagtatcaccacttggcaatttctcccccggcacaagcgcatggctaccctcgggggcaatcgtgctctctatgcagtcgtcgcgctgccacttctcgcgacccttcttcacggaccagtgcggctggcgcatgccttcccataccgttccctactccagacctgccagcccagcggctccatccagggccgttccggcaactgcaacacggagaacggctccgagtgctgcaagaacgggcggcgctacaccacatacggctgctccccgcccgtcacgggtagcacccgcgccgtactgactctcaacagcttcgccgagggcggggacggcggcggcgcggccgcctgcacggggaagttctacgacgacagcaagaaggtggtggcgctgtcaactggctggtacaacggcggtagccggtgcagaaagcacatcatgatccacgcgggcaacgggaattccgtgagcgcgttggtcgtcgacgagtgtgactccaccgtgggctgcgacaaggaccacaactttgagccgccgtgccgcaacaacatcgtcgacgggtcgccggcggtgtgggacgctctggggctcaacaaggacgacggccaggcacagatcacctggtccgacgagtgagcgactgtaccaccgctgcaccggccgggtgcgctcgtgcaagtgcaccggccggcacgtctcatgttgccaatatataataagtagtagggtacagtggtacaccctctaaataatcatgcatgaagcagctgttcatctttagacgtgtttaaccatttgcaaaattaaataactgttggccccccgagttccacaaaaaaaaaaaaaaaaaaaaggaccatacgagtgagaaatgtgtccaaaaaaaaaaaaaaaaaaaaaactcgaggaggggc

SEQ ID NO: 5609 - DNA, 949 bp, Zea mays
caggccggccgggccgggtgtcggtgaaggtcagatcagagtatcaccacttggcaatttctcccccggcacaagcgcatggctaccgtcgggggcaatcgtgctctctatgcagtcgtcgcgctgccacttctcgcgacccttcttcacggaccaatgcggctgtcgcatgccttcccataccgttccctactccagacctgccagcccagcggctccatccagggccgttccggcaactgcaacacggagaacggctccgagtgctgcaagaacgggcggcgctacaccacatacggctgctccccgcccgtcacgggtagcacccgcgccgtactgactctcaacagcttcgccgagggcggggacggcggcggcgcggccgcctgcacggggaagttctacgacgacagcaagaaggtggtggcgctgtcaactggctggtacaacggcggtagccggtgcagaaagcacatcatgatccacgcgggcaacgggaattccgtgagggcgttggtcgtcgacgagtgtgactccaccgtgggctgcgacaaggaccacaactttgagccgccgtgccgcaacaacatcgtcgacgggtcaccggcggtgtgggacgctctggggctcaacaaggacgacggccaggcacagatcacctggtccgacgagtgagcgactgtaccaccgctgcaccggccgggtgcgctcgtgcaagtgcaccggccggcacgtctcatgttgccaatatataataagtagtaaggtacagtggtacaccctctaaataatcatgcatgaagcaggacaacatgcatgctacagacgttcatctttagacgtgtttaacatttgcaaaattaaataactgttggccccccaagttccacttatattaatggttgccatactatatatattgtatgcaaagggcaagttgacctcgtgt

SEQ ID NO: 5610 - DNA, 765 bp, Zea mays
gtcggctcctcccccgctccgctcatcttggggaggaagcaaagcagagccgcgccgccgaggtggatatggccgaggccgacgacgccgccgccgcccgccggcgcaccgtcaccacggagtaccgcaacaagctcctcaactgccgcgagctggagacgagggtccgcacaggtagggaaaacctaaaaaaggcaaagaaagattacgataaaactgaagatgatttgaagtccttgcagagtgtgggccaaatcattggtgaagtacttcggccattggacagtgaaagatttatcgtcaaagccagtagtggcccacgttatgtggtcggctgcagaagcaaagttgacaaagaaaagctgacagctgcaacacgagttgtccttgacatgacaactttaacaataatgcgcactctaccacgtgaggttgaccccgtggtctataacatgctacacgaagaccccggcaatgtcagttactcagctgtaggtggactgtccgatcaaataagggagctgcgggagtccatcgagttacctcttatgaatccagaattgtttcttcgcgttgggattaaaccgccaaagggtgttctgctctatggcccacctggaacgggaaagacattgcttgctagagccatcgctagcaacatcgatgctaactttttgaagatcgtttcaagtgctatcattgacaaatatattggtgaaagtgcccgtcttataagagaaatgtttaactatgcacgtgagcatc

SEQ ID NO: 5611 - DNA, 766 bp, Zea mays
acccttccactaagatcacatttttttgctcttcccttctccattcaaggagccggggcagccatggacgccgccacgggcacgggcatggaggagctgtcatggtgcgcgcggtgcgccggcctggcattccttgtcttctccgtgtgcgtggtggcgctcggcgcggcgctcttcctcgcccgccggtggccgtggtgcagctgccacgtctgccgctcgtacctcacggggtcgtgggcgcgggacttcaccaacctcggcgactggtacgcacacctgctccgctgctccccgaccggcaccgtggccgtccacgtcctcggctgtaccatcaccgccaacccggccaacgtcgagcacatgctccacacccgcttcgacaacttccccaaagggaagcccttcgccgccgtcctcggcgacctcctcggcggcggcatcttcaacgtcgacggcgacgcctggcgccaccagcgcaagatggccagcctcgagctcggcagcgtcgcggtgcgctcctacgcgtacggcatcgtcgccgaggaagtggaggcgcgcctcctgccactgctcgccgacgccgccgacaatggcagggtggtcgacctgcaggacgtgttccggcgtttcgctttcgacaccatctgcaagatctccttcggactagaccccggctgcctcgagctcgacatgcccatgtccaagctcgccgccgcgttcgacaccgcctcgcggctatccgccatgcgcggcgcggcggcgt

SEQ ID NO: 5612 - DNA, 831 bp, Zea mays
agcgcggcccccccgttctatcttctccagctccggttccccccggcccgccggcccggggatcttgtccagacgtgcatcatatcctccgtgtgatccattcatccccgcgccgtgctagcttgctagttgcaagcaccagccgaccaccaaacggtagcgcacgcggacaatttaacagcatcaggtttaggccctgctgccgtcgtcgagcgcccgggccaccgcacacctgaaagcaatggagatcgtcgccacgcgctccccggcctgctgcgccgccgtgtccttctcccagtcgtacaggcccaaggcgtccaggccgccgaccacgttctacggcgagtcggtgcgggtgaacacggcgcggccgctctcggcgaggaggcagtccaaggcggccagccgcgcggccctcagtgcccggtgcgagatcggagacagcctggaggagttcctgaccaaggcgacgccggacaagaacctcatcaggctgctcatctgcatgggggaggccatgaggacgatcgcgttcaaggtccggacggcgtcctgcggcggcacggcctgtgtcaactccttcggcgacgagcagctggccgtcgacatgctcgctaacaagctcctctttgaggctttggagtactcacatgtgtgtaagtatgcgtgctccgaggaagtccccgagctccaggacatgggtggcccaggtcgaaggtggtttcagcgttgcgttcgaccccctcgacggctccagcattgtcgacaccaacttcaccgtgggaaccatccttcggagtctggcccggcgacaagctgaccggagtgacc

SEQ ID NO: 5613 - DNA, 896 bp, Zea mays
agtttctccctttcgggtttggtttgggaaacaaaaacaagtccccacgggcagaccgaaccctagcttcgccttttcgaccttcacccttgccattctctctttaagacctattctgatgtcgtcgtccggcgggggtggggctgggcagcagttccggtacacgcagacgccgtcgaaggtgctgcacctgcggaacctgccctgggagtgcacggaggaggagctcgttgagctctgcaagcccttcggccgcatcgtcaacaccaaatccggcgtcggcgccaaccgcaaccaggccttcgtcgagtttaccgatgttaatcaagccatttcaatggtttcttattttgcatcatcttcagaaccagcacaaattcgaggcaaaactgtttacatccagtattcaaatagacaagaaataattaacaacaagagccctggtgagactgctggaaatgtgttgcttgttaccatagagggtgttcaagctagtgacgtcaccatcgatgtaatccatttggttttctctgcttttggatttgttcacaaaatagccacttttgagaaggctgcaggttttcaggcactgatccagtatactgatgcacccactgcatcagcagcaagagaagccttagatggaagaagcatcccaagatacttgcttccggatcatgtagtatcctgccacttgcggatttctttctctgcgcataaggatttgaacatcaagttccaatcacaccgcagcagggattacactaacccctaccttccagtcaactcctctgctatagatagtacattgcagcctgctgttggtgctgatggaaggagggtggggggctgagggtaatgttcttcttgcatcactttgagatatgcagtatgct

SEQ ID NO: 5614 - DNA, 962 bp, Zea mays
gagggggagggggcgaggttcacgggcgtgcggcggcgcccgtggggccggtgggcggcggagattcgcgacccgatgctccgccgccgcgtctggctcggtaccttcgacaccgccgaggaggccgccgcggcctacgtcgccgcgcgcctccgcatccgcgggcccaaggcgtccgggagcaacctgctcccgtccggtgctcacgccgccggctcgctccctccgcccgcgcaccgcccgcccctgcccccccgccccccgccaccgcctcagcgggagaagcagcagtgcccgccaccgcctctgctcccgccgaagaagcagcagtacccgccaccgcctctgctcccgccgaagaagcagctgtacccgccaccgcttcccctcccgccgaagaagcagcagcaccatcacccgccaccgcctctgcccacacttccgccgaagaagcggctggcgtcaccgcctctgctgcccggaagcgagaagcagtgggtcatctcctccccgtcggagccgcggttcgtcccgctgccggtgtgggctctgatgtccggctccgggaagcgcaagaagcggtcaggctgcggcgggcgcgtccccgccctccacaccccagccgccgccgaggagacagggcgcgcctgagaggccgagacgatagacgacaccatccctgctactggtatccatcccctgctccttgatcatgccaatctgatgaccgctcggtcgatcgatgctaatgtgaagagcctgtaacctctctgtctctctctctctctctctctctctgattcatgcaactgatgatttgtgtacatatgctgctggtgctggagccgcagcaggtgatgaactgatctgtgaaacctgatgaactattcatgtgtaataaataagtatctgttgacatttttcgacccgaacaaaacaaggttgttgttggcttgaaaaaa

SEQ ID NO: 5615 - DNA, 911 bp, Zea mays
  misc_feature (793)..(793): n is a, c, g, or t
  misc_feature (808)..(808): n is a, c, g, or t
  misc_feature (838)..(839): n is a, c, g, or t
  misc_feature (843)..(843): n is a, c, g, or t
  misc_feature (845)..(847): n is a, c, g, or t
  misc_feature (869)..(869): n is a, c, g, or t
  misc_feature (887)..(887): n is a, c, g, or t
  misc_feature (897)..(897): n is a, c, g, or t
tctgcggggtcgaacttcgctcaaacacagagagttcctcgacctcgactggactcccttcgctgttgacccaatccgccgccgcgtccaagatggcatctccggcgccgccgcttaaggacgccgtcggaggcctggaccgcgaccccttcgtcgccctcctcgccaagctcatcggcgagtcccagcgcctgcagaacgacccgccggccctcgtcccgcaggaggacctcgtggcgcagcacgtcgtcgacgcgctccgcccggtgtcgacggacaccggcggcggcccgctcgtcgtgcggaaggtgagctacaccgacggccggagcaacgtcatcgtcgagtaccccggcaccgtccccggccgcgtcgtctccttcgtcggcatgcacatggacgtcgttccggccaaccctagcgaatgggacttcgatcccttctcactaaccttcgaaggtgatgacaaggaaaagcttaggggccgtgggacgacggactgccttggtcatgtggcgctagtgactcagctcatgcggcggcttggtgaggtgaaaccaccattgaagcattctgtcattgtggtgtttattgccaatgaagagaattcatcggtcactggcattggtgttgatggccttgtcaaggatggtttgttggataagctcaaaactggacccttgttttggatagatactgcggataagcagccatgcattggtactggtgggatgatcccttggcatctaaaggcaacagggaagctgtttcacagtggccctgcacataaggncataaattcgatggnagttaatatggatgcactttaagaatccannaccngnnnttacatgacttccctgcacacngagaaagagagctctacnagtttgctanctcatctacgatga

SEQ ID NO: 5616 - DNA, 827 bp, Zea mays
aactctcgtttccttctcctttcctttcccttcccctcctcccctaccttagcgtctcctcgccgctaccctcctaggtctcggcgccgccgccgacgccgccgagggtctccggcggccacggacgcggttcgctgttacccctgactgtccggcacgaatttgaagttggatataagaaatcaacctagcgtctgtcttgttctctgtgtagcgctttcctttggattgcagagaattttcaaacaaaccaacaacaacttgcatctgactgacttgaggtaactatgccaaaggacaggagctcccgttcagtctcgcacgagggctgccgatctcgtgtctccccatacaagttgcggagtggttctcgcaggtcagaggaggctgctgccgccgccgccgctgcagcagcaaagcaggctgcagaatgggaggaggttcgctgtcctgtgtgcatggatcaccctcataatgctgttatgcttgtctgctcgtcacatgagaaaggctgccgccctttcatttgcgacacaagctacagacactccaattgccttgatcagtaccgcaaagcctccaaggagtcctctaaggattcaggggcagcagaatgcgctgagtgccagcagccagttaaactcgcatgtccattatgccgtgggccgggcagccattggaccaaggattatgatgcacggaagttcatgaattcttaggatcgagcatgcaccatggagtcatgtgagttcaagggtgcatacaaccagttgaggaagcacgcaagggaggatcatcctgctgtacgaccaacggaggtggacccc

SEQ ID NO: 5617 - DNA, 2792 bp, Zea mays
  misc_feature (2573)..(2574): n is a, c, g, or t
  misc_feature (2581)..(2581): n is a, c, g, or t
  misc_feature (2594)..(2594): n is a, c, g, or t
  misc_feature (2616)..(2616): n is a, c, g, or t
  misc_feature (2620)..(2620): n is a, c, g, or t
  misc_feature (2628)..(2628): n is a, c, g, or t
  misc_feature (2631)..(2631): n is a, c, g, or t
  misc_feature (2633)..(2634): n is a, c, g, or t
  misc_feature (2637)..(2637): n is a, c, g, or t
  misc_feature (2639)..(2643): n is a, c, g, or t
  misc_feature (2649)..(2649): n is a, c, g, or t
ccggccgggatccaccatcacacacagcaatccacacaagcacttcgacgtcacacgggcgctgcacacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtcgcacgcgccggcgccaaccaccaccaccaccatggtcaccacggcggccacggcttcgtggtgcgcgagaccagggtcgaggaggacatcgacacctgcaccggcgaggtccacgagcgcagggagagcttcctcgccagggctaactgagcagcccgggcggccggcatccacgcccgttcgtgcctgcctgcgtgccttatgtatgtctgtgattgtgcagggtcatcgtacttggctagcgtacgtacgtgcacgcactcagctcctgtacgaattacgacaataagctcgtgacctgaataaaacttcttcgtaatactaaaaaaaaaaaaaactgcccgccggcccctggctgcgactagagagcacagctagcaaaacagagctccagaaactgaccgattggtttcaccccagagttagcgggatggcggtgacgagcggccacagcgaacgagcagacgagcctctgaaggaggcgctgttggctgcccgcaacggtagcggcagcgacggcgacggcgagaaggacctggaggagatccggagcgtggggtcgttcctgcggcacgcggcggaggagaaccggaagctctggtaccttgcgggccccgccatcatcacgtccatcacgcagtactcgctcggcggcatcacccaggtcttcgccggccatctcaccacgctcgagctcgacgccatctccaccgagaacaacgtcatcgccggcctcgccttcggcatcatgctggggatgggcagcgcgctggagacgctgtgcggacaggcgtacggcgcgaagcagctgcacatgctgggcgtctacatgcagcggtcgcttatcatcctcaacgccatggccgtgctgatgctcccgctctacctcttcgccacccctatcctgcgcttcttccaccaggacgccgagattgccgcgctcgccggccgcctagcgctctacatgatcccgcagctcttcgcctacgccttcaacttccccatccagaagttcctgcaggcgcagagcaaggtgatggccatggcggtcgtgtcggtggcggcgctgctgctccacgtcgccatcagctggctcctcatggggcccatggggatggggatcgtcggcctggccgtcgcgctcaacgcgtcttggtggctcgtcgtgctgggccagctcgcctacattctcatgggctactgccccggcgcctggaacggattcgactggctcgccttctccgacctctccggcttcgcgcgcctgtcgcttggctccgccgtcatgctctgcctggagttctggttctacatgttcctgatcgtcatcgtcggcaacctggagaacgctcaggtcgccgttgctgcagtctccatttgcacgaacctgttcgggtggcagatcatggtgttcttcggattcaacgcggccatcagcgtgcgggtgtcgaacgagctgggcgccgggcggccccgcgcggccaagttcgcgatcctggtggtgctcatgtcttcggtggccatcgggttggccttcttcgtcctcgtcctggccttccgcgacgtgtacggcgcgcccttcacggaaagccccgaggtggtgcgcgccgtggccagcctcggcgtcgtcttcgccttctcgctgctcctcaacagcgtgcagccggtgctgtcgggcgttgccgtcggggccggctggcagtggctggtggcgtacatcaacctcggctgctactacctcgttggcatccccgtcgggtacatcatcgccttcccgctgcgcggcggggtgcaggggatgtggggcggcatgctcacgggcgtcggcctgcagaccctcatcctggtcgccatcacgctgcgcaccaactgggacaaggaggccagcgaggcccattccaggatacagaaatggggtggatcggcggcggccaaagtttcacatgcatgactagtctgaatgacgcgcgccaccatgagaatacaatacaacagatgccatgcgagcagaatggcatgctgcggtgcgtaagcttgattgtacgtgcaggttgcgttttgggctgcttaagtagttggagacaaagtcatacttaggttgttttgtttccagcagatatatgcttgtaaaacacgtattgtgccatagactgcatgattcttagcagagtttgaaatagaaaataatatatctctactactacttaattacctgaaaaaaaaaaaaaaaagcggatggtgcacgttctgccgctggcgcgccccgcatcccgcccgcggccgcaccccgcttccccatcgtggcagccatctcctcaaccgtcgcgggatccccgcccttcccttggnnccccgcnccgcgcccctccntgagctctgtcgcgtcatcccngccntgtccccntcntnncantnnnnngcacangaggaagctgttaaccagcgccgccacttccaccgagtccctcgtggcgcttgaggcccgctgtctctccccccgctgtcgaggctcgcgccggctacaggtccacgctccccccccccagagatagctccctccccgaggag

SEQ ID NO: 5618 - DNA, 1126 bp, Zea mays
cattgggtacctcgaggccggccgggttttccgaatcccgcggatatctcctcaaccagccgcccccttcctccggagctccgctccccttcccccctcgtttttcctctgcgcactttttctcgtttccagccttccaggcagccacgcctcgcccgttctcggatcccctccaaaacggtcaaagccaaaccagccaaatcgcgcgcggcggcggcggcgacgagaacgagacggacgcgcgcgcgcgctagctgaatcaggtcaggaaggaggagagccgccggcgagcacagcagcaatgccttactgcgaggtgggcaggtacgcggacggcgacaagtgggagggcgtccgcgtctactaccgccgctacggccgcggcgccaccaaggtgctcctcatcatcgggttggcggggacgcacgactcgtggggcccgcagattaaggggctgacggggtcgctggagccggccgacgacgaggccctgcggccggacgaggaggccgccggcggcgacggcgacggcatcgaggtctgctgcttcgacaaccgcggcgccggccgcagctccgtgcccccgaacaaatcctactactcgacggcaatcatggcgacggatgccttggccttgatggatcatttggggtggaagaaagctcacgtctttggccactccatgggtgccatgattgcttgcaagcttgcggcgattgcgcctcacaggctatgttcgctggcattgcttaatgtcactggaggtggctttcagtgcttcccaaaggtagatgggcagatgctttctcttgcattccgtttcttaagggcaaaaacaccagaggaaagagcccttgtggacttggaaacgcattatacgaaggaataccttgaggagactgttgggtcgtgtaccagaagaatggtcctctatcaagaatatgtgaagggcatatcgtcgacagggatgcaatctaattgtggttttgaagggcaaatcaatgcatgctggactcacaacatgactactaaggagctagatacaatacgatctgccggctttctagtttcagttattcatggaaggtacgatatcattgcgcaattgtgccatgcaaaacgtcta

SEQ ID NO: 5619 - DNA, 1325 bp, Zea mays
tgtggcgagacaagttggactgctaccagatacagtgtcaaatgatctcagaggcaaaaaatctggattcaattgttcctcatggaaacaatcgagacttggcattagagcttgaactagagatgatgaaatggattgtcaatttttcctcctgggtgaacgaacagaggagcttcgtcaaggcgctgaacggatggctatcactttgtcttgactacaaagttgacgagacagtcgacggagttcctccttattcacctggaaggtgggtgctccccttgtgtttgtcatctgcaacagctggtctcaagccatggatcgtttctccgagaaggaagtggttacctcgatgcaagctcttgtgtccagtgtgcgcaagctgttggagaaacagaatgtggagcaaatggagcagacgatcgctacacgggaaagggaaaaatggaacaaaatactggaaaagaaaactgtggagatcaacaaggaggcagatgtgctgaacaggaagttggccctgataccaggtcggcacagccggcttccaagcgcgcaaacataccaggaacatctccttgacgcaagcagtttgcagagtagcttgcaccgtgtcgtccaagccctagaaagcttcacctccaattcgctgcaagcattcgagcagaccctgagacatgccgaagaggaaaggtcgtccagagagcgcgccaaagtttcatagtgaacaagaatgtagcactatgagcatgttcttgcttggaggcatcgacgccgaacatactgggcaaatgctgctcacatagaatttttggtggacaatccctaactactgtgtttaactgaccaaggctcgtttagggctttaggcgaaggtcccatcggcgtccgtcagcgtagatatatgtagcagcaatttttttataggagaagtgcccttttcggtggtggtatgcttacgaggcgcatcgagttttgtttcattgtgtcgctatggaatgccgtttgttaaggccatgtttgctatagttttaccaacagatccagatttatttttttcctaagcgttttcatctccgccaaccctagaccaaattggtggagatttgccgtcaaatccaaatttaatgtaattaagaacaaaatactcgccatgccactcgttatagataaaaatatttttattgcattgttttctgttctcttcccgtcaggggcctctcgagtacaaaccttattttaaactctattctatatacaacacaatttattatacaaagtactattttgcatgagcacctccaggcatcaaacgcccccgacgtccgcca

SEQ ID NO: 5620 - DNA, 869 bp, Zea mays
tatcaagaatatgtgaagggcatatcgtcaacagggatgcaatccaattgtggttttgaagggcaagttatcgcctgcggggcccccccccccccccccaaggaactagatacaatacggtttgccggttttctagtttcagttattcatggaaggtacgatatcattgcacaattgtgccatgcaaaacgtctagcagaaaggcttcttcctgttgcaagaatggtagtacctcatggtgcacatctagtaagccatgaaagaccagacgaggtgaacaatgcacttatggatttgataaaggccaccaaatctgagataaaacctgaagagtggtcagcccagcccgagaacacgtcggaaaccggggcgctcatttctgcgagacccatcgccgtcacggtgcgaacagatgcaggcgtagacgccaccgcagcggtctataacttgcttgggaagctgcaactgagcttcctttatctcataggcgtgatagtcatggggtttgaactcatgaggaacattgtaagggtgatgaagccagtaagggttgcagcaattgagtcgtaagtcataagaaccaaatacatgtacgttgttcttgagaccttgtggtagtcgagatgatactttcacttctccccaatgcctggagatgatgattttagagtagcatctgttaacacatgtgaaactcggcctgctcctagtagcagaataatacgaaacactgagaaaacagtgcgcgcctggacagaaatgtctatggcaaggttgcccgttggcgtatgtacctgtaagagtatctgtaccataccgagatttggaatcgatgctttgctgcttaaaaaaaaaaaaaaaaagcggcc

SEQ ID NO: 5621 - DNA, 983 bp, Zea mays
ccgagaagctaatacgtagggatgccttgaggagactgtcgggtcatgtactagaagaagggtcctctatcaagaatatgtgaagggcatatcgtcaacagggatgcaatccaattgtggttttgaagggcaagttaatgcatgctggactcacaaaatgactactaaggaactagatacaatacggtttgccggttttctagtttcagttattcatggaaggtacgatatcattgcacaattgtgccatgcaaaacgtctagcagaaaggcttcttcctgttgcaagaatggtagtacctcatggtgcacatctagtaagccatgaaagaccagacgaggtgaacaatgcacttatggatttgataaaggccaccaaatctgcgataaaacctgaagagtggtcagcccagcccgagaacacgtcggaaaccggggcgctcatttctgcgagacccatcgccgtcacggtgcgaacagatgcaggcgtagacgccaccgcagcggtctataacttgcttgggaagctgcaactgagcttcctttatctcataggcgtgatagtcatggggtttgaactcatgaggaacattgtaagggtgatgaagccagtaagggttgcagcaattgagtcgtaagtcataagaaccaaatacatgtacactgttcttgagaccttgtggtagtcgagatgatacttttacttctccccaatgcctggagatgatgattttagagtagcatctgttaacacatgtgaaactcggcctgctcctagtagcagaataatacgaaacactgagaaaacagtgcgcgcctggacagaaatgtctatggcaaggttgcccgttggcgtatgtacctgcttgtttgggtaatcttggattggagtggaatgaggtggtataaggtgtatttaagtgtaatatgaactaatttccctttcaatccctaaaaacaaaaaagaaaaaaaaaaaaaaaaaa

SEQ ID NO: 5622 - DNA, 743 bp, Zea mays
  misc_feature (3)..(3): n is a, c, g, or t
  misc_feature (666)..(666): n is a, c, g, or t
cantaccctcactaaaggaacaaaagctggagctccaccgcggtggcggccgctctagaactagtggatcccccgggctgcaggaattcgcacgagaccattacctagaacatcctcggccggcgctctgctcccccgcgtctttccctcttttcctagcggtcaaagccaaatcagtcgcgagcggcggcggtaacgagaacgagacgcgcgcgctagctgaatcaggagcagggcccagggaggagagtggagagccgccggcgagcagcaatgccttactgcgaggtgggcaggtacgcggacggcgacaagtgggagggcgtccgcctcttctaccgccgctacggcagcggcgccaccaaggtgctcctcgtcatcggattggcggggacgcacgactcgtggggcccgcagataaaggggctgaccgggtcgctggagccctccgacgacgaggccctgcggccggacgaggaggccggcgtcggcgcggcggaggccgcgccggcggaagcggacgacggcatcgaggtctgctgcttcgacaaccgcggtgtcggccgcagctccgtgctccccaacaaatcctactactcgacggcaatcatggccacggatgccttggccttgatcgatcatttggggtggaagaaggctcacgtnttcggccactccatgggtgccatgattggttgcaagctagctgccatggcacctcacaagctatgttcgctggcatt

SEQ ID NO: 5623 - DNA, 4367 bp, Zea mays
  misc_feature (8)..(8): n is a, c, g, or t
tgaatagnatgcctgcccgcaagttgttgagttctatggtggtgcccatgtccaatcctcttcccatgctcacccttaccatcatatgcgccactttgtggctaactggtggtgctggtggcactggtaccgacaccggcggcggcggctgcatcccatctgagagggatgctttgctgtccttcaagaagggcatcacgagcgacaacaccagtcgcctaggctcatggcacggccaagattgctgccggtggagaggtgtcacctgcagcaaccgaaccggcaacgtcctcatgctcaatcttgcctacccgagctatccatatgatgactcgtacgacacagatgtatgcggcgattccagaactttggttggtgagataagtccctctctactcttgctgagacaactagagcacatagacctaagctggaactgcttgttaggcccaaatgggcgtatgccttcattcctgggctccatgaagaacttgagatacctcaatctctctggagtaccattcaaaggtagcgtgcctcctcagttaggcaacctatctaggttgcagtaccttgatcttggcaattcatatttagcatatggcatatactcaaaggacattacttggttaacaaacctacctctgctgcagtaccttggcatgcgttatgtaaatctctcagggatagctggtgattggcctcatatactgaatatgataccatctttaagggtcattagtctctctgactgtttgcttggtagtgcaaaccaatcgctcgcattttttaatctcacaaacttgagaagcttgatctctcgttcaacgacttccatcacacatatatatcgagttggttctggagagcgacaagtctcaagcacctagttctggaggagaccggattgtttggtgaattgcctgatgcactaggaaacctgacatctcttgttgtccttgatttatcaggtaatgtgaacatgacgataacacaaggcttgaagaacctttgtggtttggaaatccttgaccttatcgacagttcgataaatatagacatagcagagttgatggacagattaccactgtgcacaagggaaaacaaaaacttacagttacaggagctccatctgggccaagttcgatagggtacttcaggagcttacgcatccttgatctcagctataacaatctcagaggaagtgtacctactgaaattggtacccttacaaatttgacctatttggatctaagcaataacaacctcggtggagtaatcacggaggagcactttgtaggtctgatgaacctaaaggaaattgacctgtctttcaataatttgagtgttgtagtggatgcagattggatccaaccattcaggctggagtctgcagggtttgcatcttgccatttgggccccctgtttccagtttggcttcgccagcagctccttcatatcactacgctagacatttcaagcacagggttggtgggaaacattcctgattggttttggtcattttcaagggctggttctcttgacatgtcttacaatcaattaaatggtaacttgccgacagatatgagtggcatggcctttctagagctaaacctcggttcaaacaacctcacaggacaaatgccaccatttccaagaaacatcgtattgttagacatctctaacaattcattttcaggcatcatgccacacaagattgaagccccactgctccaaacactagtcatgtcctcaaatcaaattggtggcaccattccgaagtcgatttgcaaattgaagaacctgtcatttctagatttgtcgaacaatcttttggaaggtgaaattcctcagtgttctgacattgaacgcttagaatattgtctcctaggcaacaacagtttatcaggaacgtttccagcatttctgcgcaactgtacgagtatggtggtcttggaccttgcatggaataatttatctggaaggttaccttcttggatatgggagctgaaggatttgcagtttctacgtctaagccacaattcattttctgggaatattccgtctggaataaccaacctttcttttcttcaatacttggatctatcaggaaactacttttttggtgttatacctcgtcatctttcaaatctaacaggtatgaccatgaagggatactacccatttgatattttcgacaagacggtatctaaattcgatgatatatggttagtaatgacaaaagggcaacaactcaaatatagtcgggaaattgcatattttgtaagcattgatttatcaggcaactacttaacaggtgaaattccattgggtatcacatcccttgatgccttaatgaatttgaatttgtcatcaaaccaactgggtggaaaaattcccaacaatattggtgccatgaggttgctggcatccctggacctctccatcaacaagctttctggtgaaatcccatggagcttatcaaacctgacatctttaagctacatgaacttgtcctacaacaatctgtcaggaaggataccctcaggccgccaactggataccttaaacgcggacaacccgtcacttatgtacataggcaacagtggactttgtggacctcctcttcaaaataattgttcaggaaatggtagcttcacgcctggttatcacagaggcaataggcaaaagttcgagcctgcatcattttatttcagtcttgtattggggcttgtggtagggctgtggacggtgttttgtgctctgttgttcataaacacatggagagttgcttatcttgggctcctcgacaaggtgtatgacaagatctatgtgtttgtagctgtaaaatgggcaagtatgactatgagtgcagcagctgcagaatgagagcacacaaccaatacaatgtaagtactgcgtgtgagttcgtccaaataaagaccatgttctaattaatccttctgttagctgtaaaccataatattttttggactcgaacactacatgtgtaactatattgttttggcagatttatatgtttatcaatatatggctttttcatcattgaatgactgaagtccaggttgtaattttgtagtttgaatagcattctgaaattgataagtgaaccaaggagagcaggaagcaatgcttgtataaatacagcattgatttgtgtaattgtgtatcgtgtaaataaactagttttcctgtcatccaaattataactttcagcaataaactagttttcctgtgtaactagttttcctgtgtgtctagttttcctgtcatgtaattgtataaatacagcattgatttgcgcacgcatgcatggagctagacacaatgatgatgaatcgccactctgcacttgtgtgtcgtgagttcagcttgggtaacccacctgaattgcgtctgctttacgagtcaacattaagattggaaaatgaattcatccctctctctctctacaacagagcaaacaaactgaatctaatcgaattgaatcggaactttacagaagcatgcagacaaatactctctttccttctactacatacagatacagtcaacctgccatgccactgcctaatactgctacaagctatcgaacacttaagcctagctccagttagctcagtcactgcatagtgcatactgcattttcaattagcgatcgtttctgtattcagttagctagtctgttcgtttgtgtcattcgaaggtggagccccgatatttggaggtcgatgtcctgaagaataggtccacttagttgtgtccacgaactgaggacgcgcacaacgtgcggcgtggggaactgactatggacctctggaactgagcttcaatcggatagagacatttggcatcggagctgactatggacctcgagcgtgatgtctctctcatcggagcgctctcggacaccccagcgtcatggacgatctccaactcgacgacaacgcaatcgggacgtcgtcattgagcgcgtcgtcgcagcggctggatcgacgaactacccaatgctgatgaagtccaactgcaacgactggtcgcttctgctgatgaagattaatctcgagaccaggtacctctggaacgccattaatcccggtgatgttgagcttcatgtcgcgtgcctctggaacgccatcctcggtgacccggaggaccgtgcgaaggtcgttgagaagtaactaaacatcgcacgtagtatgtacaaacagcttgttatccgtagggtgggcattctgtctattaggctaatttagttcgatctattcagattttgggaaccgaaattttcaaaataattttaggaacccaatccaaatagatcgataattttaggatccagcgcg

SEQ ID NO: 5624 - DNA, 1264 bp, Zea mays
gtgtgaaccccgtcgcgccacacggatggtataagagtacattgggtccctccaggccggcccccctcggaaggatggcggcggcggtttccagggccatctgcgtccagaaaccgggctccaaatgcagcagggacagggaagcgacctccttcgcccgccgaacggtcgcggcgccgaggcccccgcgcgccaaagccgccggcgtcatccgctccgactccggcgcgggacggggccagcagtgctcgccgctgagggccgtcgttgacgccgcgtcgatacagacgaccaaaaagagcaaatggcgcctcagtctcccgcgcgcaagctacaacggttcagggtccggtgctgcggcggctgagccgtctaccgtgggagacaccttggaacgggaggagggcggcggcacagaggcaggcgcttcggctgatgagtcatccaaccggaagcagccgccccctgttgaccccaagattgagaaggagctcaagaaggtagttcagaagactgcggcaacctttgcaccaagggcgtccacgaaaacaaagaaccctgctgtccctggaagtaccctgtacaccgtctttgaagtccagggctatgtttccatgctgttgggcggagcactttccttcaatctcatattcccatcgaatgagccagacatctggaggttaatgggaatgtggtccatttggatgttcactataccttcgcttcgggctcgtgactgctccaataaagagaaagaagctctcaactacttatttctcctgattcctctgatcaacgttatgattccattcttcgtgaagtcctttgctgttgtttggtcagcagatacagttgctttcttcgtgatgtatgcatggaagcttggatggctgcaaaggttgaaatgaagatttttggtgtgctctcttggtgatgtgtgtatgaaagcttggatatttggtttgaaaaggtggagtcggtagcttttttgctgagagaaacatttgtcctcaaaattttcacatcttttggagggagctgcatgattagtttattccaagatttagttcatatagccttttatatcttgtgtatatgcagggagtatgaaaaaacagcctttcacatttaagtgataaatatatgtacctgaagtctgaacatttttgttgactacgaactgaacagctctaaatggttcttgatttctcaataaaaaaaaaaaaagacaatatctatgttgactgctttttctgaaaatgaa

SEQ ID NO: 5625 - DNA, 1077 bp, Zea mays
gttccccagctgtcccagatcgtgtaccgcaagaacagggcgtggagaaaccgatcatgaacttgaaaggcttcatggtcgggaacgcggtgacggacgactaccacgaccaagtgggcacgttcgagtcgtggtggaaccacgggctcatctccgacgccacgtaccggctgctggacgccagctgcgtgcacgacagcggcgagcacccgtcgccgcggtgcaacgccgcctacgacaaggcgacggcggagcagggcgacatcgacccctacagcatctccgcccccacccgcaccccgacgtcgtcgtcgtcgtctacgccgaggaggatgaggctcaagggccgctacccatggatgagggggtcttcttatgacccgtgcaccgaaaggcactccaccgtgtactacaaccgcccggaggtgcagcgggctctccacgccaacgtcaccgccggcgccggcgcccatgaactacacgtgggcgacctgcagtgacaccatcaacaacaactggggagattcacccaagtccgtgctccacatctacaaggaactcattgcagccggcctcagaatatgggtcttcagtggagatacggacgcggtagtccccttgacagcgacaaggtactccatcgacgccttgaaccttccaaccgtcgtcagctggtacccttggtacgacgccaaggagcagaagcagcagcaggaggttggtggatggagccaggtgtacgaggggctgaccctggtgacggtccgaggggcggggcacgaggttcctctccaccgcccgaggcaggcgctcatcctgtttcgccacttcttgcgtgggaaacctatgccgcctaagaacggaactgttgtgtagtagtatttgttttctcggcataattaatgatgcaaaaataatttatcgcgcgccttcagtctaaggccatgtttggattcggtactactaaagtttagttggactaaactttagtgactaaattttagtcactaaaatctaccgtttgggtccggtgactaaaactttacacacaactattattactggacataaagactg

SEQ ID NO: 5626 - DNA, 4999 bp, Zea mays
  misc_feature (2072)..(2072): n is a, c, g, or t
gtttgttagtacgatatgaataaaaagaagacaaaaatacacataaaccaccattgtcgtgacatagtttgttttctcaataaatataaaagagatggtaaaacgaaactaactcttgttctaggtgaaaatgttagggaagataggagtccgggtgaacctaacaaaattgaaccgattccccctccctccgcctctaaacatatcgacaattcctcctccctcctcccatcgcttgcccctcgctcccctccctctccgcgccgccccctctcgaatcgaaatccctctccgccatgccgaagggcgccaagaagcgcgccaagctcaagaagcagcagcagcagggccaccccgacgatgccggcaacaccaacgccagcaacggcaactgtaacggcagcgatgacaacaacagcgcctcgagcggccgcgacggcgaccaccacctgcggatcccacccaaagtttctcgtggtacgaatggcacctaactctcctctaagccggagcagatccgcacgccgctttcggcaccagcggggtgggaatcaccttttcgcgtgcggcgagggtggcattcgctgtcgccgcgggtttctccgccaccatgttcccaccggccgccgctttacgggctgttcgcgctttccttgctcccttccttgcgctatatgtatgatggatgcgtgtggtttctgatgctgtgcttgtgcgtgggttgccccagtggatgcgaacgaggactccatggagagctctgaggagatggtcaccccccgagctgccgcgtcggagccggatgaggaggagactaaggccactgcggccgaggtgcccgtggagcgcaccgtcgacgcggacgtcgccggttctggggaggtcatagtggacgcgtttccgccggaaaccgttggacaggaacgtgagggccccgcgcgtccggcagaggtggaggtgcacgccgtggtggcgcaggaaccggaggtaaaggatgtggtggtggccgaggaatccgtggttcaggagccagtgtctgacgcaccggtggcagaggcttcagaggtgaaggagttggccaaggtgcattcggtgcttgaatctgagccgagggttgatgaagggcgtgatgaagtggtggtggtcgacgaaacacctgtagtgcctgaggtacaggaaccagaggtgaaaggcgttgatgctaccgttgtgttgaaggaacaagagaagaatagtggcaatgtggtggccaaggactctgctgaggtttcgcgctctcaggaggctgctggtgtgcatattacagaggtaaatggtgtatgtggtttagttctattcatctctcacatttcaaatctctgagttctgattgggtgggttctatttcctgcaggtggagcggggacctgcagtggcagtgattgctccagggcagcgggcaatatggtggaatttctgcggcctttttgatgcctttactggttcagggagatagatgaaggtgagatggttctatacttctatacctcatgattgtgttttctataatactcttgttgattttaattgacacaatttcttatttctaaacacactgtaattattgccaaagaaattggtcttggggaaatatggtcgtgagttttactggttacacctttggaatatgaggtgcatatctgagttcattgtggatagcttaagtggcgagattcattgcaaatgctgttcaacgtcagtgtacaagttataactataatttaacctgcagtttataacatgtaaggaacccataaaattgcaaaacgatggtgtttttgtgggtactgagcaaacgcttttttcagagtgaacttttgggccatgagatgcagttttgtatctctcacacatggtttaaaaatgacttgtgatattgttatgggccttagcccattagctatgtcattatggctaggttagatgcggccactgttcacgtgcggttactgtagcgcgtgaacagtgccggccaaatagggtttgttatgttgcttagctattaagttagggttacctctctatataaggangggtagggtgttgttagtagaggggggaagaaaatagatctggtttactcctagggccctacgggagggctgagtaccgggactatcttgcgagtgcatcgcagttcacaacagatattcttatcattattgttggatgtcattggtgaaggtagcaggctagcagctaaagttcttcgcttagcttctggtttgatttaataagccttaatgaccattagttattaaatgtctgcccatatagcttatgaagttgagttttttatttcacttactgagttttgaatgtagaatactctacccagttataagcagtgattgaactacagaaaatttaccaaacaagttttccaaatcaactatggtgcctccccgtgcccctgaagggtgcaaggtgaaaaataaaaggctgtctgtacagattagggggatgcagctatacaatcaccatactcaagttccatgcttttttaatctatttaataattcctttgagactttggatttatttgtggatttttttctgacatttttaagggagtaacattgtcttctattgattctcactgtcctttcgccggttccattttcttaaaaatctagcaacaatatcgatcaggcatggatgtttgtctacaaggagggcgtccttattggctttgcatgattgtctatatgatgaatggatgcatcatatcctgagggatggatgttttagtgtctctaagctttttggtaaaaagtttatctcagtcatatgaacagcttcatagttggcttagcgttatttcctttgaacattgttttccaaatgctgataaactgcccatggaagatagattatacattggggtgtaatacctgaaacttgctgaaaagccacaccatttatttgaaactcagtatacatgtcatgcacatgaaaacggtgcacaaaatttacaccgttatagagggcactcatattatggacatgaaaaatgacttcccactgtaactggagatgatctattacttctcttctatttggcagcataatgtgtatctttgtcaatagaagggccaaggacaaatactcaagtcaacactcacattgcagagagaacagaacagaactaaacaatcataaacgatcacctgccagactaggtttcttgaatatgatagcacctgcttgctacatgtggactgaactgcaattgcggtactcatcagtcataacaagaatacttggtcgatttccccttatgcctccatgagtatatgcatttgtctatgttgtgttctatatatatcaacattggatatgatcaactgagggcccgttcggttattcaggaatctactccaggaaagattccagctggaataattgtataatttgtagtataaattggtaacctggaatagttcctagccttttccagcctaaccgaacggtgccttactgaaaatgataacagccagtcctgacaaacatgatccgccacacttgctatgcttgtagcagctctgctggataccgctgttcagaaatagacaattgttttccaggcttctgaggatgaaatgaaacatatatttggcagttaattgatactaccactagtatttaagcatctcatctaacactctttcttacagggttggaacttgaagccaagaagacaaatgtggtgacgttcagtttaaagctgatgagcagttgtaactagactttttgtttgcatagtcacatgaatgtatgatgaagcagcaggatttcggataacatcgcgctgatgtttacttcctccctgtgtctctgcatgcgtgcaaagctacaccccccctggtcgtggactcatggttaatatccttaatttccttagtatccccaacgcctagtgccctttgtctagtgtcgtctaggtactgcctggtcttgtagcataagagttgaggtgggtcgaccgtaaagaaaattttgttgtttctgcctttatacttattttttctggggtgtcgtctgctatgccccttcctctcatggttgtcacttgtaagatatttattcaaacaatttgagatggttctttgaaaagcctcaattcgagattgctgagtgtcagccaggtttgtcataatttggttgaattccgtgtttgggtatggttgccgccaaaaatgtgagcatcttggctgctacagttgtggtattttaaactaaacagattacatgctggcgtgtttgaacaactatcaggcttaaagataaacttccaaaaagtgaactcttttgttttgatcaagccaaataagaagagttctgctccatgctatttggatgcaaactagcctctctcctatttagatacctaggcattctgatgcattttaggaaagtaacaaaaattggaaggcagtgaaggacaagttcgaaaagcggttgagttgttggaaagggaagtggttggaaagggaaattaatctcagtagggggaggctgattttgattaactttgtgctatctagcttacctatgtttatttatccttttttcaagtcccacacgatgttcttaagaaaatggattattatatatcgatgtttttttggcagaacgcaagaagtactatctcgttaaatgagaaatactatgccaaccaaaagaccagggagggcttgacattatcaatcttgatcttcaaaataaataccttcttaccaagtggttgtttagactatgtaatgaagacatgatgtggcaacagttgattcaaaacaaataccttaagaatgtaaccctaagtcaagtgtgcaaaaaactaggcgactcacacttttagtcaggcctaatggatattaaataccaatttctaaatcttagaacttttgtagtaaaaaaaatgggacccacccaagttaggtcttgggaagatgtgtgg

SEQ ID NO: 5627 - DNA, 1543 bp, Zea mays
aggagtccgggtgaacctaacaaaattgaaccgattccccctccctccggctctaaacatatcgacaattcctcctccctaaaaaaatcgcttgcccctcgctcccctccctctccgcgccgccccctctcgaatcgaaatccctctccgccatgccgaagggcgccaagaagcgcgccaagctcaagaagcagcagcagcagggccaccccgacgatgccggcaacaccaacgccagcaacggcaactgtaacggcagcgatgacaacaacagcgcctcgagcggccgcgacggcgaccaccacctgcggatcccacccaaagtttctcgtgtggatgcgaacgaggactccatggagagctctgaggagatggtcaccccccgagctgccgcgtcggagccggatgaggaggagactaaggccactgcggccgaggtgcccgtggagcgcaccgtcgacgcggacgtcgccggttctggggaggtcatagtggacgcgtttccgccggaaaccgttggacaggaaggtgagggcaaagtggatgaggcagaggtggaggtgcacgccgtggtggcgcaggaaccggaggtaaaggatgtgttggtggccgaggaatccgtggttcaggagccagtgtctgacgcaccggtggcagaggcttcagaggtgaaggagttggccaaggtgcattcggtgcttgaatctgagccgagggttgatgaagggcgtgatgaagtggtggtggtcgacgaaacacctgtagtgcctgaggtacaggaaccagaggtgaaaggcgttgatgctaccgttgtgttgaaggaacaagagaagaatagtggcaatgtggtggccaaggactctgctgaggtttcgcgatctcaggaggctgctggtgtgcatattacagaggtggagcggggacctgcagtggcagtgattgcttcagggcagcgggcaatatggtggaatttctgcggcctttttgatgcctttactggttcagggagatagatgaagggttggaacttgaagccaagaagacaaatgtggtgacgttcagtttaaagctgatgagcagttgtaactagactttttgtttgcatagtcacatgaatgtatgatgaagcagcaggatttcggataacatcgcgctgatgtttacttcctccctgtgtctctgcatgtgtgcaaagttacacaccccccctggtcgtggactcatggttaatatccttaatttccttagtatccccaacgcctagtgccctttgtctagtgtcgtctaggtactgcctggtcttgtagcataagagttgaggtgggtcgaccgtaaagaaaattttgttgtttctgcctttatacttattttttctggggtgtcgtctgctatgccccttcctctcatggttgtcacttgtaagatatttattcaaacaatttgagatggttctttgaaaagcctcaattcgagattgctgagtgtcagccaggtttgtcataaaaaaaaaaaaaaaaaagggcggccgctcgcgatctagaac

SEQ ID NO: 5628 - DNA, 1926 bp, Zea mays
tcgaggtcctttagctctaactaatatacagtagcctgttaattttaaaaacatgcatgagctgttagctagctgacgtacacgtggccgcgtgcgtttgtgttgtttggacgcgctgtctgctgttgacgtacagtacaggacggccgtttctacccgcggtgaaaacgacgcccccgtttccctggtctctccgctcgccccccgtccgggacccatcccccgcccgctccgccacagtccacacaggccccagccatggaggcggccccaacccccgagccggggccgcacgtgcttgtcatccccttccccgcgcaaggccacgcgctgccgctcatcgacttcgtcgccctcctggcggcgcgcggcctccgcctcaccgtggtcacgaccccggcaaaccttcagcttctctcctctctcctcgccgcacaccccaccgccgtccgcgccgctaccttcccgttcccctcccacccgtccctgcccccggggctcgagaataccaagggttgcagcccggtgcagttccccgccttcgtccacgccttggccgagctgcgtgggcccatcctcgcgtgggttaaagcgcagcccgatcccgtcgtcgccgtggtcgccgacttcttctgcggatgggctcagccgctggcccgcgagataggcgccgctgggatcgtgttctcgccgtccggcgtcctcggcaccgccgtcccgcactcgaccttccgccgcctggtgaggcgccccgcggagtgcgatggcgacgacgagttcagcgtctcgttcccggcgattcccggcgagccgtcttaccagtggagagagctcttgatgatgtacaggaactacatggcaggcgctctggacgagcaggtcggcgcgtcggtgaggcagaacttcatgtggaacctgcacgacagctgggggttcgtgttcaactcgttcagagcgctggaggggaggtacctggagcagcctctcgaggacctgggcttcaagcgcgcctgggcagtgggccccgtggctccggaggcggacgccgcggttgcccgcggcgggcaggcaaccgtcgagctcgccgatctcagcgcgtggctggacgcgttcccggaaggttcggttgtatacgtgtgcttcgggagccaggccgtgctgagccccgccgtggcggcggcgctggccgaggcgcttgagcgcagcgccgtgccgttcatgtgggccgtgggcgacgccgtggtcccggacgggttcgaggcgcgcgccgcggcgtcggggcgcggctcggtggtgcgcgggtgggcgccgcaggtggcgctgctgcggcatccggcggtggggtggttcgtgacgcactgcggctggaactcgactttggaggcggtggccgcgggggtgcccatgctggcgtggcccctgacgggcgaccagttctttgacgctcggctgctcgtggacgaggcccgcgtcgcggtccgcgcatgcaagggcggcctcggctttgtccccgacgcaggtgagctggcgtccgtgttggccgacgccaccggggagaagggccacgacgtgaggacccgcgccaaggcactcgcggcagaggccgcccgcgccatgaagcctggcgggacatcgtacgcggatctagagctgttggtgcaggaaattcggaatcggaagcttagctagctccctctccaggaatacatcagcttgattcccatgcgatctaacttgatcgcactgaaaggtgatgcaagatgatacaagactgaaagatgatacaagactttaagttatgtaattttagttgttttgtatgaattgtataattttatctgttcaattatgtatttggatgtatttattcaataaaataacatattttatgtcacctaaaagtctataataaattgacgtttcgct

SEQ ID NO: 5629 - DNA, 887 bp, Zea mays
gcccgcttcgagccggccgggccgggacgctctcccttccctccctccctccacccgccgccgccacccacaaaccctagaaaccctagcaccccctcgcccgcggcagccatggcggagcacgacctgacggcgagcgtggcggcgtggatggacccccacctggtgctcccggtgctggagttcctccaggagcgcggggtctacgccgacgaggagatcctccggggcaagatccgcctcctcggcggcaccaacatggtcgactacgccatggacatccacaagtcgctccacggcaccgacgacgtccccgccgacatggtcgcccgccgctccgaggtcgtcgagaggctccgggccctccaggaggccgtcgcgcccatcgtcgccttcctctccagcccgcagctcgtgcaggagctccacgccgacaagcagtacaacctccacatgctccaggagcgccaccagatcggcccggaccagatcgaggccctctaccagtacgccaagttccagtacgagtgcgggatgtactcggacgccgccgatttcctgtcccagtaccgcgctctgtgcaccaacagcgagaggagcctcagcgccctgtgggggaagctggcggccgagatactgatgcagaactgggatgtcgcgcaggaggagctcaacaggctcaaggagatgattgactccagcagcttcacctcgtcgcctgtcaaccagctccacagcaagatttggctcatgcattggagcctcttcatcttcttcaaccatgagaatggaaggaacgggatcatcggacctcttcctccaggacaggtacctcaatgctatccagaccaacgctccccatcttctgaggtaccttgctgctgcag

SEQ ID NO: 5630 - DNA, 851 bp, Zea mays
aaaaaaaaaaaaaaaaactactccagttgttccggttgcgcttgcagagagatcgggtcggggaggatgacgacgggagggcgcgcggtgctcctgctgccgctgctggtggtctcggcgctgttcgcccagatccgcgcgtcggatccgctgttccacgagtccttcgacgagggcttcgaggggagctgggtcgtctccggcaaggaagagtactcaggtgtatggaagcacgagaagagtgatgggcatgaagactatggtctccttgttagtgagccagccaggaaatatgccatagtcaaagagcttgatagccctgttactttgaaggatggcacagttgttctgcagttcgaagtgaggcttcagaatggcctcgagtgtggaggtgcttatcttaagtacattcgccctcaggaggctggatgggatgccaaggaatttgacaatgacactccttacacaattatgtttggtcctgacaagtgtggttcaacgaataaggttcacttcatcctgaagcacaagaaccccaagactggcaaatatgttgaacatcacctcaagtccccaccctctgtcccatatgacaagctctctcatgtctacacggctatcttgaagccggataacgaggtcagaattttggttgatggggaggagaagagcaaagcaaacttcctttccgctgatgattttgagccagcacttattccatcaaagactattcctgaccctgacgacaagaagccagaggactgggacgagagagctaaaatccctgacccagctgcagtgaagcctgatgactgggatgaggatgcccccacagaaattctggatgagga

SEQ ID NO: 5631 - DNA, 2184 bp, Zea mays
tcctgcaggtagtgggtgtgagagactgaaaatgagtgtgttttgcattcgggatgcaaataatttttttcctcgtttatgctgtcacctacatactgttgagtaattagacatttttatattaaattccgaatataaattatgaccaacaataaatagtctaggtgtctattccacaacaaggaactaacatgttacataacggcataattatataaatacaacacacatctaccataatagataaactgaagtataatatcaaagtagatgaactttgaaaaaaccggtggttaaccaaaaccacgtctcggtggtttcggtaaaccgaacgatttatcgccaaaaccgactggttttgtaaaccttgcttgcaacacataggagcagtgcatgatgcatgtctgacataagtgggtgtttaagattgctccatattagaactctaatttgacgctacaatttacaatataaatttaaatagtttttaaaaatatttttaatctaaaccatagacaaaataatttcttcactaatttttacaattttagttctaaaattttctgaagcatctaattatccttcaccataaattgtttttagagttagagcagttttaaataggatctaaattaggtgggttataggaatagttttgccgtttgcatatctatatttttttcctacaggctagtagatatattttaaaactttattgtttgaaaccttatattttgaattcagaaactttatacaagcatcttaaaacctttctacttgaatatttagaacttatgtcgcgtagagcacacgcgggaggaaagcgagaagccccagaacggctggccatcggtttatcgcatcagtctactacggctcttcggagtacaaattattgcaatattgtttttccccgcgcagaaggttccggaagcaagggacgtttctggatacagggcgttccgttctctccagctgcgtataaattctgccccaccgtgtcatctcccgcaccgtctattcttgggctgtcggcctcacgttttccactgcttccagaggcttcctctcgagtccgcagtctctcttccctacgaagttcagaagttgtcacaatgactcatatccttggccacacattgtttttttttctgttcctgttgttctatcgattcttgtaagggcgggttttgcagttcgttgctcttttatgtcatggtggactcgttgttttttatgttttctgttggaacggcgtgtttcggatgatggttccgtttcgtccttgacctgggctgggctgcacgcggcgaccagagggaacgcgaccggcagagggcgcaggcgcggcggcccgcggccaaggggcgcgacgacgggctcaccccggagcagcggcgggagcgggacgccaaggcgctgcaggagaaggctgccaggaaggcggcgcaggccgcgggaggcgcctgcgccaagggcggcaagaacaccggcaagaagtagccggggtctttactctttagttcgcaggatctgctcgtgttggaagatctgtatttgcctagatctggaatgcaatgcgatttcgtgggcgttgtctcgagcagtgctgaaacaacggttcacagtaaaatttgtagcaaagatttaaaaagaacgagggcgttggcactttgctttgcaagtgatctgcgtagcgtgccgccgcccgtttgaaggtaattttgttaacaaaaggatgggctcattgaccatcagaagtttacgaacatagataaaaccgaacacacctccaacagacgcttaggaatgttgttaaaaaaacctggcgaagtaaactgacagtaaagaaaaagaacctgatgaagtcagctttcattgataaagaacaaaatgcgatttggttgcgcccgctttcgggtccatgctggaaacatccagaacaagattaaaaaaacaaaacaaagggttgataaaaaaacaaaagcagaaaacatcaccttctagcctgttatgggtcggtagtcagtgcctcggctttagtcatacatcagctagccaagtggctgtgggcagcttaaaagagagagtcctccttctctcatcagtctggcttttggctctcttggctgggccagcccacgagcgcatgaacgtccgaagctgtcgagtgtgagctggccg

SEQ ID NO: 5632 - DNA, 518 bp, Zea mays
tgggaccctcgaggccggccggggtctattcttgggctgtcggcctcacgttttccactgcttccagaggcttcctctcgagtccgcagtctctcttccctacgaagttcagaagttgtcacaatgactcgcggcgaccagagggaacgcgaccggcagagggcgcaggcgcggcggcccgcggccaaggggcgcgacgacgggctcaccccggagcagcggcgggagcgggacgccaaggcgctgcaggagaaggctgccaggaaggcggcgcaggccgcgggaggcgcctgcgccaagggcggcaagaacaccggcaagaagtagccggggtctttactctttagttcgcaggatctgctcgtgttggaagatctgtatttgcctagatctggaatgcaatgcgatttcgtgggcgttgtctcgagcagtgctgaaacaacggttcacagtaaaatttgtagcaaagatttaaaaagaacgagggcgttggcacaaaaaaaaaaaaaaaagcggcc

SEQ ID NO: 5633 - DNA, 1048 bp, Zea mays
  misc_feature (897)..(897): n is a, c, g, or t
  misc_feature (955)..(955): n is a, c, g, or t
  misc_feature (992)..(992): n is a, c, g, or t
ggcaaagacaggcaaaaccccgtccaacaccctctcctcctccgcttgctccgtttcccccaaatctgccgcacgacccaaacaaaacccttgcggcggcgacccaccccatctccggcggccaagcggaatggagcgctcggcggcgggcgcctcgtaccagcgcttcccacgcgtgcggatccgcgagctcaaggacgagtacgccaagttcgagctcaaggacaccgacgcgagcatggccaacgccctccgccgcgtcatgatcgccgaggtccccaccgtcgccatcgacctcgtcgagatcgagagcaactcctccgtcctcaacgacgagttcctcgcgcaccgcctcggcctcatcccgctcacctcctccgccgccatgtccatgcgcttctcccgcgactgcgacgcctgcgacggggacggctcctgcgagtactgctccgtcgagttccacctcgccgcccgcgccaccgactccggccagacgctcgaggtcacctccaccaaggacctccgctccaccgaccccaaggtctgccctgtcgaccagcaaagggagtaccagcaggccctcggcaacgtcgacgcctacgagcccgatgctgccggtgaccacaggggcatattaattgtaaagctgcgccgtgggcaagagctgcgtcttcgagcaattgccaggaaggggattggaaaggaccatgccaaatggtctccagctgctactgtgaccttcatgtatgagcctgacatatgtattaaccaagaactcatggagacacttacacttgaggaaaaacaaagctgggtggagagcagccctacaaaagtatttgacatcgatcctgtcacccaacaggtgacgattgtggacccagaggcctacacatnatgacgatgaggtgatcaagaaagcagaggccatggggaagccaggattgggtagagnatcacgccaaggaggacagcttttgtgtcactgtggnagacacgggggccattacagcctatgagctgattatgaacgctatcacggtcctga

SEQ ID NO: 5634 - DNA, 959 bp, Zea mays
agtacaagaagaccactcccctcgcccccgcggcgcctcctccctccccccagaaacataccgccgcctcattccctcccaccacagcacccctcctcgtcctcgtccgatccgcccttccggaagcacctgggaggggcagcgccagcgctccggccgccatggcgctcgccttcgacgagtacggccggcccttcatcatcctccgggagcaggagaagaagtcgcgcctgcaggggctcgacgcgcagaaggccaacatcgccgccggcaagtccgtcgcgcgcatcctccgcacctccctcgggcccaagggcatggacaagatgctccaatcccccgacggcgacgtcaccatcaccaacgatggggcgacgatcctggagctgatggatgttgacaaccagattgcgaagctcatggtggagttgtcccgcagtcaagactatgacattggagatggtaccaccggggttgtggtcctggctgggtcgctcctggagcaggctgagaagctgctggaacgtggtattcacccaataaggattgccgaaggttatgagatggcgtcgaggatagctgttgatcaccttgaaagcatctccacgaaatatgagttcagtgctacagacatagagcctttggtgcagacctgcatgacaactttgtcctcaaagattgttagccgttggaagcgggctctagctgagattgctgtcaaagcagtccttgcggttgctgatttggaaaggaaagatgtaaatttggacttgattaaggttgaagggtaggttggtgggaagctcgaggatactgagctagtacaaggaatcattgttgacaaagatatgagccacccccaattgccaaagagaattgaggatgctcacattgccattctgacctgcccatttgagcccccgaaacctaagacaaagcataaggttgacattgacact

SEQ ID NO: 5635 - DNA, 675 bp, Zea mays
cctcgaggccggccgggcccacgcggcggccaaaggaaggcttgtgttgtgtttggctagggtttgctcgcgtctcctccttcccttggctgctgtcgtgccggtcggcggcgacagcaagggagggaacatgtcgaagaagaacaatcttgccaagaggaagaagcagtacgagttcgacctccaacgggagaaggaggccaaggagaagcaggccaagaagctgcaagccaagaaatccaagatgaagatagatggtgctgaaaagaaacgtaaaggtggccaatttaaggtcggcaagaaaaaggtgaagacgaaactttcagccttagcaaaagccaaagccgcgcaagccatggaggtcgacaagtgactgcggagcacaagcatcatcagcttaatcgtcgagccagagttggaactctgaattctgtgcccacatgaatagctcccgtcgggtgcagctgcagcttgttgaacctttctttctaaaaagaatgtcattcttgctttttttaagggtaatcaagctctagttataggttttggtgataacgactatgatgttagagaactaatgagatttatggagctaaatgaaaaagagaaaaatacatgtgatttttgatgcttcaatgccgccagaaaaaaaaaaaaaaaaaaggcccctagggc

SEQ ID NO: 5636 - DNA, 620 bp, Zea mays
  misc_feature (602)..(603): n is a, c, g, or t
  misc_feature (614)..(614): n is a, c, g, or t
gggtgttgtgtttggctggggtttgctcgcgtctcctccttcccttggctgctgtcgtgccggtcggcggcgacagcaagggagggaacatgtcgaagaagaacaatcttgccaagaggaagaagcagtacgagttcgacctccaacgggagaaggaggccaaggagaagcaggccaagaagctgcaagccaagaaatccaagatgaagatagatggtgctgaaaagaaacgtaaaggtggccaatttaaggtcggcaagaaaaaggtgaagacgaaactttcagccttagcaaaagccaaagccgcgcaagccatggaggtcgacaagtgactgcggagcacaagcatcatcagcttaatcgtcgagccagagttggaactctgaattctgtgcccacatgaatagctcccgtcgggtgcagctgcagcttgttgaacctttctttctaaaaagaatgtcattcttgcttttttaagggtaatcaagaattcaagatctagttataggttttggtgataacgactatgatgttagagaactaatgagatttatggagctaaatgaaaaagagaaaaatacatgtgatttttgatgcttcannaaaaaaaaaanccatgt

SEQ ID NO: 5637 - DNA, 2379 bp, Zea mays
tcttctgtagtttggtcttcatctatataattaattttgtaattagactatatttaatactcgtaattgatattcaaacattcgatgtgacacgaactaaactttagtctggaaaactaaacaccttacaatcatgtggcgaaaggccccgcttggttccaagttactaaattttaatcccatcacatccgatgattgaatactggttagaaatattaaatatagtctaattataaaattaattatacaaataagaactaaatggtaagatgagtttatcaagcctaattagttcatgattcgcttatgtgatgctatagtaaacatttgctaatcatatattaatgaagtttaataaatttgtctcgtcgtttgtctttatctatataattagactatatttaatatttgtaattggttcgaacatatgatatgacacatactaaactttagttaggggaaccaaacacccctagtactcttaagttccatcaagttctctcatttgcgcaattcagcttcatgtttgactgcctacatttgtgacctgaagtttttactataaaccattttatgtacttgttagctctttgccaagttcttcgtgccacctaaatgactttgtccaacacatgccatgtgatgtgcttcgcttctcatcgtaattttgtggctgtcgtcttaaaccaccagaactgtaatcctttggtagcattctgtgtttggtcctctggagattttctgttcactcctagtctatggaagcagtaacgtgcagggccagacgccagccggcaccacatgtcagtgaccggccgacaggtacgtccctgcacgttactgtagaggatccggttggctagtttataccttgagtttttttttctctcatctggctccttgaatttcgctgttttggtttggttttgtacttttgcctgttttatttaagatctggattaccaagctatggctgtggctccacattccccttcattccgaaaccagaactgtaattcttggggcactctgggttccataaatatatgaaatctgcacttggcgccctgagattggcaagttacacttcatttgtgcatcgctatctataaaccctatgctggcttctatggttcatcaaatttcactacacgttcgatcatgataatgcactaacactaagatttgtcttaactaactcttttttctcaaactgttcagatagatggtgctgaaaagaaacgtaaaggtggccaatttaaggtcggcaagaaaaaggtgaagacgaaactttcagccttagcaaaagccaaagccgcgcaagccatggaggtcgacaagtgactgcggagcacaagcatcatcagcttaatcgtcgagccagagttggaactctgaattctgtgcccacatgaatagctcccgtcgggtgcagctgcagcttgttgaacctttctttctaaaaagaatgtcattcttgcttttttaaagggtaatcaagctctagttataggttttggtgataacgactatgatgttagagaactaatgagatttatggagctaaatgaaaaagagaaaaatacatgtgatttttgatgcttcaattactaaagaaggacgcgacaactgattaaaggatatttaaattcatttatatttgaaatttaagtatagtaaagccgcactattaaaaggatataatgcacatgcttcattatacaggcttcatgtgtgcaatcatacgctcaaatggtctaccacagtattctcaaagcctaggtacaatagtacgcctcttattttccatactcttggctgcttggtttaagtggcattgatgcgacattactcaaccgtaaagctctttttctcaagcttttcttaaccttttcagtttaattatttgagagattgagtctacaaactatgctagcgagcttaaacaacctattcttcaaccctaagcatagccgacggttatgttcgttagacattaatcaccaaaatacttagaaatagtctaagggcacatttccctttcaacaatgtcgttaggctatcatacatagataacatggttatgacgcaacaggtcatgatacagacattaatgactatcgtagagagagaggtatggttggttaagataccagaggatggcctcaatagcgatgcattgaaataacgggatacacctgctccaccaccataacatgtgtggcaagtgtaacactatacgaaaataacatgggtataccacgacacagactagggccatcacccaccaaaagattggaataattcacatcgactggacatgatatcttaggggatcatgaccgtagtaaaagtgcgagaaacattgaagggtaggca

SEQ ID NO: 5638 - DNA, 935 bp, Zea mays
gggaattccgccatccccgccgccgcccgccgcacaccacctccaccgcccacgaaatcttctccccgaagacgcgcgagccccgccggagacgagaggcatggacgccaagtcggtgacgccgggcgccgtggccctcatcctcgccaaccccacgccggcgtcgcccgacgacgtgccggagatcgtcgtgcaggtcctcgacctcaagcccatcggctcccgcttcactttcatggccagcgacggggaggcgaaggtcaaggcgatcctctccacccacttcgcgtcggaggtccactccggcaagctccagaacctcggcctcgtccgcatcctcaactacacgtgcaacgacatcccacaaaagacggacaagatggtgatcatcaccaagtgcgaggtcgtgtcccaggcgctcgacgccgagatcaagagcgaggtcaggatagaagagccagcggctctcatgaagcccaaggaggaggctgcggtcctctccaagcccattggcggggccccggctgcgattatgctgaagccgaggcatgacgtgaagtccgcgtcccagattgttagcgagcagcgcggaaatgctgctcccgctgctcgcttggccatgacgagacgggtgcatcctctgatctccctgaacccctaccaggggaactgggtcatcaaagtgcgggtcacaagcaagggcaacctcaggtcatacaggaatgcccggtggagaaggccatgtcttccacgtagagctcactagatgaggatggcacccagatccaggccaccatgttcaacgagcctgcaaagaagttctatcccgtgtttgagcttagggaaggtctactacatctcccaagggggtcgctcagaattgcgaacaagcagttcaagacagtccagaatgactatgagatgaccctgaatga

SEQ ID NO: 5639 - DNA, 884 bp, Zea mays
cgcctttccctttttcccccacttgggaaaagggggagtgcttcaaggcgattaaattgggtaaccccaggggtttccccctcccggccttttaaaacccgcgcccgggaattttataccgctcccttttggggggaattgggttccggggccccccctcggggtaaattttggatggccccccccccccccccccccaggtttctccatttccatatttagtttttaactacgcttctgtggctacgaacgtcaaatatttacccatacatagctggttccatggctggaaccatacatgaaactttccttgcaatatacagtgggaaacttctacagagcttggctgtagcaactagccaagggtcattcttgtcggtggatcagattatctacaatggaatcggctttacaattgctgcaacttccactgctgctatcactatttatgcaaagaaagcgcttcaaaagctccaagcggaggacgagatattttgagaggtccaaggccaggatcaaacccgtaacgctagttttctttcaggtgtactatatatgaacagctggtactaatctggtttcctgtgtcgactaccggactgctactaccatccatctgaggaagaggagggggggaggtgcttcagcaattgtaaagaaaatagaggcccagagtttttcgttcttgttttgttttctgtagagagaattaccaacctcatctgtgtattgcaattgcgctatgtaaatccccaagttgaaagttgtttccttatcttgagaagtataacaaggtatgctggctgcgtcgaaatatattaaaaaaaaaaaaaaaaaaatttgcgtgttgtatagtaatgcatcttaagctaatatatatacga

SEQ ID NO: 5640 - DNA, 2154 bp, Zea mays
actcccacctcacctcccttcccttcccctctccgagtccgctctccgctccaatgccgttgcctctctcctccacctgcttcttctcataaacgcttccggcctcccggagtcccggacacaaaccctagcattcaatcacgccgagctcgccggaacaagcccaacccgagcccaagcccgctcgggccccagccgatccggcggctcctcaccagtacaatccggggtacccgcggatgctagcctgatcgggtccccacggtcgatgggttcgcccgggtccgccaatggcagacgcggcgactatgtgaggatcccggaggaggcggaggtggcgtccaagggggagggagatgccgcggcggccgtcaaggcggccgcggcggcggagtgccctagggtgctgcggtgcagcgcgatccggtggtgggccaaggtcgccgtgctcgggatcttccttgctggggccggagctgctgctgtcgtcttcctcggcccgctccttatcaagaagattgttgtacctattcttcactgggaatcaacaacgttcagcagaccatctattgctctaatatgtttcggcacaatcgcattattcccaagtgttttgttaccttcttcgcccttcatgtggcttgcggggatgacttttggatatctttatggttttttaataatcacagtgggtatgagcataggcatgtcattgccgtattttataggttctgcattccactgtaggatacatagatggttggagaagtggccaaagaaagcagcttttgtaaggcttgctggcgagggagattggcatcatcaatttaaggctgtagctttactcaggatttctccatttccatatatagtttttaactatgcttctgtggctacgaatgtcaaatattacccatatatcgctggttccatggctggaaccatacatgaaactttccttgcaatatacagtgggaaacttttacagagcttggctgtagcaactagccaagggtccttcttgtctgtggatcagatcatctacaatggaatcggatttacagttgctgcagcttctactgccacgatcactatttatgcaaagaaagcacttcaaaggctccaagcagaggaggagatattgtgagcgcatgaggtccaagcccaggatcaaaacccataacgctagtttcctttcaggtgtattatacatgaagggcttgtttggcagcaaaggggaggggaatctagcccctccaaccccctccatttcccttgctgccaaacatgcctgaacagttgctactaatctggtttcctgtgtcgactacctgacttgccgctaccatctgaggagagggaagggtgggtgctgaagcaattgtaaagaaaaacagacccagaaaaacttacgttttcggttcctgttttgttttctgtaaagagaactatcaacttcagtgtattgcattgcgcgatgtagattcccaagtcgaaagttgtttcctcttggatgctggcagcgtcgatatccatgacatgcactgcaggcatggcatgcgtgttctacagtgacagcatcttatgctgatacgtacgttctgggggattattctaaaacctattcattaggctctctccaacaagagacgctaaagcgttgaggcccccaacaatagttcgctaaattatagcgtaggctggggggccggtaaatctggcgtctcattcatccgctaaacaggcgaccagtaaaaaaagcatgcagcgtagatatgctaacgtatacggctaccagtaacatgttgctgggaatcaagaaaatatagagagaaaatcttttagagagtgatgtaacatgttgctgaaaatcaagaaaatagagaatagaatcttttagagagtgatgtaaagggcatgaaatatacttttagaaatgaaatttagtgaatgctgctagagccttatgcttattatgacaatccctcccggagacgttagctgggaaatccctctaggaaatggtcctgtttgtcatattttagtttacagcttctttataggaagctatttcaaacagggtgtttttgcagagttcagttgtttttccaaataaactaaaagtacacaataaacaaaagctagataccaact

SEQ ID NO: 5641 - DNA, 1625 bp, Zea mays
ttgggtacctcgaggccggccgggaatgccgtcctatttgcgcacctgccgcttccgctttacgcctccggcctccccggcacaaaccctagccctcaatcacgccgagctcgacggaaccagcccaacccgagcccatttctgctcgggtcccggccgatccggcagctcctcatcagcacaacccggggcaacgtcccccagcggatgctagcctgatcgggtccccacggtcgatgggttcgcccgggtccgccaatggcagacgcggcgagtacgtgaggatccctgaggaggtggaggtggcgtccaagggggaggcagatgccgcggcggccatcaaggcggccgtggcagcggagtgcccgagggtgctgcggtgccgcgcgatccggtggtgggccaaggtcgccgtgcttgggatcttccttgcaggggccggagctgctgccgtggtcttcctcggcccgctcgttattaagaaggttgttgcacctattctttactgggaatcaataactttcagcagaccagctattgctctaatatgttttggcacaatcgccttattcccaagtgttttgttaccttcttcgcccttcatgtggcttgctgggatgacttttggatatctttatggctttttgataatcacagtggggatgagcataggcatgtcgttgccgtattttataggttctgcattccactgcaggatacatagatggctggagaagtggccaaagaaagcagcttttgtaaggcttgctggcgagggagattggcatcatcaatttaaggctgttgctttactcaggatttctccatttccatatttagtttttaactacgcttctgtggctacgaacgtcaaatattacccatacatagctggttccatggctggaaccatacatgaaactttccttgcaatatacagtgggaaacttctacagagcttggctgtagcaactagccaagggtcattcttgtcggtggatcagattatctacaatggaatcggctttacaattgctgcaacttccactgctgctatcactatttatgcaaagaaagcgcttcaaaagctccaagcggaggacgagatattttgagaggtccaaggccaggatcaaacccgtaacgctagttttctttcaggtgtactatatatgaacagctgctactaatctggtttcctgtgtcgactaccggactgctactaccatccatctgaggaggaggaggagggggggaggtgcttcagcaattgtaaagaaaatagaggcccagaaaaacttaagtttttcgttcttgttttgttttctgtagagagaattaccaacctcatctgtgtattgcatttgcgctatgtaaatccccaagttgaaagttgtttccttatcttgagaagtataacaaggtatgctggctgcgtcgatatatattacatacactgcagccatggtttgcgtgttgtatagtaatgcatcttaagctaatatatatacgacgaaatcctatggggctattaggaaacatcatcgttgatgctgatatatggacattctgaaatgccagaagtgttggttgcgtttggatggttaaggaagctatattttagc

SEQ ID NO: 5642 - DNA, 718 bp, Zea mays
cggccgggccgggaaaacttggacctggaagcttgaggcgccaggccccgatcgatcaagcgcacctcccttcggagagaggcatcagccgtccatctccggcgccggctggctcgacctcggccgcagtcatgtcgaagaagaaggcggtgacgacgatgacgctcaaggacttccacggcggctccatcccctccgagctccctctcccctccgcccccggcgtctctgcacgaccgcccgaccgccccacggccgctccgtccgcctcttccactgcatccgcgcgcccgcgcactcccgccgcttcctccgcagcggcggcggctgccgctgtcccttccttcctcaccaatccctcccgcatcggccgccacttcgatgaggacgagcgcacgcccttcgagctggccgcgcctcgccgccctgcgccgtcgcccccgtcgttcccctccgtgccggcggtggcccccgctagatctggaccgggtaacgcctggggtgcgaagagggaggtcgctccagccgcgccgccggttgttcctgccgccagcagcggtcagatctggtcggcgacgcgcatcgcgcaggcgagcgctgtggagaaggtaatctccggtaggtggcatttgtcgaagccctcctccccgcccgcgtctgtgtcggcaccagtgctggagactcacggggtctgccctgagatggagaggtcagggtt

SEQ ID NO: 5643 - DNA, 802 bp, Zea mays
ccgctcgagccggcggcggacgcccttcagccgctgccgccaccaccagagctcagtccgttcgttcgttcgttcgttcgttcgagcttagagaaggacgagatgaggatgtcgctgctgagatccgcgtcgcagcacctgcgccgccgccgcgactactcctccgcctccgcctcgcccgagcgcaaggtggccatcctcggcgcggcgggcggcatcggccagccgctggcgctgctcatgaagctcaacccgctcgtctcctccctctccctctacgacatcgccgccacgcccggcgtcgccgccgacgtatcccacatcaacacccgcgccctggtgaagggcttcgtcggggacgaccagctcggggaggcgctggagggcgccgacctcgtcatcatccccgccggggtgccccgcaagcccggcatgaccagggacgacctcttcaagatcaacgccgggatcgtcaagggcctctgcaccgccatcgccaggcactgccccaacgctctcgtcaatatgatcagcaaccctgtcaactcgactgtcccaattgcagctgaggtgttcaagaaggctggtacctatgatgagaagaagctgtttggtgtgaccactcttgatgttgttcgtgctaaaacattctatgctggaaaggcaaacgtgccagttactggggtgaatgttcctgttgttggtggccatgctggaatcactatcctgccactgttctcacaggctactcctgccagtaatgcattgtcccatgaggaccttctcgccctcacgaagagga

SEQ ID NO: 5644 - DNA, 827 bp, Zea mays
cgggaaacatccgatccaatccaatacagccccccatccgatctcgccgggaaatctctccgatcgaagcgaagcgaaggctctctcgtcctcctcctcaagatgcagatcttcgtgaagacccttactggcaagaccatcacccttgaggttgagtcctctgacaccatcgacaatgtcaaggcaaagatacaggacaaggagggcatccccccggaccagcagcgtctcatctttgctggcaagcagcttgaggatggccgcaccctcgcggactacaacatccagaaggagtccaccctccacctggttctcaggctccgtggtggtatgcagatatttgtcaagaccctcactggcaagaccatcaccctggaggttgagtcctcagacaccattgacaatgtgaaggccaagatccaggacaaggagggtatcccaccggatcagcagcgtctcatctttgccggcaagcagcttgaggatggccgcacccttgcagactacaacatccagaaggagtccactctccacttggtgctcaggctccgtggtggtatgcagatcttcgtcaagaccctcacaggcaagaccatcaccctggaggttgagtcctcggacaccatcgacaacgtcaaggccaagatccaggacaaggagggcattcccccggaccagcagcgtcttatcttcgccggcaagcagcttgaggatggccgcacccttgcggattacaacatccagaaggaatccaccctccaccttgtcctccgccttcgtggtggcatgcaaatctttgtcaagaccctcaccggcaaaacatcacc

SEQ ID NO: 5645 - DNA, 855 bp, Zea mays
cggatgcgccccgcccccaccctgctcgccctcaccctcgacgccgcgctcctccgcatcgccaccctccgcgacctctcccgcctccccgaccacatcctcgtcgacctcttccgcagaacccttagtgctggtaagctgacagagagagtcctcaagttgtttctggcaaccgactgcgaggagatcatcttgcttgttcagctcctcaacattaagcagccacttctaccggtccttcccacgaggtgctctgagaagttctagtactgctgctgcttagatcaggctgattagctgtgaagatgtctttggaagttcatgatagcgaggttgacattgtgattgcagcactccagcccaacctgacctctttctttcaggcgtggcagccatttttctcccggtttgacatcattgttgtcaaagacccagagttggcagcagatcttcagatcccttcaggttttaatgtgaaggtttacacaaagtctgacattgatggactgcttggtgccacatccatcaacttctctggccactcatgccgttactttgggtaccttgtctcacgcaagaagtatgtcatctcgattgacgacaactgcctcccagcaaaggaccctgccgggatgactgttgatgctgttacacagcacatgatcaatttgaagacacctgctactcctttcttcttcacacactgtatgacccataccgcaagggtgctgactttgtccgtggataccattcagcctgcgtgagggggttgaatgcatgctctcatgtgggctctggctgcacaatgcggactatgacccaatgacccatgtcgtgaagcggaaccccacgcac

SEQ ID NO: 5646 - DNA, 710 bp, Zea mays
taggggccttttttttttttttttttgtacaaacagttcagtggattgctggatcatagaaccgtgaccaacccaaaaagagagagagagagacgactaagaattacaaccagaagtccactttgcgaattctctcacaccatacatacacgcacgcaagagttttacgagatagcccatcctggagccctgggtacccctacattgtcttatggatagtatgtatagaaaattaaagggacagtatttccaaaacgcatgcagttgtcttcctcaggattgcgtagggctggctgtcacacaacaaaaccatttcttcgtgcttggctttgcagcataagattccaccctctcagtcctggtgtccttggaaggtgactcagtgtcttggccgttcccacccttcttctcgtctctggctttgttgaatatgacagtgaatccgtctgcagaagctggatcattaacatcccaatcgccaaactttggcaaggggcggcctgattcctccgccatgggtggattgcgcagagcaggggtcccgatccggggctgcgctgggtgggagggacgaagaggaggaaaagtcaggcacaggcacagcggagataagagcagaggagacgaatcgctgtggagaattgaaaaggaaaaggaaagctggtgacggagaacttggcaacttgtactgagtccggaacccggccggc

SEQ ID NO: 5647 - DNA, 1328 bp, Zea mays
cttttctttttcaattctccacagcgattcgtctcctctgctcttatctccgctgtgcctgtgcctgacttttcctcctcttcctcccctcccacccgcaaccgcacagagaaaggggaggaggctctctacccagcgcagcccgagcacccctcccccccggatcgggacccctgctctgcgcaatccacccatggcggaggaatcaggccgccccttgccaaagtttggcgattgggatgttaatgatccagcttctgcagacggattcactgtcatattcaacaaagccagagatgagaagaagggtgggaacggacaagacactgagtcaccttccaaggacaccaggactgagagggtggaatcttatgctgcaaagccaagcacgaagaaatggttttgttgtgtgacagccagccctacgcaatcctgaggaagacaactgcatgcgctttggaaatactgtccctttaattttctatacatactatccataagacaatgtaggggtacccaggcctctccgggctccaggatgggctatctcgtaaaactcttgcgtgcgtgtatgtatggtgtgagagaattcgcaaagtggacttctggttgtaattcttagtcgtctctctctctctctctttgggttggtcacggttctatgatccagcaatccactgaactgtttggtactgctaaaaaaaaaaaaagccaagcggccaagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctatctctctctgcatgtttggcgtcagtctttgtgctcatgtacgtacgtgtgtctacctgcatgttggttgatccgattgcatctgctgtaaccatatattaattggtccacgatgatatgatttgatactatatatatactaaaaccggacttcttattataat

SEQ ID NO: 5648 - DNA, 856 bp, Zea mays
actcctactttattattgtttttattttaatttatttcccgggggaccgcgaggccgcgggcgagcagtcctccacaccagtgcggcttttcctttccgttccactccacatcgattcgcctcctccgctctttactcttcgtcgtactcgtctcctcccacccgcaaccgcagggagagaaaggggaagcccgccgccgccccggcccccagcaaccagcagatcgggacctctgttctgcgcaatccatccatggcggaggaatcaggccgtcccttgccaaagtttggtgaatgggatgtcaacgatccggcttccgcagacggatttactgtcatattcaacaaagccagagatgagaagaagggtgggaatggtcaagacacagactcaccttccaaggaccccaggactgagagggtggagtcttatgctgcaaaaccaagcacgaagaaatggttttgttgtgtgacagccagccctacgcaatcctgaggaaggcaattgcatgcgctggaaatactgcccctttaattttctatacatactatccataagacactgtagaggtacccatggctctctgggctccaggatgggtgtctcataaaactctggcgtgcatgtatgtatgtatggtgtgagagttgtcggcatacatttgcaaagtggacttctgcttgtaattctagtcctgtctctctttttttttttcctgttggtctgctagtaaagaaaaaaaaaaaaagtgcccctatcaaagtggattgagtgggattaaacccttcccgttcaaaattgtacttgaagggcggccatcctcctcaatccctttcaatctagatgcaactgaac

SEQ ID NO: 5649 - DNA, 1486 bp, Zea mays
tgtaatcgtgcttcgggccagcccggccctatgggctgaccgggctacaggcacggcacggcccgtttctgcctctttcgtgccgtgcttgggccaggctttcaacccgcgggctagcacagcacggcatggaattgaatcgggccgtgcccggcacgcccaaactcgtgtcgtgctttgccgtgctcgtgccgtgccggcccagcacgcacgaatggacatgtatagcttcagatcacttgttcaattggcttggcggtctgttggaccaccggcatctcatgtgagctccatttcgtcacttgttcaactgtcccatcgactgctagctgaagccaactgcagtggtgtttggtgctatgatatcacgatgtgctgctgccataccgacctgtttgatactccttgctaagcggccttccacagcatgggtcatgaggaccacatgtaaagtaggtccactttgtcagttccagaccttgcacaccacatttgtttctagggcacagatcagtcggtggtcccaacaaacaaacatggggtcctcgtgccacttcccagcaccgaaagcacagcaccggcaccggcacgccaccagacactcggccccatcagagtctcatccaaatcgtactcgcactcgcagacgcgtcatgcaacatcgcactcgccgtcctcatggccttgtcgcttgcccaacaatacgatccccattggactgagctatatatccatgtcgaagtggcctcgggccgggccggaatcaccaatctcaactcagcgagctctccaccagttttacagccaagaaagaaccaaccatgatcagcaccaagaggatcgctcagctggccaagaagtggcagaggatggaagcgctcgggaggaagcgccgcctcgcctgggggacggcggcggcggcaaagaaagccgacaggtgctgcgcctccgtggcgagcaagggccactgcgcggtgtacacgactgacggggcacggttcgaggtgccattggcgtgcctcgggacggaagtcttcgccgagctcctgcacatgtccagagaggagttcggcttcgcgggcggccacggcaggatcttgctgccctgcgacgccatggtcatggagtacgccctgtgcttgctgcggaggggcgcctctgcggacctggagaaggcgttcctcagcaccatggcgatgtcgtgccactctgcagaccacgcggcggcgccatatgtggcggcttgctgttagtttgcagctgtataagtagtggcagagagttcatcactgtatatagtaggacaaagagaggtgttgttcagatcctgcgacccattaaggaaggtagcgattagcaagttagcgccagtgctcttgtttgagcagtgagcatattacagcttaatttcacgcccaaaaaattaatttcctgagcataattttcagggtattgcccaaaaaaaaaaaaaaaaaagccgcctagg

SEQ ID NO: 5650 - DNA, 743 bp, Zea mays
ggccctaggggccctgctttttttttttttttttcagtaccaaacagttcagtggattgctggatcatagaaccgtgaccaacccaaagaagagagagagacgactaagaattacaaccaaaagtccactttgcgaattctctcacaccatacatacacgcacgcaagagttttacgagatagcccatcctggagcccggagaggcctgggtacccctacattgtcttatggatagtatgtatagaaaattaaagggacagtatttccaaagcgcatgcagttgtcttcctcaggattgcgtagggctggctgtcacacaacaaaaccatttcttcgtgcttggctttgcagcataagattccaccctctcagtcctggtgtccttggaaggtgactcagtgtcttgtccgttcccacccttcttctcgtctctggctttgttgaatatgacagtgaatccgtctgcagaagctggatcattaacatcccaatcaccaaactttggcaaggggcggcctgattcctccgccatgggtggattgcgcagagcaggggtcccgatccggggtggaggggtgctcgggctgcgctgggtagagagagcctcctcccctttctctgtgcggttgcgggtgggagggacgaagaggaggaaaagtcaggcacaggcacagcggagataagagcagaggagacgaatcgctgtggagaatgaaaaggaaagagaccggcccggcccgcc

SEQ ID NO: 5651 - DNA, 1209 bp, Zea mays
cattgggtacctcgaggccggccggggaggagaaaagccggttccacccaaaccggccgggagtacaagttgccaagttctccgtcaccagctttccttttccttttcaattctccacagcgattcgtctcctctgctcttatctccgctgtgcctgtgcctgacctgtcctcctcttcgtcccctcccacccgcaaccgcacagagaaaggggaggaggctctctacccagcgcagcccgagcacccctccccccggatcgggacccctgctctgcgcaatccacccatggcggaggaatcaggccgccccttgccaaagtttggcgattgggatgttaatgatccagcttccgcagacggattcactgtcatattcaacaaagccagagacgagaagaagggtgggaacggacaagacactgagtcaccttccaaggacaccaggactgagagggtggaatcttatgctgcaaagccaagcacgaagaaatggttttgttgtgtgacagccagccctacgcaatcctgaggaagacaactgcatgcgttttggaaatactgtccctttaattttctatacatactatccataagacaatgtaggggtacccagggctccaggatgggctatctcgtaaaactcttgcgtgcgtgtatgtatggtgtgagagaattcacaaagtggacttctggttgtaattcttagtcgtctctctctctctttttgggttggtcacggttctatgatccagcaatccactgaactgtttggtactgcaaaaaaaaaaaaaaaaagagccgccccctgtgatgcatcgcagataggttagggagaatgggagatgctgctccgtgcatgaagacagcacactggcgcagggcgtcaaggcgggagggatggggccgcgacggggaggcccagctggagaattggcgcgggctgtgacgacgaggcatctctaagcgcgggcgtgggcctccttcgtggctccatgggcgtgggtacggccgcacggaagcgagtcggagataggctgatccgggggacgggaaaaagtacggcttaaaaacggtacggtttgaaatagtgccatctacaatacaaaatattgtaaaacagtatttagatgattatatagtcgaattattggacacaatctaatacgacttttccaaacacactggtacaaataattaaactatgaca

SEQ ID NO: 5652 - DNA, 660 bp, Zea mays
ttgggaccctcgaggccggccgggaaaaacccgcccgggccgcttactcttcgtcgtactcgtctcctcccacccgcaaccgcagggagagaaaggggaagcccgccgccgccccggcccccagcaaccagcagatcgggacctctgttctgcgcaatccatccatggcggaggaatcaggccgtcccttgccaaagtttggtgaatgggatgtcaacgatccggcttccgcagacggatttactgtcatattcaacaaagccagagatgagaagaagggtgggaatggtcaagacacagactcaccttccaaggaccccaggactgagagggtggagtcttatgctgcaaaaccaagcacgaagaaatggttttgttgtgtgacagccagccctacgcaatcctgaggaaggcaattgcatgcgctggaaatactgcccctttaattttctatacatactatccataagacactgtagaggtacccatggctctctgggctccaggatgggtgtctcataaaactctggcgtgcatgtatgtatgtatggtgtgagagttgtcggcatacatttgcaaagtggacttctgcttgtaattctaaaaaaaaaaaaaaaaaaagcccccaaaaaaggggaaggggaaaaaaaaaaaaaaaaa

SEQ ID NO: 5653 - DNA, 3437 bp, Zea mays
gagaactatcatttgtctctctctgaactctctttgccactgagtagattacaacagtccgcgcgacgcttttgccatcgtcgcgcgccgatgcggggtgcggggggcagggcactgctgtgcctgtgcctgtgctgtgctgcccgttggttggcgccagtgcgctgcgcggtttgccgccatctctccagttcggaccgtgcctctaccgcccgccccactcgcgttcctgggtttcggggtccgtgcagctgggggacgaaaccgaacgggtctgtgtgtgtagcaagcagggtatgtatgaggaatattggatggtatggtagctactgttgcccaataatcaaagttcaaagcttttagcaagtaggatctgtactacttgcgtcaggaatatttaatttagcacacatctccagttgtagattgaacgcgtctttgtgttcagggagagttgccaggcatcgtgtcctactattgtgcttcgcgggcctaaaaatggggagagctaccactaccagtagatgatatgcatttagacataccaaattctggaaacccacggcgctgacaggaaatcacagaaacagttaaatacatcggaaaaaagaaaaacttcgatcgcgcagtatagctgtcgaaatccgccgtgtggcagtttccaaccgtgccactcctttctactgctagtaccaaacgcgaaccctttcccttttgcgaaccgtgtagtaataaaaaaacaaaagccagagcatcatcatcatcatcatcggatcgaaatgcgcgacctttttctttttgaaaaaaaaaacttcggcagcttccgtccgtcggccaagttcgtgaacgtgaagcaggagcacagtgtagtggatgagtttatcgagcaatcaggcacggaggctcgtcgtggtcgtgggtgctgttcgtctctctcttcccgacgtcccacccccgacccttttgatcttttcctttgactggccacctgcgctctcacgtcaaacggtttcccccctcctctcctctcctctcctctctcctccctccgctttatcttttcctcggccctgcctggcgcctgctttcaccgtttccgcccgtcgccttccacctctcgcattccctccctcccgccctccctctcactacagctcaagcgcagcgcggcacggcaccctacgtccccgactccctccttcttccactccactactcgccgcgctccccatgccctccccgtgacgccgaaaccaaatcctttttgctcttccatattactagtcctcctctccttggtcgcggcggcggtgtaggtcggcggcattgcgagatatggagaaggagaggaagcaggggttcttcgccgcgctcaaggaggaggtcgtacgggggctgtcgccggcaaggaccagagggaagtccccggcgccgcggagcgcgtcgcccgcgaggatgctgatcccgcgccggcggaaggcgcccgcggctccgccgccgccgccgccgccgccggagaaggtgctgcagcagtacctgggggagcagctcgtcgcgcgctccggcagcctgttgcgccccggcggggaggctctggcgccgctcatcgaggggcccgacgccgagcgcctcgccgccggcgaccccgacggcgaggactccggccgccgcgaggggttcgggcactgggtccgcggccacctgacgcgcgcgccatccatggccgccgcaggtggtcccgacggctcgttccggcggtccgacctccgcctgctcctcggcgtcatgggcgcgccgctcgcgcccatcccgtccaagccggccgagccgctgcccctcctctccatcaagggaaccaccattgtacgtccgtccacttgttgcccagcctagcatttggtttcgtctgtctggtgttgcttcgcttctacgagatgctgcggtctgcccgtgcatccgggacccttggcttggccttggctgaccgcactgacatgatgcaggagtcgtcgtcggcgcagtacatcctgcaccagtacacggcggcgtccggtggctacaagctgctgcagtcggtgcggaacgcgtacgccatgggcaaggtgcggatggtggcgtccgagttcgagacggcgacgcgcgtcgtgaagaaccgcgggcccagcggacgcggcgccgccgccgtggagcagggcggcttcgtgctgtggcaaatggcccgcgacatgtggtacgtcgagctcgccgtcggcggcagcaaggtccacgccggctccaatggccgcctcgtctggcgccacaccccctggctcggcgcccacgccgccaaagggcccgtccgccccctccgccgcgtcctccaggtcccagcagttcttttttttccacatcctgtttgatctctctctccgcttgtcctagcaaatcaccttacgatacgatctcctccccgtttcctttccgtctggcattggcactggcaactggcaatgcagggcctcgatccgctgaccacggcggggctgttcgcggaggcgcgatgcgtgggcgagaataaggtgaacggcgaggactgcttcatcctgaagctgagcgccgacccgcagacgctgaagctgcgcagcgagggcccggcggagatcatccggcacgtgctgttcggctacttcagccagcgcacgggcctgatggtgcacatcgaggactcgcacctgacccgcatccagccgcacgccggcggggacgccgtgtactgggagaccaccaccagctccgccctggaggactaccgcgccgtggagggcgtcatggtcgcgcactcggggcgctcggcggtgaccctgttccggttcggcgaggccgccatgagccacaccaagacgcggatggaggaggcctggagcatcgaggaggtggcgttcaacgtccccggcctgtccgcggactgcttcatcccgccggccgacatccagtccggtccagtcggcgaggcctgcgagctgccgtcgtcccagtcgcgcgccaaggccgtcgccgtgcacccttcgcgcgtggccgccgtggatcgcgccactgccgccgccgcctgccgtggccggaagaccacgtggagagtggaagtgtgaggagtgagtggcatgcgtcagttattagcacttttagcagcggcagagtctaatctgtccatactagagtttaattttggccagtccagtcatgaatcaaacaatcgaattgaatcggatccactaacctgttgcgtctagtagatatctgtaaatagaaccgtgactgatcctgggcctggatgaatctttttatccctctgaccgcagaaattctagcacaatcttcccctctctaacctctaaccttgcagcaggccatagaaatgaacggaaagcatgctttcaagataaccaaaaccaaagagtaga

SEQ ID NO: 5654 - DNA, 3417 bp, Zea mays
agccagagcatcctcatcggatcgaaatgcgcgtcctttttctttttggagaaaaaaaaacacagcggcagcttccattgttcaagttcgtgaacgtgaacgcgaaccaggaacacggtccggtggatgagtttttatcgagcaggcacggaaaaaagcaccggaggctcgtggtgggtgttcttctctctcctccccaccccgacatcccacaccgcctcttttgatctttttctttgtcacctgcgctctcacgtcctcccgcgtccccctctctctctcctccctccgctttatcttttcctcggccctgcctgctttttaaaacttccgcccgtcgccttccacctctcgcactccctccctccctccctccctcgctttcactccaactcaagcgcagcgcggcaccgtacgtccccgactcccccccttcttctactccactcctcgccgcactctccatgcccaccccgtgaagcgaagcgaaaaccaaaaacccctttgctacatcactttactagccagtcgtccccgttctctccctggtcgcggcaccggaagagggcgacggcattgtgagatatggataaggagaggaagcagggtttcttcgccgcgctcaaggaggaggtcgtacgggggctgtcgccgtcgaggtcgagggggaagtccccggcgccgccgcggagcgcgtcgccggcgaggatgctgatcccgcgccggcgcaaggcgcccgcggctccgccgccgccgccgccggagaaggtgctggagcagtacctgggcgagcagctcgtcgcgcgctccggcagcctgcgccccggcggggaggctctggcgccgctcatcgaggggcccgacgccgagcgcctcgccgccggcgaccccgacgcggaggactccggccgccgcgaggggttcgggcactgggtccgcggccacctgacgcgcacgccgtccatggcctcctctgccgcaggtggtggtggtggtcccggcgggtcgagcggctcgttccggcggtccgacctccgcctgctcctcggcgtcatgggcgcgccgctcgcgcccatcccgtccaagacggcggagccgctgcccctcctctccatcaagggaacccccattgtacgtccacttgttgcctagcatagcatttgattttgtttggtgtttgcttcgcttctacgagatgcggtctgtgcccgtgcatccggtacccctggcctggcctgggctgaccgcccccgcctgagataatgcaggagtcgtcgtccgcgcagtacatcctgcatcagtacacggccgcctccggtggctacaagctgctgcagtcggtgcggaacgcgtacgccatgggcaaggtgcggatggtggcgtccgagttcgagacggcgacgcgcgtcgtcaagaaccgcgggcccagcggccgcggcgccgccgccgtggagcagggcggcttcgtgctgtggcagatggctcccgacatgtggtacgtagagctcgccgtcggcggcagcaaggtccatgccggctccaatggccgcctcgtctggcgccacaccccctggctcggcgcccacgccgccaaggggcccgtccgccccctacgccgcgtcctccaggtcccagctgttcttcccacgcctcgtttgatcccttccccgccgacccgagcaaatcaccttacgatctccgcctctttcctttccgtctggcattggcactggcactggcaactggcaatgcagggcctcgatccgctgaccacggccgggctgttcgcggaggcgcgatgcgtgggcgagaagaaggtgaacggcgaggactgcttcatcctgaagctgagcgccgacccgcagacgctgaagctgcgcagcgagggcccggcggagatcatccggcacgtgctgttcggctacttcagccagcgcacggggctgatggtgcagatggaggactcgcacctgacccgcatccagccgcacgccggcggggacgccgtgtactgggagacgaccatcagctcggccctggaggactaccgcgccgtggagggcgtcatggtcgcgcacgcggccccccccgcgccgtccccgccccgggtcggcgaggccgccatgagccacaccaagacgcgcatggaggaggcctggagcatcgaggaggtggcgttcaacgtcccgggactgtccgtggactgcttcatcccgccggccgacatccggtccggctccgtcggcgaggcttgcgagctgccgtcccagccccacggcgagcgcgccaggaccggcgccgccgtgcacccctcgcgcgtggccgccgtggagcgcgctggcactgctgccggcgccggaggccgcggcgagaaggtcatgtggagagtgcaagtgtgagaggaatggcgcgcatcagttagcagcggcagagagaattgaaaccgattgcccgattctaatctgtccatactagtagagttttaattttcgccagcccaagtcatgaatcaatcaatcaatcgatcgaatcacactaactcgctgcatctagtagtagagagctggtttaggtttctgtaaataggagcataaacgatcccaggccgtcactgatgtcttgtcctcgggttggatgaatcttttatcctctgaaaacgcagaagttttagcaccatcctccaaaaaaaaaaaaaaaagttcccctagtcttgcagaccttgttttgatcttgagagaaagagagagagagagctcgtgcaggccatgagaaagatgtagtactggtccagttctgttcgtgtttactgtcaacggcacttgatgttcctagtactaaaaatgctgaatctgtgtaccgtttggtgctgacctgtgtggaagccttcccaaaaagacgtactgtttggcctcatcctgcagcgtggcttctggattagtggtaggatggatggcggtttagtttccgtggaaatcttgcttgcaagattactaacccaggggcacagcaggcacccggccggcagcaatagcattggatgcttggcatggcaagtggtggatcgcagatcagaaccccgtagtacgttcctgcacctgccggtctccgtccactccactcccgcttgctcttgctctccgtcactccggtccactcggctcatgctgtcgtctctcccccctctcatcagaatcagattcaggggacggacctcctggctggagcgctgggccgaccagtgaacactgctgctactcatcagacagggccggggaggagggcccagctgcaggccatagcatgacgtgacggaactggcgtcccaggtggcaactgcgtccacctccaccgtgcctgccggcggtgccggctctgccgggcttttacttcatcatctttgttgaccaagcaggacac

SEQ ID NO: 5655 - DNA, 2301 bp, Zea mays
ctctccgggaggctcgacctcggcctccgggactgcgcgctgctcgtcaagaccggcgtcctgtcggacgccgccggcccgtcaccgccgccggaggaggcgcccgacgtccgggagctgctcgcgcggctgcagatcgggcacgccgaggccaggggccgggccgtggacgcgctgctggacgcgctgcgcagggacgagcggggcgtgctggcggcgctcggccgcgccagcgtcgccgcgctggtgcagctgctcacggcgtcggcgcccgcggtccgggagaaggccgccacggccgtgtgccaggtcgcggggtcgggcgccgcctccgaggcgctgctcgtgtcggagggcgtcctgccgccgctcgtcaggctggcggagtccggcagcgccgtggggcgcgagaaggccgcggccacgctgcaccgcctgtccgcgtcgcccgacgtcgcgcgcgcggtcgtcgggcacggcggcgccggcccgctcgtcgagatctgccggacgggggactccgtctcccagcccgccgcggccggcgcgctcaggaacctctcggcggtgccggaggtgcgccaggcactggccgacgaaggagtcgtccgcgtcatggtcggcctgctggaccgcggcgccgtggtggcgggcgccaccaaggagcacgccgccgagtgcctgcagaacctcacgtccggcagcgacggcctgcgccgcgccgtcgtgtcggagggtgggctgcgcagcctgctgctctacctggacggcccggtgccgaaggagccggcggtgggcgcgctccggaaccctcgtgggcgcctgtctcgcccgacagcctcggggcgctcggcgtgcttcctcggctggtccacgtgctcaaaatagggtcggttggcgcgcagcaggcggcggcggcggcagtctgccggatctccagctccgccgagatgaagcgcgccgtcggcgagcacggctgcgtagcgccgctggtgcgcatgctggaggccaagtcgaacggcgcgcgcgaggtggccgcgcaggcgctggcggccctggcgagctgccctgccaacgcccgagagatgaagaaggacgacaaatgcgtgcccagcctggtgcagctgctggacccgagccctgcgaacacggctaagaagtacgccatcgcctgcctcctcacgctctcggggaccaaacgatgcaggaaggtcatggtctcgcacggcgccatcggttacctgaagaagctctccgacatggacgtggccggcgccaagaagctgcacgagaggctggagcgcggcagtctacgcagcatgttcagtagatagtagcagctgttactattttattgccttgcgaaagtttcacctctactgtatagaaaccaaactcagtctcacactctgtatgaaatgaaatgaaaatgtctcttcaggaactaataagcctagtaagtgggccgccgactagcaagatcagccgtccagatttgtgcaacttgatttgttacggacgtcaagatcacatctggtgagagttttccttcagaaatgcactcagctccatatgtcaatgctcacatctgtggctgaatgaaattggaacatcctttttaccatccagatagacaatgttccaacgaaaaaactattccaaatttagaaatgcgtgaggaatttgtttaaaaaatggaaaatatcccgccttcgcaacaagattgccggggttctaatagaaaaatgttctggaagaaaaatgttttcagattacaagaaaattgttccagccacacgataaaattatcctgcttagtaacaaaaaaatgtaacatgattggaaaggaaatttgccacatacatgcattttgctctataaatgtaaatgctgttctctaaacaaaaaagggtagattaaagagaaaaaatgttatgctcatgcatgcaagtttttcatgatttttttagatttattccagttcaatggcaaataatattctaactttttaaggggaaatggattttggaacaagggcccatttgaatttctcctctaaactttggagctaaatctatgaacaagtggtctaaaatcagacctaaactttagcacatatctttagagctcaaaagtgagataaagtgctctaaaacttttagagctccaaaatttagatgaggatatccacacatatactaaatctgaaactaggtttaagggaaaaaaggaacaaaaaaagaggaagccaaaacaacaaaatagaaagttattctgcttaataacaaaagaatgtatatt

SEQ ID NO: 5656 - DNA, 2652 bp, Zea mays
attcagcggaatgtttacccttgctgttttgatgggtttgcagtttcctgttggacaaactaatattgatgggatacttcaccttcgggagaacgaattgaaacgacatgctggggagaaatctacggcaatagaagcatattgtgcctatgttgctgaagggttcgaaaacctgctggactggaatgatgttatgaagttccaagcgaagaatggatccttgtttaactctccttctgcaactgctgccgctttggtcgccaactatgacgacaaagcgctacagtatctaaatttgcttgtcacacaatttggcagtgcagtaccaacagtgttcccacaaaatattcactatcagctttcaatggtggacacgctcgaaagtgttggaatatcacggcatttttctgtggagaaaaaggctgtcctggacatgatatacagtttgtggttacagaaagaggaggaaataatgttggatgcagaaacatgtgcgatggcatttcgaattttacaaatgaatggctttgatgtttccacagattggttgtctcatattgctgaagcctccaatttccataactcactacaaggatatttatgtgatacaaagactctattggaaatgtacaaagcctctaaagtcatattatcagaaagagacttgaccttagagaacataggatgttggacaggtagcttattgagggaaaagctatgctccgtgggcgcgcccggggtaccgatacttgaagaggtagagtatgcccttaagtttccccattatgccgtagtagatcctctcaacaacagaagaagtatggagcatttggatgttaggggttctcagacgctaaagacaaaatatctgccatgtcatgtaagtcaagacatccttgcgttggctgttgaagatttctgtttttctcaatctatttaccaggacgaactacagaacatcattagttgggagaaagagaataggatggaccagctacaatttgtgcggcaaaggctggcatattgctatctcgctgctgctaccaccatatcccctcatgaattgtctgatgctcgcgttgcatgtgccaaaagcatcatgctcacggttgtagttgatgacttcttcgatgttggtggatcaaaagaagaacaagaaaatctcatcgaattagttgagaactgggatgagcaccacaaagttgagttctgttcggagaaagtagaaatagttttctatgctgtctataatacagtgaaccagcttggatctatggcttctgcagtacagaagcgcgatgtgacaaaacacctcgctgaatcatggctaaaagtattgctgtgcatgctgacggaggcagactggcaaaggaggcaatttgtaccaacagttgaggaatacatggcaaatgcagtttcctccttggcactggcggtcattatacttccagcgcagtattttcttggcgaaacgctctcagattacatggtcaaagatcatgaatacagcaatttgtctgagctcatgttcacttgcagtcgtctcttaaatgacattcgaagcgttgagagggagttcgaagctggtaaactgaacagcgtttcactgcttgctctacacagtggtggttccatgtccatagaagcggctaagaaggaaacacatggatctttagagtcgtataggagaggtttagtagcgttggttcgtagacaggacagtgttgttcctaggtcatgcaaggagctgttctggaagctttgcaagacaattcacctgttctacttccagattgatggatttacgtcgccgaaggagatggttggggcagtcaatcaagtaatcaacgagccactcgaactccaatcaagcaacacacatgtttagtttagctgttcgatctatttgaagattaaggactctggaaggacaggtacttccccggagacgatgcaaacaatcattggtgggtcaccatacaaacagtgaccttagttgtttgggcctcgcattgaccttgttaaaggcattatctaaaataccgagtgtctttttctctttaatgaaaacctttgatttggccttttgttggttggtcatagcaacgacgttgcttttggagagcctcagtctcggctctagctttgcctggttagtggttgacttgaaaattatgttgtggtgatagctcgctcaaagtgatgagtttgttttttctgtcttttttcttctttttttgcctgtgtgtgtacatcttagtgtgtagagtccaggataaatcttagtccacttgtatcatcttgatgtaattgtctaagattaataaagcttcctaatacaaacaaaaaaaaaaaaaaagaccccaaatatttctgtaactattatgaactatttcatatggttgtccggtttctcggattacggtggatctacgcacaagattttagtgaccgccaagaatttcaatggcggactgtatctcagtctttgtgtgctgggtggtaatatatatctatacgaaattgatatggatttctgattgtattttaaaattattgtacgagtgttatatatcacctacggtttatagatagagatcaaatcaattaggttggatttttctttgtaagccacgatatgagctattccta

SEQ ID NO: 5657 - DNA, 2042 bp, Zea mays
tgtacatataatccccttcattcgctgactttcaacaagccctgatgaggcagcgccccggagagcgaggcttcgagatttaggcgacgacaggacaagaaatgttgagaaggcacgaggtggccaggggattttggttgggctgcttcgttcaggctcctttgatttgacgatgatcttgtacgcttcctgtcataataagaaaaggaaaatgtggaagagaaaacatagtcggattcgtatgaaatctacggattcgtatgaaacctacggattcgtatgaaaacatagcccgaaaaaggtgtcttctatatttatctatatctctattggtaggtctgtttctctctaccgtttctcggttaacaacatgcgcaaagtctgttacacaagaaactacttaagcttaacacaacaggaagtcgcacgcatcatgacgttcatatatagtaacaccccgctatataaaagagaaacggtgaatgagtgggctataataaaaatgagatcgagctccttttcaactcacatctttctcgatcttaccttttaattaagataaaatataatatttattttcattaatttaatgtctgatatattatttaatgagatcgaactctttttcatatgttcattttaatattaaatttattatttatgggtatcaaatatgatattgtgcagcagcaacgcattagtattattgtactagtaacatttaaatcaacagcggactctatccgagctggacgctaataagctgctaaaaaaacatccactaacttagctttggactgatggctcatctgctcattagaaaccaacctaaacaacgaaattccgcttcctgtcaactgtcatgctccttacaattccggagaccatgcctccgtcctacaaattgaggaatacgtccggtaatctagctatatccctgtccacttgtccattatgtctacagtctggtgctcttctgtcctctcggcgacggcgacctcagtgccaaagaatccctcgcgcagtaatccaagtaaccatcttcgcttcaccttctccaactcctccgcaaaatcaagctgccacagattctcttcctgtagaagtaaccgtcctcctcctctctactactgggcttgcatcgagtctcggaggaggatatcttgtggaggtaataaagagccccaaggttgcatggatgtgtctctcatgttgtttatagatatatttatgcctgagattgcagctccatctttattgtttttactggattaatgtctgaatatatatagcttgccatttttcattagttcaaacaacagcacaatctggaacgagggttgtcgaaagaaatgcaagcctagaaatcgaggtaccagcagcattcctgaatcctgatccttccatccaagtactttgagccttttgacacggtattctttacaaagttctttgtcttgatcatgataaactaggaacggcacgccagaataaggaagccggcggcgcccccgaggctgatcgcgctcccgccggcgccaacacgcggcggctgctgctgctggaggacacgcaagcccgcgatccccgcggcggcggcgcgcctcaaggtctccgcctccgccgcctcgtcggacgtgccggacttcctctcgtccaattggtcagtacccgccgtttcgacttcccttgcccctgctgcgtcttgctctgcacgtatgaaaagtcagctaggttgagtatacgttatgggatttagtatgattaggttgagtaatcagggcagacacgaatagctagctgatggggcctctggttttggtttttagtgagttctctaactcatttttgtgactactacactacaccacctttttttgcccagcaataaagtaaatatattcattagaaatttagaatggaacaaaattccatgacaatattatttgggttggttaccgtgatccaaacagtccgctattggaacaaaacccgagcgcaaaacacacacacacaaattgttcaggtttatacatcagggg

SEQ ID NO: 5658 - DNA, 2420 bp, Zea mays
gcacgagaccattacctagaacatcctaatcgaaaaaactattactagtagattattcaaacacccgtctagttctacttgttggaagggtgccgctctccacgagatccaaacccccgcacccgcggcgccggcgacgcagggaggaggcgatgcacggccgcccgcggcgaccggccaagcccgaggacgaggaggcggcgtcagcgaaagccgccaagcttcgggacctccaggcccaggtcctgcacaatcaccatggccgcacgtacacaaaggaggcaattgggctgagcttcaagctgctcgagataaatccagaggcctacaccgcatggaactaccggaagcttgcgtttcagcacaatgtcaaggagctttctgatccggaggccatcaagtctgctgttgatgatgagctgagagtggttgaggttgctttaaggcaaaacccaaaatcctatggagcttggtatcaccgtaagtggttgctatgccaaaagctagcgcccgtggatttcaaacgtgagtttggcctcttggataaactgttgaaggtggacgccaggaattttcatggatggaactacagaaggttccttgcaagattcatgggtgtgtcagatgaggaggagctaaagtatactatggataaaatcagcgacaacttcagtaattactcagcatggcataatcgtagtatacttctgtccaacctactgatccagcagagcaaaggttttgagtcaaagcagaagattttttccgaggagtttgaacttgttactcaagctctttttacagatccaagtgaccaaagtggatggttctatcacctttggcttttagctcaaacgtcttgtccagataacccccagctgattgcttcatggccttctaatgctgcaaagctcagttcctctttgatcaaggaaaaagctgagcagcacagacagtcatccatcttgtcaaggactgtacccattgttctttattttaatgagcctgtcaaaggattaaatcaatcaagtgttaacttaaagtctgatttggagttcagtaaggatattatatggaggcccctcacaatggcagactctgggtattctaactgttgggccacagatctccagattataaatgaatgtagcagtttgcaggaatattctgttgaagtgagcataccctgctcgaatggcattgtatctagaagtggctctaactacaattgtcctgtgcattttacatttggcattgaattgatcagcaacgatccagtacagggtttagatatgtttgataagccagttgcctggaattgctcagaatcattccagcctcatgggaaccgtgatcctatcccttttgatctgctaaagattactagtgccttgatcgagcatgactcaaattggcattttgaaagactatctgaggaaatagatcttttcagagagttacctgatgacaacagcaagtttgggaagttgacattagcccggttattgcttgcttgttctgctataaaatctcgtggaagatctctaattgaaaggaagggatactgtgaagaggcactggggctcttcactgacttgattcacctggatccatctcataagcagtactatgaggatgaacggagcttagtcctgatggataaattaacatgtgacatggagactttcatgaagcactgttcagttcaggttcaaccaaattcagctcccctgaatcatgtgcagctttgcagattatctctaacatgcattggatttgctgaacgcctgttgtgggttcaaatgctggacctaagccataatagtctgagatcagtcgaaggattggaggctttgcagcaccttgtgttcttgaacatcagcaacaaccagatcagtggtttcacagcacttgaatcccttacgaagataatctcattgaaagttctggatttatctttcaacaagattggagctcactcaattgacacaacacggtatatctgctcgtctccattctcacacaaaatggaagcaagtgaagcttttgaagcgtaccagaaggtaaatatcaacgtggaggaatactgggatgccatactgtttttcagatctctgaagttggcacagcttgatataaaaggaaatgcagttgcaagcaaggagaacttcagaactattgtcatgatgctcattccttgtctaaaatggtttgatggtgaagatgtcaattaaaatggagttgagcaatgatagtgtcaaggctcacgctgtaaaccattttttgctagaaggcattgatttgcatcatatgtactgctatatttgtttaaaaaactcggccggtaggggaaagaccgtccccctcctgtattatattaataagaagttcaatcgcagccccgatcgagtaagatcccg

SEQ ID NO: 5659 - DNA, 2725 bp, Zea mays
ctataaagaaataaccaaaacaaaaatatacatctcgatgagttatacaactttatagttgaaaacttttacagctcaattattttttcttcaaaatttgatttgcatagtgtaaaaaaaacattcagcgaatgatttctctagctgtttgccgagtgttaaaaaacactcgccaaaatgtttctttgctgagtgttttttagtcgagcgttttttgtttgacaattagtaaagagttttttttttgttttgttgactgtggaaagaaaaacaataagcaaattatttaacgctcggcaaagggccagaattgtgaactatatatactgctccgtctcgaactaggccatcggagcttctgcgagacactgagaatccacgaatccagcagcctccatgcatgacctccaagctcaacgcagacgtgaagttcagggcagcactccacgatgtcccgttggggaagacctaataggaccgccagtagaaaacgtcactgtactagtacagtctccagccgatatacatgcagctgagccgctgtcatatcttgttctcttcctgttgttcgccaccgtctcacgagatcgagtccacctctctgcccagagttgcatcaacgaaaagaaaaaggaaaaaaaaccggcggttccaaaaaagactcggccacacacaggcacacgctcgctacgaggccacaataattcgcagaagcgaccaagctgcacttgcgctcgcggacaaggccacccatctaaaggattcagagagatctttgcgaggcttgtggtcgagatgccttcgccgttcgccacaacattgggtacctcgaggccggccggctggctcgccatatggcaccaacagcaaaacagcgaaacagtgcagagacaagctacaacaacctaccctaacaggccattccttccactgcacttcattcgatcctgagctatagctggctgcctgagctcgctccaagaagtgtatctatagtatagacactaggcttcgtgtggcgtgctcgagatatgcttgcagtgtcgccgtcgccggtgcggtgtgccgatgcggaggagtgcggcggaggaggcgccagcaaggaaatggaggagaccgccgtcgggcctgtgtccgactcggacctggatttcgacttcacggtcgacgacatagacttcggggacttcttcctcaggctagacgacggggatgacgcgctgccgggcctcgaggtcgaccctgccgagatcgtcttcgctgacttcgaggcaatcgccaccgccggcggcgatggcggcgtcacggaccaggaggtgcccagtgtcctgccctttgcggacgcggcgcacataggcgccgtggatccgtgttgtggtgtccttggcgaggacaacgacgcagcgtgcgcagacgtggaagaagggaaaggggagtgcgaccatgccgacgaggtagcagccgccggtaataataatagcgactccggtgaggccggctgtggaggagcctttgccggcgaaaaatcaccgtcgtcgacggcatcgtcgtcgcaggaggctgagagccggcgcaaggtgtccaagaagcactcccaagggaagaagaaagcaaaggtggattggacgccggagcttcaccggagattcgttcaggcggtggaggagctgggcatcgacaaggcggtgccgtccaggatcctcgagatcatggggatcgactccctcacgcggcataacatagccagccatctgcagaagtaccgttcccacaggaagcacatgcttgcgagggaggtggaggcagcgacatggacgacgcaccggcggccgatgtacgctgcccccagcggcgccgtgaagaggcccgactctaacgcgtggaccgtgccgaccatcggtttccctccgccggcggggaccactcctcgtccggtgcagcacttcgggaggccgctgcacgtctggggccatccgagtccgacgccagcggtggagtcaccccgggtgccaatgtggcctcggcatctcgccccccgcgccccgccgccgccgccgtgggctccgccaccgccagctgacccggcgttctggcaccatgcttacatgagggggcctgctgcccatatgccagaccaggtggcggtgactccatgcgtggcagtgccaatggcagcagcgcgtttccctgctccacacgtgaggggttctttgccatggccacctccgatgtacagacctctcgttcctccagcactcgcaggcaagagccagcaagacgcgctgtttcagctacagatacagccatcaagcgagagcatagatgcagcaataggtgatgttttaacgaagccgtggctgccgctgcccctcggactgaagcccccttcggtagacagtgtcatgggcgagctgcagaggcaaggcgtagcgaatgtgccgcaagcttgtggatgatccccggggctgcatagctgctagctcgtccctgcacgcagtgcaacaaaagaaatttgtcgacatgccttttatgttttgaattcccgtgaaccgtttatggagcactcacagctcgttcagggtcagatgaacagaacattataggagtacattctttgaggtttcaggtttgagggaaatcaacctgagtgcatccaagtacagtgtactgccacagtgccacgtcggaaaatgaagtcttgacccgaataaaagggggggcccgg

SEQ ID NO: 5660 - DNA, 2794 bp, Zea mays
gagttggtgcgccataaccccttgggtcccccgcggccggcccggccaaaaagggtagcggattgggctttcccctccgcctccctcccctcacaaaaaggcggcagcacagcgccacccctcctgtcccgccgagttcggagcgcagcgcaaggcggggggaggagcaagaagccgccggcctccctcctccggctcaccaccaggcttactccgcaccgcgctgccacgggtaggagcggcgtcaaattcgggattcccaagcggcttcagcccggaggttgagccaaagctattttctaagaaaaatggcggcaatgatggtggcgatgactgcgaggagcaagaacagcatattacccgtggagaagaagcagggctggtctattcagctaccagagctccggttcccttgggattcacatgaagacaagggtttctctctgagtctgcaaggatctggaccttctcatggcggcctgtttgctagcgtgggtcttaaagtgtcgacaggtgccccagcagtggcgcccggaccgggtgacaaggatattaagattccattcactgatcattgtatgaagtacgtgtctgaggcagttgggtaccaggttattagcactgaagcggagtcagtggaggaggtggtggatgctaaggcaaagaaggcagccaagaaacgtgggctgcagctgaaaattaagattgggaacccacatttgaggaggctggttagtggagctattgcaggtgctgtttccaggacttgtgtggcaccactggagacgatcaggactcacttgatggttgggagcaacggtgactccatgacagaggtgttccagtcaatcatgaacactgaggggtggactgggcttttccgtgggaatcttgtcaatgttatccgagttgcgccaagcaaagcaattgagctttttgcttttgatactgccaagaaattcttgactccaaaggctgatgagtctccaaagaccttcctacctccatcacttattgctggagcacttgcaggagtcagctcaaccctgtgcacatatcctttggagttgattaagaccagattgacgatagagaaagatgtctataacaacttcctccatgctttcgtcaagattttacgagaagaaggtccatcagagctctaccgtggtctgacaccaagtctgataggagtggtgccatatgccgcgactaattactacgcctatgacaccctaaagaagctctataggaagacgttcaagcaggaggagatcagcaacatcgcaactctcctaattggttcagccgctggtgccatctccagcactgccaccttccctcttgaggtggcccgcaagcaaatgcaggtaggagcagtaggagggaggcaggtctacaagaatgtgttccatgcgctctactgcataatggagaaggaaggggttggcggcctgtacaaggggctcggaccgagctgcatcaagttgatgcctgcagcaggcatctcgttcatgtgctacgaggcctgtaagaagatcctggtcgaagacaatgaggatagtgagtgaagctgaagcatgtatgcccctgaggaggggtatgactgatgtgccaggctagaagaggtttgggttgggttggggagtataccctagtattatcaactgatgaaaatgtagatccaagatatttgaacgccctttagatcataatttggttcagttttgtgttgaaatccataaacaatacacttacttgatggtgcatgttgcggggggcaattttgtcatgtggccatgtctgggtctgtcgaagggctcgtaacttctgtcgctacctttgttaaaactcattttgtaacctattcgatcagtcctgaaaccagtgacgaaagcatttagattttgtgcagaagcatgatcaattgttcatttaattacttcaccgagctttccccttctacgcatggatcccgtttagcatattctgcctcgttatatagttttattgatttctatttcatcttaagaaccattcttatagagcatacaagaactagagctgaaaccagctgacgaaaattagaggctaaagcagtggcggtgggatgtgctggtgcatgcctagagatggcgccgagcgtatatctgctcgattttgccaattcaaactcataatatccatgaacataaaatatgcttagtaaaaaactaattatgggtacccaacaggttcttcctgcccgctacagtaaacacatcaacgcagatacatattgcatagtgcaatgaaaaataatactccctttgttctgaaataaaattcgttttaggaaataacgaattcatataatagtttatgtatgtgctttatatatgtatctaaattcattatcatttatttgaatataaacataaaaccaaaagctaaaatgactattctcccgttttaaaatagtagtcgttttagttcttagttttatatctatattcaaatgagtgaggatgaatctagacacacatataaaatacattcatcaagtctttgatgagtccactattggtataaaacgaattttattttggtacagaggaagtactattttgggacgaatggagtataaacaagaaataagatcttacgaatcatataaaagccaaccaccatagtatgtattactcacatgcatatatcaactagttgggatctcaatctctcggatatggcgtgatgcacaaactcgagtgaatgtgtgatccggatgtgtgccattgtcgttgtagtgtgattg

SEQ ID NO: 5661 - DNA, 5894 bp, Zea mays
  misc_feature (4271)..(4271): n is a, c, g, or t
  misc_feature (4949)..(4949): n is a, c, g, or t
ttttttttttttttttgctgcgaattagaatctgcaggtaaatttacagcagctgtatttttgtctttagtgaagcccaaatacaccagcgatccaattctctaaaacggagacagcaagaaaaaaaagataaacctaaaaaacatgaactaaagaaaatgccaattagactggatgccctattgcccatgcaactaatctaggttcttatcagaactgagcacgttggaacgaccacggatccttcaactccaatgtacactgtcagtcactagttgtcctgtcttctgaagaatagggccctgtcgacggccgtgagtagacactgatcatcgagacttggctcgtccgcctgatcactctccatgtccacgttcaaatctatgcaagaaggagacggcttggaaacaccatcttcgttgtgttcatggtcacctgctgcgcgctcctccttggcctccttcatctctaccttcaccttcttgctcggcggcgagcaagctctactagacctgctgtcgccaaagctctcgcagctgaggatgacgatggcgtcgcccacgccgacctcttggccagcatggttccgcaccaccccgctctcgatcgcctccttgatgcggagctggcagtcccggtcagcccgctcgacgtcctccatgaatatgacccggtgtgggttctcggagacagcctcgtgcaaccgctctaggtaggccgccggctcctcctccggcatccgtgggcgcttactactcctgtgcccctcggaggagcctgacgaggccggcggcggcgacgaggcggagacgacaccgccaggcctgatggacaaaaagctgctgcgtgacccgaacacgagcctggcgagctccctcgcaaccctctccttgccgtcggcgtcgcctccgaggaagagcatccacgtctcctccttggcatccgccgacctcgacttgtcgcgcctcttggcgatccccgaccggcactgcaggacggcgctcgcgacctcggggacgatctccctctgccacggcacctccttctccagcgcgccgcagagcagcttgaggttctcggcgttgagctccttgaacctggcgcggcactccacctccacggagccgttggaggcgccggagtcgtgggacctgatgctggcctcgcgcttgggtctccacgggtggtgcgcggcgtcgaggccggcgaggagccacgagtggcgaggctgctgcgactggccgccgccgtgctcgtaggaagagatggaggaggccggagacaccggcgccgagaaatgcagcgtcgtcgttcgccgtgacggcctgctgctgctgcagatggagctccatgtcttgccgagatcatccgtaagatgggtagcgggctcctgtgtgcgtcgtcagttaggatgggaagattgtaagaagtctgacgtagtaatttagtttggttgttggagaagggattaaatataatcatgcaatgtgagcgaacacttctgtattacctgatgatcacggcaatgctggagccaggaagggaggctggacgacgagacgaacggcgtccgaggcagcgccgccttcgtcgtctcgatcctcgcggcggagcagtcgccgccgcagcatctggagatcagcttgctgccggccaaaagcggccagcaagacgctggtccgttcccatccgtgtcagatgagcccgctttcatggactgattgaccgtgcctagacctagagcactgcggcagaaagaacaaacgggacggaataagattccagtgtcattccacgactccacatatccatagaatcagctagctgatatgctagctttgccggtgtacgtccagtaccacacgcattgcctttggagttttgtactttttggctatagtaataaaccagtttcttctttttttttggtatcggtaaaaccatagagctgacaatatagtaagcaaagtgaaggcaatatatgcctggcttgtatacaattttgaacccaacccaaggggagtgcagtagaagagggaatgtgaaggcgacgagcgagcgagctagctaaagctgtccagaaaagcacgcaaaagctgcaagctttcactcacacagtcacactcatggagtcatggtagggaaaagggcagagcacgtagttgctactcctcgtcctagctgctcagttacttcagttactacgatttgttagtgacatttcgtttcgagtcagttcgttcatctgacgtgacatttctgaaccggaaaataaatctaacagctttgcatcgcaaataaaaagattgcgaatgggattcacctgtcgtcgaaggcgcagttgaggctcagcgcgaggctgccggcgggcacggtgagcgtctggagctcccacaggctctccagcgacggctgccccacccgacacctcgtgtaggcctggtacgtcccgaacccgaggagccagcacaggctgccgccgccgccgctcgccagggcgcgcagctcggtgacgacgtgctcgacggagcagtagtagtaccctctcctcccgctctggacgacgtgacccgcccagaactcggccgcccacttgaggtcctccacgacgagcacgacgacctgccccctcctgcccctgacgaggcaccgcagctcgccaagccgccgctcggtctcctccctcgccatctcgcggaacgacgacacgcggacgctgacgacctgcgcgcctcgcagcgcgtcgtgcttcgcctcggcgctcttgatcttgtccatggccgcatgcgccgtggcctcggccgccgccgcgctctccgcgatgacgaccaccctcctcttgctccgcgaggccaggcagtccaggacggcggcgacgtcctcgtcgcgcgcttggtggagcggcagcttgttgcctttggcggcttcctgaggtgggcttgcggtggcagcagagctgctaggattagggtttttgctgggagcggtggccgcggccgcggtgcttgttgtggtggtgctgctgcacacggcctgctccacgttggccttcacctgggtgctggagaagccagcctcgcgcatcacgcggctgacgctggggtcgtcgaggatggacaccacgagctgctccagctcgatcttgacggcgagcaccggctgctgctggctctccacggacccgcgccgctggtgcgcctgcgcgcgcttgaacgccgccacgagcgcgttggacagggacggcgggtagtagtggtggtggtggtggtggccgtgcccgccgagcagcggcgacgaggcgaccgcggccgacgcggggaggcggttcagcgccacgttgaagcacagctccagcgccttgcactgcaggccggcggggtgcgagcggaggcacgccgcgcgcagcaaccccgtgggcgccgctagcatcgcgctcgccacgtgtagcggcgtcacctgcgcgttcccgcgccgccgcgcaaggctcaccgcctgcttcaccaccgccgcggcctccgccgtcagcgactgctgcaccgtgcaccccccggccctcatctctccagcgagccacctatagctagctggtagctacacctgccaagacagatttgatgcagcaacgacggcagtcagtgctgaaagatccggtggcagttgcgaggctgaactgaagacgagatcagggagatgtgtgcgtagatatagagggggtcgatcactgtagctgcaggtggctgctgctttgtatgttggtgagtgttgctcatcttttgagctgcagggccggcagtgatgtcttgaggtgaaggatagatgattatttgggtgtttgggtttgtgcttttcttgttagagaggtctgctgctggctgggtatactattagtttttttttttcagatccaaagtggattttgtggtgggaaagacaaagtgggtagaggtagaatgcatgtgctgacaaagcagatacaaaggcgccttagctttccctcctctctctctctcactatctctctcctccatacctagctctcactctagttcaatgaccatgagaaagcagatcatacggatgtacacagtagtattgcgtatctttacgaccagattttgtatgtgatcagctacctctaaagaatgaccccgtgagaggctgaggtctaaaatttatgcaggaatgcatcaaagcgagcaaaggcgaacatgaaatttcgaacctgatgatctggaaggattcgaaccggccggtgacaaatgtgcattgancattggatcactgctcgctgatattaatctaattttttaggctatggccaatagattgtgtatatgatggtagactactgcactgcttacagagtaaacttcaaaatgagatacaaagatgaggttatggccaaccgattgtgtatatgacggtagacgactgcactgcttacagagtaaacttcaaaataagatataaagatgaataagctgctgaatatagccttagttctgtggctattcatataaaagtaacattggtgtttaaaagtattaaggatgtgtgcgtggtcttcaagtgttatgagtgattatcaagaaaatcgattttgctttagtgttgattagtcttagtgtgagttatggtgtgtgaaacatgtctcttagcctgtgatgcgcaggattagaagtcatagacaatcgacgacaaatgtgaaagtaaagttggttcgtgtccatggactgagagcgatgaagaatggagggcggggtttggagtaagtgacttgagaagccagaaaacttaccatggtgattgacatccagagacatggactgatgcaagagtacatgaaggagtagtgtgctttgaccaagtcaacactatagttatataagttaagtagaggaactaaaggacttggtgatcgggcagtcagggactggcagtggcacatnttgagattacggagcgagtgtagaggatagtttactctagagtggtttgggcctcaaaactttcgagggatgaaccttggttttggactcaaaacctaatgaaattcttgtaggaactagaaacgacacatggtgttattgtaaagcttgcatcaagataaagcaaagtcatgaaaagcatgtgcccgtcatatgcaaagatctcatgattgaccattttgcccatgggtttacgtggcttagcctaaaatatctagtggctttataaatgaaatccccaaaccattctctctgtagcatttgagttttccatcttcaagtttagtttttctcttcctctattttttatgttgagtgggatccaaagatttagatctgaaatttataatattatcatttatgaaactctagcaaagtgtcttccctctactaggtttgaatcaaaggaatctttgttttgaaatttggtgctcttaattttgcatttgatttgaattacacttattgtttctttctctttcagtctccattcttagttcttttgttggatctttcatatctaagctcttggcaacttttggattagatcaaaatgtgcaatcatgtctaagaattactcctagtaagtgattttggtagattcaactcgagcaggacaattcattattttgaacattttttagaaaaccccaaacaaaaaatgttgtttcttcgattcctagagtctccttatctttggacttcaaatttttatggatgcattagaaatgtgtgttgaaaattctagctcaattggacaatgcattagaaacgtttgatctagttttgcctttttcttttgttcgggttgttgtacacatgtcatgcgacactgattgttgctacatttttgtacttcatagtttcttttgctatgtttctttcacttattttaagcacacctta

SEQ ID NO: 5662 - DNA, 2814 bp, Zea mays
caatcatccatccccgcatttctccactcaacccacaccccaaagagaggggaatcagtctctcccatcccatcaccaaccctcctcctccttgcctaggtactcgcagcagcgtcggcaagcaaggttctcttctcgcgccgcccagatctgagcgctcccatggccatgccgtcctcccgctccccggcgccgccgccaacggcctcctcctcctactggtgctacatgtgcgaccgcttcgttcgcgccgccgcttcctcctcctcctcacccacttcgccgtcctcctcctcccccgcctgcccgtcctgcggcgggggcttcctcgaggagatgggcgcgccgccgccccgcgcccgccggccccgccgcgccgcccgccgcggcaccgactcccgcgcctcgcccttcaaccccgtcatcgttctccgccgctccccgcccgccgacgccgacgccgatggctcctcctctcccgccgccgccaccggcagcagcttacgagctgttctacgacgacggggcggggtcgggcctccgcccgctcccggagagcatgtcggacttcctcatgggctccggcttcgagcggctgctggagcagctggcccagatggaggccggcggcggtctggcggcgcgcgcccgcgacgcgccgccggcgtccaaggccgccgtggactccatgcccgcgctccgcgtcggcgccgcccacgtcgcggccgacgcgcactgcgccgtctgcaaggaggccttcgagctgggcgccgaggccagggagatgccctgcgcccacatctaccatgccgactgcatcctgccctggctcgcgctccgcaactcctgccccgtctgccgccacgagatgcccgccgacaacgccgccccgcgcgctgccgccgccgccgccgcggacgaggacgccagggtcggcctcaccatctggaggctccccggcggcgggttcgcggtcgggaggttcgccggcgggccgaggcccgacgagagggagctccccgtggtgtacacggagatggaaagcgggttcaacttcaacagcggccacgcgcccaggcggatctcgtggggcgccaggcaggccgcggccacggacaggggcaccgtccgccgcttcctccgcagcgtcttcgcctgctttggacgcggccacgccccgtcggcggcggccgcgcgcgccatgcctgagctcaacgacgacgacgtggcgtctgaccacagcgccgccttcagccgtgggtccaggagccggagcaccagctggaggctcgaggacgggcgtgccgacgccatggtgcagagatgaccgccgtatactgtgtggaactgcttgtagtacagttacagtaacgctgccgaaaaagattgctgctttgtttcattcatgttgtatttaccgtactactgctagcctcctgcctactacttaggaagatttgaggttgtagaacagggcaaattggtgttagtacatattgtagtagtgaggaagggaaagagagcagcatctcgacctctctttgttagagagtttgcattgcagctgcaggtggggggtcaactgcgaactcaaacacttgttcttggcttggttggtggtaatattaggagcgaggtgatggatcaactgttcttttattatctttctttctgttcagttcattgtggcaggaaccatcctttgcatttgtttctaaacaactcaatggttggagaccacatcagcatcgctggctatttttgctggatccaacacaactctttcttctgcctgttattatctgatctgctctgctgcattcgtttgtgcacctaccactaccagatggatacctcatagtttgaccagctcgctccttcctggctaccttgggtgttgtttatcactatgaccagcagctatttttctttgggccacaagtcaacgcctctacattcattcatggagtccagcccatcgctactggcttctacaatgtttctgtatctacatattacagctgcagcagtccaaggacttgcttgcttgtttttttgatcctacatatacataccagtacataaccgtgaagccaagatatttggatgctccacttcttctgtatctgtgtcctacttttatagtctagcatgatgcttacagctgcatgtttcagcggtgatgtcggattggatgtgccggtgtatgtcctgttgtcctgttctggtgcaagccaatcaatcagttttaagcttctgatgatggccggcatggcgccttttaaaactggggtcacggccgggatgaaagggacctgcacactgcgctgcaggtaagatgggtttgctcaatcataagattcattcatccattcattctgaattcagccagtcattcatttatttattctgaatgaattcattcgttcgttcattatgaatccattcattgacgtaatagtagttgtgttgggtgaaaacatgattgtactacgaggcaggcaggcaggccggcctagcaagcgatgatgaatcaagcaaccgtaccggaaattgcagacagagagggtctgcaattacaccgagtacggtggctgatcgtctgttgggctttgtctgcaactgcacaagcgcatttatatattagaattagggagcatgacccgttttcaattgaactgcatgtaggggagcacagtgcttcaaaagctcctgtatactctttgtatatgaatccctcagtatatttagggagcattatactccgtttatactttaattttgtcacttcttacgaaattaattgtgtttaac

SEQ ID NO: 5663 - DNA, 2532 bp, Zea mays
gttccgtgcagccattaattacgagattggaaaaaatacatgtttgtttgtttccttgaagtactcctgatcggcgagtacagtgctagtatatatagaacggattgcagagcagtgtagttcgacgcgttgaacggacggaggggaaaggaagaggaccgtggggcggagggtcaaagcagctcaggcacacggtgacatgacaccagcgtgtgttgtgttgttgtgtgtgcctgccttttccagggaaggacaaggaaggaagctcgtctcgtcctgtcaacgcggcgccttctcgtctcaactaccatcgccttgccttttttttttcttcctttggcccggtccgccggttaaaaacatctgctttcctccacaacacccccgccacccccctcgccgagctatcaatcagagcgggcggggaggagaatacaaggccccttcgtctcgcctcccaccaccaacccttcctccgcctccgccgccgccgcctggagctgaaagtatcccagatctgagcccgccttccgatggcgatgccttcctccccttcccccacacgccttccaacggcctcctcctcctactggtgctaccagtgcgaccgcttcgtgcgcgccgcctccccgctctcctcccccgcctgcccctcctgcggcggcggcttcctcgaggagatgagcgcgccgccgccacgaccggcctacctccgccgcccccgcgcgcaccacgccgccgactcccgcgcggcctcgcccttcaaccccgtcatcgtgctccgtcgctccccgcccgccgccgccagcttcgagctcctgtacgacgacggcgcggggtcgggcctccgcccgctcccggagaccatgtccgacttcctcatgggctcgggcttccagcgcctgctggaccagctggcgcagatcgaggccgccggcgggctggcggccggcgcccgcgacgccccgccgccggcgtccaaggccgccgtccaggccatgcccgttgtctccgtcgccgccgccgacgcgcactgcgccgtctgcaaggaggccttccacctgggcgccgaggccagggaaatgccctgcgcccacatctaccacgccgactgcatcctcccatggctcgcgctccgcaactcctgccccgtctgccgccaccagatgcccaccgacgccatcccccttgagcaggaggaggaggccacggtcgggctcaccatctggaggctccccggcggtgggttcgcggtcggtagattcgccggcgggcggacgcccgaggagcgggagctccccgtcgtgtacacggagatggacggcgccgggttcaacagcggccgcgcgcccaggcgggtctcgtgggggtccaggcaggccgcgtccacgaacaggggcaccgtccgccgcttcctccgcaacgtcttcgcctgcttcgggcgcggccacgcctcgtcctcctcgcgctcccacgccgtgcctgagctcaacgacgacgcgttcagccatggctccaggagccggagcaccagctggaggctcgaggacgggcatgccgacgccacggtgcagagttgacggacgaaccaactcctgctgcctgcctccctgtctctagtacagcacgctgcaagaagcgaatcttgttgcttttgtttcataattcattcgtcttgtattgtgtttaccatactgctgctcctactcctgcctgctacttagaagaaaaagaggaaggggaaggggaaggcgaaggcgaaggaggaattggaggatttgtagaacaggtcgattgcaaggagaccatgcaagggttttcattgtaggtgggggattgtttttttttttttttttgcttcttctgtagctgtatgtatccatgctagtcctatcctttcctatgttgcagcaggatacttgtgctggctgcttgcttggcagggcagcggcatcactgtcccggccgttgtctgtcctggcttggcaatgaagcagcagagcacagaaagtcagaaagtggcatccccatggaatttacctgccgtctttcagtgaagtttaacgtctccttccgactgcttgtctgcgagctggatttgcagcggtgaattgcagactttgcaagggagacgagacattgatatagatggccggccccaccacaacgctgcatagggccgtgggctcgcacgacctgttagctaatcgggctcgggctagctcggcacgataggcgggccatgtttgggccgtcacctgggcatggcgtgtcagaccggcctagcacgcgagggttgctagggtttcatataccctgtccacgcggccacgcccccctcgagcccaacgtcctagcccccaacctctcgcccgatgcctctgtcttgtcgacctcgcctcggcttctcgcccttgctcacacctcgttggcaacgcctctgagatcaagtcgctagtggactggatctacgacgcctcggtcgcctcctcgccttcgagatccaatcactgatggactagatttggtcac

SEQ ID NO: 5664 - DNA, 1318 bp, Zea mays
gcacgagaccattacctagaacatcctaatcgaaaaagacacagatagctagaacacgagcagaggatggctaggcctaggccgtcggtcgtcgtcctcgcggtggccgtcgccgtcgccgtggcgtccctcgcgcagcccggcgcggccgacctgaagctggactactacgcgagcacctgccccaacgcggaggccatcgtgcgcggcgtggtgcagcagcgactgcaggccaccatccgggccgtcggctccaccgtccgcctcttcttccacgactgcttcgtcgagggttgcgacggctcggtgctgatcgaatccacgcccggcaaccaggccgagaaggacgcctccgacaacaagtccctcgcgtccgaaggcttcgacaccgtgcggagcgccaaggccgccgtcgaggccgcctgcccggacacggtctcctgcgccgacgtgctcgccattgccgctcgggacgccatctccatgagtggcgggcctttcttcccagtggagctgggcaggctggacggcctgagctccaccgccagcagcgtgccaggccagctgcccgaggccaaccagaccatggaccagctgctggcagtcttcaaggcacacgggctcaacatgtcacgacctcgtcgcgctctcagcggcgcacagcgtggggctggcgcactgcagcaagttcgcgagccggctgtacagctaccagctgccggggcagccgacggacccgacgctgaaccccaagtacgcgcggttcctggagagcaagtgccccgacggcgggcccgacaacctggtgctcatggaccaggcctcgccggcgcagttcgacaaccagtactaccgcaacctccaggacggcggcgggctgctgggctccgaccagctgctctacaccgacaaccggacgcgccccatggtggactcgctggccaacagcaccgccgccttctaccgcgccttagccgacgccgtcgtccggctcggccgcgtcggggtcaagtccggcaggcggggcaacgtccgcaagcagtgcgacgtgttcaactgacagggaaatcgtgttcaacctccggaagattcatttgatttgggtgttttgcttgtaatgcagctgttctctttgattcgttgcatagcacgcggttgctgattcttaaacttgtgtgtggtaattattcagcaattagttgttctacaaagtggtgaataatggttctgcctgctttgtcatagagtaaaaccccaaatagcagccaaaattagatcatacatagatacagttgatttcactgtaatttgaatactc

SEQ ID NO: 5665 - DNA, 1301 bp, Zea mays
cattgggtccctcgaggccggccgggatagacacagatagctagaacacacgagcagaggatggctaggccgtcggtcgtcgtcctcgcggtggccgtcgccgtggcgtccctcgcgcagcccggcgcggccgacctgaagctggactactacgcgagcacctgccccaacgcggaggccatcgtgcgcggcgtggtgcagcagcgactgcaggccaccatccgggccgtcggctccaccgtccgcctcttcttccacgactgcttcgtcgagggttgcgacggctcggtgctgatcgaatccacgcccggcaaccaggccgagaaggacgcctccgacaacaagtccctcgcgtccgaaggcttcgacaccgtgcggagcgccaaggccgccgtcgaggccgcctgcccggacacggtctcctgcgccgacgtgctcgccatcgccgctcgggacgccatctccatgagtggcgggcctttcttcccagtggagctgggcaggctggacggtctgagctccaccgccagcagcgtgccaggccagctgcccgaggccaaccagaccatggaccagctgctggcagtcttcaaggcacacgggctcaacatgtccgacctcgtcgcgctctcagcggcgcacagcgtggggctggcgcactgcagcaagttcgcgagccggctgtacagctaccagctgccggggcagccgacggacccgacgctgaaccccaagtacgcgcggttcctggagagcaggtgccccgacggcgggcccgacaacctggtgctcatggaccaggccacgccggcgcagttcgacaaccagtactaccgcaacctccaggacggcggcgggctgctcggctccgaccagctgctctacaccgacaaccggacgcgccccatggtggactcgctggccaacagcaccgccgccttctaccgcgccttagccgacgccgtcgtccggctcggccgcgtcggggtcaagtccggcaggcggggcaacgtccgcaagcagtgcgacgtgttcaactgacaggaaaactgcacgcgcgcgcgcacgagcacgagattgtccttggcgtgcgtggtccagggaagcgcgcgcggaagattatattcatttcgtttgggcgttttgtttgtaatgcatctgttgttctgtttgattcgttgcatctcatgcggttgattccttaaatgtgtgtgtgtgtagtaattatcccgcaattaattgtacaaagtggcgaataaaacatcctccagaatagtaataatttatctgggcagtctgca

SEQ ID NO: 5666 - DNA, 2257 bp, Zea mays
caaaagtcattgcagacttgcaagcttccctcccctactatccggcgctccagcccgcccgggttgggatgctacccaaaccgtatgaacaaaatcctcctaattaagacgggcgtcgttggcttcaaatactggtctctcccctgtccaaaagtctctcgaatctccaccctggttccgcaccggttccagaattttctcccatttccagggtctccccgtttctgtccggcggttctgccgttccactgcttttgatttcggagtgtgagcttacatcttgctggacaataaagattggattttaagcgatttggggggtgcttgcctgatctccccctgcgaggtactgccgggggattggatttcggggaagttttggtggtttgatattcggcttggccggagcaggaatgacgatcgacatgtccattcccgggagctccgggctgctgaacgctgcggggaagagggacatgaagttcttcagcaacccctacgtgcttgcgctcacgggcgctgcaggaatcggtggattcctctttggctacgatacaggtgtcatatctggagcccttctgtatatccgcgatgattttccagcggtcaaggacaattacttcttacaggaaacgattgttagcatggccttagtcggagctatgattggagctgctgggggtggttggatcaatgatgcatacggtcgcaagaagtctactcttcttgctgatttgatgtttgctcttggctcacttgtcatgtgtgctgctgctggtccttacattctaattatcggaaggctcctcgttggtttgggtgtgggtgttgcatcagtcacagcaccggtatacattgctgaagctgctccttcagaaatcaggggaggtttggtgtcaactaatgtactcatgattaccggtggccaattcttctcctatcttatcaatcttggctttactgaggtgcctggaacatggcgctggatgcttggtgttgctgctgttcctgccattatacagtttgtgctgatgctattcctgccagaatctccgcgttggctttactggaaggatgagaaggcaaaagctattgccgtccttgagaggatctatgaatcggaccgcttggaggaagaggtagagctgcttgctacatcctccatgcatgaattccagtccaacaataccggaagctatctggatgtcttcaagtcgaaagaattgaggctagctttctttgctggggctggccttcaggccttccagcaatttactgggatcaacaccgtgatgtattacagccccacgatagtccagatggctggtttctcctccaacaggctggccttgctcctctccctgatcgtggcggccatgaacgccgccggaaccatcgtcgggatctacctaatcgaccgttgcggccgccgccgcctggccctcacaagcttggccggggtcgtggtctccctggccatcctcgccacggccttcatactgcagtcatcatccggcctctgcgcgagcgccgccagcggcacgtgccagggcgcgctaggctggttcgcggtggccggcctcgctctgtacatcgccttcttctccccgggcatggggcccgtgccgtgggccgtgaactcggagatctaccccgaggcgtaccgtgggatgtgcggcggcatgtcggccaccgtgaactgggtctctaacctcgtcgtggcacagacgttcctgtcgatcgtggggctggtcgggaccggcccgacgttcctgatcgtcgccgggatcgcggtgctggccttcgtcttcgtggccacgtacgtgccggagacgaagggcctgacttttgagcaggtggagcagatgtggagggagagagcgtgggggaacagcggcggcaactgcgagagccttttggcgggtactgcttctgcgccgtaggctacccgttgtcagcactggtcaagcgcgtcagttttagtatggccgcgctgggcttgatcggctccgtcctggcattagttggaagaaagtaaaaaacaaattggagatgcagatgcaaactgttgtatgtggtggtgctttatattgctatcctgttgcctgattgtacgtgttgtcatcgtggcaaatgtgcagtgggtgtaaaatatgaggtcataccgtaacgtcaaactaaggcaaaagggcagttgtatgacccagatgggtgattataattatttgtacagtttccggcaaaaaaaaaaaaaaaa

SEQ ID NO: 5667 - DNA, 1791 bp, Zea mays
tgggtaccggggcccccccctcgaagggtcggacggtatcgataagcttttttttttttttttttaacgatggccaataggaatattgcatattagttgttgccattgtggtaattactaatatgcacgctacatggaacaggtgcctggaacatggcgctggatgcttggtgttgctgctgttcctgccattatacagtttgtgctgatgctattcctgccagaatctccgcgttggctttactggaaggttaattattgcctcttggtccagttctgcgctgtctccttcggtatggtatcctgttcttatctttacttttttttccttccaggatgagaaggcaaaagctattgccgtccttgagaggatctatgaatccgaccgcttggaggaagaggtagagctgcttgctacatcctccatgcatgaattccagtccaacaataccggaagctatctggatgtcttcaagtcgaaagaattgaggctagctttctttgctggggctggccttcaggtatgttcttcagcctgcttactcgttcgttggttcgttcgtgctctattttctttcagttgccagtgaagcagatattccacttggctacatgttctgttgtctagattcagttgacgcatcaagcaggcaactgggcggtaccttttttctcatctaggcttatcaaaaccatgcaggccttccagcaatttaccgggatcaacaccgtgatgtattacagccccacgatagtccagatggctggtttctcctccaacaggctggccttgctcctctccctgatcgtcgcggccatgaacgccgccggaaccatcgtcgggatctacctaatcgaccgttgcggccgccgccgtctggccctcacaagcttggccggggtcgtggtctccctggccatcctcgccacggccttcatactgcagtcatcatccggcctctgcatgagcgccgccagcggcacgtgccagggcgcgctaggctggttcgcggtggccggcctcgctctgtacatcgccttcttctccccgggcatggggcccgtgccgtgggccgtgaactcggagatctaccccgaggcgtaccgtgggacgtgcggcggcatgtcggccaccgtgaactgggtctctaacctcgtcgtggcacagacgttcctgtcgatcgtggggctggtcgggaccggcccgacgttcctgatcgtcgccgggatcgcggtgctggccttcgtcttcgtggccacgtacgtgccggagacgaagggcctgacttttgagcaggtggagcagatgtggagggagagagcgtgggggaacagcggcggcaactgcgagagccttttggcgggtactgctgctgcgccgtaggctacccgttgccagcactggtcaagcgcgtcagttttagtatggccgctctgggcttgatcggctccgtcctggcattagttggaagaaagtaaaaacagattggagatgcagatgcaaactgttgtatgtggtggtgcttatattgctatcctgttgcctgattgtacgtgttgtcgtcgtggcaaatgttcagtgggtgtaaaatatgaggtcgtaccgtgacgtcaaactaaggcaaaaggccagttgtatgaccccagatgggtgattataattatttgtacagtttccggcatatgaatgaatgatgtcctggagagacagtagggcaggagtttttttttggttgtccttggtcaagtgagttggtgtttgggctctacatgcggaccatgacaaacgag

SEQ ID NO: 5668 - DNA, 977 bp, Zea mays
aaccataaataacctcacccgctctccctccgccctcttcccatgcaccgcccgctgccgtgcccgccctgccctccaccttctcccggcgcaataaacaagtcgaggcgaggcgaggcggcagcggcggcggcggcattgccgagatttccgtgattcttgcgcttgttagttgtgctgtgtatagttgggccggccgggggtggttccgtacagttccttctctgttggagtagtcggcggcgatgggtatcctcgcgctcatcaccggcaaggcgggcgccacgggttcgggtcggcgtccacggcggacatgtcaccgacggcgccgacgccagccgcctcaccgtcgctatcacaggaggagctagtggcattggtctggagacatcaagagtcttcgccctgagaggagcccatgtggtcatcgctgctagaaacacagaggctgcatcagaagcaagaaagaccatcatggagaagaacccaacggcacgtattgatgttctgaagctagacctcagctccctcaagtctgtcagggcttttgtggaccagttcaactcgatgaaactccctctaaacatcctgataaataatgcaggcgtcatgttctgcccttttcaactgtctaaaaacggggtcgagatgcagttcgcgacaaatcatctcggacactttctgcttaccaatctcctccttgataccatgaaggccactgccaagtctacgggcattgagggccgcattgtgaacttgtcatcagtcgcccaccaccatacgtatccgaagggaattgacttcgataacctcaccgtcgctatcacaggaggagctagtggcattggtctggagacatcaagagtcttcgccctgagaggagcccatgtggtcatcgctgctagaaacacagaggctgcatcagaagcacgaaagaccatcatggagaagaacccaacggcacgtattgatgttct

SEQ ID NO: 5669 - DNA, 1516 bp, Zea mays
gcccgcttccgtgcccgccctgccgcgcaataaacaagtcgagtcgaggcggcggcggcggcggcattgccgagatttccgtgattcttgcgcttgttggttgtgctgtgtatagtatatactacgacctggttgtctcaactcttcctttcgtttctcttattggctgctgcgcttgggagttcgctcctggggggccgcccggccggccgggggtggttccgtacagttccttctctgttggagtagtcggcggcgatgggtatcctcgcgctcatcaccggcaaggcgggcgccagcgggttcgggtcggcgtccacggcggagcatgtcaccgacggcgccgacgccagccgcctcaccgtcgctatcacaggaggagctagtggcattggtctggagacatcaagagtcttcgccctgagaggagcccatgtggtcatcgctgctagaaacacagaggctgcatcagaagcaagaaagaccatcatggagaagaacccaacggcacgtattgatgttctgaagctagacctcagctccctcaagtctgtcagggcttttgtggaccagttcaactcgatgaaactccctctgaacatcctgataaataatgcaggcgtcatgttctgcccttttcaactgtctaaagacggggttgagatgcaatttgcgacaaatcatctcggacactttctgcttaccaatctcctccttgataccatgaaggccactgccaagtctacgggcattgagggccgcattgtgaacttgtcatcagtcgcccaccaccatacgtatccgaagggaattgacttcgataacctcaacgatgagaaaatatacaacgacaaaatggcttatggacagtctaagctggcgaacttgctgcatgcgaaggagctctctagaaggctgaaggaagaaggagcaaacatcacagttaacagtgtccatcctggattgatcatgaccaatttgatgaggcactcctttgttctcatgaaggtgcttcaggttgccacttacatactgtggaagaatgtaccccagggagctgcaactacttgctacgtaggactgagccctcaactcaagggagtgacaggaaagtactttgctgactgcaacgtggagaagacgagcaaactggcgaggagcgaggagttggcgaagcagctctgggacttcagcgaggagctgatcaagtctgcgaaatgagagccgaaaatgttgtggtcctgcttggcatctagtggtacaagtgatgactgattagtatatagcacggaggaacctgggcgatggctggacctcatggtgttcaggaataaaatctgcttgctttcgtacattaattagtccggtgtggcaaacatcaatttgtagtgctgtcaatatctgttaatatacgtgcagctcagttctgacttgaaaaatgcagagtcgtgtttgcccgaaaaaaaaaaaaaaaaaaaaaaaaaaaaaaaaaaaaaaccgagaaaaggggctgtac

SEQ ID NO: 5670 - DNA, 662 bp, Zea mays
cccatgcactgcccgctgccgtgcccgctctgccctccaccttctcccggcgcaataaacaagtcgagtcgagtcgaggcggcggcggcggcggcattgccgagatttccgtgattcttgcgcttgttggttgtgctgtgtatagtatatactacgacctggttgtctcaactcttcctttcgtttctcttattggctgctgtccttgggagttcgcttcagttgggccggccgggggtggttccgtacagttccttctctgttggagtagtcggcggcgatgggtatcctcgcgctcatcaccggcaaggcgggcgccagcgggttcgggtcggcgtccacggcggagcatgtcaccgacggcgccgacgccagccgcctcaccgtcgctatcacaggaggagctagtggcattggtctggagacatcaagagtcttcgccctgagaggagcccatgtggtcatcgctgctagaaacacagaggctgcatcagaagcaagaaagaccatcatggagaagaacccaacggcacgtattgatgttctgaagctagacctcagctccctcaagtctgtcagggcttttgtggaccagttcaactcgatgaaactccctctaaacatcctgataaataatgcaggcgtcatgttctgcccttttc

SEQ ID NO: 5671 - DNA, 1434 bp, Zea mays
gcccgccctgccctccaccttctcccggcgcaataaacaagtcgaggcgaggcgaggcggcagcggcggcggcggcattgccgagatttccgtgattcttgcgcttgttagttgtcttgggtacctcgaggccggccgggggtggttccgtacagttccttctctgttggagtagtcgtcggcggcgatgggtatcctcgcgctcatcaccggcaaggcgggcgccagcgggttcgggtcggcgtccacggcggagcatgtcaccgacggcgccgacgccagccgcctcaccgtcgctatcacaggaggagctagtggcattggtctggagacatcaagagtcttcgccctgagaggagcccatgtggtcatcgctgctagaaacacagaggctgcatcagaagcaagaaagaccatcatggagaagaacccaacggcacgtattgatgttctgaagctagacctcagctccctcaagtctgtcagggcttttgtggaccagttcaactcgatgaaactccctctaaacatcctgataaataatgcaggcgtcatgttctgcccttttcaactgtctaaaaacggggtcgagatgcagttcgcgacaaatcatctcggacactttctgcttaccaatctcctccttgataccatgaaggccactgccaagtctacgggcattgagggccgcattgtgaacttgtcatcagtcgcccaccaccatacgtatccgaagggaattgacttcgataacctcaacgatgagaaaatatacaacgacaaaatggcttatggacagtctaagctggcgaacttgctgcatgcgaaggagctctctagaaggctgaaggaagaaggagcaaacatcacagttaacagtgtccatcctggattgatcatgaccaatttgatgaggcactcctttgttctcatgaaggtgcttcaggttgccacttacatactgtggaagaatgtaccccagggagctgcgactacttgctacgtaggactgagccctcaactcaagggagtgacaggaaagtactttgctgactgcaacgtggagaagacgagcaaactggcgaggagcgaggagttggcgaagcagctctgggacttcagcgaggagctgatcaagtctgcgaagtgagagccgaaagagctggatcagagaaaatgttgtggtcctgcttggcatctagtggtacaagtgatgactgattagtatatagcacggaggaggaacctgggcgatggctggacctcatggtgttcaggaataaaatctgcttgctttcgtacattaattagtccggtgtggcaaacatcaatttgtagtgctgtcaatatctgttcaatatacgtgcagctcagttctgacttgaaaaatgcagagtcgtgtttgcctgtaaccgcagaagaggcgccggtacc

SEQ ID NO: 5672 - DNA, 917 bp, Zea mays
gctctctccccgccgcgttcccatgcaccgcccgctgccgtgcccgccctgccctccaccttctcccggcgcaataaacaagtcgaggcgaggcgaggcggcagcggcggcggcggcattgccgagatttccgtgattcttgcgcttgttagttgtgctgtgtatagttgggccggccgggggtggttccgtacagttccttctctgttggagtagtcggcggcgatgggtatcctcgcgctcatcaccggcaaggcgggcgccagcgggttcgggtcggcgtccacggcggagcatgtcaccgacggcgccgacgccagccgcctcaccgtcgctatcacaggaggagctagtggcattggtctggagacatcaagagtcttcgccctgagaggagcccatgtggtcatcgctgctagaaacacagaggctgcatcagaagcaagaaagaccatcatggagaagaacccaacggcacgtattgatgttctgaagctagacctcagctccctcaagtctgtcagggcttttgtggaccagttcaactcgatgaaactccctctaaacatcctgataaataatgcaggcgtcatgttctgcccttttcaactgtctaaaaacggggtcgagatgcagttcgcgacaaatcatctcggacactttctgcttaccaatctcctccttgataccatgaaggccactgccaagtctacgggcattgagggccgcattgtgaacttgtcatcagtcgcccaccaccatagcggtccgaagggaagtgacttcgataacctcaacgatgagaaaatatgcaacgacaaaatggcttatggacagtctaagctggcgaacttgctggatgccaaggacctctctaaaaggctgaacggagaaagagcacacatcaccaggtgaca

SEQ ID NO: 5673 - DNA, 3232 bp, Zea mays
tatgattcgtgataacgtagttctcaatacaaggaatctgctctttgctggcatttgctatccacgctgagaagaaacgaaccaacaaatgggaattaggaaccacaggcaatacgagcagtttaggacatggaaaaaagaaaggaaaaaagaaataataaaaatagtcagaatactattttagtaataacacttataaatactgttatggacaattttaaattaaaagagtcctataatagcaataaacttatcggactgctaagacggggcagaagcacgtttgaattattgtaagcccatttgcgtcaccaggccgactctgggctatgaactgtgtacgctcggccggaccagcccatacaacggacccaacttcacaaaaccaaccaaaaggggccgaagaccttgttcgtcggcgtatccggattatgctggctaggacctaggagcgtgcggggccaccaaccgatgcgtccgtcccgtccacaccagtacaccaccatcccccaccggccaccacttctgctccgcgtccgcttttcagctctccaccgctatctcgcacgtcgctccccaaatcatcccatcctacgcccgcggccgtggcaccgaatccagaagcgtctagaagggggaggtggtcgcccatgaccgtctgaccggccgtcgccatgggatgcgctggatccactccaaagactgacggtctatcccccttcctattctactgtttcttctccgttgttttctgtatggttcagattgggatcttatattagatgaccgttgcatcttcggtaattcggttctggaaccgagtttaggatacggtgggtagctggtttatcagcgtccttggttcttgtatgagctgggtgggtagcgattggtaactcgaattagctccgcctgccatcgatggttaattgagctccaggaccatcgccatggtggttccaaggaagagccatgatcggcttatatgtagcacagcttcttgtgaatcgtgattgagtcacggccgacggatggagggagaagatattggtattgccacaaagcaattgaagggatgacctgctcccttttgggcaaaaaggtagatcatacagttgttggggagacgaagacatgtctggttgtcataaaaataactggaactgaccgcttattcttcatgtgacagatgcactgctgcagctctgttcatgcccagcagaattaacgatgagataatacagtattaatggctagctgagatgatggtttattcttgttgttgggggaagccatttcgttggtttaaaaaaattgctttccttagggcagcaaaatcaaatatggcggtgatatgcaagataaattgaagtgataacttaatctatttgtaggaggaaagccatggattgattaagaggatttactttgtgttagatgattatctttgctgcacctacattatccataaggtattaaggtgcagttcagataggagcaagatgacgatagcagattggttgcctgtgcagttcccttgtttgataaatactagtcatgctgttggaccaagggaaatgacttcacacttttttattgattctgatctgatgcatccttagtgtagcactttagaaggttcattaggctgtaatatttttgcatgcctcaagaaaatcacttttctatctagagaattaggtttaggtaaagacatttttttatcttcgaccatcatgtcaagaatagtggtattttagaaagcatgtcgtcaatatgttgtatgttgataccatttttttttataaaaagtgatgtagcatgtcgtatatttgtaaaaaaaagaacatttgcataatactccctccattttttttatttgacgttttgcagttcatttgtacattagttggcgtcaaataaaaaaggatggaggtagtacaatatactacaattgaaactaatatcttgaaaatcaggtactgtgcctgcatccaaatcaccatgtttttttacaagaggaattaataggtttgtttttaaacaggtccattcaagtattttgtcagcattttttagataaaggaagtgtttcatcaacatgctcagatctttgtttagaaagagcaaaataacatatataatatgccaatgcttgctggtagaatgatatttggccacataacgtgcacatcccttgtatgtttcttgattgtattagcttggtagaatgtagtatgatggcattgcttatttacaatggaaatcattgtgctgatatactcacttgttaatgcccaacacttcctcttcgtctcagattaatgctcaacattttctctttgtctcagataatggtaagaatttgaagaaaccaaagccttggaagcacacccaagcaataacgccggcacaactcagacagatgcgtgatgaattttgggacactgctcctcactatggtggacagaaaggtacattgcatatttactgatggcagcttcagttttctactgtcggcatttattagtgaatctgtgacgcatttatgctgcatgttctgtgatgcattatgctgcatgttggaccactctttttcccccctcctgagatgatggtccattctgttttgactgagcttcgctaaataaatgtggcggcataacactttgaattcgcgccaaaatattgttggttttgatgtcttggcagttcacccctatatttggtgttagatttgacatagcaactgtcgtcttaaaaggaaaagaaatacatatatagatgtaccataagttcatagctgaacatgtaactagagtagaaattggcatctcctatgccactcagggaatggacagctttctgacatttttggatttgtgaccaccatgcaaatttctcataagtatacttgaaaactagcgcattatgcggaaaaaggtttagaacatgtagatgttgtgcaactgtcatgaatttactgaagtgtatggtattgtttacataatatttatgttctgcacttctgccgatggcacacactgaacacgctagatacaatcattttttttacgaaacgaagctcctcccccaattctggtaccatgataacggaaaattaagtgcaataaaatagttaaagaattgtttgatgcggtgttttttttccacactaatactaactttgtatctcttccagagatttgggacgcacttagagccgctgcag

SEQ ID NO: 5674 - DNA, 789 bp, Zea mays
gggtacctcgaggccggccgggccggggttctccggcgtatccggattatgctggctaggacctaggagcgtgcggggccaccaaccgatgcctccgtcccgtccacaccagaacaccaccatcccccaccggccaccacttctgctccgcgtccgcttttcagctctccaccgctatctcgcacgtcgctccccaaatcatcccatcctacgcccgcggccgtggcaccgaatccagaagcgtctagaagggggaggtggtcgcccatgaccgtctgaccggccgtcgccatgggatgcgctggatccactccaaagactgacgataatggtaagaatttgaagaaaccaaagccttggaagcacacccaagcaataacgccggcacaactcagacagatgcgtgatgaattttgggacactgctcctcactatggtggacagaaagagatttgggacgcacttagagccgctgcagactctgacctagcgcttgcgcaaaccatagtggatagtgctggcatcatcgtatcgaattctgacatgacactttgctacgatgaaagaggtgccaaatatgagcttccaaagtacgttctaagcgagccaacaaacttgatcagggacggttgaattgataaaataaacgtggggtccaatgtaaattatgtggatcacattattatactgacatcacgttggcatgattttggaacttcaataatattatgatgtgctagattctgattttaaaaaaaaaaaaaaaaaaaaaaaaaagggcgcgggccc

SEQ ID NO: 5675 - DNA, 1606 bp, Zea mays
  misc_feature (478)..(478): n is a, c, g, or t
attgaacctttaataataataagcgtaagctggaattatttaggagatgtggatttcactaaccgtgctgatgtgatcctcgtgcagtgctccaggaccaagaccctgctcagtctatctaactgggtgtacagtctgttccagcaccaaagcaacacaggaattagcgagaatatcgagcggagaatattccagtgcagaatatgatactgtaaatgagtgatccgagaaattgtacctgattttaacctcagccaatgctctgacacagaaattaatacggtaagcaacacaaaggcattgaacacagaaattccaacgaacatatccagcagacaatgttcctttgattttgacatgctgaactgacaattatagacaaccaagttaaggcaatttatagacaaacctgccctgtcagaagaggtgtatccgacaatgcagcatgtcgtagccatcacaaaagtttgacaagttnccgctggtcgctagagcagacagttttcaggcattttttttttttttttcgacgaatagctgcaacaggtcaaacgaagagaacagctgcacagcacagctgtgtggttaccaggtcagcaatgtccatacagaaaggctagcgaccagttaaccaatggcggtagcaccaactactaccaaaccctagagttaaaatctggttccagagcatctggaagttcgttttccataacagaccaaccaaatagacacccaacccgctcctgcaaccttaaacaagagactaagtacgttcagcctagacctaacaggtatttttcatttggcgggggtcaaaaaaatacaagagaatcaatgtactcctagaaccctaagcaggagaggctaagacgacagccccgagctcgtctaccaatttcagctgagaatcaaaatagccccagaagtggacagcttctttcctgaacagcagcttgccacctcttttcctctctctgccatcatgggggggatggcaccctcacatggccagaggaagaagagccaaaaaacaccccctctgtattccactcaccaccttgaagaaacaaaatacacaaccctaccatcaaaatgccataccatgcccccacaatgcctttgtccacattctccttccgtgctctccctcccatcagtaatcaccatccttcttcttgaccaggctcctggcgaaaagcaagcagatgaccacgaaacccaggccatggcctcggacgacggggccgaggcggcggcgaccgaggccatggccgtggcgagcgtggcagaatccgggaaggagcggttctgcttgcggtcgctcttgcgcgagggcgcggcggagccgtggtccgcggcgcgctcgcgacgggagctagggttagggttcggggagcggcggcgatcctgggagcggccgcgggacttggagcgggaggtgcgtttcttggagcgcggggtggaggcgcggaggcgcgcggcggcagcggaggcggagacggcttcgtccatggcgtgcggggaaggccgcttggagggcatcggcggtgtgggggcgagggctcggcaggcgggcgattcgaatttcggtgtgtatcgagaaatc

SEQ ID NO: 5676 - DNA, 3293 bp, Zea mays
ctgcagaatggtggcagcccaaagaagagagccatggtgctgctcgtgctcgtgtttccactaactcaccaccatccttcttcttgaccaggctcctggcgaaaagcaagcagatgaccacgaaacccaggcctacggctcccccgagcacaatggctacagtctttgctgtctgctgccctgagatgcacaacacgaagaggcaaatcgattgatcaggccaggggcaccacggtctaatcatgtggacaatcatacaggcatatctcccggtaaatccccgaagaaaaggcaaaaaggcaatgaacacaacttttaccaaagcttgaatagacagatgcataaacaaggtggcaaaatggaaactgcgctaccctactaccatattgtacctacagaaagcgtgagccaagcaatgtgggttgaaggaggttcggtaatgaacatctcctaagctgaactaattagctaaagaaacatgtagaatgtggaagtggaagaggaaagacatggcatggcaaacaaacgtatccatgtctgccaattcataaactgggcagacaagataagagcaagaccatgccacatctcgatcaaagttccacttcaacagaagagtcacacctacctatggttctggaccagtcaaggattctaatgtatacaatgatacacctgagagtggacgactaatctacataaatttgcccccaaacaacccagaggaccacccaaaaaggtaccattcgctatcaatcaaatcaattctgaagcacgagtgaacagagggcactgccaagatctcacctacacacatacaaacaaatcttctaacaaaaactttcagtctaggcacccgcatgaatttttaaatgtcactgataactggctgcacttgaacaacaatgcagcatctgcccgattcatcagttggggcaatctatctacggagccatccacaacaaattgaatctgaatgctgaacgcgaatggaacttgcaagcacagccaagtcaccaagttgtcaaatcgaagggcgtagcctaggtaaggcagaagtgggagactgacctccggtgccgccgccgtggggcacgccgtgggggtagtagctgtagctgatgtagcacttgtcgaggtagacctggccggagggcgcgccgccgcactcgacctcgacgtgctgcacggcctgggtgacgcactggctgcaggcccccgtggagaggtcgccctcgcactgcgccatggcgtagacggcctggtagctggtggcgacgaagccgccggagctggtggcgacgccgccctcgagcgcggagaaggcggtgtccctgcgcatctcgaagtcgccgccgccgccgccgctgccggtgccgcaggtcttgaagagcatctggacgccggagacctgggggaagccggacacctcgtagagcgcgaggcagccggcgagctggacccgcgccgcgacggaggcgccgcagacgccgggccaggaggacatggcgcgggagacgcaggcggcgcagtcggaggccgagaggtccccgcggcactggaagaggccgaagacggaggtggaggaggaggccgccgaggacgaggaggaggtcttgtagaacttggcggaggcggactgcgccgagagcgtggtggagagcgcggcgacgctcgggggcgccaccccgcccgggaagctctggttggcgcagcccttgtagatgagcgcgtagaggtcggcggacgtcgcgggcagcggcgcgtggagcagcaagacggcggcggccaggaagaggaaccggcgagctctgcgaatgcccatctcgccaccggggtcctggggatctctcggcctcgtctccccgccctagccctctctgctctgctctatcactgccctctgccccctcgtcacggcggcggcggcggcggtgatggtgtggagtgtactggagtggatagtggagactggacctgaactgccacgctcgcctgcttctgcttggtccttggtggggtttccttcccctcttgccttgcctccgctccgccccgcgccgcgctcgtctcgcctaccacagcaagaggccaccaccgccaggtgccttgcccgttccccccgctgtgtttgttacggctgacgacgttaatgccgcggttaatgaggaaagaggaccagcgaaagcacgcgcccatctgtactgtgggagcgtttgcacgcaaaatgcagccggtgccactcaccagctttttactttggtccgcaaaaccggcctgctgtggttgccaaagtgtttactacaagattacggttttcaaaaggcgaaatgtcgcagacccaccaacgtctcgatggaagaggatatactaaatgttcttgtcacttgtcacgaaagagcttctcaaaaaaaaaaggagaggaaaactcgtcaggaaagagacttgtaatcttggttatcttaggctagagggtttccgatacctaggttggtcttcgatgtcttcagcagatcgcgagtggttgacacttgacaactccccctctccgctgtgttcctcacgtaaagatgtatccgtctgcattcaagttcgatctgtctaataactctttcggttataattagattgacaaggatattaaatcatttgctagttaaaattaaatagaagatgactcagtctctttcgattctcacgcaaccgaacaagtaaaagggttaatatttaattcttattttgagtggatattcaagatatcgatatttattcaaatattatccgacacaactcgataatacgtgtaccgatctgaatcctaagataaaatataaaaataaatatgaaacgattaaaatacatccatatctgatgcaattacattcctaccctcacactccgctttgttttaatttattggtatatttgtttttaggtgggattcctgatttggtcaagaagttcagctgctcgggatcatttcaaaacaccatatatatcgtccaccacgtcacctacccttcacatagccgactacgtcattgatcatcgtcgaactttatccatcacattgttctagactccagtacagaatatttactgtcagtctacaatcacattagtgtcacattagcttttcttttaaagtttcgtattttaaaatgaaacatggtgtttttcttaggaaaaaatccataaagcacgtaatgaagaaaaaatcacaaatcaaacaaaatacataaaacatgaaatacacataactcgtaaaaaataagactacataaattaaacaa

SEQ ID NO: 5677 - DNA, 2489 bp, Zea mays
acgcaacttactggaagcatcccaagttcactgtcaaaactcgaaaacttaacagccatgtcagtcaacggcaaccatctaaatggagacctaccagacacttttgattcgctcaatagacttgtaaatttggatatttcttcgaacaacttgactggtgtgttaccatcttcaatgaaaaacctggcatctttgacttcattgcacatgcaagataatcaactgtctgggacccttaacgttttgcaggatctcccactgaaagacttgaacatagagaataatcttttttctggaccggtgcctgcgagtttgcttaacataccaaacttcaaaaaggacgggaatccattcaataccagcatcgtcccatctgcatctccgccttcaacaggaccagctccaacaccagcagcatcaaaaccagctccaacaccagcacccaccacttcaaattcaacgcccccagcaccagcaccctcatttccttcaagatctcctcccccgcctaaaacaacctcaaactcttctgaaggatcaactacccgagatagcacttcaccatctaagaaacacagtacatcaaccctcaagattgttggctttgttcttgccggagtagtgctgtttattatcatagtcctcctagtattattttgtctatccaagtaccaagagagacggtcgagatatgatcataacagaagtcagcaggcaagggtgcatcatagggttgaaccgcaaatcaagccacctccagtgcaacaaagcaatgatcttaaaaaaggttcaggtgaggtacttgatagaaggggccatgaactaagttcatcaacggcagctctcgcaaagaaatctcctgaaaaccaaaaggagcatgtaattaattttgatcgaacagattcagatctgtttcctgtttctctacccccaccacctcctccacctccattacccccaattgaaagagttattgcaaatcccattgttccaccagaaaagcgatatagtcctccaccaaagacaagtagctctacttctgccacatcattctctattgcatctcttcagcaatatacaaatagcttcagagaggagaatgtgataagagagagtagattaggaaaggtttacctagcagagcttcctgatggcaagttattggaggttttgaagattgacaatgctaatggaagaatatcagtagatgacttcctagaagaggttgaatgtatcttagatatcaagcatcctaacattcttgagttagtcggatactgtgctgaatatgggcagaggttacttgtgtacaatcactttagcagaacgacactagatgacacacttcatgatggagaggatactgaaagtgcactgtcatggaatgcccgcctccaggttgctcttggttctggaaaagccttagagtatctccatgctagcttccaacctccaattgtgcaccagaattttgaaccagctaatgtgctccttgacaaaaagttctcagtgtgtgttgctgaatgtggactggcagaattgatgccaccaagttcagtcactcagctgtcaggtcggatgcgtgcattactgaactacgaagcacctgagttgcaggattctggggtcgtttcagaaaggggtgatgtatacagctttggtgtagtgatgctggaacttcttactgggcgtaaaccatatgacagttcacgcccgcgtcatgagcaacatcttgttagatgggccagttctcagcttcatgacattgaatccctgtccaagatggtggacccatctatacgtggacaatgttctgagaaagcattgtcacgtttcgctgacataatcagccgctgtatccagcagcagccagaattcaggccaccaatgtctgaaattgtacaagacctagctagacttgtaaatgccaccggtgaggaatcagagtaacccccaaaaaaagcatggagccatggaaggcatacaatacaaacgtcgcgaccaagttacgtgctgtacaatttttttgggaagataattgtcttgcttggtctggggagaatactgtgaagatgtattttcctcagagagcattgcacactaatgtcagattggaatttcatttagacctggctggggagtggaggtgcagccatctgtgcacctgattgttgatcaaatccatgtaatatttttgcagacatgatattatatatagcgacagtggcggagcctccgccaagcgccaaggcccggcctgatcgggcacgtgtccaggcttccgccgaggaacacttgggtgggctctcgatcggcctagcacacggatgtttggatgggtcaggcagtggtgtcgatttcaggccggctccgccactgtactgtatagcaaggtgtatatatagcaagaccccggattcttgtaataatagtcagggattcgttaaatttgttactctaaagctagtcatttacttgttcgcccgttt

SEQ ID NO: 5678 - DNA, 2391 bp, Zea mays
cattgggtacctcgaggccggccgggaggcccggccggacccgcgcccacgcccacggccgcaccaaccaccagccccgatttcctcctaatcaatcacaccccccaaaccaaaacccaaacagcacttctcctgcaatcgccgacgtcgccggaggcttcgccggccggagcagcgccgacggttgttttgcccctccctcgtccggcccagcagcccaggcgagcatgccttcgattgcgccaccgtcttcctccgtcgctgccctcacccgtcaaccggtgcaattcttcaaagggtgcagtgtatccaaggagacaaagggaccggtccgcagtttcttcactgcaaattcaaagagcaccaaggtgaaatcagcgggcttgaaagtagcatcatccttcaaaaatgatggtggttatccagctggcggtgtctcttggaaggacgacactctattgccaaaaagcacaaccattcgtggccaggaccatccggttgctgaccctgtactcccaatggattccatgattacgccagaaatcctctctgctaatgtggaacgtgttatagacatgtttgcagatgatgacactgatactgaacttgatttggatagcccgacagagggcttcgcatcaattgcagaagccattgaggacatacaacaaggaaaacttgtgattgttgttgatgatgaatcaagggaaaatgaaggagatctgataatggctgcctccttggttaccccagaggctatggcttttatagtaaggcatgggacaggaattgtttgtgtcagcatgaaagaagatgatctggaaagactgagccttcctttgatggttaccacaaaagaaaatgaggagaagctatgcactgctttcactgttacagtggatgcaaaagagggcacaactactggggtatctgccaaggacagggcaaaaacggtcatgactcttgcatctcctgactctaagcctgaggacctcaaccgccctggtcatattttccctttgaaatacagagaagggggtgttctgaaacgagctggacacaccgaggcatctgttgaccttgccatgttggctggattacctcctgttgctgtcctttgtgaaattgtggatgatgcagatggttctatggctcgcctaccaaagttgcgtgtctttgctgaaaaggagaacttaaagattatatctattgctgacttgattaggtataggaggaaaagagacaggctaattgaacgcgcttctgttgcacgcttgcctttgaaatggggcaatgtccatgcatattgctacaaatctgttattgatggcattgagcatattgccatggtgaaaggtgatattggtgacggccaagacattttggtgagggtgcactctgagtgcctcacaggcgacatttttggatccgcaagatgtgattgtggcgaccagcttgcgatggcaatggagatgattgagaaggctggaaggggtgtattagtctatctccgtggacatgaaggaaggggtattggtctgggccacaagcttcgtgcttataacttacaggatgatgggcgtgatactgtggaagctaatgaggaacttggtcttcctgtggactcacgggaatacgggattggcgcacagatattgcgggatctaggagtccgttcaatgaagctgatgactaataaccctgcgaaatatagtggtctcaagggctatggattgagcattgcgggcagggtgcccttgattacgccaattaccagtgagaaccgtaggtacctggagactaaaagaacaaagatgggacatgtatatgggttggccaatgcgcaggccaacctagcaaatggcagccagagcacagaagagaatcattaggcccccaagcatgtttccattattattccagcaatccagcttggtgacacaaaagagtgatatgattcttcgtttggggagttcctgaaatcttctcccccgatatttccgtagattctttcgcaaaaaagccgatatttcggtagatcgatttgttcttcaattgtaactgtaggtttcaaggtggctaatgagtaatgagcctaataatgaacggtaggtttcaagatggccagtaatgatatacacggagttagtcgtcataatgtactgtgttgagttttacgactttatcgccttggtgtggttgtcctgatggagttgtgatcgaatggtgtggcttttcactgccctttccttcacccactaaaaagcatagaatgtggagaattttaccttgagccattatagaagtttataatactttatgtgccacgaaatttttgggtggccctcttcatttcttcgtacgaaaaaaaaaaaaaaaaaaggggcggcc

SEQ ID NO: 5679 - DNA, 805 bp, Zea mays
agaatctcacccgcgcccgcgcccacgcccacggccgcaccaaccaccagccccgatttcctcctaatcaatcacacccccaaaccaaaaccgaaacagcacttctcctgcaatcgccgacgtcgccggaggcttcgccggccggagcagcgccgacggttgttttgcccctccctcgtccggcccagcagcccaggcgagcatgccttcgattgcgccaccgtcttcctccgtcgctgccctcacccgccaaccggtgcaattcttcaaagggtgcagtgtatccaaggagacaaagggaccggtccgcagtttcttcactgcaaattcaaagagcaccaaggtgaaatcagcgggcttgaaagtagcatcatccttcaaaaatgatggtggttatccagctggcggtgtctcttggaaggacgacactctattgccaaaaagcacaaccattcgtggccaggaccatccggttgctgaccctgtactcccaatggattccatgattacgccagaaatcctctctgctaatgtggaacgtgttatagacatgtttgcagatgatgacactgatactgaacttgatttggatagcccgacagaccgaggattccatgttgctgaccctgtactcccaatggattccatgttgtttcttgtcaggaatatctacatgtagtgttgttgtcttcaggattggtttccttatcaaataaatagctcacatgcaggagatgttgctgtttattacatgccgaaatacccaatgcattttgttagaagaaaaaataaaaaaaaagcgggc

SEQ ID NO: 5680 - DNA, 4516 bp, Zea mays
  misc_feature (2181)..(2181): n is a, c, g, or t
  misc_feature (3198)..(3198): n is a, c, g, or t
  misc_feature (3440)..(3440): n is a, c, g, or t
gttgtttgagaatgatttttggtttctgaatgcctctttgttctttttaatggaaggcaagagatttgctgtgatttttgttagacaagatgaattgatgcctgtttgtgacaatgcagggtgcaattcttcaaagggtgcagtgtatccaaggagacaaagggaccggtccgcagtttcttcactgcaaattcaaagagcaccaaggtgaaatcagcgggcttgaaagtagcatcatccttcaaaaatgatggtggcggtccccctggcggtgtctcttggaaggacgacactctattgccaaaaagcacaaccattcgtggccaggaccattcggttgctgaccctgtactcccaatggattccatgattacgccagaaatcctctctgctaatgtggaacgtgttatagacatgtttgcagatgatgacactgatactgaacttgatttggatagcccgacagagggcttcacatcaattgcagaagccattgaggacatacagcaaggaaaagttagtttatcttaaaactttcttatggtatcttgtacttccatctcatctaatgctctgctaacgttgttttgtacttgaagcttgtgattgttgttgatgatgaatcaagggaaaatgaaggagatctgataatggctgcctccttggttaccccagaggctatggcttttatagtaaggcatgggacaggaattgtttgtgtcagcatgaaagaagatgatctggaaagactgagccttcctttgatggttaccacaaaagaaaatgaggagaagctatgcactgctttcactgttacagtggtatgatattgtcatcatattctcctgccaccactattgtattgtctattgcagttgatatggtaatcttttgttgttgcttgtcagaaatatctacatgtagtgttgttgtcttcaggattggtttccttatcaaataaatagctcacatgcaggagatgttgctgtttattacatgccgaaatacccaatgcattaattgagttatttttattcatacttagatttgtagaagagctggttgcaattcatttgagctcagttttggtatgtcattttattgtcctggaacctgtttttcgtaaaaagccaaataaactttattctttactgttcctgctaccttctttatgtggcagtgagtttgagataattctatgctgatcttttttgacaatgtgttttttactgttctgttacatgattagtttgctctttcattactgctctgttcagatgatgactttgcaacaattacgttctattgaattgaattctaaagtgagctaagtttctgtcctttttatgtttagacttactaagttaactatgcttataaatgtctatgtcaatgatttagggaactatttatccaacttaccttaatttatgaattggtccctatgaaacttctccgatgtttttttgtctgctactgacctatatctatatattttttgcttttcaggatgcaaaagagggcacaactactggggtatctgccaaggacagggcaaaaacggtcatgactcttgcatctcctgactctaagcctgaggacctcaaccgccctggtcatattttccctttgaaatacagagaagggggtgttctgaaacgagctggacacaccgaggcatctgttgaccttgccatgttggctggattacctcctgttgctgtcctttgtgaaattgtggatgatgcagatggttctatggctcgcctaccaaagttacgtgtctttgctgaaaaggagaacttaaagattatatctattgctgacttgattagggtgagttgaattaccaaagcttcagcttctggtacctgacatgttgctactaagacagtagtcagcatctagctagcatttcaattaccattgaacagttttctcttcgattatttcataattatgctgaaacagtgtttgctggtaaaaagaaagaaaaaagaagctgaaagtgttttcaggcagatgcctacattttttttctctctatcctagttgtaacatatgattgaaagtgatgtacttaatatggttgcaagaatcatattaatacctatggctggttatgtacacgcctcttcggtgttcttatgtgctgttgctggtgatccttgagatattgantgctatgctaacaaattttatctgttgcaggtataggaggaaaagagacaggctaattgaacgcgcttctgttgcacgcttgcctttgaaatggggcaatgtccatgcctattgctacaaatctgttattgatggcattgagcatattgccatggtgaaagtaaagtcactgcagtactattttgcctatgtagaattttgttttgtgacgtattactgtttgtacatcacctgatctaactatcaatcacatacccaatgatgggcagggtgatattggtgacggccaagacattttggtgagggtgcactctgagtgcctcacaggcgacatttttggatccgcaagatgtgattgtggcgaccagcttgcgatggcaatggagatgattgagaaggctggaaggggcgtattagtctatctccgtggacatgaaggaaggggtattggtctgggccacaagcttcgtgcttataacttacaggatgatgggcgtgatactgtggaagctaatgaggaacttggtcttcctgtggactcacaggaatacgggattggcgcacaggtaagactggattatctctcaagttaccgtggaacctttctccacaacacttcctttctgctgaagtctgcttgtataggaaagttgtatcatatatctttctagagcttcaacatgaatttacttggaggcactgaagaatttcatgcctgttgcagcctgaaactgtgatgtacatagaatgaagtaaccctatcatgcagtgagtaggccactgacatttcagtactctgcaggcatgccgggatctaggagtccgttcaatgaagctgatgactaataaccctgcgaaatatagtggtctcaagggctatggattgagcattgcgggcagggtgcccttgattacgccaattaccagtgagaaccgtaggtacctggagactaaaagaacaaagatgggacatgtatatgggttggccaatgcgcaggccaacctagcaaatggcanccagagcacagaagagaatcattaggcccccaagcatgtttccattattattccagcaatccagcttggtgacacaaaagagtgatatgattcttcgtttggggagttcctgaaatcttctcccccgatatttccgtagattctttcgcaaaaaagccgatatttcggtagatcgatttgttcttcaattgtaactgtaggtttcaaggtggctaatgagtaatgagcctaataatgaacgntaggtttcaagatggccagtaatgatatacacggagttagtcgtcataatgtactgtgttgagttttacgactttatcgccttggtgtggttgtcctgatggagttgtgatcgaatggtgtggcttttcactgccctttccttcacccactaaaaagcatagaatgtggagaattttaccttgagccattatagaagtttataatactttatgtgccacgaaatttttggttgtccctcttcatttcttcgtgcaaagttttctggttgtgtgtgccacttctgtcagtctcgtcacgtcgaagaatcagttcttatctgaggtctcttatctcatctcctattatgtcttttatttcaaactttactataaataatatttacattgtttacattataaaatagtgttttatatggtcataggccatggccttagaacgaggaagcaaatctgaatgagagaaaaccattgtactcctctatcggatgaccaaagagacgctagtctccaactcatttctctactctctcttgaaatcctagttaaaggaaccgagtcaacgacgaccaaacggagcaagcagagcaagcagatccgagtgaaagggagctgatgggggtatggatcaaggtggaaccactgcatcaaggctgcctgtagcagtggccttttaggagatccatggagttgtgatggtggagccgaatgtgcgctcatggtgtgtaggatgaagataatggaatagtcctttcaagaacttaaacacgtaagctagcaaattaatataattacgaattaaattaaacagtatagctaagactacacctctctgtctatatttgtatctatgttgtaaaaatcttaaaaaaagatcctaagcaagttatctcgaagatatcgagctagtgagagctcaactaaataaatctaaataacaatatcatagtataacacaaacctgtgcaattagccaactaagagcaactccaatagttatgtaaacaacccctaaatatgaatttaagaattttttggggaaaactcttctctaacagttatgtaaagcaggtccttaa

SEQ ID NO: 5681 - DNA, 3432 bp, Zea mays
aacgtgtcctcctacaattgccgacgtagccgtcgtcttcgccagagcagcgccagcgggcccagttcttgaaagggtgcagtgtatccaaggagacaaaggcatcggtctgcagtttcttggctacaaattcaaacagcactagggtgaaatcagtgggcttgagagtagcatcatccttcaaatgatggtggttatccagctgacggtttctctgggaatggcaacacgctattgccaaaaagcacatccgttcgtggcgaggaccatccggttgctgatcctgtactcccaatggattcaatgatgacgccagaaatcctctctgctaatttggcacttgttatggacaagttctcagatgatgacacagatactgaacttgatttggatagcccgacagagggcttcgcgtcgattgcagatgccattgaggacgtacggcaaggaaaacttgtgattgttgttgatgacgaatcaagggaaaatgaaggagatctgataatggctgcctccttggttaccccagaggcgatggcttttatagtaagacatggaacaggaattgtttgtgtcagcattaaagaagatgatctggaaagactatgccttcctttgatggttaccacaaaagaaaacgaggagaagctatgcactgcttttactgttacagtggatgcaaaagagggcacaactactggagtatctgccaaagacagggcaaaaacagttatgactcttgcatctcctgactctaggcctgaggacttcaaccgccctggtcatattttccctttgaaatacagagaagggggtgttctgaaacgagctggacacacagaggcatcggttgaccttgccatgctggctggattacctcctgttgctgtcctttgtgagattgtggatgatgcagatggttccatggctcgcctgccaaagttgcgtgtctttgctgaaagggaaaatttgaagattatatctattgctgacttgattaggtataggaggaaaagagacaggctagttgaacgtgcttctgttgcacgcttgccttctcaatggggcaatggccatgcatattgctacagatctgctattgatggcatcgagcatcttgccatggtgaaaggtgatattggtgatggccaagacattatggtgagggtgcactctgagtgcctcacaggcgacatttttagatccgcaagatgcgattgcggtgaccagcttgcaatggcaattgagatgattgagaaggccggaagaggcgtaatagtttatctccgtggacacgaaggacggggtatcggtctgggccacaagcttcgtgcttataacttgcaggatgatgggcgtgatactgtggaagctaatgaagaacttggtcttcctgtggactcacgagaatatgggattggcgcacagatactacgggacctaggagtccgttcgatgaagctgatgactaatagccctgcgaaatatagtggtctgaagggttatggactgagcattgcgggcagggtgcccttggttacgccaattaccagcgagaaccgtaagtacctcgagaccaaaagaacaaagatggggcatgtatatggattggctaatgcgcaggttaaccagccaagtggtagccagagcacagaagagaagcattgagcccaaaaaagtgatgcagtcttctttttgggagttcctgaaatcttctccctcgatatttccatatattctttttttctatatttccatatattctttctttcacatagaaggccgttttgttcttcaactgtagctgtaggtttcaagatggttaatgagcctaataaaagcaagtttaataatataagcaactgttcttgtaaggagctttacagtctgtcttatatagccgatatgtataatggttagctttcacaatgaatatatgatcaactgtttttctcacaaaaaaaaaaaaaaaacttaatggccgatatgcataagagcaagttaaataatatggtcaattgttagtttatagcaagtttaataatatcaacatttagccggtgtataactagctattatactaaggcggtctccagcagttatcctatctaatcctctatcagttatcctatctaatcctctatcttatcctccatttcaaacttaactctgaaaacaatgttatctacagtataaatcaactattttacacgatctgctaggtgttaagctttgttgcttggtgtggttgttcgatagagttgtgatcggatggtgtggcttttcaatgtcgtttcctatacccgctttcatatcgagtatcgtgtatctattgctatctctaggtatgatatagcattgtagcatgtcttggcgtgtagtggtgcaaccaaagttgtgcgcagcagagtaggtttgctccattgtgcattgcttttaggttcgaatccattaaaaatgctcccttgtgcattgattttaggttcgaatccattaaaaaactgattgtgacacatcattttttatttctttttctaaaaaccatggcaaaacatttatggtcatttcaaaaataatgaaatgtgccctttctttttcttatttccacctatgtaatcctttgctaccaatcacattatcactctgaatacatataaactaccgcgactctagcacgtaataatgaaggtcctgtttgtttccttccaggattacataattcggcctatggattatataagcacctaatgatctgcttatggattatcataatctagatatctcgattatgtaatacacctaataattatttgtttgtctcttaacttatttaagccggattatacttcctctgttcgcttaacttggtcattttagcctgattgatttgtccagtgaatttgatgctcccgcagcccaaatactgtgtcccatccgtgaacatggaagagccaccgaagacggagaggaacttgtcaagcaaggatacatacccgacttgggcattttggtcttcagttgcggtcgttgcacgagctgctagaggtgtttgtcatcgttgtaacatcagcgtggtccaacatcttccgtatgttcgcaaacattcctccaagccatgaagaggtgctttgttgatcaatctagatgaggaggacgaggtcaactttgtgaaggtacaaatggagaatgtaacacccctggtgttatgtgaactaaaacattggcatgccatcatatgtactggcattatattgctcgtgttacacttagaatgcatccactagactaaaatttcaaaaaaatatgtgatgtgatacttggttgggtatagggtatacttttcagggttgcttgaaccaagtgaggagtgagtcaccccatgagttagtagtgtcaattgaccatatggtcaaagtgggggggggggcggtt

SEQ ID NO: 5682 - DNA, 2137 bp, Zea mays
gcggccctcgtgcctcgcccacgtcgcccccacggccccacggccgcaccaaccaccagccccgatttcctcctaatcaatcacacccccaaaccaaaacccaaacagcacttctcttccaatcgccgacgtcgccggaggcttcgccggccggagcagcgccgacggttgttttgcccctccctcgtccggcccagcagcccaggcgagcatgccttcgattgcgccaccgtcttcctccgtcgctgccctcacccgccaaccggtgcaattcttcaaagggtgcagtgtatccaaggagacaaagggaccggtccgcagtttcttcactgcaaattcaaagagcaccaaggtgaaatcagcgggcttgaaagtagcgtcatccttcaaaaatgatggtggttatccagctggcggtgtctcttggaaggacgacactctattgccaaaaagcacaaccattcgtggccaggaccatccggttgctgaccctgtactcccaatggattccatgattacgccagaaatcctctctgctaatgtggaacgtgttatagacatgtttgcagatgatgacactgatactgaacttgatttggatagcccgacagagggcttcgcatcaattgcagaagccattgaggacatacagcaaggaaaacttgtgattgttggtgatgatgaatcaagggaaaatgaaggagatctgataatggctgcctccttggttaccccagaggctatggcttttatagtaaggcatgagacaggaattgtttgtgtcagcatgaaagaagatgatctggaaagactgagccttcctttgatggttaccacaaaagaaaatgagaagctatgcactgctttcactgttacagtggatgcaaaagagggcacaactactggggtatctgccaaggacagggcaaaaacagttctgaaacgggctggccacaccgaggcatctgttgaccttgccatgttggctggattacctcctgttgctgtcctttgtgaaattgtggatgatgcagatggttctatggctcgcctaccaaagttgcatgtctttgctgaaaaggagaacttaaagattatatctattgctgacttgattagatgagttgaattaccaaaacttcagcttctggtataggaggaaaagagacaggctaattgaacgcgcttctgttgcacgcttgcctttgaaatggggcaatgtccatgcctattgctacaaatctgttattgatggcattgagcatattggcatgatgaaaggtgatattggtgacagccaagacattttggtgagggtgcactctgagtgcctcacaggcgacatttttggatccgcaagatgtgattgtggcgaccaacttgcgatggcaatggagatgattgagaaggctggaaggggcgtattagtctatctccgtggacatgaaggaaggggtattggtctgggccacaagcttcgtgcttataacttacaggatgatgggcgtgatactgtggaagctaatgaggaacttggtcttcctgtggactcacaggaatacgggattggcgcacagatattgcgggatctaggagtccgttcaatgaagctgatgactaataaccctgcgaaatatagtggtattaagggctacggattgagcattgcgggcagggtgcccttgattacgccaattaccagtgagaaccgtaagtacctagagactaaaagaacaaagatgggacatgtatatggattggccaatgcgcaggccaaccaagcaaataaatggcagccagagcacagaagagaatcattaggcccccaagcatgtttccattattattccagcaatccagcttcgtggcacaaaagagtgatatgattcttcgtttggggagttcctgaaatcttctccccctatatttccgtagattctttcgcaaaaaagccgatatttcggtagatcgatttcttcaattgtaacggtaggttttaaggtggctaatctctactacttattaagttagcaatagtagcctgcctttttgtgttctgccgtgtagtctctgacaggtagggcccgcttgctcctgcgtgtatgctcccggtttattccgtaacacttttttttac

SEQ ID NO: 5683 - DNA, 1634 bp, Zea mays
  misc_feature (537)..(537): n is a, c, g, or t
  misc_feature (707)..(707): n is a, c, g, or t
agaatattcatcaatgatcaattcacagcctagtcatagtggcattgtgctgtcgaagcagacggcctatatatactagggttgaaaacggtcgaaaacgatcggtaaacactaaaaccgttactgttttcatattttttatcggaaatgaaatcagaaacggtaactccggaaacggaaacgatatcggtacttcgaaaacatcggaaacgaaagttcggtacaaaaaatacgttggtaacggtcgaaatctaaaattcgatcggtaaacatatcaatataataacttcacaatacaataaagatcgcaaatatcacaagtacacaattcacaatataataagttcacaaaaattacaagttagtaatttaacaagtttaagttcacatagtcaaagatcaacctttccttgctccaactatattaaaaattggctagttaatcaaacaactcgatattataaacaattaaaatatacactatatatctatatatatacgcaggttatatatatatatatatatataacacggatngtgcagacaggagccttgctcctcctgcgccaatgcgccatgcagacaagagccacccgcacgagccttcctcctcctgcgccatgcgagccacacgcgatggcccatatagacgtgacggtggcccagtagcaggaagcgcctttcagcgctcgtgatggccaagcgcngtgcaagcaacgcccaccatgcaacaggtgggtgtatattttgtcccacatcgcctagttataatagattgagtcactgatttttctatataaagacgttgtgccaagcttctttgaatttttctgaatagctaggcctgacttaagtgtgggcctgactgcctactttattttttatttttgaaatacttttgttttttagtatcttcggaaaatttcgaaatttaaaatcggtaaattccgattaaattcggtaatcgaaggaaacggtcggtaaaaggctgtaccgatttcgataccgattccggtataaaattccgataaccgatttcgattccgaaaaataccgttattgttgaatctggtcggaaaaaatcgaaaacggtatccgaaaaaccgaaaaattccgaaaccgttttcaaccctaggtggaagactcctccaactctgaggagtggagcagcggcaaaagcaacggcgacgaggacgacggcagcggcaacaacgacgacggcaagggcggcggcgatggtgacggcgaagatggcgagggtgatggcgacggagatagcaagggcgacgacgacgacagtagcaagggcgacggcaagggcgatgacagcagcaagggcgatggcggcgagggcgacggcggcgacggcatggccagcgacataacgccgttggtgtaaatattagtataggtaacaatagtagtagtagtagaataaggtagtgttagttagtatcgtagtgtagtgtgagtagcagtgtagtgtactgtgatgtaatgacccaggggtgacgaggccgactcaagatgagttggtctcaagtttgtaatgatctccccttatgaatgaagacaaaaaaaaaaaaaagctatatccccccccccccccccgaggggggggccgggtaccaatt

SEQ ID NO: 5684 - DNA, 2286 bp, Zea mays
gagaattctttggatgatcaatatgtggataaggtgaagttaggagagccaggatacagggagcgttattatgctgataagtttaaagaagaggcagaatcaaaacccattgttcaagttcggagagatgttgtccagaaatacgtggaaggtctttgttgggttatgagatactactatcaaggtgtttgttcatggcagtggttttatccctatcattatgcgcctttcgcatctgatctaaaaggcttggctgaattggaaataaccttttttttgggtcaacctttcaagccatttgatcaactaatgggaaccctaccagctgcaagctccaatgcactgccaaaatactatggggatttgatgagtgatccagattcaccgttgaagtctttctacccaaaagattttgagatagacatgaatgggaaacgttttgcatggcagggtgttgcaaaattgccttttattgatgaaaggcgtctgcttgcggaaacaagaaaacttgaagatactttgacagaagaagagaaattcaggaataggactatgcttgacataatttacgttagagatactcatccattgatcactcagattatcttcctgtatcagaactattaccatctatcaagaacagacccttatgttattcccattgagcctgctgctagtggtggaatgaatggattcctatgtttatctgaaaggaactggtatagtgtcactgtcacttctccagttaaggggttcaatggcattgctcagaacagagttttgaatgctgcctatctcaatcctcagtatcacaaacacatcccagagcctccagcgggggtcatcatacctgcgaagatactgaagcctagtgatttcaaaccctttcctgtgttgtggcatcaagataatagtcgtcgacaagtaagagaaaggcctcaggtttctggagccctgtccggttctctcttaggagaagctgcacaccgactggtgaaaaactccctccagatcagatctggcaatgctgctgggttactttatatgccatacagaggtgcaccctatggccctggaaacagaccaaggcctgctgggccattggggtatgagaggggttttgtggataatccataccatgcacacatgtctagaagtgttccaaaccctcacgctcaattctttggtgattctcaagctaacagacagcccatgcggatactagaacggccagactcccgaagtcatgatgctggtatccgtgcatcaatgtctaaactgacaatccaagaagggccaaggcctcatcaaaataacaggatgcagaattccgggtactggcccaatcaaccacatcctactcactttactggacccccagcccagcggcctatgcagaacatcagttttacacctcagcgacctttccaaaccgggggatttccgcagcagagacctgtaaatggggctccaccaccattacctcccagtaactggattggtaagcaaccaagtggatgccacatgagtgtatcacctgcaaaactcgatccaaggacagctccagacagacagcccaagcaggataacccaagatctcaacaggataagaggcagcaggcgaccaaggtataccgtgtcaaaactcaagctactaatgttaatggtttgtcagagccaggtaaacaggaagaacctgaagggtaactgggttgctgcaaatccacacgccaagtttaatgtgcgtggagagaatacgctggctcttggtgatagcagcagagggtttccatgtatccctcccacaatttacctttcgatgttgaattgtttgttgtattacccggaaaggagtcggctaaattttaggtcaggggatttagacacagcttttgtttagttgataggacatggtatgggcattcactgcttgttgtaaagctgttagttggatagctgaaactgttttgtgctggctgactgctgcatattcaacatagacccgtgcggaggctggctcaactgccctgctcctgctctatctcatggaagttgggggcagatgtgcttgtggtcttcaaactgagcagtttgtgtctctgagaaaggaggaagcattccgaatttttcattgtaccgttgaaccaagttgagtctttaacactgaaaagaacatgttcctctcgagcttaacgagtgccataattaggacatggaataatatatatatttttcttttctgggatgcaaaaaaaaaaaaaaaaaaaaaagaaaaaaaaaactcga

SEQ ID NO: 5685 - DNA, 2229 bp, Zea mays
ctcgaggccggcgcacgagtcttttcccttctccgtccggttgtcaccctgcctctgacgaaaactctcctctgactccgctccacccccttctctcacttgtctatcggcggccgtcacctccgctgggctgctggcctcctcactttgcagttgctgcacaggcaagacacggaggcaggcaccacgagtccacgacgctcgctcgcgcgctccgtgaatcccctcgtgactcgtgagggctcgaggcccgacgggaggacgaggaggcaagaaccctagcgccggcgccggcggcccgtaaggctgctgagtgaaaatgggagtggcaggtcacaacgatccattgttaggtgaaacgacatgtgggtctttgctgcagcaacttcagctgatatgggatgaggttggcgaaagtgatgaagatcgtgacaagatgttacttcagctagagcaagagtgcttagatgtttataggagaaaggttgatcaggcttctagctccaggtcatgtctcctccaacagctttccaactccaaatcggaactgactagactcctttctgcattaggagagtcatctatttctggtgctcctgacaagacatctggtacaatcaaggagcaactagcagctatatcaccatctttagagacactccgcaggaaaaaagagagtagggtgaaagagtttgctcatgtacaacttcagattcagatacttcgtgatgaaattgctggggatctacatattggtgaacagttggaaacaccccatgttaatgcggatgatctttcagtgaggagattaaatgaatatctttctgaactacaagccctgcaaaaggaaaagagtactaggctctcaaggattcttgaatccgtgagttcagtgcacgatctctgttctgtacttggcatggattttgtgggcactgttactaaagttcatccaagtcttgatgactctgttggtgtccaatccaagagcattagtggcgaaacaatatccaagctgtctaaaatggtgattgtacttgaagaagaaaaatcgaagaggtttgcaaagattcaagctctagcttcccagctatctgatctttggaacttaatggattctcctgtggaggaacagcaaccttttcgtcacgtaacatgcataatgtcctcaacattggatgatgtgatagttccaggagctctggctcttgatgtaattcagcaggcggaactcgaagttgaaaggcttgatcagctaaaagctagtaggatgaaggatattgcattcaagaaacagactgaacttgaagatatatatgcccgggctcatgttgcagtagattctagtgctgcaagagataggataatgtctattattgagtccagtagtttcgagccttcagaactactggctgatatggagaaccagatacttaaagcaaatgaggagtccttaagcagaaaggacatattggagagggttgataggtggatgtcagcatgtgaagaagaaagctggcttgaagactacagccgggacgataacaggtacagtgcaactcggggtgcacatctgaatctgaagcgtgcagaaaaggcccgtgttttggtcaataaaattccggctattgttgacacactgcttgcaaagacccgggcatgggaacaagagcatggcgtggccttcacctacgacggcgtccctcttcttgcgatgctggacgaatacaaaatcctgaggcaggagaaggaagacgagaagcgacgaatgagggaccagaaaaagatgaacgaacagctagccgccgaacaggagaagctgttcgggtcaaaaccgagccccgcgcggccgcagtcgtcctcgaggaaggtggctggcgcacggaccaacggcggtggcacgccagctcgcaggctgtcggccctccagagcggcggcaggaccgctagccgggatgggaggagggatgcgagcaggcccgtggcccccgtgaactacgtcgccatcgccaaggaggacgtggcctcgcaggcgtccagcaaccacactgggccgtccaccccctgaccggccgtgccagcagtaactgaactgttgtggcggtgcttagatatatatataccagtgcagtgcagtagtcagagctgattgtagatcggataatggaaaaaaacaaacgaagctggatatggtatcacaaaaaaaaaaaaaaaaaggcccctagggcc

SEQ ID NO: 5686 - DNA, 5419 bp, Zea mays
ctttgtattgaacaaagcaagatacctactagcaagaggtagcaacacaacaacaattactactaagtataatcctcacaaatctagttgagcaagtattgtacaacaagtagattgatgtaaatggaagagtaagtaaacacgacttggttcatctgtaactcctctaagtaccgtatccagtgcaggatccgatgtgccacctgacatatccagtgcgttgtaagctcccatgtacatgttatagctcttaccatgcgtctttgtccggtgtggtatcgtgtgcacatatctggtgcacatgtgcatgtccggtgtactcaatgttcattccattctttagtacataggctgcacttgtgcggtgcaacatctggtgcacctctacagtcttgttttattcgtttcttcatgtttctttgttcgggctgctttcattccatgtcttggattcttgaaagatctccataggtctttaatgagccttctaataatgcctttctttgtggtattgatcttttctatcatcatattgcctttcgtcccaagttcgcgctgcatgctttgaactataatcataaacaccaacaaattttactagctcaaatggttatgttgatcatcaaacactaaaatccattaattaaatgggctacaatgatagtctcccaaaaatcaatagaatatatttcaaaaaacatttttaagtatttatcaagaggccttaactgcttttcaaacaatggatgatactttatcactcttagatgttgtatatctaatgagttggatatcgtagatacgtagaacttgaaaaactagtcgtccttcggcgtgtaaacgtggttggttacattttgatagttttctcgtaaatctcttctatgtaaatgttttactatgtaaatatgatattatgaatgtattgtttggtacgtgaagatgtaagggcttgtttggttgatgaggattaaagaggattgagagacatataatccttataatttcttccaatcctcataaaaccgaacaagccttaagggcttgttcggttttgcgtcgtgtggatcgtgggcttccccggaggagcatggaccgcgttcgttcgttcgttctgtgacctgatcgctgctgtgctacaaccttcgttgtggtctgcacgtacgtagacacgcacgccttgataatcttggtacattcaccctcgtgctatttccttgtcgtcttgtcagtgttactgcttactgcgcctagaggagctatctattctgccctcggtgacctggttgccatgccaccagcctgctagagtggttatcacgcattgcgacagctacccttgtatagtactgggggctggggcgtacgtggagctgaagaccgaaagcaaaattaatgggaagttgctaacagtacaagcctcttccccaaaaggaactttactaattccaaaacaacccggaataagtgtcagagcatgcttagattattaccaccagtccactactcattaataacgaggtcaaatggacgtgggatacgtgaagttaggggggggggggggggggggcgcgcgcgctggagctgttgcttatagaaaattatctgtcagaaagattctgacgccaggggcggcgggcgcgcggggcaaccgttcatgttaggcgaaagcaatgggcgccatttccacacacctactaatattaccttaattagttaaccttcgatatttcgatgtggcattcaaaatatggaccaaacaggttcgacaagtgtggtcaaggaggaccgtgcgtgcacgcgagaagaatactcatacaaagcaagtgtatagtaatattccgcccgttttcgtaccagctcgtgcttgtaagcatcagccaaaaatgcgtgctcaaacgtgtctgcaggcccagcgagctttatacgcctgcccccacaaatgttcggccggcgagcggccacgaacaacagcgccactttgctcccagtgagcagcacgagcggcgggcaaaaccgtagggccggccccaaaagagcagacacgagtacacggcacgatacatcagccaaaaaccctgtaataaaagcggtgggaggagagtttgcatgcatgcgcagcaagttgcgcggggggtcgaggcgcgagttcgacggccgacgaagggaggattccgcgcgtggtcaggagctgattggcactgtgctcccccccccggtgtcgctcgttgcgaactcgcgagatgacactgtcagcgctgtaattggtcggataacctgggctctgcgtgccgtgccgtctcgtgatggaccatccagccgtaacgccaagccgacccgaccctttggcacgacacgagcggggagatgggcatgcacatcacatcagtgttcggcgagggcacatggactgtctctttagccagtactagtaggccgggtacgggcacgggcacgagacgaggaggaggggcagcgcagatgggttcaatcacttgagcccttttggtatggtccttgtgcctggctttcttgcgacgcgccgtacgtgattctcgaccgaccgtcctctctgcacccgcgccgtgcctagaagcgcacgtccgcaagacgattcggccttttctcttgggaaaaatcaggcagggctccggcctccagcgtggggaagttttgcgttcaggaaacgagctctccgcgtgcgtgacaccccaagaagggtggaggtggagcgcgtgccggacggacctttgagcctgcctgcctggctgccacgactcgacagctgctgccaagagtccaagacccaagcccgcccaccaaacccgattgctggatttgctttgctgcatgggagccccggatttgggcctacatgctcactgttaggtcactgtcatgtttccggtcggctcctggctgtaaatacaggaaaagtctcctgccacgccacaaccctgcaaccactaaaactttggtcggttccggcccagattttagtttgcgagaatttctgacaagttagcaccaggctaccggactcggattccatagccagcctcaccgcgaaaagaaaagaaaaagacgctacctcacagctactagcagattcaggtgtatccgtcgccgccccgttagatcacgggctggctatggcgctgcaacaacatgcatggatccacatccacccgacctctacacgggcgcgcaggcaacggcagacgcagagcagaggttcgcagggctgctcggccaatggcgtcgccgccgtgcagggtgggtggggacaccggcacgctatcatttcgcctgccctgtttacgggtgctctgttgatcagcaggggatggcgtggcgtgccgtgcctttttacaggggaggtggtgatggcccaacccaactcgcctgcggccaaagccgagcagccagttctcgtctcgtgtgctttgatgctccgattcacccccccggatggaccgctccaagcctgccctccaattaacaaatgggggtcaaggcgcagtctgattaccgcgccaattaaaaaaaaaagtgattcgggctcagatcagcgtggagggcgctcgtacagccctgcagttttctcgctctgttctcatgtgcgcctctctggtccgcgcgcttgttgtcttgctgctgggcagagagctccaagggtggtggtggtggtgtgggagggagggccgaggggagaggaggagcaccaagtgcaataatggaggccgtcagatggccacgccggaaatggcagtcccaaaagggtgaggacaaaggaaaaaaggggggttgccatccccatttactgcgccggctctggctgcctgcctgctcctccctcttcttcctcagcgggaggcatttgctctgctcacagtcacagctctcatctcccactcccagtctccttcgccaaaccgcccgtctcgctgatcccaaaactccactttactttcgtctccctctcgtgctctgtcaatcagcacccagcaatgtctcccttttgtcgatcagcatcctcgttggacgccacccagagagaaagatgtcgtggtgtttcggaacagaaagagagattaaaaaatatatataaacaggatacgaggtgacatgcatctttagcaggctgttgcgtctggtttctttagctatacatggccgggcgatgacgacgttgttgttgttttttttaccgtggtcgtggtacaactaacaacagaagagatccactagatttcatctcagctgcctgcggtgctccttcgcagcactgcagctgtaaagaacccagatccccattccccttgaagaaggggattcccaaaactgtccacgataccacacgcatctacctcgcaacgctaggtactgtactagttactactctttacctaatcgagcaccggcaatcgagaaaacgtcccagaaatgggaggtaaaaaagaagaagaaagatgaggactcctaatcaagactgatgactgatctatacacacatcacctaatctgccttcttccccgtgtccccccggcttgcagcttgcttgcttcagccccatggctgactctctctctctctctctctctctgatcctggcgggcgggcggacgggcggggggaactgcgaggggtcgagcctcttcgccggccggccctggagccgtggctacgagcagtccttccagcagacgagcatggtgacgcagcggcgcatgatgtagaagcgcgcccgctgctccttcaccaggcccgcgcaccggctcgagaacgacggctgcggcgcgcacccgcccgccgccgcggcgccggcgccgccggtaccgcgccggccgatcgccgcgacgtccctcatgctcgacgatctcttcagcagagagtccccgccgccggatcccgggacgcgccggctgccgttgttccggctcttcttggagaacttccacttctcgtccacgtacaactccatggaccgatggatgcgcttcgccggccttggctcgctgaggtgggtagctagtgaggagaaagagtgcgctggacagagggagagagagagaggagaggtgtggccgtgtcccggcgcgcgccgcccgcgccgcactggtaacaagggtgagaggtgagaggggagagctggagagggcacgggggaatggaccgagacctgcaccgttttcttcagcggggcagcccccagccaggtgtgggttgagttggactgccttctttctcactggaatctatatcccgttgtgcatttgctagctttatttttccgtggtccagcggaaataatttccagccagtttgcaccgtgatcgcttccaaggttctggtcagcattttcaatcatttgtgaatcctgtcgttggttgctccttattttgtacgctagacttt

SEQ ID NO: 5687 - DNA, 2474 bp, Zea mays
ttgggtacctcgaggccggccggccccaaaggatggcaaactcaaaagatggagcacaactgcacaacaccctagaacagtagtgtgatatgtagctcaataggttggttggttgtgtatcacaagagcaggggtagagacacagagagctaaaagaacattggacgcgagggagcagagtagaactgtagaagggagtggtgtacgtgcgctagactgccagtggcagctgctctgcaagctagctaaggtgaaggatggatatcgagtcgaggcaagtttccaaaggggacgccatagctgctgctgtctctgttgactggaagggaaggccctgcgaccccctcaagcacggcggcatgaaagccgcggtcttcgtcctagggatccaggcgttcgaaatgatggcggttgcggcggtggggaacaacctgatcacgtacgtgttcggggagatgcatttcccgctgtcgcaggcggcgaacatcgtgaccaacttcatcggcaccgtcttcctcatctccctccttggtggcttcctctccgactcctacctgggcagcttctggaccatgctcatctttggattcgtcgagctctcgggtttcatcctgctggcggttcaggcgcacctgccgcagcttcgaccgccgccatgcgacatgatggcgccggggcaggcgtgcgaggaggcgagaggcttgaaggccggcatcttcttcgctgcgctctaccttgtggcgctaggcagcggctgcctcaagcctaacatcatcgcgcacggggccgaccagttccggcggggcagcggcagcgacgccgcccgccggctgtcgagctacttcaatgcagcctacttgagcttctgcgtgggcgagctggtggcgctcaccgtgctcgtctgggtgcagacccgctccgggatggacgtcggatttggggtctcggccgccgccatggccgtcggcctgctcagcctcgtcgctggcgtcgccttctaccgcaacaagccgccacagggcagcatcttcactcccatagctaaggtatttgtcgccgcagtgagcaagaggaagcaagtgtgcccgtcgacggcctccacgcaggcggtcgcaggttctaccgtccatgagatgtccgttaacaccacagacatttgccacatcaacaagttcaggtttttggacaaggcatgcatgaaggcgcaggacggccccggcggatcgtcggcggggaagaagagcccgtggattatgtgcacgccagcagaagtggagcaggtgaagctgctgctgtgcgtggtgcccatcttcgcgtgcaccatcatcttcaacaccatcctagcgcagctgcagaccttctccgtgcagcagggaagcgccatggacacccgcctggccgcctccttccacgtcccgccggcctcgctgcaggcgatcccctacatcatgctcgtcgcgctcgtcccggcctacgaggccgccttcgtgccggccatgcgccgcctcacgggcgtccccacggggatcacgccgctccagcgcatcggcgtcggcctcttcgccgtcaccttctccatggtcgccgccgcgctcgtcgaggcccggcgccgccacgccgctgccacggacggcggccgcctcctctccatcttgtggatcgcgccgcagttcctggtgttcgggctctcggagatgttcaccgccgtggggctcatcgagttcttctacaggcagtcgctcgccggcatgcaggccttcctgacctccatgacctactgctcctactcgttcggcttctacctcagctccgtgctcgtgtcgctcgtcaacaggctcaccagtagctccagctccacggcaggcaatggcaatggcggctggcttgccaacaacgacctcaacaaggacaggctcgacctcttctactgcctcctcgcggcactcagcatgcttaacctcttcgactacctcttctgggcacgctgctactccacagagcgtagacacgctgcaagtgcaagtcgtcggactcggaagcggcggcggtgagcagcagggtgacgaaatgacacccctgagtgctgagattaatatgactgggtccttgaaaacaagttcagccaattaatcaactaaactagcgtacgtcaagtgtaggtatcttgtctgctttcatggtttttcttcattcgcaactatcttagaacatatgtgtgtgtgagggttagattaatctcacaaagcgatagatagctgatcacaattaacgaccttggccgggccaagttaatttaagggtgtgtagttatgtaaattcaactcatgtatggatgcatgagtagaagtggtttgggtagctgaacctatatattagtccccttacacgcgggttgagctaatactatgtatatgtagttgtgtgtaaatgcaaatgatgtattatctatttatttatcttactatttcgacaac

SEQ ID NO: 5688 - DNA, 2701 bp, Zea mays
ctttgcctagtgtcaaaaaacacccaataaaaaactctttaccgagtgttaaaaaaagcacactgccagaaagtttttgtcttgtgtcaaaaaaagcactcaataaataagttctttacctagtgtccaaacaagcactcgataaaaaagatctttgccaagtgtaaacaaacaaatggcaaataagttttggcgagtgtttttttgacactcggaaaatatctcctttaccaagtggcttatatcggcaaagaattgcaaaaacaagtccagattgtaaactatatattcctacacaaaaagaagattaaaggcttatatcgaaaacaataatttagaagcaggacatgaaaatcggcatgactggttccaaaaacaggtctggaaagttttcatggactaagtttaatgtggctggcgggtgtagcagggaaacctgttcttccttcgctcgtgctttgaattttgttgcatccattttttttaatattatctcgtttcagaattttattgtttcagttgaatttgcatgttgtatttattcgcaaagtttggcctagccagcagtacccccacggccagcagggcccttataaataaccgttccggttgcctagaaacttaccaagacatcgcaaactcaaaagatggagcacaacacaacaccctagaacagtagtgtgatatgtagctcaataggttggttggttgtgtatcacaagagcaggggtagagacacagagagctaaaagaacattattggacgcgagggagcagagtagaactgtagaagggagtggtgtacgtgcgctagactgccagtggcagctgctgcaagctagctaaggtgaaggatggatatcgagtcgaggcaagtttccaaaggggacgccatagctgctgctgtctctgttgactggaagggaaggccctgcgaccccctcaagcacggcggcatgaaagccgcggtcttcgtcctaggttcgtgcgagagctttttctcctctctcggttccaaagttttatttggctgaacaagtgttggttttccacccttcgttcttgcagctctcgctgtgttaatttgtgttccttgtgctctatatgattttgctcttcataatttggtcgatgaacctgcatgcgtcgtcgtgcatgttgccagggatccaggcgttcgaaatgatggcggttgcggcggtggggaacaacctgatcacgtacgtgttcggggagatgcatttcccgctgtcgcaggcggcgaacatcgtgaccaacttcatcggcaccgtcttcctcatctccctccttggtggcttcctctccgactcctacctgggcagcttctggaccatgctcatctttggattcgtcgagctctcggtaacaggaaactaataattgcatataaactattcgttccttcttatgcttcaatcatcatccccatataaagaaaagctttagctaaaatgatgccatgccacctgcttggggggctcgtttaagaacggttgattgcattcctgtctgtttctgtgcaagagggccagcagcctgatgatgaacaggatcatggcatttaatttaatttaattaactctctctctctctctctctctctctctctctgctggttacgtactgttctttatttatttttttcctgtaagtaaagtggtacggtaaataggaagagaatttttttttccgtcctgcaaagaaaacaagcttggtactttaattaacggcctgaaacaaaaggaaaagatatacagtaacaaacagtttgcttgctcagtgagaaaacagtgctttgatctgtagagaggcaagcaagggagaaataaaggcaatgaaaggacaggaacaaatcatcactcccaatgccagccgtctagtgcgcctcttgagtgcgcgccccgaacgccaatccacttttttcctgcctcatctttggattcagtgcatcagaagaatggcaacagcaaaagctgctgcagtgcaccaactaacttaatctcctctgaatggcaattagtaataataatctctacatattgttaatatatatctacttacttatatggcactggcagggtttcatcctactggcggttcaggcgcacctgccgcagcttcgaccgccgccatgcgacatgatggcgccggggcaggcgtgcgaggaggcgagaggcttgaaggccagcatcttcttcgccggcgctctaccttgtggcgctaggcagcggctgcctcaagcctaacatcatcgcgcacggggccgaccagttccggcggggcagcggcagcgacgccgcccgccggctgtcgagctacttcaatgcagcctacttgagcttctgcgtgggcgagctggtggcgctcaccgtgctcgtctgggtgcagacccgctccgggatggacgtcggatttggggtctcggccgccgccatggccgtcggcctgctcagcctcgtcgctggcgttgccttctaccgcaacaagccgccacagggcagcatcttcactcccatagctaaggtatttgtcgccgcagtgagcaagaggaagcaagtgtgcccgtcgacggcctccacctccacgcaggcggtcgcaggttttaccgtccatgagatgtccgttaccaccacagacatttgccacatcaacaagttcaggtttttggacaaggcatgca

SEQ ID NO: 5689 - DNA, 1342 bp, Zea mays
agactggtaggttggtagctgttactgaaaaactaagagaaggcaggacggggaaaggagatggagctcaacagcatcccctatattgcgtcgtggtcttcctcctcgagctgcttctactacagctacagtcgctgcgcctgcagaggtacaagagatgggaagctggtaacaaaagcttctgcagctggtcgtaagcgtgctgctgattcagtatgttcacaactctctgagcagggaactgaagattccatttcaggtcctagatcttcctggcgtataaggaggagagaccttgcttctgccattttactcccttttctgattcctcgtgttaacatctctatcgcggctgagatatacgacgcatcaattattcgaagtggtgtgaggagtgttttaaccaagggcaaggctgctggtgtgcttcggttggttttccatgatgcagggacttttgaaattggggacggatcaggtggcatgaatggctctataatttatgaagttgacaggcctgaaaacattggcctaaatagatccataaagatactaagaaaagcaaaagaaggaatcgacaacgttcagaaagtgtcgtgggcggatctgattgccgtggctggcgctgaggcagttgcgctctgtggcgggcctgagattccagtaaggctaggaagagtagattctagcagtgctgaccctagtggtaaacttcctgaagaaacattggacgcagcttccttgaagacattattcagcaagaagggcttttcggcgcaggagctggttgttttgtcgggagcgcacacgattggagggaaagggttcgggagtccagttgttttcgacaacacctatttcaaggtgctgctcgataataggccgccgcagacatcttcgaaagctggcaatggcatggcggcgatggttgggctgcgcacggactgggcgctcactgaagacgacgagtgcttgagatggatcaggatctacgcagaggaccaagctaggttcttcgacgacttcagggacacgtacatcaagctcgtagacagcggagcctcgtggagaacagcttgactagaactgcctgtttctctacagtgttaggccttgttcggttataagggaataaatcccaccatggatttaatccggatctggattggatgaatccatatgtcacacccaatcctatggtgggattaaatacaccatttaatccatgtatctcttaaaactagctattcttttgattcatggattctaatataaacttgtgcaacatcttcatggatttgccccccaaaaaaaaaaaaaaaaaaaaaaaaaaaaaaaaaaa

SEQ ID NO: 5690 - DNA, 256 bp, Zea mays
cggtccctttccgcatcaacccggtgcaaggcacccacgccagcatgaccgccctgggccaggcccttggccgggaaacccaggccaaggcgttcctcgacttttatgaccagcacatcaaggtgatcaccgacgccgtcgccaccttgccgaccggtccgcgcccgagcgtgttcctggaactgctggccggcgcctggcaggcacccggccacaccaccggcaagagcggcatgggcgaagtgatcaagctggt

SEQ ID NO: 5691 - DNA, 4612 bp, Zea mays
  misc_feature (1231)..(1231): n is a, c, g, or t
  misc_feature (1241)..(1241): n is a, c, g, or t
tgtgtagggtcaggtcagaccgtcagagacaaacgggaacctgtgcaagtaaaaccacttgtcggtactgcatgcataggtgtaacgtgtttgcggtgtgcccacgaactaccactgcaactgcaacacgattttatttttgacgagacgagcgttccttgtagacagctgtgatgttgtaaattaaaacacttgtgatgtatacaggttcgtttcatcaatgattgtgtttaatcgcttgtgatgttgtaaatgtttggctcggtaaccttttcctatatagtgtatttattttttagagtgatcgttcgttgtacttggcatgggaaaaccgcttaataaccttttttagctagctagctagctagctgctttattttgagcaaataattaattgtactgatagtacgtacagtacagtacgtgtttggatctaacagtattaatttaagctgttaggttggatagatctacgggtgatgtcttgtgtctcccctcaaccaagtcattgtactcctactcctgtttaggccggcccaacaatctttaaagaggagagagagagagagagagagagagagagaggactcaacaacgccattaatggtaagctgtgagctttacaattagcaatgatatatcatctagtagctaggcttagggtttgggaacaagattgctcaattattgtgtaccctaattagtccacacgcacacatatcttgctaacaatcacacataaacattcttccgtctacagggtagcgtgcttgcagctagctagttacatttttccggaagccaccgtgcgtgctttcgtgttttcccagggccctttacagccatcaacctcatgaatcttttagatatacgatgcctgtggacatgggcagtgatgacttttaggcttcgcacaaggtacatatcataaacaaaatgctggccctgaccgtcatagtcagtgatggatggagatggaataaagcagagcagtggaaacgcatgcccgaacctgttgctgttggtgactttttcctcgcttatgctgactgcctggccgatccaatccagccagcgtgcatggatccattccagctttgcaaacagaggaaccagatctgcacagggcatacattcattcattcactggcctctcctctcctccaaagaaagaggaaccacttcctaaaatattcaacaagttatagaacatatccctttctttagcgtngagcatccantcctccaaggcccggccatttctttggagcccccattcgtttcgttttctatgatacccaccaggcccctcatattcctctctgctctctgctctctgctaggcggcataatacggagtatatagttttcccacttcaccgtacgatacgttgagtttgtgattcaaattctgaagaagacgatcacattggcgagcgaattgaaggcccgtcgccggaagacttggatcgttctctactcagtttagggtttcacctgtataaatacacttgtaatccgcatgagatagctatctcaagtgtaaccctccggcgatctgtaaacacccgaaaaatagtgagattgttcctggccgacgcccgtggttttttacccttcgtcttgaagagggtttcccacgttaaatatgtgtcttctctgtgtttgatctattttgtgtcgtattgattcatgacaagatatctggacttatcactagcttagctccttgttcccaatcataccagagaaaacaaagtttgttcggtttgaggtggattggaagaaattaaatctccttatattcaaatttgtatagaagaggattttatctcttctaatcctcatcgatccaccgctaaccgaccctaagtaagaattagctacatgtatacacagataagcaatccatctgacaattcaacatatgagctttatcttggtgattgtgggcctccatgagtcattccccctaccggttttaaaaatgtctgccattgtgacacgcttgtagtgactcactacccgtctgccgttctgggcctctttctctgaggacctgctcgctctcggcctgttcgaggtgctggggcacgcggcgccccgcgtatgagcttggtcgcgatgggccctgcacccgtccttgtcacatgggccaccacacatatagcaatctattcctctctctttttttctcatttttttatgatggaaacatccgcctgagcctcctctttctggaaaaaaaatcacccccaaactccgaccgagcatcttccccgggccggtaggccttatccggtttcttcttgcacctctccagtgagccagtcaccgccagtccacgccatggcttgtcgcgccactctcctgcctctcttcctcttcctcctcgtggcgcccgagcctgcgctcgccacatccggcaccatcgtcttcaccacgctgggccggagccgctacgcctttgacgtcttcgcgctcacgatcgccccgctctccgccgcctccgcggagctgcgcctcacggacggcgcctccgtcaactacaacggcaacttcgcgccctcctcctccggaccgccctccctcctcttcgtctccgagcgcaacggctcgctcaacctctacctcacccccgtccccacatccgcctccgcccgtcgccgcgacgcgctggaggaggaggaggaggactcggcgccgcccacgccgctgctcccgtgggaccctatcgcgctcaaggaccggccttcgctcacccccgacggcgcccacctagtgtacgtctccacggcggagcccgcgggggcgccgcgccggagctgggcggccgtgtactccacgagcctggcccccggccgcgccacgcgccgcctcaccccgcggggagtcgccgacttcagccccgccgtgtcgccgtccggggtctggaccgccgccgcgtcacccggcccgcgcggctgggccggcgaggtggaggacctccgcaccgacatctacgtcttccggacctccgacgggtcgcgccgggcgctggccgtcccggacggcgggtggccgacctgggccgacgacaccaccgtcttcttccaccgccgggacgccgacggctggtacggcgtgtaccgcgccaggctcaccttcacggacgacgacgtcgcgtccgtcgtcgaccggatcaccccgccgggtttccacgcgttcacccccgccgcgtcgcccggcgcgccggggctcgtggccgtggccaccaggcgcccgggttccgactaccgccacatcgaggtcatcgacttgtccggcggcggcggcggcgccaacaacaggagcgcctactacgaggtgacccggcccgtggccccgcgcgcgcaccacttcaacccgttcatctcgccggacggcgagcgcgtcgggtaccaccggtgccggggcagcgggaacggggactcgccgctgctgctggagagcatcaagggccccgcgccggacacgttctcgctcttcaggatcgacgggtcgttcccctccttctcgcacgacggcaagaggatcgccttcgtcgggctgccggggctgtacgtggtcaactccgacggctccggtggccgccgccgggtcttctcgggcaacgcgttcccgacgacatgggactggaagaggaaaggggtcatctacaccagcgtcggcccagacttcgcgagcgagagcaccgaggtggacgtggtcgccgtgtcgctcggcgacggcgacggcgacgaccccagcgtctccatcaagaagctcaccgtgggcggcgagaacaacgcgttcccgtccccttcgcccgacggcaagtgggtggtgttccggtccgggcggtccgggcacaagaacctctacatcatggacgcggaggacggcgaggccggcggcatccggcgcctcaccgagggtccttggtccgacaccatgtgcaactggtcccccgacggcgagtggatcgcgttcgcctcggaccggcacaacccgggcggcggcagcttcgccatctacatggtgcacccgaacggcaccggcctgcggagggtggtgcacagcgccgacggcggccgcaccaaccacccctggttcagcccggactcgaagacgctggtgttcacgtcggactacgccgccgtgtccgcggagcccatctccaacccgcaccactaccagccctacggggagatcttcaccgtaaacatcgacgggtctggcatccgccggctcacgcacaacctcccttttcggaggacgggacgcccgctcggtggggacgccggaccacctcaaggcggaggacgtgggcgagacgccccacgcccccggggcgcgcgcgctcgaggactgccactggctcaacatcgctgcccggcctgatggcctcatgtgtggcaagcacgcctagttatagtatctgtgggagaaacgggactcacgtatatatgtgtgctgtgtatatagtgcggtgatgccatcttgtttgcttgcatatgcatactactgaacatatgatgatgaataaggtcatgccaactttagggcaaaaaataaacatacttaaaaaaaaaaaataaaaaaaaaaaaaaaa

SEQ ID NO: 5692 - DNA, 966 bp, Zea mays
cacatgcgcgaagtctggaacctggtcaaggacggcacgatgatcgagattcgtccgtaatttttccgccgctcgtaaaataattcaaaaaaaattcctgccccgcgcagcgcttgccggtgaataccagttcaccccggcaagctgcgcgcttctgcccgatagaaagacctctctaataccacttgaattggcgcactattaaggcgcccgtaaacacttgcctgcaccgttttcgctgcattgacatggtatttaagtggtattagcttgcgatcactaccgggcgacaacactccaataaccgcatcggaaaccgacacgatgaaccccatcctggccctgcgccccgacgataaacaatcgacgccgctgtacctgcaactggcccgtaaccttgaagccgcgattcatgccggccaatggaaatccgagcaggcattgccgtcggaacgcgccctcagcgagcaactgagcatttcccgagtgaccgcccgcaaggcgctggaagtgctgttcgagcaaggcctgatccgtcgcagccaaggctccggaaccttcatcactccgcgcctggaacagccgctgtcgcgcctctcgggcttcagcgaaatgctccggctcaaggggtttgtaccgacgtcccagtggctcgagcgcgacatcaccccgccgacccatgaagagctgatccgcctgggcctgtcgccgagtgacaaggtcgcgcgcctcaagcgtttgcgtaaggccgacgacacagtgatggcgattgaaatgaccgccatgcccgcctccgtcctcccccacccgcaggccatcggcaactcgctgtacgaatacctggaaagcatcggcaagcccatcgtgcgcgccctgcaacacatccagggcgatcaacgcctcggacgagttcccagccctggtgggcatcgcccccggcacgccatgctgtgttgaccccgggtg

SEQ ID NO: 5693 - DNA, 2281 bp, Zea mays
  misc_feature (179)..(180): n is a, c, g, or t
ctactgatgacactttgtcaagggcgtttttcgtcgaaagtttgatattcgacaaagcccccctttgccgagcgtccgtgtaggccaagggttcagccctcggcaaagttggtttgcgccaagtggatttttcgttgagagtgacactcggtaaagcttattttgccgactgctcaatnnattgcactcggcaaaaatcgccacactcgataaagtgtcggattccaataataactgttttacattgtaaattataatgtttataaagtagagtttgtaacatagagtaagataagaagtgtgatagaaagtctagattgtctatgtaccgactgtcgcatgcctaccgattgccgctagaaccctcgtaaaaaatctgactagctagctacttgtgtagaccgtcccgatgcatgggatccacttgacgaccttcggttcggaatttgagtattactactattaatgaggcgtgatgattgacttatctcacagccgcgccccccaccgcacaactgaagtatgccattgtcgacaacttccatggctctaacaaacttgtgctcatgcccaagcagcagagctcatcagctgcagcttctatgcttctgcttggccctctcactgcatgtcccttatcatgccaattctctctccttcagctacagcttcttcaaccctgatgacttcaggccggaggacgacgcgcaggtcgtcgatggcaggatcgagctgctcggcgacgagttcagagggcgtgccagggggcgggtgtggcacaagcagccggtgcagctatgggacggcaccaccggcgaggctgccagcttcaccgcgaacttcagcttcagcatcgagtcagtggctggcaagggcgcggcaagcgctgggcacggcatgacgttcttcctcgcgccgtacacgccaaacttgccgcaggagtcctacgacggctgcctcggtctgttcgatgagagccaggcgcttaactactccaagttcaacgcgtccggcgactcgaggttcgtcgccgtggagttcgacatccgcaaggacatctgggacccgagcagccagcacatcggcatcgacatcaacagcatggactcccgcggcgactacacggtcttgccagacggcagcctcgtcgacgccggcgtgatgtccgcgacagtcgtctacgacaaccgcacgcgcagtcttcgcgtcaccctgatggtcggaagcgtcacttacacgtccgtagccaccgtggacttgagaagcttgctgccggagaaagtcgcagttggtttctcggcggcgacaggcgacgagtacaacgcaaaccacacggtgctctcgttctctttcgcctcgacgttggcaaccaagaacggcacctccatgcctgtgactgtgacctcgtccaccaagaaggccaccctgcaactcggcgctggagcggccgccgcagcgttgctggttttcctgctcgtcgccaccgtggcgctgctactagttcggcggtcaagcagaaggggcaagaaaccatacgatgacgagcagctaaccacagacggcgacgactccctcgacgccgtcgatgacagccacttcgagtccagcacggggccaaaacctatcccgtacgcccaactcgcggcggcgacgaaggacttcgcggcggagggaaaactggggcagggcgggtcggggtcggtgtaccgcggccacctgaaagagtccggcctcgatgtcgccatcaaggtgttctctcggggggcgtccatggagggacggaaggagtaccgggccgaggtcaccgtcatcagccggctgcggcatcggaacctggtgcagctcatcggctggtgccatggccggaggcggctccagctggtctacgaattggtcagcaatggcagcctcgatgaccacctctacagcacagaggtgacactgacatggccgacgaggtatgcgcatgtacctatcttatggtcgcattcttaccttgtcctagctgctctactacttttctcgctcccgatggccgactagtagctagccgacacatgcacataacttgaccgatgcacacgtagcgatccgccagtagaacgcttatttaattattttgtcagctagcacctatccttttacgctgattagaatcggccaacaaaattggcaagcttctcgcggtccactactacaaagtagctctacagtgatagttgtaaacttattttcgctagtgtttcttagaaccgtcggtgttagaggccaataaaaatca

SEQ ID NO: 5694 - DNA, 600 bp, Zea mays
ccctctgggatgctggcgatggaagtccgccagaaactcatcaaaggtgtccgagttgatccggctgatcatcagcaatcgcactttgccgagcacctcgtcgccaggcttttgcagggcgttgctcatctgtgagacctggccatacatctcgccagcgatcgcgaagatttgctcgccagcttcggtcagcacgaaacgtggcccgcgacgagcgatcagttggcagtcgagctgctcttccagacgcttgagcgcctggctgatggccggctgggtgaggtgcaggcgggcggcggcgcggctgatgctcaattcctggccgatcacccggaaggtgcgcagcaggttccagtccaggcggtcattgagcagcgggtgaatatcgcggcggttttctgacatggcgacagctcgataataagcaggatttataatcggaataataaatagaaaattgactaatcatagcgccgagacgaaaaatccccctcaaccagcgccatcagagcgcgagcgccagacctttctcctgccaaaaaaataaccaaaggagccagccccatgaagccatccgcttcgccgcagcctcgccgtgcc

SEQ ID NO: 5695 - DNA, 1970 bp, Zea mays
acgcaacgtcgccgcatgcccgcatctaatcattccagcccctagagcctagaggcctagacaaaacccaggcccccttcctcgtacactctctcccaatttctcctccaagaacaaacgaaaaacaaaataaaaaactgctcctaaatcttttcaatccttcctctctgttctctctctctctctcttcctccagtagtccagtcctcctccttcgaatcccaaggtggcggccagagagtagagatagagagagagtgggactatagagacgttaccgttgctgcttgttattattaacgccgccgccgcctcctgcattcgtatggtccgcgtcgtcacggggctcctgcgtccgtaaggcaccgccgcagcgtctcggctggatcaacaggccggccgatccgtcttctccccctcctcctgcgggtcggcgtttggggatcatggcggcgcgggcggctgacgagaacaggagaccggcggcagggaagcccgcgccaggcgtccgagacatggcgagccggcgcgcgctcacggacatcaagaacctcgtcggggctgccccgtacccctgcgccgtcgccaagaagcccatgctgcagaagagcagaagggacgaaaagcagccagcgttggcaagcagccggcccatgacaaggaaattcgtcgcctccttggcgagcaagggccaacctgaatgtcagccgatcgtagctgatccagaacccgaagtttgtcaacagaaggaatcagtaggcgatggcaccgttgatattgacgtggaactctacgagctggtcgacggtagtgatagtgacatcgacatgggtgcgacagagaacaaggacattatgaacgaagatgaattgctcatggctattgacagtgcagactcggggaacccgcttgctgcaacagaatatgttaaagagctttacaccttttacagagaaaatgaggctaagagttgtgtaaggccagattacatgtccagccaacaagacataaactcaaagatgagagcaattctgattgactggctgattgaggttcactacaagtttgaactgatggatgagacgctctttcttatggtaaacataatagatagattcttggaaaaggaagtggttccaaggaagaagctacaactggttggagtcacagctatgctgctcgcttgtaaatatgaggaggtatctgttccagttgttgaggaccttgtgctgatatctgaccgtgcctacacaaaagggcaaattttagaaatggaaaagttgattctgaacacgctgcagttcaacatgtctgttccaacaccttatgtcttcatgaagaggtttctgaaagctgcagatgcagataaacagcttgagctagcgtcatttttcatgctggagctctgcttggtagaataccaaatgctgaattatcggccttcgcatctggctgctgctgcggtttatactgcacagtgtgctatcaatcgttgccagcactggacaaaggtctgcgagtctcatagcagatacactagcgaccaactcctggagtgctcgaggatgatggtagattttcaccagaaggctggaaccagtaagctcactggcgtgcacaggaagtacagtacctacaagttcggttgcgtggccaagattttgcctgcgcagttcctgctggagtcgggagggacaccgcctccttcaggtgcaaactagttgaatcgacctattcaactgggtggattttttaaagtttttagaatactccatgaacaagatgcagaaaacatcgtgttgatgttgcccaaaagtgcatcgaatttctttggagagttatgattaacaactttttttttatctatgttgaatgacgagtgacggtcggtcacgttgtgcttgtgcagttatactgcggctaataacaaactgtccagttattctaaaaaacaacgaacgatgttcagg

SEQ ID NO: 5696 - DNA, 1869 bp, Zea mays
cttcctctctgttctctctctctctctcttcctccagtagtccagtcctcctccttcgaatcccaaggtggcggccagagagtagagatagagagagagtgggactatagagacgttaagaacatcctaatcgaaaaccgttgctgcttgttattattaacgccgccgccgcctcctgcattcgtatggtccgcgtcgtcacggggctcctgcgtccgtaaggcaccgccgcagcgtctcggctggatcaacaggccggccgatccgtcttctccccctcctcctgcgggtcggcgtttggggatcatggcggcgcgggcggctgacgagaacaggagaccggcggcagggaagcccgcgccaggcgtccgagacatggcgagccggcgcgcgctcacggacatcaagaacctcgtcggggctgccccgtacccctacgccgtcgccaagaagcccatgctgcagaagagcaaaagggacgaaaagcagccagcgttggcaagcagccggcccatgacaaggaaattcgccgcctccttggcgagcaagggccaacctgaatgtcagccgatcgtagctgatccagaacccgaagtttgtcaacagaaggaatcagtaggcgatggcaccgttgatattgacgtggaactctacgagctggtcgacggtagtgatagtgacatcgacatgggtgcgacagagaacaaggacattatgaacgaagatgaattgctcatggatattgacagtgcagactcggggaacccgcttgctgcaacagaatatgttaaagagctttacaccttttacagagaaaatgaggctaagagttgtgtaaggccagattacatgtccagccaacaagacataaactcaaagatgagagcaattctgattgactggctgattgaggttcactacaagtttgaactgatggatgagacgctctttcttatggtaaacataatagatagattcttggaaaaggaagtggttccaaggaagaagctacaactggttggagtcacagctatgctgctcgcttgtaaatatgaggaggtatctgttccagttgttgaggaccttgtgctgatatctgaccgtgcctacacaaaagggcaaattttagaaatggaaaagttgattctgaacacgctgcagttcaacatgtctgttccaacaccttatgtcttcatgaagaggtttctgaaagctgcagatgcagataaacagcttgagctagcgtcatttttcatgctggagctctgcttggtagaataccaaatgctgaattatcggccttcgcatctggctgctgctgcggtttatactgcacagtgtgctatcaatcgttgccagcactggacaaaggtctgcgagtctcatagcagatacactagcgaccaactcctggagtgctcgaggatgatggtagattttcaccagaaggctggaaccagtaagctcactggcgtgcacaggaagtacagtacctacaagttcggttgcgtggccaagattttgcctgcgcagttcctgctggagtcgggagggacaccgcctccttcaggtgcaaactagttgaatcgacctattcaactgggtggattttttaaagtttttagaatactccatgaacaagatgcagaaaacatcgtgttgatgttgcccaaaagtgcatcgaatttctttggagagttatgattaacaactttttttttatctatgttgaatgacgagtgacggtcggtcacgttgtgcttgtgcagttatactgcggctaataacaaactgtccagttattctaaaaaacaaaaaaaaaagttcaggaaaaggaaaaaaaaaaaaaaaaaaaaaaagggcggccgc

SEQ ID NO: 5697 - DNA, 1703 bp, Zea mays
aagttctcccggggctcttctccgtccgtaaggcaccgccgccgcgtctcggctggaccgacagttcggccgatccgtcttctcatcctcctcctccacctgcggctgtgcaggtcggcttcggggacgatggcggcgagggcggctgatgagaacagaaggccgggggtggggaggcccgcgccatgcgtccgagacatggggagccggcgcgcgctcacggacatcaagaacctcgtcggggttgccccgaacccctgcgccgtcgccaagaagcccgtgctgcagaagagcagaaaggacgaaaagaagacagcgttgccaagcagccggccaatgacaaggaaattcgtcgcctccttggcgagcaaagagcaacctaaatgtcagccgaccggagctgatccagaacccggagttgatcaacggaaggaaccaatcgttgatggcaccgttgatatcgacgtggaactgggcgagccggtcgacgatagtgatggtgacatcgacatgggtgatgagacagagaacaaggacattatgaaccaagatgaatcgctcatggatattgatagtgcagactcggggaacccgcttgcagcaacagaatatgttgaagagctttacaagttttacagagaaaatgaggctaagagttgtgtaaaccctgattacatgtccagtcagcaagatataaatgcaaagatgagagcaattctgattgactggctgattgaggttcactacaagtttgaactgatggatgagacgctatttcttacggtaaacgtaatagatagattcttggaaaaggaagtggttccaaggaagaagctacaactggttggaatcacagctctgcttcttgcttgcaaatatgaggaggtctcagttccagttgttgaggaccttgtgctcatttctgaccgtgcctacacaaaagggcaaattctagaaatggaaaagttgattctgaacacgctgcaattcaacatgtctgttccaacaccttatgtcttcatgaagaggtttctgaaagcagcagacgcagataaacagtttgagctagtgtcatttttcatgctggagctctgcttggtagagtaccaaatgctgaactataggccttcacatctggctgctgctgcggtttatactgcacaatgtgctattaaccgttgccagcagtggacaaaggtttgcgagtcacatagcagatacactggcgaccaactcctggagtgctcgaggatgattgtagactttcaccagaaggctggaaccggcaagctcactggcgtgcacaggaagtacagtacctacaagtttgggtgcgcggccaagattgtgcctgcgcagttcatgctggagtcaggagggacagcaccgcctccttcaggtgcaatctaattgaatcgccctgttttaactgggtgggggtttttttttttaaaagattttagcatattctccgtgaacaaaagatgcagaaaacatcgtgttgatgttgcccaaaagtgcatcgaattttcttggagaattatgattaactgttttttttctatccgtgtcctgaatgacgagtgacggactgttttttgttatactgcggctaataacgaactgtcctgttcaggaatgttgttggaaccttgtaaagaaaaacaagttctgaatcaaatggtcaaatggatcctttgtcc

SEQ ID NO: 5698 - DNA, 279 bp, Zea mays
ctcttcggcttgccagtcgtgcttcggcgcgtcatacccgaccgtcgcgccgagcagcgtgtaggccgccgcgtagtaggaattggcatagtccactgccacccgcgatgagtgctcgccattgaggctggtgtagaaaccgctgggatggctgtagcgcaattgcgcctggtagtagtgcttggggatgccgggcaaggtgttgtcgccgaagcggtcgtcgttccggtagtggaagtcgccgtaggtgtaggcctggcgcagggcgagctggccggt

SEQ ID NO: 5699 - DNA, 1142 bp, Zea mays
gtccctatcatcaccggccagaaaagcatcctcagctacctgctcaagccgatccttcgggcgcgggcagaggcgttgcacgagcgctgatcccgactgcacgcccggccgtcccttgtgggagccgggcttgcccgcgatgaggccctccaaaacacccaagcgccatggcctgtacaaaagccatatcgatattcattaacggtatttaaaatgccgttcttatgactataaagtcactctcctgaccgtccgggagtgaactcatgtctgccacctctactgttccaacagcgaacgacactgcacaaacctttgagatccgtccatttcccggcagcgtcggcgccgagatcattggcctggacctgacccgctcggtcagcgaccaggactttgcccgcatccatcgagcgcacctggatcatcacgtcgtggtttgccgcgaccagcgcatcacccccgagcaacagatcgctttcagccgccgcttcggtgtgctgcaaatccacgtgctcaaacaattcctgctggccaaccacccggaaatcctgatcgtctccaacatcatcgaaaatgggcaatccatcggcctgggagacgccggcaagttctggcactcggatctctcctacaaagagctgccgagcctcggctcaatgctccatgcccaggagctgccgtccgaaggcggcgacaccttgttcgccgacatgcacaaagcctgggaccaactgcccgagcacctgcgaaaggctgtcgaaggtcgcagcgccgcacactcctacacggcgcgctatagcgaaaccaaattcgaaggcaactggcgcccgaccctcacccctgagcagctcgctcaggtggcagaagtggtgcacccgatcgtacgcacccaccccgaaaaacggccgcaaggggttggttcctccggggagggtttcccccccccccatcgtccgccctgccggaaaaacaaaaccccgactttggttggcccactttttccccccccaccggggtggccccaaaaaattctaccccccattcaaggggaaacccccccgaactgggggtttctgggagaacacgcgtttcttttgtccccccctgggggcgggccggggtgccccggaaccccctcc

SEQ ID NO: 5700 - DNA, 419 bp, Zea mays
cccattgtgctggcggtgtacagcccggtgatcaagtccgacccgtggagcatcttcaagagcgtgctggccaacccgttgatcatcagtgtgatcgcggcggcgccctttgcgtacttccagattggcttgcctggctggctggaatcctccgggcagtacctggcggacatgacgttgccattggcattgatctgcatcggcggcacgttgtcgctggcggcactgcgcaaaagcggcgacatggccctgagtgccagcctgatgaagatgatctggctaccggtgctcgccacccttggcgcgtggctgctggggttccgtgggccggagctggggattctgttcctgtacttcggtgcgcccacagcagcggccagttttgtcatggcgcgggcggcggagggcaatcatgagct

SEQ ID NO: 5701 - DNA, 350 bp, Zea mays
tgccacaagccgctcggccagttgcgccaactggtcacgcaactgctgcggttgtacccggctgatccaggcgttgtcgtcggcgggaagcgtgcccgccagggtcaacaggatgtcgggggtcagcgcctggctgcggtaagcggcctgccattcgccaagggtccagccaagttgttcgttgcgcattgaggattccatcttgtatccaagtttggatttcttttagcaatcgctgggccaatcagctgcaagccaatgaatacgtggcgctggcagaaaaccggcgaattggccgccctcaaccgtgctccgtgatgaagcagcaatgcgccaaaaaaagacattca

SEQ ID NO: 5702 - DNA, 346 bp, Zea mays
cgtccattttcctaccatccgcccgcacaagctggcgatgcacacgatgcagaaccagaccctggtggtcatccgcgtgcgctgcgccgacggtatcgaaggcattggtgaatccaccaccatcggcggcctgagctacggcaatgaaagccccgacagcatcaaggtcaacatcgaccggcacttcgcgccgctgctgctcggtcaggacgcgagcaacatcaatgccgccatgttgcgcctggagcgcagcattcggggcaacacttttgccaagtcgggcatcgaaagcgccttgctcgacgccctcggcaaacgcctgaatttgccggtcagcgagctgctc

SEQ ID NO: 5703 - DNA, 4711 bp, Zea mays
cttgaaccatagcctcgttcttctcacccccttcaaaaaaaacgaggggctggctggctggctggtagtagtagtaacctgcttgttagctggactggtgatttcaaaccgtgatgggtgggtgcacatgtcctgatgtcactcgaatcgggttctgttttgccgcgtcgcctttgcacgccgccgtgatgtgccgctgccaaccttggggggatttcgaacggggacgacgaaccagatccaccgcgcagcgtcacccagctagcctgctgcctgctggactggaaccgggggaagcctccaaggcgaaggcagcagcaggaacagtagaagcttggggatgtggattactagactattattatttattagactagactagagtagtcatggggatcaacgacaccccttgagatctcccacatgcaaacgcgctcgattaacctttttttactactttcccaaacaaaagtcgccctcccgaccaactatatcaaaatcccctcaaatgctttcaaaccaatcgaatcaccaccgggcggtccttgcagcgcattcatttcaaatcgctttccccaaactacccctgccttccctcaatgatctagtctacaggtgtgggtttcccgtcatttcgccgctaaatcccagtcacctaaaccccacgcccctatcgctcccctccttccccttctccgcagctcctcctccccttgtctgcgacccagggaatggcagcactgtcattctagtcactcaacaaccaccaccacctgcacccccgctcgctccgggcaatggcggcggttctggcggtcctggtgtcggcggtggccgccacgtccatcacggccgcggcgctcaacacggacggtctcgcgctgctggcgctcaagttcgccgtctcagacgacccgggcggcgcgctgtccacgtggcgggacgcggacgccgacccctgcgcctggttcggcgtcacatgctccaccgccgccggccgcgtctccgccgtcgagctcgccaacgcctcgctggccgggtacctcccgtcggagctctcgctgctgtcggagctgcaggcgctgtcgctgccctacaaccggctctcggggcagatcccggcggccgtggccgcgctgcagcggctggccacgctcgacctcgcgcacaacctgctgtcgggcccggtcccgcccggggtggcgcgcctcgtctcgctgcagcgcctcgacctctcctccaaccagctcaacggcacgatccccgccgcgctggccgcgctcccgcgcctggccggcgtgctcaacctcagctacaaccacttcacgggcgccgtcccgcccgagctcggcgccatccccgtcgccgtcagcctcgacctccgcgggaacgacctggagggggagatcccgcaggtcggctcgctcgtcaaccagggccccaccgcgttcgacggcaacccgcgcctgtgcggcttcccgctcaaggtccagtgcgcgggggccgccggggcggacgacgacccgaggatcccgaactccaacggccccaccgaccctggcgctgcggcggaggtcgggaggaggggaggcccgaggcagccgcggcggcggcgctcgtcgccggcggtcccggtcctcgcggccgtcgtcgtcgtcgccctcgtcgccggcgtggttctgcagtggcagtgccggcggcggtgcgccgccgcggccggggacgaggggaaggagtccggcaaggagaagggcggcggcgcggtgacgctcgccggcagcgaggaccgccgcagcggcggggaggaaggggaggtgttcgtggccgtcgacgacggcttcgggatggagctggaggagctgctccgggcctccgcctacgtcgtcggcaagagccgcggcggcatcgtgtaccgggtcgtccccggccgcggccccgccgtcgccgtccgccgcctcagcgagcccgacgacggcgacagcgatggctccggttctggctccggctggcgccgccgccgcgcgttcgaggccgaggctgccgccatcggccgcgcgcgccaccctaacgtcgcccgcctccgcgcctactactacgcccccgacgagaagctgctcatctacgactacctccccagcggctccctccactccgctctccacggtaacagatctgtgttccgctaccgatagcaatgagcaaggataatacatagattaacaccggcaagagccgttccgttggttatctgtcccaggtggcccgacggcgtcgccgacgccattgccgtggtccgtgcgtctgtccatcgtgcagggcgcggcgcgcgggctggcgtatctgcacgagtgcagcccgcggcggtacgtgcacggctgcatcaagtcgtccaagatcctgctggacgacgagctccgcgcgcacgtgtccgggttcgggctcgcccgcctggtcgccggcgcgcacaaggccgccggcggcgggcactccaagaagctcggcagcgcggcatgcgcgctccgaggcggtggcgcggcgtcgtacgtggccccggagctgcgcgcgcccggcggcgcccccgccgcggccgccacgcagaagggggacgtgttcgcgttcggcgtcgtgctgctggaggccgtgaccgggcgcgagcccacggggcgcgagggcggcgtggacctggaggcctgggtgcgccgcgcgttcaaggaggagcggccgctgtcggaggtggtcgaccccacgctgctcggcgaggtgcacgccaagaagcaggtcctggccgtcttccacgtcgcgctcgggtgcacggagcccgaccccgagatgcgcccgcgcatgcgcgccgtcgccgagagcctcgaccggatcggctgacttccagcgcgacggcgtccggccggccgccggttactgatcatcaactacgtaggtgcaatccaacgcataaaagagactcgcagtcctgttcatgtagattagcgcagttaagcagtgtggatttcagagacggtaaacgcaggcaaaaacaatcatcatccgctccatctgtgaatgacgaaggtgaatcactcgacgtagcaggctacaggctagcagccgtgctaatattttgtggcaccccttgatccattccaaagcgaactctgttgggagttttctatcgttttgccactgcctacaactgtgcggcgctttgcccaaaagcttgcgatgcgttccttggggacctgggactctgggaggcagagagagcagacaggcttttggccctaggctgtgcggttcacctttggcttggtcgaattgactctgaaaagatgcgacaatgacacaaggtgtgctgcacccttctggtcagtgcactgtcctcttgcctgtgctgctgtgcagtgcaggagcagcatgcttttgcaagtttgcatgcgtaggagtaagtgacaaacaaccaacaggacgccagcgtcaagaggtgtcgattggtcattggagaagggctgttcggatggagattttgtttgaatttcttgatgcaaaaccattgcctgaaacgtgtagcaatcatgctcatgccgaacgttagttgctgtacatctgcagataaaactaggtgcaaatggtctttttgcaatagttattaatcagcgcatcgacgattccttcacgttttcgacagcgtcggattcctgaataaagtcgtcgcactcgcactgctggatgggcatatcgcacgcagatgccatcatgcacgctactagtagaatgggatccaacgttaagcgtcatcatttgccatgtagcgcgaatctagcgatgcaagcctgccaagcaacaactctagggcagctctaacggtcttgtttgacctgtcttttatgctcactccaccacattttagcttttctatatacattctttagacataatatgtatgaaaacttataaaatatctttttttttaaaacgagtaaataatatatttaatgatagagcatggtaaactattaggcaaggttggctctagccatagtcaaaagggactagtagggcttaggtccatcagtttggggtccaaaaaaagctatatgtgatatataataatgttatcaatttacttaatctttctagcagccagcaagtctacctaaagtctctgataattatagaaaaaaaacactcaacctttattgtttatatcaattgtctaaccatttaaactaccaacttaagcttcctcagcttcatcatcaaagacatcatcatcatttttgaagtcgatagaagcaacggttgtacccatacgagcatgaaccttctgtgaaacatcttctctagttgcaacgcaaacttcgccaaacaatgagcccgaaggaaagagtagacttaggctccataacaccgcatctgtatgtccgcctttccacctacaaagtaatctctccaccccctataatctaaactaatttcttcctatgaagtcactctggacacttgaccttcgtcacgagaacattcatcctagcctcgaatattaacattctcatctacacccaaatgcctagctcccatcgaagatgccaagtactaaaccaaagcatcaggggcagtaaatattgacgaagctccaccaccaccaccaaatgcgctttcaataaaactcacctctataacacgagcaacctcactttcaacttcaacatcgccacca

SEQ ID NO: 5704 - DNA, 1120 bp, Zea mays
cctacggtgatttgcgacttgctcaattcgggaacgctggtggccaccaggttgatgatcgccaacacctggccaggctccagggagcggccggcaaacagctcgaccagtaccgaggcgctgggcttgcgctcgtcgcgtacaaacaccgagcttttcggaatcgccaggtgcacgcgggcgcccttgacgttgttcaacgcagaaatagtccgcgccagctcgccttccaggccacgacggtagcgggtggcttccatgaactggctggtacccaggccttggtccttgtcgaggatttcaaagccgatattggcgtcggaaggagtgacgccggccgcagccagcttcatccgcgcacgggccacatcatcggccttgaccaacagggcgccggaattcggttcgacggtgtagccgatgtcggctgctgccagggtttccatgatctgcttggaatccatgcccgcgagactgccatacagcgggcggtaatccggttgctgggaccacagcaccacggcaaaaccaatcgccacgctggcagccaggccgaccatcaggcccacctgacgcagcatggtcatctcggagaggttttccaggaacgacaggccaaacagcggcggcttgccgtctgccttggcgggtgcgttatccacgactgcttctgccatgactcaaatcgtccttaaaccggcatctgcatgatgtcttgataggcttgaaccagcttgttgcgcacctgggtcaaggcctggaatgaaacgctggctttttgcgaggcgaccatcacgttcggtgaggtccacgccgcttttgccgatctcgaaggcggtggccaactgattggaggcctgttgggtatcgctgactttgttgatggcctggccgagcatgtcggcaaagctgctctggccccattcccggcacggtttgcgcggcggattttcgttgggccatggcatccattttgatgggaccggatatcccaacaatcaacccgattgaacttcaaaacccttgggttcaggaccttttcttctccgacaaccccgcaattttttttgaaactaaaccaaggaattaacagggggggggaaacaaaaaagggggggcc

SEQ ID NO: 5705 - DNA, 637 bp, Zea mays
cctcccagcgtcagcggcagcctgcagcacatgtccgccgagcttcgggtcaacggccaggtgcaacgcggttgcgcgtcgttcggcggctcgcgggacgactgattgtccgctgcgctgttttaacatgacgggaaaccgctgttggggcttataatcgccggtttgcaaaacagccggcctctttgcccgccgcctaccggattcctgtcatgttacgaatcaccgaactcaagctgcccatcgaccatcccgaagaagacctgcggcctgccattgtgcagcgcctgggcatcgccagtgatgacctgctcgatttcacgctgttcaaacgcagctacgacgcccgcaagaaatcgtcggagctgtgcttcatctacaccatcgacctggaagtcaaaggcgaggcggccctgctactcaagttcgccgacgaccgcaacgtcaacccggcaccggacatcagctacaaggtcgtgggccatgcgccggaaggcctgaccgagcggccgatcgtcgtcggttttggcccgtgcggtatcttcgccggactgttgctggcgcagatgggcttcaagccgatcatcctcgaacgaggccgccctataggatctacggtttacaaagcgagcatgtt

SEQ ID NO: 5706 - DNA, 654 bp, Zea mays
acacgcaagagtactctactagtagtgacgagtagtggtagcagcaattaaccaacgagacaccaatggcggtcgcaagtaatagaccagcaaccactctactgcccctggcggcccttgtggccgtcgctggctccctcttcctcgccggcccggccgcggccacggggaagaccgggcaggtgactgtcttctggggccggaacaaggccgagggcacgctccgagaggcctgcgacacgggcacgtacaccatcgtcgtcatctccttcctcaacgtctcggccggccccggcaacagcccgccgagcctggacctctcgggccaccccgtcgccggcatcggcgccgacatcaagcactgccagtcgaagagcatcatggtgttcctctccctcggcggcggccagcactccctgccgagcgccgaggccgccgcggacctcgccgactacctctggtacgcctacttcccggcgccggccccgcgcgccggcgtgcgccgcccgttcggcgacgcgtacgtcgacggcctcgacttcttcctcgaccgcggcggccgcccgccgccggaccacctcgacgcgctggccgcgcgcctgtggagctacaaccggcagttccgcgcccgcacgcccgtgcagctgtcggcga

SEQ ID NO: 5707 - DNA, 885 bp, Zea mays
ctatcaatcacgctgccagtgataaacccgttctccatcgccagcacgtacccggcagccacttcttcggcctgccccactcgccccaccggcaatgccccgcccgccttggcaaacattgccagtcgctgctcctcggataagcccgaatacgcctcggtatcgatcaccccaggactcaccacattgaccctgcgtggcgccagttccttggccagttgcttgcccagcgcttcagtggccgcattgatcccggtcttgatgaattgccctgcaaccgctttgcgccccaactgtcccgacgtcagggtgatgctgccgtgctcggcgagaaagggcagcgccgactggatcgcccgcagcgaaccccagagttttacgttgaagttgtcttgcgccaggttcaggtccgtctcgatcaatgccttcgcctgtaccgcagggcctgcggtatagaccagatgatcaaacggccccaccgtttcgaacaaccgctgcaacgaggccgcgtcggtcacgtctacctgctcgctgcgcacaccgttctccacggttgaagacaagcgtcgcccggccagcaccacgtgggcgccgcgtgccacggcctgcttggccacggcggcaccaatgccgctgctaccgccgatgacgatgatggttttgccgctgaggggagaattcatgaagaactacctggttgagaaaatgagctttcatcttcccagcttggcaatcgttgaaaaatcccggtaaaacgacaagatctttaaaggatttttacagatgagttcaatcctcgaccttgaagtcttcgtacgcaccgccgacaccggcagcctgtccgccgccgcccgtagcctcagcctgacccccggcggccgctct

SEQ ID NO: 5708 - DNA, 689 bp, Zea mays
tatctgcccgccaaagaacgagcccacggcaatgatcacctggaacaacgcgacgaacagcggcatgccacgttccacatccttgggcgccaccacgaacatccagatgctcgcgcaggccgggaaggcgccgaaggcgaagccccacagtgcgatcagcatcacggcgccgctcatgccggtggcgaagtaggggaacagggcggtgctggtgccgatcatcagggccaccagcagcagggtgtggcgcacgctgcggttggcggcgaagccggcgaagacgttgcccattacgccggccacgccgtagagcagcagcagcgagccaatggtcgggccgtcgaagccggagctgtttttgaagaacggggcgacgtaggtgtaggcggcaaagtgcgcgaggccgatcagcagcacggcgatcaagccgacccgggcttgtgggttgatgaacagggccggcaggtcgctgatgcggatggctttttccggttcgaggcgcggcagcaggaacatctgcgccagcagtaccgggatgcccaccagcgcggtgacgaggaaggtcatgcgccagcccatcaggccgctcagccaggtgccgacgggtacgccgaggacggtggccagggtcacgcccatcatgatgatcgaggtggccttcgcaacgcccacgcccttgggcgccaggg

SEQ ID NO: 5709 - DNA, 766 bp, Zea mays
cctcctggccggtattcgacccctcgaaaatccgcggcccgtccatcccgctgccgtaccagaacgtacaggcaccggtgaacaacagcatcacctacaccccgctgggcagcgacaaaccggtgaccctcaagcagatcgacaaccccaggctgtttgagcaattggtcaaccagtacaacgggcagcaaagcgacgcgacccttgagaagaatctggctgacagcaaaagcgccggctacaaggaggccgacgccagcaccgtggcgcccggcttgggcaactacaaggcgatcggcagtaccacggaattgggcccggggctgatccgctacgagaccagtgccggcgacaaagtcgtggtcagccagaaggaaacgcccgcgctgttcgctcaggtcagcggcgattcggccaagctgttcgcgatcaacgccagccaggccgagggctatcgcctggccggtcccaccgaaaccatggacccggcagcgaagatcggcccacccgaggaagtcggcccggggttgattcgctataccactgcttcgggcgacaaggtgatcgtgtcccaggacatcacccccgcgctgtacgaccaggtggccaaactgtatgccggcagcaccggcgccgcgggggcctcggacacgtcctggatcgacacctcgtcgttcggcgtttccggcgccaaggactgggacacgatcaccggcaacaccagcggcacgccgaccaaggaagaactggacctgaaccggccgaa

SEQ ID NO: 5710 - DNA, 880 bp, Zea mays
gtccccgcggcccgcccggcacacctcagtcactcgtccagtgcaaacgacagatggcctccttggtcgccctccttgcggtggcccttgttgcgcagctggcctcgtggcagcaggccgccgtcgcctacgatcctagccctctccaagacttctgcgttgctgacaagaactcgcctgtgcgtgtgaatgggtttccttgcaaggacccaatggccgtcaccccggacgacttcttcaacccggccatgatcatcggcaagcgcagggacaccaacaacaaggtcgggtccaacgtcaccaacgtcaacgtggagagcttcccgggcctcaacacgctgggcatctcgctggcgcgcatcgactacgcgcccctgggcgtgaacccgccccacatccacccgcgcgccaccgagctcctcaccgtgctggaggggaccctctacctaggctttgtcacgtccaaccccaaccgcctcttctccaaggtggtcaagaagggcgacgtcttcgtcttccccaaggccatgatccacttccagatgaacctggaccacgagaagcccgccgccgctctgtcgtcgctcagcagccagaaccctggcgtcatcaccatcgccagcgcggtgtttgggtccaagccacccatctcggatgacgtcttggccaaggcgttccaggtcgaaaagaaactcatcgactggctccagtctcagttctaggataccaactattaggctacgcctacgcgtacatatgtattcatgaataaatggcgggcatgtggaggagtgatactatatattgagtaccggaaaacaagctagtgaaataaatctgattacgtttccgaacctggtataaggggcaatggcccagt

SEQ ID NO: 5711 - DNA, 2131 bp, Zea mays
cgtttcctcactatttgcgccggccattacgtacgccacctttagcctgcttgctataaaggcagcacacatctgccctgcccaacgacgcacacttcactcacccatccaccgcaaacgccaaacggccggcacacaactacacaagccgctggcaaagatggcctcctccttggtcctcatcgcagcggccctgcttgcgctggcctcgtcgtggcagcaggccatcgcctacgatcctagccccctccaggacttctgtgtcgcagacaagaactcgcctggtacgtacgtacatgcatttattttgtgcatatatctctcttgtcttgtgtgcatgcatgtaatatatatatacgtcgtcgtctccagttcgcgtcaacgggttcccttgcaaggacccgatggcggtcaccccggacgacttcttcaacgcggcgatgatcatcgacaagcggagggacacgaacaacaaggtggggtccaacgtcaccaacgtgaacgtggagagcttcccggggctgaacacgctgggcatctcgctggcgcgcatcgactacgcgccgctcggggtgaacccgccgcacatccacccacgcgctaccgagctgctcaccgtgctcgagggcaccctctacctcggcttcgtcacgtccaaccccaaccgcctcttctccaaggtggtcaagaagggcgacgtcttcgtcttccccaaggccatgatccacttccagatgaacctcgaccacgacaagcccgccgcggcgctctcgtcgctcagcagccagaaccctggcgtcatcaccatcgccagcgccgtcttcggctccaagccgcccatctcggacgacgtcttggccaaggcgttccaggtggagaagaaactcatcgactggctccagtctcagttctgggataccaactactagctgcctagctagctagtaatatacttgcttgcttatttgttgcatgcatgcaccaccaacacaagccttatattaattacgtacgtacatctatgtataatattgaataaatggccggtatgcatgtggaggagtgaaacttattactgtgcgtgattaataatatttaatgtaaacttttcattattatctaatataaaaaaaagaatacgagttcaaaaaaaaaaaaaaaaaaaaagattggggatgatgctctggattacatatgtacagccgaattcagtccgtcggcatgtacaacctcagagactgcataagcctttagctttgcatcataaatacaattaagagaccgttgagcaccatatgtgccacacaatagtcactaccagaatcgggcgctttgccgagtgcctcaagcaactcggcaaagcctgaaaaacactcggaaaaggctttaccgagtgtcgtactcggcaaagagggctcgacgaacagtacatcggtaaagacttctttgtcgagtactttttctcagcgctcggcaaaagctaacggccgtcagttatagacggctgctgacgaccctttgccgagcaccgccttcgccgagtgtttggcactcggcaaagatatctttacagagtgtaattctttgccgatagtcctgctctcggcaaacgcgttcgttaccgagtgcccgacaaaaagcactcggcaaagccatggattccggtagtgagtaaaaccacgagtttccgacagcttaaaccgtcgaacataagggctaacccgtcctatttccgacggtttatcccttatgtccgacgtcagatgtccctcggtcatcattcatcggaaatagagtaacttatttccgacggccgcaaggggccatcgtcaattgcaataggtaacagttgtaatggtcgtcagtgggccccaccaactaaaatcctacgatctgcatgtagatcgtcggacataaagtgcccttatgttcaacgatcgatttggccctcggacattactacacattatgtccgacgacggcccgtggccctcggacataacttctcttatgtctgatgaccataataggccctcagaaataatagattgcagggaaggcaaaagttgttccacatccaccatattcacatagttcaacatccgccacattcacatagtcccacatccac

SEQ ID NO: 5712 - DNA, 1032 bp, Zea mays
gcgctccgtggccccccgcccgcgggagacgcacacttcactcacccatccaccgcaaacgccaaacggccggcacacaactacacaagccgctggcaaagatggcctcctccttggtcctcatcgcagcggccctgcttgcgctggcctcgtcgtggcagcaggccatcgcctacgatcctagccccctccaggacttctgtgtcgcagacaagaactcgcctgttcgcgtcaacgggttcccttgcaaggacccgatggcggtcaccccggacgacttcttcaacgcggcgatgatcatcgacaagcggagggacacgaacaacaaggtggggtccaacgtcaccaacgtgaacgtggagagcttcccggggctgaacacgctgggcatctcgctggcgcgcatcgactacgcgccgctcggggtgaacccgccgcacatccacccacgcgctaccgagctgctcaccgtgctcgagggcaccctctacctcggcttcgtcacgtccaaccccaaccgcctcttctccaaggtggtcaagaagggcgacgtcttcgtcttccccaaggccatgatccacttccagatgaacctggaccacgacaagcccgccgcggcgctctcgtcgctcagcagccagaaccctggcgtcatcaccatcgccagcgccgtcttcggctccaagccgcccatctcggacgacgtcttggccaaggcgttccaggtggagaagaaactcatcgactggctccagtctcagttctgggataccaactactagctgcctagctagctagtaatatacttgcttgcttatttgttgcatatacatgcaccaccaacacaagccttatattaattacgtacgtacatctatgtataatatcgaataaatggccggtatgcatttggaggagtgaaacttattactgtgcgtgattaataatatttaatgtaaacttttcattgttatctaatataaaaaaaggattccgggtccttacaaaaaaaaaaaaaaaaaacccgcggcc

SEQ ID NO: 5713 - DNA, 842 bp, Zea mays
ggtaccctgtttcttttaccatatactaactattattagtactgtactactcagttattaccctccgatacaaaatcccatgccatgcgtgacgctacaccttccgttattaaacggcacggccaaggaaacaacaagaggaaaccttggacgcagacacgtccccatccactgcatgcagcagcagtccgcggtcagcaagcaacttggcagcaccgcgccgccgcagcccctccgccacgccagccatcagtccatcactgcgcgtctgccccttgcgcagttgcgctcgcggcccgcccgcacggtcccgccgcctatttatcaacgccgcccccacccgccactctctcccctctgtcccagaacgcgccccagcctcccacctagaactccgcgcccagcgctttccgtaaccaccaccaccacagcgggaacagtgacaggttgaggagacggccgccatgggagaggaaaagaagacgggcaagggcggcggcggcggcggcggcgacaagaagaaggacgccggcgctggggccgcgccgcagcccatcgtgttgaaggtcgacttgcattgcgccggctgcgccaacaaggtccgcaaggccatcaagcgcgcaccaggcgtggagtcggtgacgccggacatggcggcgggcaaggtggtcgtgaccggtccggcggacgcggtgcagctcaaggagcgcatcgaggctagggccaagaagcccgtgcagatcgtctccgccggcgccggttcgcccaagaaggacaaggagaagaaagctgacggcggcgagaaaaatgcggccaaagagaagggcggcggcgatgcagag

SEQ ID NO: 5714 - DNA, 2430 bp, Zea mays
gggtacctcgaggccggccgggccgggtccgtgctgcagcaaccgcatccgcatccgaatccgcacacgatccccgtgccacttgccccgtcaccccctgcgcgccccgcgcccccccgggctcgtcggccactgcccggcgcaggccagcgcggcgagatgagatgacgccgccgcgcggcggtgcccggcctcccgtcgctcacgcgcgccagcaccagcaccacccggccccatcgggattcttcatcccgtcctccacctagcgcggtagcgccgcatttattccctcccccgcacaacggtcacgtttccatcgcccccccgtcttctctccctcgtcgcatccggcgctcctcctcgtctcctatttaaagcgcgccgggctgggagccagcgatcatgctattctctaggaggcctctcgccgccgctttccacctcgcgcccctttcgcctccgctgctcctcttcttcgcatccgcgtcctcgtcctgctcgcccgccgcctccgccgccgccgcgtcggtctccggctccaggggttgcactgctgcaaggatggacagcggtgcggtggagacagcgtccactggggcagtatggtcatcaccttcggcagaaccgagaagcatttctgtcgggaaggaggtattctgcaacaggtcactcaacatgaggaacatcacagcagtgggatttgatatggactacactctggcacagtacaagcctgaaaccttcgagtcccttgcttactatggtacaatagagaagcttgtgaaggatctccgctaccctgaagagctgttgacttgggaatttgattggaaatatatggtcagaggactagttctcgataagaagagaggaaatatcttgaagatggatcgacacaagtatgtaaaagttgcataccatggttttaaggaactatcgaaagaagaaaaagttgctgcttatgggagtacattgataagagattcatttgatgaacctgattatgcccttatagatacacttttctcactgggtgaagcttatctatttgctcagcttgttgatttcatagacaagaatcctggaaaagtacctgcaggcacagactatccacttatgtacagagatgtgaggtctgcggttgacttgtgtcatcgtgatggaactctaaagcggatggttgcgaaggatcctgccaggtacatcaatgaggacttggcaattgtaccaatgcttgaaatgatcaggaaatctggacgctcaacattcttagtgacaaatagtttgtgggactacaccgatgttgtcatgaactacctttgtgggccatacacttcaggtgtaggctctggtctcaatcacaagtggcttcaatattttgatattgtaataacaggcagttcgaagccaagtttcttccatgatgataaccgtgcaggattgtttgaagttgagcctgattctggaaaacttctgaatgctgatattcagatcggaagcccaagatcaagtcatcaacactcaacaccagttcagaaagtttatcaggggggcaatgttggtcatctccacagattactttctgttgcttctagttcacagattctctatgttggtgatcacatatacggagatattctgcggagcaagaaagttctaggctggcggactatgctggtgattccagaactagaacaagagctgaagcttctctcagaatcaaagtctactcgaaaggagcttagacatcttagaatggagcgtgattcgattgaagacaaaatccatcatcttgaatggtctcttaagcttgatgatatctcagaaaaccagaaggagaaattgttctctgaacatgacaatctgctgaaacagagagggcatgttcgtggtcttcatcaagaagctcagaggcaacatcatcagaagtttcataaggtgtggggacagctcatgaagactgggtaccaaaattccagatttgctcatcaggttgagagatttgcttgcttgtacagcagccaggttacaaacttcggtttgtattctcctgacaaatactatcgtccgagcgaagattacatgccccacgagtttgatgtgcttgggctgtaggagcagcccctactgctggtcggagttcctcgttgtaattgatccatagcctaggaggggacatcgtagttgccgtattatataacaggaagcttcacccattgtgaaggagagaaggtttataactatagtagctacatttctacttatcagtaagtttacctgtatataaatatgtacataactgatatatgatgcgtgttatttgtgagcacgcgataagtagacctgacaaaaaaaaaaaaaaaaagtcattggtttttttatgatggattagcatgtaattattgtctattaaatgattctaattttttt

SEQ ID NO: 5715 - DNA, 866 bp, Zea mays
cctgcccattatcaaaaaaacattgaaagagactgctcttttagcgggttttatcttcgagagaaatagccaatcatctgtccatcccgttcatcacgtgtctggagtcgaatatgtccgctgcctttaacgtcatcgccacgctgatcgccaaacccggccaacaggccaccctggaaaccctgctgcgcgagctgctggagccgacccgcaccgaagccggctgccagcagtacgacctgcaccaggacctgcaacaccccgagaccttctacatgctcgaacgctggagcgacgacgccgcgctggccgaccacgaccagagcgcccatatccagaatttccgcgccaaggctgccgacgtgctcgagcatttcgaactcaagcgcctgaagtttcttgcctgatcaaccgccccctttttggaaaccctcatgaaagccatcgcctactacgctgcattgcccatcaacgatccaaaatccctgcaagacatcgaactgccagaaccggtcgccggcccacgcgacctgctggtggaagtcaaagccatctcggtgaacccggtggacaccaaggtgcgccagaacgtcgccccggaaaacggtgcagccaaagtgctgggctgggacgtggccggtgtggtcaaggccgtgggcagtgaagtgagcctgttcaaggtcggtgacaaggtgttctacgccggctccctggtacgtcccggcggcaacagcgaactgcacaccgtggatgagcgcatcgtcggccacatgccgaaaaccctgggtttcgccgacgcgggccgctccaaagagaaccaagcttaccttacgccgtgcatgcgaacgccaataactccttttaat

SEQ ID NO: 5716 - DNA, 899 bp, Zea mays
tactcgatctatccctttgacctgtccgtcgagcgcgtcgaagccgcggtcgccgctgcccgcagcttgccatttcctttcaccctgaccgcccgcgcggaaaacctcctgcatggccggctggatttgcccgacaccatccgccgcctccaggcctacgccgaagccggcgccgacgtgctgtatgcaccggccctgcgcagtgccgaggaagtgttggccgtggtgaaggcggtcgcgcccaagccggtgaatatcttgatgtcaggcgccctgaaactcagcgtggcgcagttgagcgagatgggcgtcaaacgcatcagcgtcggctcggcgatggccctggcggcgtatggagagttcttcagggcggcccaggagattcatgaactgggtacgtttacctttaccgaacgctcgatgccgttcagccaggccaatcaactgttcaaggcttgaggcatcgtgcgttccttcaaggtactgggggtgttgctcgtgttggcgggtggtctgctggtcggcgtgtggcggggctgggtgccgctgcccgatgactggaacccgtgggcgccgctggacgtgcgcgcaagcccgaacctgctgacccgattcaaactggggcgccttcaggatgatcctgcgctgtgtgaccaggtgctgaaaacctctgggttgcgggtcacccatcaggccgacagccctgtcgatgccgcttgcccgctgcgtaataccttgcgggttcaaggcgctgatgtccgcttgagcagcagctttctcgccagttgcccgctggccgtggcattcgccctgttcgagcgccacagcttgcagcccggcggcccgggccggggttgggccaggccgggatgcgggtcgatcttcttggaagttttcct

SEQ ID NO: 5717 - DNA, 345 bp, Zea mays
ctttccttcgcgcagccccagcgccatcgcttcggcggaggcggcaatgtgcacgcccgccagcaactggttgatgatcttgaccttggagcccaggccatgcacgtcgcccagtcgataaaccttgccggccatacccgcgagcaccgcatccgccttggcataggcttcggccgggccggaagtcatcatggtcatttcgccggccgcggccttggcggcaccgccggagatcggtgcgtccaggtacagcaacccggcgtctgccaggcgcttgcccagctccacggcataggttggcgccaccgtggcacagccaatcaccaggcttcccgggcgcaatgc

SEQ ID NO: 5718 - DNA, 821 bp, Zea mays
cccctacctggcatgtcctcggcgctggcagcctcggaacattgtgggctgcccgcctggcccgcgcccggttgccggtgcgcctgatcctgcgggaccacgcgcggctggcgagctatcagaccggcaagggcctgaccctggtcgagcacggcgtggctcacacctatccagtcgtcggcgaaacatccgacagccctgggccgattcatcgcctgctggtggcgtgcaaagcctacgacgcccaagaggccgtcgcacagcttgaacatcgtctggcaccccacgccgagctgatcctgctgcaaaacggcctgggcagccaggatgcagtcgccgcccaactgccccaagcccgctgcatcttcgcctccagcaccgaaggcgcgtttcgcgaaagcgactggcgggtcgtatttgccggccatggctacacctggctgggagatgcgagccaccctaccccgcctctgtggctggatgacctgcaagccgccggcatcccccatgcatggagcaccgatatcctcacccgcctgtggcgcaaactggccctgaactgcgccatcaacccgctgactgtgctgtatcaatgccgcaatggggaactgcaagcccatcagtgcgaagtggccaccctgtgcgccgaactcgccgaactgctggaatgctgcggccaacccgccgccgcgcaggatttgcagagcgaagtggagcgggtgatccaggccacggctgccaattactcatcgatgtaccaggacgtggccaatgcccggcgcaccgaaatcagctacttgctgggctatgcctgccaggcg

SEQ ID NO: 5719 - DNA, 1107 bp, Zea mays
cacggccaggttgatccgcaggtcggacaggtaatggcccacggggcgctcctgggtccagaccagataggcggaaacggcggcgaccagggccatgatgagggtgaagccaagaagtttacgcatgggaaaaagacaacggaccgggtgcagggttcggtacctagggtagggctcatgtacacggttgccaaggggcgctgcgcatttggatcaataacttgtcagttacagtcattgagcggcaaccggcagcctcttaggctgtgggacataaaccgatggagtgccattcgagcgctccacccccgtgatgatccgttgtggagctgtaccatgaccgctgctgcctacccgcacctgttggccccgttggacctgggtttcaccaccctgcgtaaccgcaccctgatgggctcgatgcacaccggccttgaagagaagcccggcggcttcgagcgcatggcggcctattttgccgagcgcgcccgtggcggcgtgggcctgatggtcaccggcggcattggcccgaacgatgaaggcggggggtaatggcggtgcagccaagctgaccaccgacgaagaggcgcaaaagcacaagatcgtcacgaaagcggtgcacgaggcgggcggcaagatctgcatgcagatcctccacgccgggcgttatgcctatagcccgaaacaggtcgcgccaagcgcaatccaggcgccgatcaacccgttcaagcccaaagagctggacgaagaaggcatcgaaaagcagatcagcgatttcgtcacctgctcgctgctggcccaggtcgccgagtacgacggcgtggagatcatgggctccgaaggctacttcattaaccagttcctccccgctcaccccaaccctcgcacccgaccgctgggggggcagcctatgaaattccatgcgccctgccgggggaaattggggcccgggggcgcgaaaccgaaggccccaatttcattttcatctttccgcctggccatggctccaccctgggggaaggggggcagccccctgggaaaaaaatcggtgcgtttggcccagggccctttgaaccggccggggggcaaaaatctttccacaaccgg

SEQ ID NO: 5720 - DNA, 303 bp, Zea mays
ttgctcctcgccgatcccgctggcgccattgctggtggggctgaccttgaagctgtcacccgccgccatcggccctttgccatccagcgccagggtgaaaccgtcaatcaccggcggcggcgtggtggtggtatcgaacgagcccatggccttgccatcggaacgcaccacgttgtactggttgccgctggtaaacgtgaccttgtagtcgtaggtggtcagcttgctgctgtcggcaatcgacacattcaggttgccggagccggcgctgttacccgcggtcccctgactacgctgggagat

SEQ ID NO: 5721 - DNA, 611 bp, Zea mays
catctggtggtcaccggcatttgcgcgaacaagctcgacagcagtcgggcgatctgcaacttgattaccgagttgcgtgaagacctcaagcacacccacacccatgccccggccctcaaacgagccggtgcgcgtcctttctattaaacggacggttgagcttcaatcagtgaagacttgcgggcctggataaacgccaggcccaacgccgtttccgtgattaccgccagcaaaattcccgggcccgcgtggccgctgatccattcgctgatccccaacatcgccagcacaaaacagccgatcacaaagccggaggtcatggcgtgccgtgtcgcatcaggtggggagtggcgggcgcggtaaaacatgatgccgatggccaggaacagcgcggcattgcgacgggcgaccaggccggtggcactggagtattcaacactccacacccacaggagcaggtccgggcgcaaaccccacatcagcgcgagggcaaagcacagcagggcagtgaaggtagcgagggggcggaagtgcaattgcatggcgaatcctttcagccgtaacgagcgctcaaggatacccatgtaggaggggcaatgctgactcgccct

SEQ ID NO: 5722 - DNA, 514 bp, Zea mays
cccctggtgcagctcgacgaacttgtcgataaagcttttgcataaggcttcggttttcgtcgcgtccaggcccagttccggcggcaggtccgagcgcaggatgatcccgttgacccgctccatcacgtagaactcggcaccgatcaccgactcgtcggtgcaatgcacgtaggccttggggcaatacgggaaaccgtccttgagctggttgagaatccggtattcgcggcccatgtcgtgggcggacttggccttgtggccaaagggcgggcgacgcagcacgaattcctggccggggtattccagcaggtacgtcaggttcgaggcaccacccgggaactggctgattttgacgttgccgctcaagcccgggatatgggccttgaggtagggatcgatgaggctggcatcaagttcttcgccggggcgaatctgggtcgattggtcattaagcgccatgcttatcccttctgcttattcttaaggccttggactattggctaatctaatgcgc

SEQ ID NO: 5723 - DNA, 1550 bp, Zea mays
  misc_feature (18)..(33): n is a, c, g, or t
gtacctcgaggccggccnnnnnnnnnnnnnnnnaaaaaaaaaaaacattgggtacctcgaggccggccgcgatctcgccctcgctcacctacagctccgtccgccagcgtcagccaggctgccccgggaggccgggaggaagcagatcggagaaggtgatctgttgtaatggctcgattgtacatcggcaacctggatccccgggtgaccgctcgggagctggaggacgagttccgcacgttcggggttcttcgcagtgtctgggttgcccggaaaccacctggctttgcgtttattgattttgatgataagagggacgcagaggatgcaatccgtgacctagatggcaagaatggatggagagttgagttatctcgtaatgccagcggtggtcgtggaggtcgtgaccggcatggtgggtctgagtccaagtgttacgagtgtggtgagactggtcactttgctcgtgagtgccgtttgaggattggttctggaggtctaggcagcggaaggcgccgaagccgtagccgtagccgcagtcgcagtcccagatatcgccggagtccaagttacggtagaaggagttacagtcctgcagcacgctctccaaggcgtcgtagcgtctcaccagctcgtggacgcagctatagcaggtcaccacagcacaagggtgcacgtgaagaatctccctatgataatggataccgtcgcagcaggagctagagccagatccttgtatctgacgagcgttatgtgacagatattgggaaagttatggtcaataacctgcttgaaagatccttcgtcgactgcttgactttggttaaggcatcgtcctgcacttcttaaacgactcggccgactacggctttcagttctgtcttcatggttttgttctgcgctctacattcttcgcacgccctcgcatgcttcattcagtctgccgtgtgttaacctgcctgcgtatcttctcgaagatgctgcgcatcgcaaaagcagtaatgaccttccttctcataccatttggtaaggtttgatttgctgacaaatgcagcatctggtaagtttctccccgtaggtttggtgtccgtgctgcgtgcgctgctcctggttcaggaactgcagtatgttagatggatgaggatgactcacctactcatgttatcatgccttcagaggacccaagttagtgagcgccaggaagtgaattgaccaggccaaatgctacgttgagccgactttggctttgctcagcgatctccacttgctaccatgtgttgccttcgacgaagtcttcttctccttccgcttccttctctgcagcatcctgattgattcattcttcgagtgacatgcagtcaccctaattgatcgtcattgagcctgcgttgaagtcgaatcctgcatccttattattcaaccgttcccccccccctaatggacaatgtagttacattgttattagcttgtttcttgttcgatagactaatgtcagatgctgtttgatatataatggtaaccatctggttgatgattggcggcgaaaaaaa

SEQ ID NO: 5724 - DNA, 1592 bp, Zea mays
aggtaccggtccggaattcccgggtcgacccacgcgtccgcgcgagaatatatcaatccatcctcgcgtcgcgtgatcgcatctcgccctcgctcacctacatctccgtccgcaagcgtcagccaggctgccccgggaggccgggaggaagcagatcggagaaggtgatctgttgtaatggctcgattgtacatcggcaacctggatccccgggtgaccgctcgggagctggaggacgagttccgcacgttcggggttcttcgcagtgtctgggttgctcggaaaccacctggctttgcgtttattgattttgatgataagagggacgcagaggatgcaatccgtgacctagatggcaagaatggatggagagttgagttatctcgtaatgccagcggtggtcgtggaggtcgtgaccggcatggtgggtctgagtccaagtgttacgagtgtggtgagactggccactttgctcgtgagtgccgtttgaggattggttctggaggtctaggcagcggaaggcgccgaagccgtagccgtagccgcagtcgcagtcccagatatcgccggagtccaagttacggtagaaggagttacagtcctgcagcacgctctccaaggcgtcgtagcgtctcaccagctcgtggacgcagctatagcaggtcaccacagcacaagggtgcacgtgaagaatctccctatgataatggataccgccgcagcaggagctagagccagatcgttgtatccgacgacgagcgttatgtgacagatattgggaaagctatggtcaataacctgcttgacagatccttcgtcgactgcttgactttggttaaggcatcgtcctgcactgcttaaacgactcggccgactacggctttcagttctgtcttcatggttttgttctgcgctctacattcttcgcacaccctcgcatgcttcattcagtctgccgtgtgttaatctgcctgcgtatcttctcgaagatgctgcgcatcgcaaaagcagtaatgaccttccttctcataccatttggtaaggtttgatttgctgacaaatgcagcatctggtaagtttctccccgtaggtttggtctccgtgctgcgtgcgctgctcctggttcaggaactgcagtatgttagatggatgaggatgactgaatgactcacctactcacgttatcatgccttcagaggacccaagttagtgagcgccaggaagtgaattgaccaggccaaatgctacgttgagccgactttggctttgctctgcgatctccacttgccaacatgtgttgccttcgacgaagtcttcttcgccttccgcttccttctctgcagcatcctgattgatattcttcattcttcgagtgacatgcagtcaccctaattgatcgtcatagagcctgcgttgaagtcgaatcccccctaatggacaatgtagttaaattgttattagcttgtttcttgttggatagactaatgtcagatgctgtttggtataaaatggtaaccatctggttgatgattggcggcgaactatttgttcagcacgtggttgctatatgccaagtcccaaggtattattac

SEQ ID NO: 5725 - DNA, 974 bp, Zea mays
ggcaacgcgagaatatatcaatccatcctcgcgtcgcgggccggcatctcgccctcgctcacctacatctccgtccgcaagcgtcagccaggctgccccgggaggccgggaggaagcagatcggagaaggtgatctgttgtaatggctcgattgtacatcggcaacctggatccccgggtgaccgctcgggagctggaggacgagttccgcacgttcggggttcttcgcagtgtctgggttgctcggaaaccacctggctttgcgtttattgattttgatgataagagggacgcagaggatgcaatccgtgacctagatggcaagaatggatggagagttgagttatctcgtaatgccagcggtggtcgtggaggtcgtgaccggcatggtgggtctgagtccaagtgttacgagtgtggtgagactggccactttgctcgtgagtgccgtttgaggattggttctggaggtctaggcagcggaaggcgccgaagccgtagccgtagccgcagtcgcagtcccagatatcgccggagtccaagttacggtagaaggagttacagtcctgcagcacgctctccaaggcgtcgtagcgtctcaccagctcgtggacgcagctatagcaggtcaccacagcacaagggtgcacgtgaagaatctccctatgataatggataccgccgcagcaggagctagagccagatcgttgtatccgacgacgagcgttatgtgacagatattgggaaagctatggtcaataacctgcttgacagatccttcgtcgactgcttgactttggttaaggttctcataactttctatatacctattatcttgtgtctactttataagtagcagtaaaaccttttgatgagtgtatttgttgaactaagacctactgtcttttcttgtgtggtaaaaaggcatcgtcctgcactgcttaaacgactcggccgactacggctttcagttc

SEQ ID NO: 5726 - DNA, 985 bp, Zea mays
  misc_feature (13)..(13): n is a, c, g, or t
ggcaacgcgagantatatcaatccatcctcgcctcgatgaccggcatctcgccctcgctcacctacagctccgtccgccagcgtcagccaggctgccccgggaggccgggaggaagcagatcggagaaggtgatctgttgtgatggctcgattgtacatcggcaacctggatccccgggtgaccgctcgggagctggaggacgagttccgcacgttcggggttcttcgcagtgtctgggttgctcggaaaccacctggctttgcgtttattgattttgatgataagagggacgcagaggatgcaatccgtgacctagatggcaagaatggatggagagttgagttatctcgtaatgccagcggtggtcgtggaggtcgtgaccggcatggtgggtctgagtccaagtgttacgagtgtggtgagactggtcactttgctcgtgagtgccgtttgaggattggttctggaggtctaggcagcggaaggcgccgaagccgtagccgtagccgcagtcgcagtcccagatatcgccggagtccaagttacggtagaaggagttacagtcctgcagcacgctctccaaggcgtcgtagcgtctcaccagctcgtggacgcagctatagcaggtcaccacagcacaagggtgcacgtgaagaatctccctatgataatggataccgtcgcagcaggagctagagccagatccttgtatctgacgagcgttatgtgacagatattgggaaagttatggtcaataacctgcttgaaagatccttcgtcgactgcttgactttggttaaggttctcataacttatttctatatacctattatcttgtgtctactttataagtagcagtaaaaccttttgatgagtgtatttgttgaactaagacctactgtcttttcttgtgtggtaaaaaggcatcgtcctgcactgcttaaacgaactcggccggctacgagcttatcagttcaagcggcc

SEQ ID NO: 5727 - DNA, 1797 bp, Zea mays
gggtaccaagggtaagggttttagcggcagcggcagccggagatgggggagcgggcgaaggaatggctcctcgcagcaggcgccggcgccgccgtcggcgcgctctctgccgccgctgtcatcgatcttctctcgagatccaagcggagagagaggtacgcgcgggacctgctggagtccaatggaatgacgactgggaacactcggtccagcaagcacctgggctctcttggtagctcggctcttctctctgatgaagtggtctctgaacagcttacaaggaatatacaattttttggcatggactctcagaagaaagtgactgaatcctatgttgtggttattggtcttggaggggttggcagtcatgcagcatcaatgctcctgagatctggtgttggcaggttgcttcttgtggattttgatcaggtatcactctcatcactaaatcggcatgctgtggcaaccagagatgacgttggaacttcaaaagcgttgtgcctcaagaagcatttttcaatgatatacccagagtgccaaatagatgcaaaagtgcaattgtatgatgcatcgtctgaggaggaaattctttctggacagcctgactttgttcttgattgcatagataacattgataccaaggtgtcactccttgcagcttgcgtgcgcagaggtttgaaagtactttctgcaatgggggctggagctcgagctgatccctccagaattcgtgtcgcagatttgagagaatcaagcaatgaccccctctctcgatcggtgaggtacaggctcaagaaagaacatggaattgagggtggaataccagtagtcttttcattggaaaagccaaaggcaaagcttcttccttttcaagcttcaaaagaagaggaaactccatcagattaccagattgtgccaggattcagggttcgcattataccagtattgggaaccatccctgcaatatttggtcaagttatggcctcctatgtggtcactcagcttgctggattagattttcaaactgaaccggttgttaacctggatttggatcattaccgtatacttcatcagcgtcttattgagcatgaggaactgatgtatggcacagccgagcaagttctggtagatgctgaagaggtaatgtacattgtcaaagaattgtggcgtggtcgaagtgctagagaccaaagccaggacactggccggaagatgtggagatctgtgaacgaactaatgcttgttcggtgggacaaatcaaaggctgctggcatctcaaacttaatacttgtcaagttcagtgaggctgacgcccatgaatccaccacactcgaccgaataaaagaacaagaacctgaattctactctatggtttcacgtgtcctgaaacgagctgagatggagtttgccttatgacttgatgagtagcgagggttgatcctgttggactcccacagttgctattcagtgatggccttggaacagcattcagtttggcgggaatcacacttggggtacctgattggtgtgctatggtgaaaatgtgatgtgcaaagtttcttcttgaggccgctgaaacatcagctctgtgttatcactgagttgtgcacttgtggccatctatgtatgttttttttttctgcacgccaaatctgaaattttgtttctagtctgattgtctgatgtagttttgatgtgatttatgcttgctgtttaccacgaacatagccacttgtagacttaccgatcaccgatgataatgatatgacacgggtttgcgcaaaaaaaaaaaaaaaa

SEQ ID NO: 5728 - DNA, 1848 bp, Zea mays
gcagaagtcgaccggcatcacagttcacatccgacaactaatcagtccatcgcgttcgcgtccacggtcagttgccggcgccatccctgcccctgctcacccctccccgcctggcgtccacgatcggcgacggcatgtctcgcgacgcccatctcggagtcggagtcgagggagacgcagccgaggaaaagaacgccgccgctgacggcggcgaaggagtcgggttcaggtcaggcggcggcggcgggcacaagctgtccctggtgccgctcatcttcctcatcttcttcgaggtggcggggggtccctacggcgcggagccggcggtgcaggccgcgggcccgctgtacgcgctgctgggcttcctcatcttccccttcatctgggccatcccggaggcgctggtcaccgcggagctctccacggcgatgccgggcaacggcggcttcgtgctgtgggccgaccgcgccttcggcccgttctcgggctccctcatgggcacctggaagtacgtgtccagcgccatcaacggcgccgcgttcccggcgctgtgcgccgactacctggcccgcgtcgcgcccgccgtgtccgggggcggggcccgcgtcgccaccatcgtcgccttcaacgtggcgctcacgttcgtcaactacacggggctcaccgtcgtgggctggtccgcggtggggctcggcgtcgcctcgctctcgccgttcctggtcatgtccggcgccgcgctgcccaagatccgcccgcggcggtggcgcgtcgtcgccgccgagagggactggaagctcttcttcaacacgctcttctggaacctcaactactgggacagcgtcagcaccatggccggcgaggtggagcggcccgggaagacgctccccaaggcgctcgtgtccgccgtctccatgacgtcgctcggctacctgctgccgctcatggcggccaccggcgccatcgacgtcgcgcctgaaagctgggggaacggcttcttcgcagatgccgcaggcatgatcggtgggcgttggctcaagtactggatagaggtgggcgcggtgctgtcctccatcggcctctactcggcgacgctgagcagcgcggcgttccagctgctggggatggcggacctgggcctgctcccgcgcgcattcgcggcgcgcgcccccgtcttccgcacgccctgggtcagcatcttggccaccagcgccatcatcctcggcatgtccttcctcagcttcaacagcatcgtggcggccgccaacttcctctacagcctgggcatgctcctcgagttcgccgccttcgtctggctccgcgtcaagcggcccgcaatggcccgcccgtaccgcgtccccgcgcgcctgcccgccgccgtcgcgctctgcctcgtcccctccgcgttcctcgtcttcgtcatggccatcgccggctggaaggtgtacgccatcagcgccgcgttcaccgccgcgggggtggccgtgtactacctcatgcgcttctgcaaggccagggggtgcctcaggttcagcgacggcggcgaccaagggaccacggcggtgtaccaggacggcagcaacgcgggcgatgtctgaatgatagatagactctttgtgccaaaagcactatacgaatttgtattgtaggctagtgttttgtgattaggaattagtggttccggggaaaaggattcatgctccctccagtttctgctcgtgacatcttgcttacgtgtgtgctccaactctccatacttgttggcaacatcaaagacgactccctcaagtctgacgtaactgtttggttgaacgttgaaatggtgtgataaccatttcgcggtcgcatact

SEQ ID NO: 5729 - DNA, 988 bp, Zea mays
  misc_feature (11)..(11): n is a, c, g, or t
  misc_feature (15)..(15): n is a, c, g, or t
gcgcgcgccgncggnagcagctgcaggtgcttggcgggggagacagccagccggccgggtcggggaaatgcgcagaaaaatggacgcggccgtcggtggctaccaataaatggactcccacgccacgccgcgctcctactagcacaaggttgaaaccagcgttgccgagcgagagaaacagagcgccccctgtccaagtggtcaggtccaggacaccctccacgcacgcactgatggaacccctggtgttcgtgctgctcttggtggccatgccactcagaggatcagatggcgcgtggtgcgtgtgccgcccggacgtgtccgatgcggcgctgcagaagacgctggactacgcgtgcgggcacggcgcggactgcgccgccgtgctcccgaccgggccgtgctacagccccaccactgtgcgcgcgcactgctcctacgccgccaacagctacttccagcagaacagccaggccaacggcggcgccacctgcgatttcggcggcacggccaacctcaccgacacagacccgagctctggaacttgcaaataccctgcaacaccaagcgaagcagggacaagcggcaacgccaccggcacgggcacggcaccgccaggctcgacgagtaacccagctacgacgcccagcatgggagggagcgtcacgacgacacctgtcggcgcgtttggtcccgcgcctagcaccttcagcgcggccaccgccactgccgccgcgtttggtggtcgccgtgccctcctcctcgccgtcgtctccgtcctgtctttcttggcgcgctaacttgctcgatcagaagaaatccgtagcatcgtcaccctatgtgtaattggcggccgcacaggacagggctttttttttggtgtcatgccgtcatcgtgaatatttcacaattgttcgttcttctctctcatgtttctcgcggttttcattacttccgctcatgaaaaatggatcgagtttcaaaaaaa

SEQ ID NO: 5730 - DNA, 381 bp, Zea mays
tccgctgctcgggttgtgcggcgtgccgaaatgcgggttcaagcccaggccggaatacgccagctcgctgaggttggtcttgcccacactgaccatgccggcgcggcacaacaggcctacgctcggcgcatccagcaaggcggccggcgcgtggctgcgataggccgcgcccgccgtggtaatgctgccagccacatcaaacagatctttccaggccaggggcacaccgtcgaacacgctcaacggctggccggcacgccaacgggcagcggacgcttccgcctcacggcgggcgcgctcggcagtcagggagatgaatacgctggggacttggctcgcgtgagcaagtgcctgttcgagggcctgcaccgggtcgctgca

SEQ ID NO: 5731 - DNA, 458 bp, Zea mays
cccgccccgctgggcggtgacggtgccacggctgtagccggcttccatttgcttgagcagttcggcctgtttttccggctcggcttttttctggtagaccgtggccaactcgacgtagcagatatcggtggtgttcagcgcggccttgcagatgctttccacttcatccagatgctggtcgtaggtgtcctgggtgcgatacagcagcacctgggccaggccggcttccgggtagcccgaggcgcgccatttgctgatctgctgctgggcgttgatgttcgggaaactgtgcgggtattgcaggtacaacatcgccagcgggatcagcgtgttgccttcgccattggcaaaggcttttttcaacaggccttcggcttcatggtgctcggcttcagtggcgcccggcttggccaccagcaggcgacccaggcgtgcctgggcacggggcgaggtatcgc

SEQ ID NO: 5732 - DNA, 389 bp, Zea mays
cctctcctgagccagctgtttcatccggccaagcgcgacaatgcgctgcgtgaaagctgggcattgaacagtgaccagatcgcggtgctgcacgtgggccgcctggcccaggagaaaaacctcgggctgctcaagcgctgctttgaaacgctgcaggacacctatccactgcgccagatgaaactgatcatcgtcggcgacggcccacaacgggcgatgctggaaaaggaactgccggaggcgattttctgcggcaccctgcgcggcgaagagttggccaggcattacgcatccggggatctgttcctgttccccagcctcactgaaaccttcggcaacgtggtgctggaagccatggcttcagggttgggtgtagtggcgtacgacca

SEQ ID NO: 5733 - DNA, 354 bp, Zea mays
attccccgcctcgggagatcaggttttcaatctgcgagatctgccgctgttcgttggcgtccgccgattgcacatagaccttggcgcccagctgctcggcggcggcggtgaagtaatcgcggtcccgcgcccagcgctcaaggcgcaggtcgtcgatggaaaagccgattttcggatgggccgcgtcggccatgaccgagttggaaagcagtgccagaacgctggtgatcaagacggttttcaggtgtttcatgatggtgagtcccttttattgttgtttagacgcacttctggacctggagcgtagcggtcatgggtagataaagcgattcaccacgccttcgagcatctcct

SEQ ID NO: 5734 - DNA, 1341 bp, Zea mays
aaaagtagaaacagcgggtaccccggggccgaaaggctacaagcctacaagcaaccgcgtccgcgtgtggagcaaggaaggcgaggggagccgagcgggcaaccggcggcgacagacatggcggagcagcacaaggaggagtcgggcgtgacagtgctggacaagatctccgacaagctccacgggcgcgggggcggctcgtcttcgtcgtcggactcggacgacgagcgctcgtcggcgacggccgccgtgaaggccaagatctaccgcatcttcgggcgcgagaagcccgtgcactccgtcctcggcggcggcaagccggccgatctgtttctatggaggaacaagaggatctctggtggggtgctcgcaggcgcaactgccttctggctgctgtttgaggtcatggattaccacctcctcaccctgctatgccactgcctcatcctcaccctggccatcctgttcctctggtccaatgccacgactttcatcaacaagtctcctcctaacatccccgaggtgaagatcccagatgacctggctgtgaatgttgcacgttccctgagatatgagatcaacaggggttttgctaccttgagggagattggccaaggccatgacctcaagaaatttctgattgtgattgcaggactgtggatcctttctgttcttgggagctgctgcaatttcctcaccttgtcttacatagtttttatggtactgtacactgtaccggtcctgtatgagaaacatgaggataaggttgatgcttttggtgagaaggccatggtcgagctgaagaggtactacgccatcttcgacgagaaatgcctatcaaagattccgaagggcccattaaaagacaagaagcaacattagaagcttagaatcagataagggtctgcggtgatttatcatctcttttgaccattattcgtcggttttggtggatggatgtgattccatgtctaaatacctggacgtgctctagtgttttagtgtggtcagtagcaatgttctaaattatctgagattacgctgaatcatgttctgaagtccacgtttaacgttgctctccctatcctttggaagtggcaatttcctcaatgtctgtaatatatctagtctagtgctatttcttaatctgacctagcgtcatgatgaacccttcttggatatttatttatttgtgccaccggacatggtaattagagagcacgtaaattgtacaaaccacaaaaaaaaaaaaaaaactcaagactagttctctcctcgtgccgaattcggcacgagccgacatcctctccaagaagtactgcaagagcttcgcgggcctcc

SEQ ID NO: 5735 - DNA, 881 bp, Zea mays
gcacccaaccgtggcagcgtgggacacgaacgcagcgggtacccgcgggttggccggccagcctacaagccaaggctacaagcctacaagcaaccgcgtccgcgtgtggagcaaggaaggagaggggagccgagcgggcaaaggggagcgcggcgacagacatggcggagcagcacaaggaggagtcgggcgtgacagtgctggacaagatctccgacaagctccacgggcgcgggggcggctcgtcttcgtcgtcggactcggacgacgagcgctcgtcggcgacggccgccgtgaaggccaagatctaccgcatcttcgggcgcgagaagcccgtgcactccgtcctcggcggcggcaagccggccgatctgtttctatggaggaacaagaggatctctggtggggtgctcgcaggcgcaactgccttctggctgctgtttgaggtcatggattaccacctcctcaccctgctatgccactgcctcatcctcaccctggccatcctgttcctctggtccaatgccacgactttcatcaacaagtctcctcctaacatccccgaggtgaagatcccagatgacctggctgtgaatgttgcacgttccctgagatatgagatcaacaggggttttgctaccttgagggagattggccaaggccatgacctcaagaaatttctgattgtgattgcaggactgtggatcctttctgttcttgggagctgctgcaatttcctcaccttgtcttacatagtttttatggtactgtacactgtaccggtcctgtatgagaaacatgagggataagttgatgcttttggtgagaaggccatggtcgagctgaagagtactacgccatcttcgacgagaatgcctatc

SEQ ID NO: 5736 - DNA, 512 bp, Zea mays
ggggaagctgcgacgccgtgcggtaccggattccgggttcccctttaaataccgccgtccggtacttacacaaagaagccgaggccgaatacgccgtaaacgatggcaggtacaccggccaggttgttcactgcgatacggatgatccgcgtcagggtgttctgcttggcgtattcacgcaggtacaccgccgccagcacgccgaacggggtcacgatcatcgccatgatcagggtcatcatcacggtgccgaagatcgccgggaaaatcccgccttcggtgttcgcttcccgcgggtcgtcgctgaggaattcccagaccttgctgaagtagaagccgaccttggtcatgtaacccatggcgttcggctgataggcatgcaccaccttgccgatgccgatttcgatttctttgccgttggcatcgcgggcggtgaggctgtcgcggttgaactgggtgtgcaggtccgccaggcgggcttcgatgtctttgtagcggttgttcagttcggc

SEQ ID NO: 5737 - DNA, 269 bp, Zea mays
ggccttcattgctcttcaagccaggtcaggaacggctcgtcgcagatcaggccgtacttgatgacttccgccaggcccgccgacagctcgcggggcggcagggtattgagggtggcggtgtcgatcagcaccacattcggctgatagaacgcgccgaccatgttcttgcccagcggatggttgataccggtcttgccgcccaccgacgaatcgacctgggacagcaacgtggtcggcacctggataaagtccacgccccgctggtagca

SEQ ID NO: 5738 - DNA, 704 bp, Zea mays
ccagcaacgcgattccccgcggcaagctgcgcatcggcgcagtggaatccagtgccagtggccgcctgccgccgttgttggctgaataccatcggcgctatccacaggtggaattggaactggtgaccggcgcctgggcgcagttactcgatgacttgcaacatcaccgcatcgatgcggcgctggtggccgccggcggcaaacgcccgaagctcgaacaaagcgtggtctacagcgagcgcctggtgctgatcaccagcgcctccagcgcgcccattgaggacgcgcgggacctggccggccgcaccttgctggtctggccgcccggctgcccgtaccgcgccgccctggaaaactggctcaagccccacgacatcaagcccgccatcgccagctacgccagctggggcacgatcattggctgcgtcagcgcggggattggcgtggcactggcgccggaaggcatcctggcgcgctacgagcaggccaaccaattgacgtcctaccgcttcgacgaattggctgcggtggataacctgctgttctggcacaaagacacccaacgccacctggcgcgggatgcctttgcggggctgctgcgggagacattcggctaacccgttgcaacatgtttcagttatcctcccgcgaaattaattcaaattgtaagggactaccatgaattacttccgcctgttgctggc

SEQ ID NO: 5739 - DNA, 856 bp, Zea mays
  misc_feature (9)..(9): n is a, c, g, or t
cggccgggnaaaaaaaaggacgcccccgtcgggccccccggggccgcccgggacacacgcaggacaagccatcgccccgatggacaccgccgcctcatgccgcctcctctcgccggcctcgtcctctccgcccccctgtccgaagcagctacccaagcggcgaccgaccttcgcggcctcgccgcagcagtcgtcgcccagctccagcgctaagttcaggctcctctgcctcctccatgacaagtccgcggcgccaacgtcgtcggtgcagatgcagagctcgcacttgcagaggctggcgacggtgttgcagtgcggagccgtctgggcagctgttgaggcgccggcggcgctggcggtgaccggcgaggaggacatcgacctgctagggatcctgccgccgctcgcggtgttcgccttcttctacttcctcgtcgctcctccggtgatcatgaactggatgaggctgaggtggtacaagcgcgaattcgtggagacgtacctgcagttcatgttcacctacctcttctacccagcgatgatgttctgggcgccattcgtcaacttcaggaagttcccgagggatcccaccatgaagtacccttggtccaagccgaaggagggcacgccgctgttcaaagacagatacccgcctatagactcctagatacagccttgatacttgtactcggctcgtcgcgcgccacgggcatgcaggcagcgaaaaggccggtttcttcacctaaaaatctgtgtaaaacattactatatatcacacagtctaataatacccgtgctagtacatggggaaaggttactatcacaaaaaaaaaaaaaaaaaagcggcccgtcgtcg

SEQ ID NO: 5740 - DNA, 927 bp, Zea mays
cctcgaggccggccgggggtaccccccggtccggccgtgatgcgtggggccgccgccgcgggcggaaaccacaacgcaggacaagccatcgccccgatggacaccgccgcctcatgccgcctcctctcgccggcctcctcctctccgcccccctgtccgaagcagctacccaagcggcgaccgaccttcgcggcctcgcagcagcagtcgcccagctccagcgccaagttcaggctcctctgcctcctccatgacaagtccgcgtcgccaacgacgtcggtgcagatgcagagctcacagtcacagttgcagaggctggcgacggtgttgcagtgcggagccgtctgggcagctgttgaggcgccggcggcgctggcggtgaccggcgaggaggacatcgacctgctagggatcctgccgccgctcgcggtgttcgccttcttctacttcctcgtcgctcctccggtgatcatgaactggatgaggctgaggtggtacaagcgcgaattcgtggagacgtacctgcagttcatgttcacctacctcttctacccagcgatgatgttctgggcgccattcgtcaacttcaggaagttcccgagggatcccaccatgaagtacccttggtccaagccgaaggagggcacgccgctgttcaaagacagatacccgcctatagactcctagatacagccttgatgcttgtactcggctcgtcgcgcgccacgggcatgcaggcagcagcgaaaaggccggtttcttcacctaaaaatctgtgtaaaacattactatatatcacacagtctaataatacccgtgctagtacatgggaaaggttactatcaaaaaaaaaaaaaaaagatccatagttctatacctcacaacattcatgtaatcatgtccgttaaaaactatgttcaccagtac

SEQ ID NO: 5741 - DNA, 1360 bp, Zea mays
ttttttttttttttttcttttttttttgcatgcacacagatcattcattaatatataatgaatacaaatatatgtaaacccaagaggagcatgcacgcatggttcgacgtttttagttactaataacttgtcaactaattaagacttccctatgccccttagttactatcaacttgaataaacctataacccatccatccgtccgtccgtatctgtgtagcattaaaccaaggtctaataataataataagagcccccaataattatttacatcgtccaccagtagtacgcggcagtgtatactagctacacccatctgttccccagtgttccgtcagaatccatcgtagaatccaccgaaggatatgttggccctcgcggacgcgcctcctcccgcccccatcacggacgacatggcctggttcagcctcgacgtctgctgcaccacctgatggatcctcttatcgtcgccgtagaactgcagctggatcgtctcctcccgctgctcctgccgcctgtggtgctgcctgccgccgacgaggaacacgcagagggtggcggccgcgacgccgaacgagcacagcgcgccgatcccgttcaccttcagcttccccacgctgaacaccacgcactgcggcgcacgcgccgccttgtcgtcgtcgtcgttttccttgccggcatcttcctcctcgtcctccccctcctcctcctcctgctgctgggcagcaaacttgccgccgtcgtcggcggtggccttggcgtcatcagggctctggaacggctccttcgcttccacggcgccctcggaggaggccatcgtcggatcgccggcggcagcgctaggcgcgacggaggaggacttcttggcctcgtcgtccggcacgacgccgatgtccttgcactcgtcgtcgtgcgcgtcaacgacgtcgtcccctcctggcgcaggcagcagcaggtcgagctcctctgcttcttcttgatcgtcaagggtattattgttgctgccgtggtggtggcgcacggaggatgagctcctgtggtctggcagcaggacctcccagtcccagtcccacgcatcctgctggcccgcgtccatggagtcacacacctcctcctcggctagctcctcctagtcctgtcgcaagctagcagcaagccggtgcaagtgcaacaaacgaacgctgcgggatctcgtatctacagcacaggacgcagccaggcagcgaggcttacaagcatcaacagctgagttccaacaagcatcagcctgattgtacgctgctgtccttggggttgggcttcctcttccttcactgcagggaaaccggaaaccaggcgcctgctactgctagtcccgaat

SEQ ID NO: 5742 - DNA, 819 bp, Zea mays
gcttggatccttagagcgcgacgcgcaacgagcacagcgcgccgatcccgttcaccttcagcttccccacgctgaacaccacgcactgcggcgcacgcgccgccttgtcgtcgtcgtcgttttccttgctggcatcttcctgctccccctcctcctcctcctcctcctggctcctgagcagcaaacttgccgccgtcggcggcggtggccttggcgtcagcagggctctggaacgcctccttcgcgccctcggaggaggccatcgtcggatcgccgccggcagcgctaggcgcgacggaggaggacttcttggcctcgtcgtccggcacgacgccgatgtccttgcactcgtcgtcgtgcgcgtcaacgacgtcgtcccctcctggcgcaggcagcagcaggccgtgctcctctgcttcttcttgatcgtcaagggtattattgttgctgccgtggtggtggcgcacggaggaggagctcctgtggtctggcagcaggacctcccagtcccagtcccacgcatcctgctggcccgcgtccatggagtcacacacctcctcctcggctagctcctcctagtcctgtcgcaagctagcagcaagccggtgcaagtgcaacaaacgaacgctgcgggatctcgtatctacagcacaggacgcagccaggcagcgaggcttacaagcatcaacagctgagttccaacaagcatcagcctgattgtacgctgctgtccttggggttgggcttcctcttccttcactgcagggaaaccggaaaccaggcgcctgctactcccggccggcctcgaggtacccaatg

SEQ ID NO: 5743 - DNA, 3592 bp, Zea mays
  misc_feature (21)..(21): n is a, c, g, or t
  misc_feature (2788)..(2788): n is a, c, g, or t
tgcaggtaccccggtgccggnaacttcccggggattagctgggtttgcctcatataaaaagaacttggttcttgaagatgcattcaatgaaaatatgcttggctccttccttctggcaaatatccttactggtctggttaatctctcagttaacacgctctctgcctcttccttcactgccttcatgattctgtcagtatacgcctttactttatgcatggttactggccttacccatttttgtggtgttaggatgaaattctggtgaattgtaagctaccatttgatatgatgtattcattcattaacttgtcaacaaactggtagctagcttgcttgaaatataatactacgtctgttcttgaatatttgtcgcccggtagtttatttttcaactaaaacgtgacaaataaaaaagtctgaataatttttagggaaagaagccaaattgctatcctaattagttgatccagttattaactctgcctagactcgggagcttacttctttcatgtgtgttcaaggttctttgtgtctcatcagaaacttcctagtttccttcatttcatggtacaacgtgtctgctggtattaatcaataccgctatttacttttgacctaaagacgacacatccacccacggtatatgtgttgacgaattgaagatggtctgtcaagagtttgctgtttcagtatttaatgtcagtcagaatcaggcttgaagtaccataggttcatactgctacagttacccacttgtcacagataaaacagtgggtccaggaaagcagtgctgtagtcgaatgttacttgctggatttctgcagatgacagagagaatttgagcactatgacattcatgacagatagtacatactcggagaacagtggcgtgccggtgctggtagaggtttttggttgctcatttgatgagttttcatgacttggggtgcctctgaaatctgaatcctgcattcctgccaagcacggcatggtattatggagttcctttgtcctgtgagaactggattttcgaatttacatacatacatattgggctgccctcgcacgccactccgaggggtcggccatgttcatgtcatgaggccatattgcccgtgtgccaggctgaccggaaggacggacggctttgttggcgagggtcgctgctgcattaaaagtcgtacgaggactttgtgatgaatttcgtgacgcagatgacccactgacctaggtgagttgcagctggaggagcgtgtgggcattttggcgtggcgtttcttcgtgcctgtttcttcaaaagcatgccacatcttagcactgtcaatccatccgtagcaagcgccatgattcgtcgtcgtctcaactctgagctggagccctaacttaaggtgacagacgacgatcggcgctatctcatctcatctctgccatcttttggacggagaaacggcaccagctcgtcaccgtgttggcacatgcgaagctcgtcggtttggtcgtgcggcctgacccgtgaattatgatctcgaatttcgccggaaactgctacgtaacgtcggcgtgcccattcggccgtcttcgtcggtggtgttgcgcacgcgggccaagttgacgtgccagccatccggtgcacccacattaattcgcgtgtcgatagcgagagctaggtcacggcacggctggacctggacccgtcgccggcttacccggttagccttgtccgatctgcagcgctggttggctggtcgcacaggagcctttaagtacagtacagcgccgcttcccctcgtttctatgtgccttggaggattattgcaggttttcacccatggattcgggtgcacgatccgtgctctgctttgtcgttttagatttgtccaaagtcaatcactgttaacatctatcggttataccaaatgttttataagattttataacataaaaataaattattaaatttatcatgacttaaactattataatatataattattatagtttaaaataatttaatcttatatatatatatatattactctctccgtccaaaattataatctgtttgacttttctgtggcaaatttgaccggctcgtcttattcgatttttttcgagaaaaatgaaaaattcaaaaccatacttaaagtatattatatgctaaacaatagtattacagtaaaaattagcagtaattacggttttttaataagacgagtcgttaagtcaaacttgagtaaaatagtttcattttggacaaatataaaaagacaaactcataccgtatagatcaagggagcagaagtaaaggcatgcatgcaacaaagcagtttatcccagatatgtcaagtcgtcaatcatctttgagcgggtccagcattatttctctgagcgcaggcttttgcgataccaacgcagaagttgaccctgttgcgtcgtggataccatgttgatttttttttgttgctaacgagtcactgccatttacagggtagggggcgtaggggtactccactgtagctgggcatgcacgctcctcctgtcctggttggtacagtggtggtgcatttcccttccctaggtgcagggatgtgctctacttcactgcagcgtgttgcgtgaacatcaagtgtacagtgtagcactggactaggcttgtactagcttgcttgcttgcttctttattcattaatgtgttgaaccaatgtacgagagagagagagagagagagagagagagagagagagagagagagagagagagagagaggtgcctaccgtactagtgncatcaggcatgtgtacgcatacgagtactactccatgtctgctccgatccctccacaacagatctctatgggttaatgacttaattctttgccattctagcagttaaatcaccaacacccattaatactattagttgggtcacctacaatctccactaggtaatcaccaagctcccgatcgacaccaaaccgtcgaccatcaagagtaacaagcacgaacactcacttgatctaaacaagcctaataaggatgatggatgcacacttgttactctatatgcactaattaggttcctaatctcacgatttcatcaaatcttagacaacctcaccagccaaaggctctatctatatctctaatgtgtttctttggcaaaaataaatgggcaagaacactaaaattaacaagttgaagggtatttatactccctaaccaccaaactagcagttagaagaactctggcatgaaaacacatgtgtccgacctattcatagggcccgacaacatgtagagcggaccctagctcctacaatcataatgtctggcccgacagcacacgtcgaatcagtccaatgcgtgaaaaacctctctatctgtttatggactgtgtcgagctgagacgttatagtccgacgaccctgatacacacagtcatctagcctttttaaacaccccatgtgtaggtgcccaaccaaactcaatggtccgacgacccttattttttagggttcagtgagacaatgactataaaaccccgccaaaaacactttctgcaaatgagatttgttccaaaagattttaaa

SEQ ID NO: 5744 - DNA, 2759 bp, Zea mays
ggccaatgagttttttccgggagcatggttggcggtctagttttcggattgattgccactagtgtgtgtttttaaactctgttgtgttgggttgtgtgctcttatgggcagagtccggaagtgactttcaaggacttgtatcatctcgatgtactgttcttgaatgaataaaaatccttcccttttgaaaaaatggatagttcactgagatgtcagtctgcagttatccagcactcataaacactaaggtgtaggcaaaccctaaaatggagcatttgtttgtttagcaagaagtgtaaatctggagaaatgatatgcatctagtccaacgccagtcttgctgttgtgtgcaattgtgcatcgataattttttcacctcttgtttcagcagatcagctgtggtatgtgagagttcttggtgtacttgtaaaagttgaatagtcagctatcttaggccggataactatcgttagctatcttaggccggcaccgtcgcaggttgttatgatattacaaacgcatatgcttatctaagtaatagatacatataccagcagtaccggccattgatcagatcagtgcaagcaatgcatgcctacctagtttttagcggcaccgtcttatgatattacaaacgcatgcttatctaattaatagatcggacttgatattacaaacacgcataggcatgcatgttcagatcaaactagatacatataccagcagtaccggcaatcgatcagtgcaagcaatgcatgcctgcctacctagtttttagcggccatcgatcagtgcatgcaatcggtacctctatttacgttttaccggccatcagtgcatgcatgcaaagggatcaggcgcctgttcaagcgcggatcggaaacgaagagacctaatcctcatccaattccatcgatcatctatctcatcaccatatgttcaatccaccaccatcatatccttaagggaagagatcatcatattctcaagggcagggcagagatggaggagcagctacctgacgatatgcttgtggaaatcctgagccgcctcccgcccagcagcctagcggcgtcacgctgcgtctccacgcacttgtgctccatcgtggacgcccgacgtctcctgcgcgccggccacctccttcctctccgcctcgacgccttctactgcatcagcctggcctcggtcgatcgcgagacatatcttttcgcacggccatcggtagcgcgtcggatccccggcgcctgccttgacttcagggtatatcttgaggttgtggatcactgcaacggtctactgttgctgtgtgacatggtgctcaaccctgccacacggcaatcggcagccctgcctaacgccccggatccatccattgagaacatgcttggggtcgccacagtttgggccgggacagcgccgcaccgccccccattttacttgtatacagactttaatcttgtgtacgaccccatggccgagtcgccggagcatttcgaggtatttctgatccccgtgttatcgtgcggccatagtggtttgatgtccgacaatatcaccatcaaccttgaggagcaagaatggccgccatcgacattcagaacccacgtcttctcgtcgaggagctggaggtgggaggagaggtcctgggtccgccaaggggagcctacggggaccatggccgatatgctgcgctccgagcatggctcgaatcacaaggctgtctattttcgaggagcactctatgtgcattattcaaatgaatctgtcatgagatatcgatatcaatggcgtttcatcatctattattattattattattattattattattattattattattgttgttgttgttgttgttgttgttaataaataaatatatttggtatcattaattttaattaattgtaggatatccatatccaaggacaggaatacgtatcaaatgatgagacttccagcaatacggagcaaacagatagttaagcgtgctaccttttacttgggaaaatctgagaaaggagtatattgtgcgttgttttattgggcccaggatgacagcgacccccagtttcgagtctggtctcttatggaggaagagatgaatggacgtgatggacaaattcatatgaagtggttgataaagactagcatcagccttaaacccctgctggcacaacttcatcattgtggtcacgacttgactccagatgaatggaggatcatctataaccgccatgaccgtgaccttgctggttcgtctgcacaagatgataatgatgatgaatgggactttgaaaatgctcatgagattgtccttgaagcacctaacaatgttaaagactggtaccctatagattttctcggatttcatccttacaaggagattgtcttcttttccttatcatggaagacaatatcttataatttgaataccacaaaggttcgacagctgggctgcgcagcttatataccggtgggcataaaaacttgttttccatacacaccctgctacctgactatggagaaattaactaacagttgatcgtcctccgcccaccacttttgatgatgattagtgcttataattacttacttaactagagagtgcacatctttcttccactttacattatatttgtcagattatctttaattttggcaatacatattttacttccgtttttttaaaaagagatgataataataaagaagcagtggacatattatattaattaccaaaaaaaaaaaaaaaa

SEQ ID NO: 5745 - DNA, 1711 bp, Zea mays
agagatgagacctagcagcgcatcttctcctcgacctgtatcgacacgttcaatccaccaccatcatatccttaagggaagagataatcatattctcaagggaagggaagagatggaggagcagctacctgacgatatgcttgtggaaatcctgagccgcctcccgcccagcagcctagcggcgtcacgctgcgtctccaagcacttgtgctccatcgtggacgcccgacgtctcctgcgcgccggccacctccttcctctccgcctcgacgccttctactgcatcagcctggcctcggtcgatcgggagacatatcttttcgcacggccatcggtagcgcgtcggatccccggcgcctgccttgacttcagggtagatcttgaggttgtggatcactgcaacggtctactgttgctgtgtgacatggtgctcaaccctgccacacggcaatcggcagccctgcctaacgccccggatccatccattgagaacatgcttggggtcgccacagtttgggccgggacagcgccgcaccgccccccattttacttgtatacagactttaatcttgtgtacgaccccatggccgagtcgccggagcatttcgaggtatttctgatccccgtgttatcgtgcggccatagtggtttgatgtccgacaatatcaccatcaaccttgaggagcaagaatggccgccatcgacattcagaacccacgtcttctcgtcgaggagctggaggtgggaggagaggtcctgggtccgccaaggggagcctacggggaccatggccgatatgctgcgctccgagcatggctcgaatcagaaggctgtctattttcgaggtgcactctatgtgcattattcaaatgaatctgtcatgaggatatccatatccaaggataggaatacatatcaaatgatgagacttccagcaatacggagcaaacagatagttgagagtgctaccttttacttgggaaaatctgagaaaggagtatattgtgcgttgttttattgggcccaggatgacagcgacccccagtttcgagtctggtctcttatggaggaagagatgaatggacgtgatggacaaattcatatgaagtggttgataaagactagcatcagccttaaacccctgctggcacaacttcatcattgtggtcacgacttgactccagatgaatggatgatcatctataaccgccatgaccgtgaccttgctggttcatctgcacaagatgataatgatgatgaatgggactttgaaaatgctcatgagattgtccttgaagcacctaacaatgttaaagactggtaccctatagattttctcggatttcatccttacaaggagattgtcttcttttccttatcatggaagacaatatcttataatttgaataccacaaaggttcgacagctgggctgcgcagcttatataccggtgggcataaaaacttgttttccatacacaccctgctacctgactatggagaaattaactaacagttgatcgtcctccgcccaccacttttgatgatgattagtgcttataattacttacttaactagagagtgcacatctttcttccactttacattatatttgtcagattatctttaattttggcaatacatattttacttccgtttttttaaaaagagatgataataataaagaagcagtggacatattatattaatt

SEQ ID NO: 5746 - DNA, 658 bp, Zea mays
cacggtcaacgcccgagtgatcgccaaccgtatcgctgcggacctcactgctgctgatccggccaacgccgagcgttaccagagcaacgtgaaggcctttgatggccgtatggacgcgttggatgcgcgcttgaaagcacgtatggcggatgtcgccggcaagccttacttcgtattccatgaggcgttcgattacttcgaagatgcctacggcctcaagcacactggtgtgttcagcgttgccgcagaagtgcagccgggcgcccagcatgtggcggcgatgcgcacgcggttgcaggaagtgggcaagacttgtgtgttcagcgagccgccgctgcgccctcgcctggcggaaaccctggtggcgggtttgccggtgaagctggccgagctggatgcgttgggcggttacacgccggcctccgcccaggggtatgagcaggtgctggagaagctggggaatgacctggctgggtgcctggagtccctgtaaggctcagcgaagatccaaatgggcggcgcccgcttgctcgcgaaggcggagtgtcaggcaccagatgcctggaatgattccatctcgggcatttgcttgagggggtccgattcgtgaagaacggcatcgcagaccccagacattgaataaaatttgattgcgttc

SEQ ID NO: 5747 - DNA, 717 bp, Zea mays
  misc_feature (685)..(685): n is a, c, g, or t
tagtttgcggcagatggctggtgaaacttcaacgattctgccttgcaactttggaaggttgtttacctggccaacccggtggagatgactccggcaagggtctcgcatttccggatgctgtttgagaccttgctacagaaagacgatgcacgcgtgtggaatgtcttcactcgtgtcgctggccttccagagctcgaggtattgagggatggcattgtgatgttcatcaagcagcacgtgatcgccgaggacgcggggaaggacttggctagcaaattcaagattgcgaagaaggcgctcgacaatactgccggagttctgatgtaactctgcccttgtcgaacattctgggcatctccaagcgaaacaaagttattagaacattctgctggagtcctctgttctcgttttgcgtggtccttcaggggataaaccaaccaattctgtagagaacggttgtggtagattgatgccttgttattagaatgcttctccaagagacctttcatgggttttgaatgcttacccaaaaaaagggctttgatggtcatacattgtaccatttcttagaagtactctgtttattgtttagctgcacatgaagatccttaggcggctatatgcactgccacatggtatctattgctccaaaagtgagctgtaacaaatatagcaaaaattgctncaggatttgtttgggcaaaaaaaaaaaaaaaa

SEQ ID NO: 5748 - DNA, 2247 bp, Zea mays
  misc_feature (2216)..(2222): n is a, c, g, or t
aattcggcacgagggaaaaataaggagaaaaaggatgacacagtgatggaggaaccagatgacattgatgaagagaatggtcggaaaaagaagaaaaaaaagaagaaggatggtatggagaaggaggaactggttgatgtaggtgaagagaatggtcagaaaaggaaaaagaagaagaagatgaaggatgactcagagatggacgaaccagatgatgaaggtgttcacatggatgaagagaatgatggagcagtcctggaatctgaggatggagtgtctaatgtggttgaactgcccaaagaatcaaaagggaagtatgtacctccgagtctgcgtaatgcttccaattcagaatcagaagaaattgcccagatgcgtcgcagagtaagaggacttctgaacagactttcagagtcaaatgtggagtccattactcaggaaattgccacactttttcgatctgttccacgaagtgatggctcccagataattggggatgaggttttggctagttgttcccgaggacctcgtggcaatgaacagtatgccgctgtctttgcagcctttgttgcaggtatggcatgtttggtcggtgttgacttcagtgccaagatccttgcatctattgctaagtcatttgaggatgagtattcaaaagaagatggtctatctttgagaaaccttaccttactcttctgctatttgtgcatatttggtgttacctcaagcgatcttgtgtatgatcttctgtcgattctgagcaagcgcttgacagagctagatgtctctacagtgttgaccatcctacagtgctgtggaatgaagctgcggggagatgatccatgtgctatgaaagattttgtccttagtattcagaactctgtgaatgatcttaaattgcactctggtgttggagcagacgggaagactgatatacgtagcagaagaatggaatttatgcttgaaaccatatgtgacattaagaacaataagaaaaggcctaaagaggatccttcacaccatactcgaataaaaaagtggcttcaaaagcttaaggcagaagatgtcctcttgcgtgggttaacatggagcaggcttttggaccctgataagaaagggcagtggtggttgtctggggatgttccatctacagtagctaagattgaagatgttgcagctgttataagcaaggatgttgcagagacaaaaaaacttcttcagcttgcagctgctcaacggatgaacactgacatacgaagagcaatcttttgtattataatgagtgctgaagactatgtagatgcttttgaaaagctcttgaggctgggcctttctgggaagcaggaccgagaaattataagggtcattgttgactgttgtctgcatgagaagatgttcaataagtattacacagtccttgcttccaagctatgcaaccatgagaaaaaccacaagttcagcttgcagtactgcatctgggaccattttaaggagctagataatatggagtcaagtagatccatgaaccttgcgaagctagttgcggagatgctgttgaacttcacgctctccctcgcaactttgaaggttgttaacctggccaacccggtggagatgactccggcaagggtctcgcatttccggatgctgtttgagaccttgctacagaaagacgatgcacgcgtgtggaatgtcttcactcgtgtcgctggccttccagagctcgaggtattgagggatggcattgtgatgttcatcaagcagcacgtgatcgccgaggactcagggaaggacttggctagcaaattcaagattgcgaagaaggcgctcgacaatactgccggagttctgatgtaactctgcccttgtcgaacattctgggcatctccaagtaaaacaaagttattagaacattctgctggagtcctctgttctcgttttgccttgttattagaatgcttctccaagagacctttcatgggttttgaatgcttacccaaaaaaaaggctttgatggtcatacattgtaccatttcttagaagtactctctgtttattgtttagctgcacatgaagatccttaggctaccgccgctgcctcgtcgggtcgacccctccattagtgcgctgtaacaaatagagcaaaattgctccaggacgccaatcactacggcaccgtttgtttgggctttccaaaaaaaaaaaaaaaaaaaaannnnnnnagtactctgcgttgttaccactgct

SEQ ID NO: 5749 - DNA, 4436 bp, Zea mays
  misc_feature (191)..(191): n is a, c, g, or t
  misc_feature (1227)..(1227): n is a, c, g, or t
aaaaagactaaattcatttctaagggacaacatggaagttgggccaagatcaaactgagctagagcaatatagcaaagaaccattgcttagttggaaagatagtgaccactttgacatattgagttggtggaaggcacatggcacaaagtatccaaacctttctcaaatggcaagggacgttttggctatnccagcatcaacagtagcatctgaatctgcattcagtgctggaggaagagttgttaacaagtatcgtagccgtttggaccctcaggtggttgaggcacttatttgcaccaaagattggattagggcttcaaacaaaggtattttcagtgccacatttgtcactactgcatgctggttttcccattgcatgcattactctctgatgatatccccatgcgattcttgtatatttatttcagacccaaaagatttattctcaaacgttgatgacttagctggttctggtgttaatgctacactccaggaagatggaggtacaatataataactatttagctatacttcatgctgttagtttagttgcacaatttttttatacacatcatcatgtgtgttgtaggtgctactgatgctgctgaaagcattgttgatggtgacaaccttgttgatctagaagaaagatagggttgttctttctttaggtgagtcctaatactttttgagtgttttcattagataaatatttccactttgctagtataatattttttatctagtataaaaaatattgcagaacatattgttgaaaattctcatcatttctttaggtgagagtgagatgtgcttgactgcttggagctggaacttgctgttctcccacatgttgagtgccttctatagtgtttccaatgctagaattgtgtttttcaattttgattcacctgctgcttattttggggcagtgctactgcggctggtgctgtattcatcgtgagagaaaaatacagtagtgtgtggtaaaactagcagccaaatagaattataatttacaagtggttgcttttgtatccatcgtgaatgagatgtactttaatgtgggactttacatcagtggttgctgctatttaactttatctcattttaacatggtagttagttagttacggtatgaagtatgaagcatttatcactcatgatttatgtttgtattgatcagagagtatatgtagtactttgattttagtttgccttggttnttgatgaactcataacaaatattttctttgttatgattgaattatatgatgtttgtaatggatttaactatataaacatccgggtgtgaatccgtattcgagatatccattttgtattcgtattcgataacattcgtattcgtattcgtattcgagttaaaatatggtaaatagtgctatccggattcgtttccatccgtatccgaccgaaatccatccctatatgcaggagcggttggtgctgttccagtcttatcccaacaacttccgccgccatcgcaggaaccgcctgactatcgcctaacacgtgtcagcacatccacgtggcatgatcccaagcctctgcctttgcctcgcaacacgtgtgccacctcctctataaatatcggctctagcgctacgaattacggctacctctaaacttctcttcctactttaaccgtttaatgtgcccccttcttcccgttacgattaccagcgtcaccgccaatgccgccgcctccaccaacgggcgaaccgaagcgccgccggctgctatccctcatggcagtctacccatgcgagagcatcgcgccggcgcctctgttcagctcgcttctcgcacttgcggccgacttggcgagccaagggctcggcgccgacgccggcgccttccctgttctccggcgcggcttacggcaggcagtgcggattgcaggcctcctcctcgcgtttctggaggaggtccaagacgtgtcagtgacgaagacggcacctctgccatcatcggcggtgctggggctcacggagctgcacgtggccatgcagaagctgcggttactcctcacggactgcgcgcgacggggcgcgcggctgtgggtgctcgtgaacgccggattggccgcgtctgagctcagggtgattctcgggtccgtcgctgcggccatggacgcgctgccgaaggacgtcgtggacgcgtccgtggaggccggggagctcgcgcggctcatgtcggagcatgcgtggcgcgtggccgtgcgtccggacgccagtgacgagcgcgcggcgaggagcgtgcggtcgatactggagcagttcaagagcggcgtctcgccggacgccgaggacgcgaggcgggtgctagagcacatcggggttagaagctggaccgagtgctccgaggagattgccttcctggaggacgagctgcgcacgcggttggacggcgcaggcggcgacagcagcagcgacgcggtgctcatcaacagcttaatggcaatcctggtgtactgccgtgtcgtgctgttcgaccagaccgacgcgaatccaaaagcggacgcggcgtcacggccggcgaggtgcccggactggctcagaccggagatgttgcagtgcccgatcgcgctggacctcatgacggaccccgtgactgtgtctactgggcagacgtacgaccgcgagtccatcacccggtggatcaaggccggatgccacacgtgcccggtcaccggcgagcggctccgcaccgccgacgtcgtgccgaacgccgcgctgcgcgggatcatcgagcggatgctgctcagcaacggcgtctcgcttccggacccaagcagctcagggcaccgtcacggcgcgctcggcaacacagccgtgccattcgggccggccgccgcgggcgcggcccgcctcgccgtcgcctacgtcgtggcccagctctcgatgggctcgacggcggagcgcaggaaggcgacttgcgaggcccgcaagctgtgcaagcacaacatgttctaccgcgcgtgcctcgtggaggccaacgccgtgccgtggctgctgtgcctcctgtcctcgacggacgcgtccgtgcaggacaatgcggtggcgtcactcctgaacctgtcgaagcacccgcggggccgggcggcgctcttcgaggccggcggcgtggggctcgtggtggacgtgattaacgtgggcgccagggcggaggcgcggcagaacgcggcggccgtcctgttctacctgtcgtcgaacgcggagcacgccgaggagattgggcgcatcccggaggccatcccgactctggtgcagctgatccgcgatggagcgcaccgcgggcgcaagaacgccatggtcagcctctacggtctgctccagtgcgcgagcaaccacggcaaggccgtcggggctggcgccgtgtcggctctcgcgggcctcctgtccggcgaccgggacgacctcgccagcgacgccgtgacgctgctggcgaggctcgcggagcagccggcgggcgcgcaggccgtgctggcgcggccgggcctggtcgcccgcgtcgtcgaggcgctcgccacttcggcgtcccggtcggggaaggaccactgcgtggccctgctggtctcgctgtgccggcacggtggggacaaggtggtggccctgctggggaggatgccggggctgatgtcgtcgctgtacacgctggtggccgacggcagcccgcagacgtgcaagcgggccagggcgctgctcaacctgatccaccgccattacgagatggacggccagcagccggcgtcggaggtgcccggcgagcgtgtcgttcgcgtgctatagccgcagattccggacctgccgtaagtacagtaaataggtgtagatctttacggtgtgccatttgagaccatttcttgttttctgttctcagctcgtgttttagaagagctgagaacgatttttgctgcttccgttttgaagactgctgtagtcacagacacacacacagacgcgagagtatagataaatatgtttgcgagcttgagacttatagcagataatgaaagtgtgacagcatgggattactgtttgcaacgctttcgtgtgtacataccagtgaaatgttttggtttgtgttagtaatgaggggatttgagttaaaaataaaacaacagctcaccgcccgggccatgcttggttcgttttcaaagcatgtcaaatttaaacttaacagatcatcatttttttttctgttattttggcttgctaccaaaatttactaacctttcatgtttagcttactagactatagcaaccttttgtactcagattttacttattattattattattgacacggcaaaatttccatgtgttctcaacagttttgttggaaattaaagaacgtaagcatggtaaagaacactcagtagagaacaaggtgatgtaccatataattttca

SEQ ID NO: 5750 - DNA, 1895 bp, Zea mays
gttctctttctttttgtatggtttctattcgatgtcaggtgaaatctcttagcctcttttgaatgaaaatgtgtattgcttaaattttattactaagccataagacatgtttaggtactcttaggttaaagttgcatagtggccaggttcatatctgacaagcttaatcctctcttatacatatgaacttaattttgactaaacatgcatgtagtgtaattttatgaaacatatttaattatatattgttcttcagttcttgattgttgaaaatttatttctgaaatagtattacaaatggggggtaaggcttgtctcggttattcctttcactcacgtggagctgttagcactgggtctttctttcttctattacaaatggtaccagatccagcacttctgattctcgtttagctagccatgaagtaagcttgctgaactgtagcagatttcaagaaattgagttaatgcatatacacacatgaaggtggaccacctatatggttagtggtagtaagtcctatacgaccccactttattgagtcttgtagtcatatatgttaaactaggtaagcatggtggatggatcatctcttatttgtatgtagatgagatgcaattactgggggggtattttaaattcttctgactgcattattttatgttaatgcaaaacttggaaattaagaactgttgattccacccttagtcatgaagagagggagcgtaggaggaggagagctgctgtgagatcagcttttgtccagcatctccttgtcaccaccatttttgaagactagcagatcaagcacagctcatgcaaaggaatcttgtgggcgggccttttgcccactcatttatctggatggataaggcactaattatcttggataccatcacgctgttcatccggtctgctgggtaaccatgacaggaaaaatgaagcagcgggcgtcttaccttatatatgttctctggaagcagctgacatttgttttctggatcatattcataattctatgtaggctgtgacaggaatctctatagtagagccatgatttttttttggttgggtttcagcctgcgttggagaatatgcccaattttttttttggagaatatgccttatctggatggataaggcactaaacatttgaagattatatttcggagggtggagaatatgacaatttgatttatatcactaaacatttgaagattatgttgaaaaaaaaaaatcggagtttggtacttgtttcttcttaatattcttaatataatgatgtgtgtttctttggtacttattctcattaaggctctggtccatgcatgctatggtatgacggatcataccctaccatgaaggctaatgtgtgtatgtgtttttaaggatacaaacgtgtttggtatgacggatcagctcgttcgggccagtctggtccactccggacgacctcgtcgtctggttttacatcggatgatcatacatacatttatatcactatacattttaattttttcagaactgttgaaacgtgtttggtatgtacgtacgtacgtacgtatgtacacgaggttgcttgatacatatatccgtttctgcacctcattaacaattagtataatatccatactttactacgtacatcaatcatatttgataatgcaacagggggacgcctttggagtcgcccggcgggtctccatgtgatgggccctccaaaaaaataaattaaattaaagtggaccctttccacaaaacaaaattaaaattaaagtgaacatatgacatacatacctgatattaaatcatagatactgcttcttatcttagctaaaaggattagaaatgtataagttgaaaataagacatgtctctttttatagcttgcttg

SEQ ID NO: 5751 - DNA, 747 bp, Zea mays
gcaggcattcgttccattttcccgtcggaaacaaccctggccttaggaggccaggcgattctccgccgcctcgtctcgtcttcgctatgcaccagcacctccgtcgctccaacgccctgagcgcctccgtcgtttgattccggtttgcttctggtttctgccgcacaagggcatcgacgtcgtgctcttcgcgccggacgacgccaaggccacgcagaccgccgacccgaacaggaagaagatcaagctccatgcagggcatcacccaaggccacgcagaccgccggacgactccaaggccggatctccgtgcagccgtgcagggcatcacccacaagaagaagatcaagctccggcgagtacctctttccatctcctgtcgctgcctctaccatatctatctaaaggaacaaatttgagcgcatcttctgttgacagtgactttagtttgctattggtgctccagtaagaaaaatagatgtattttgttgatggtggcttcacaatctggcacatgactcatgaaaagctttgtttgacaaactattgtgaaggaacaagtatactgtcttttactacttcagtttgcttgacaaactattgtgatgatggataaagtgtgatgtgatgatggataaaccaatttactatgcttcagtttaaaaaaaaaaaaaaaaaaaagaccaaaccaaaaaaatttgcccggcgaaagaatgaatgtagataaaaaaaaaaaaaaaagcggcc

SEQ ID NO: 5752 - DNA, 2359 bp, Zea mays
agtcctgggccgctgctgccgcgcactgcctgcttcggccgagacgagccccccggcccccgtttcgctcccatctcgcgacactctgcccacagctcactcgcctccgtctctccccgtcaaaaaagccacccccgtcccccgcgccgcgccacccgcctttggcctctggctggcaccctttcccccgcctagaaacccgagctctccctctagccttctgccgcacacttccgagttccttccgccacaacatccacacgcaaacctcgcgatggccgcgtcggaatccgtgccgttctgcgtcaaagggggcggcggcggcgcgcccaggccgcacggccacctggtgctcccggcggggcgggtccgcgaggggcttgcgttcgcggcgggcgccgtggtggccgctctcgtgctcctctcctcggcctccgtcctcacgccgccgcccgtgcccaacatcgtctccctccccctgtcgtcgtcgcccgccaacgccaacgccgccatctcttcctcccctgccgtggccgtcggcgagggcccgcgcacgttctacgacgaccgggagctgtcgtacgccgtcggggggcagcgcgtcacgggctgggacgcgaagcgcgcggcgtggctgcggacccggggcctggacggcgcggcggtcgcggggcgggtggtgatggtgaccgggtcgcagccggagccatgcaaggggccggggggcgaccacgcgctgctgcggttcctcaagaataagctggactactgccgcctccacgggatcgagctcctgtacaacaccgcgctgctggagccgtccatggtggcgtactgggccaagatccccagcgtgcgcgccgcgatgctggcgcacccggacgccgagtgggtgtggtgggtggacgccgacgccgtgttcacggacatggacttctccctcccgctggagcggtaccgcgagagcagcctggtggtgtacgggtgggagcgggaggtgtacgaggagcggtcgtgggtggggctcaacgccggcgtcttcctcatccgtaactgccagtggtcgctggacctcatggacgcgtgggcgcgcatgggcccggcctcgccggagtacgcgcggtgggggaagacgctgcgcgaggagctggaggggaaacccaacgacgagtcggacgaccagtcggcgctcgtgtacctcctgtccaggcacctggagcgggagcggtgggcgaacgccacgttcctcgagtccgggtactacttccaggggtactgggcggagatcgtggacaggctcgacggcgtggccacgcgctacgaggccgtggagcgcggccgcgcagggggccgggccgggctccgccgccgccacgcggagcgggagcacctcctgtacgcggcggcgcgacgtgaggcggtgcggcagcagcgagggaccggcggaggcgtgcccgggccggacggcggcggccagaaggggtggcgccgccccttcgtcacgcacttcacggggtgccagccctgcggcggcgcgcccaaccggatgtacacgcggaggcggtgcgccgaggggatccgccgcgccctggcgttcgcggacgaccaggtgctccgctcctacggcttccgacacgccgcgccgctcagcgacagcgtcacgccgctgccgttcgactaccccgccgcacactgatgggcggtcgcgttggtgggcggtgggttcggcaactggctatggctattggctaggttaattaaatgagacaaaaccatgaatgcgatgcaatgtgtcaagtcacagtgtgtgtactatacatttttgatttgggtgtcatccatattcgtccaaagactgaaacagtgaaaccactgtgtgggcttcgtgttcgtcggtacttttaggacatgtacagcgtgtcttgtcttttccctacactctctcgctgttgttgtcgtcatgtatcaacccaacttgtcatctctatcttcgcctccctcaccaaggttatttctcaccatatagaggacatccacctttgctcctcggcgatcctcttgacccgctgttacaactctctgctggcatgcacctctgcagacaccagagcaaaacatccgagaaagaggagccactgccgccggtgatgtatgcagccatggagaagagaaagaggaggtgatctagaactcgagtttcgtttgcatatagtatgtgcttgtgtggctcggctttttcagataacctttttttgagaatttgggtgtgacgagaagaggagaatctaagtattctggagattacgtgtggagaaagttaaaagagtttatagaattctactatcgcaacgattcaacc

SEQ ID NO: 5753 - DNA, 713 bp, Zea mays
cccacggcgaagatcgctgccgcaccgtggttcgccctgccccacttcaccgcgccggaattcaactggcaggcgatcctgtttatcgtcccggtagccctggccccggccatcgaacacatcggtggtgtgattgcagtgggcagcgtgaccggtcgcgactacctgaagaagcctggcctgcaccgcacgctattgggtgatggtatcgccaccaccgctgccggcctcttcggcggcccgcccaatacgacctacgcggaagtgacgggcgccgtgatgctgaccaagaactacaacccgaaaatcatgacctgggcggcggtgtttgccatcagcctggcgtttatcggcaagttcggcgcgctgctgcaaagcattccagtcccggtaatgggcgggattctatgcctgctgttcggctcgattgccgcggtggggatgaacaccctgatccgccacaagatcgacctcggcgaagcacgcaacctggtgattgtgtcggtaaccctggtgttcgggattggcggtgtgctggtaggtaccggcaccggcccggatgactttggcctgaagggcattgccctgtgtgcggtggtagcgattgcgttgaatctgctgttgccgggcaatgacggctggaagaacaagaagccggatgagccgttgctgtaaggctttagctttttggtgttgctgatggccttcatcgc

SEQ ID NO: 5754 - DNA, 557 bp, Zea mays
tcaacgcgcccatctatctgcagaacaagacccagatcggcaaggttgaagagatcttcggccccatcaacgaatcctatttctctgtgaagatgatggaggggatcattgcaacatcgtacaatgaaggcgacaagttctatatcgacccaatgaaattgctgccgctctcacgcttcctgccacaaccaaagggacaatctcaaggagcacctagaggtggtgggcgtggtggaggaaggggttttgggcgaggccgtggtggtggttctttccgcggtggaagaggaccaccaagggggggtggtcgaggtccaaggggtggaggccgtggcggttttagagggcgaggaaggttctaggtgcagtttgagtttgatgatgttttccccttgaagcatcatagctgcacaattggaaacttccatgttattgtaaccagatatgtttaaggtagcagagcactttatctgtggaacttggattctcaactgaaacaaacggtttgtacctgttccgttcccaatggccattatgtgcttccttgttctgaattc

SEQ ID NO: 5755 - DNA, 1228 bp, Zea mays
ttgggtacctcgaggccggccgggtggcatgccgacccggcggaaaaatatctcgccgttcccatggacatcgacctcttccccgacatcgaccttgacgccctcctcgcctccttctccggcgaccccgccgccgtctccggcctcatcatcccgtccccgcctccgccggcgccggcgacggcgcacgatgcggaggcggggtcgccggagtcggtgacctcccggacgaacccactcggggaggtggcgctctcggagatcgagaggctcctgatgcaggagggggaggcggagctgggcggggaggtcgatgggatcagcgtggaccagttcttcgacgcgctgtacgacggcgaggaggcgaaaggtgagcgggaggcgggggcaagcgcggatgtggactccggcagggacgaggcgctggaagtcgtgacgccagaggcggggacggtggaggtggatggcgatgatcccatcagcaagaagaagatgaggcaaatgaggaacagagattccgccatgaaatccagggagaggaagaagtcgtacataaaggacttggagacaaagagcaagcacttggaggcagagtgccgtcgcctcagctacgcacttcagtgctacgcagctgaaaacatggcactgcgccagagcttgctgaaggataggcctcttggtgctcccacagccacgcaggagtctgccgtactcacggaaaccctgccgctggtttccctgctttggctggtgagcatcgtctgcctgttcctgatgcccgttctgcccaaccgaagcccagctgctccaagcagcggcggaagagacctcgtgatggcagccggaaagacaagcagtgagaccccagagatactggaactcatcctccatggaaggcgttgcaagagcacgagggcgaagattaagctatgtattttaccatttcatgcaggagctgcttgctagtagttgctaggctttgagcctcttgcaagcttacctctatatgtagtgtacccgcaaatcttaccgtgctcgctatgcgcctgtcttgcagagaagcctgtcgatatccatggagtagtaccttttttttgtttaatagctcctgtgctacccagaatatgtttaaaatctggattttgtgttattttctatttcttcaccttatctgtagttgctcctgatataaagttccttcgctcgaaaaatcttaggaaggccccta

SEQ ID NO: 5756 - DNA, 2332 bp, Zea mays
caaaataaaatacttccattcaacaacgtagaaagagtgtcacaacgatcatgccatcgtggatcgttgcacgggagtatgaaatacgtgccatcgccggtgcttcgaaactgacggtcggatgcccggtacggtgtggtgctacagagaaaccagccgcgcacaagaacccctgcgacgggcagcaaagcattccttgccggagtgagctggcagaacccgcctctcctattggccaggccacggcaccacccactaaactgccactctgccaggaacgaggaagcttccttcctgtccttcctcgcgaagcaagacacagataagagagtccactataaagcaacacagctgcgatcatagcgacaaaatatctcgccgttcccatggacatcgacctcttccccgacatcgaccttgacgccctcctcgcctccttctccggcgaccccgccgccgtctccggcctcatcatcccgtccccgcctccgccggcgccggcgacggcgcacgatgcggaggcggggtcgccggagtcggtgacctcccggacgaacccgctcggggaggtggcgctctcggagatcgagaggctcctgatgcaggagggggaggcggaactgggcggggaggtcgatgggatcagcgtggaccagttcttcgacgcgctgtacgacggcgaggaggcgaaaggtgagcgggaggcgggggcaagcgcggatgtggactccggcagggacgatgtgctggaagtcgtgacgccagaggcggggacggtggaggtggatggcgatgatcccatcagcaagaagaagatgaggtacgttgttagcgcagttgcgctggacatacgaaggttctttcctcttcgcttgagaaattgatcgaggggagttgtgtcctcatgcttgctagtgaaatttaggagctactacctggcagttagggatgggacagaccctaggtttgggtgggtttttggagatgggaatacttaaaactccttggtatttgtgttgttgtgaactctaccgaatggaagaaatatctgcgagtgaataactgctatatacatgcacaaatgcttactttggtttcaaactgctacgtcgaaatggggccagcggacgggaggaatctgattcatgaattcaagatgctttttttctccttacattttttctttctgtctagttaggtattttttctcctgtataaaacctacttgccttgcgaatttatcaggctaatgaatgaggaacagaaggaatatgactcacgaattcaagatgcttttttttctccttttccttttacgcttttgctttctaagtctagttaggcaatttatctcctgtataagaccaacccaccttgtgaacttatcaggcaaatgaggaacagagattccgccatgaaatccagggagaggaagaagtcgtacataaaggacttggagacaaagagcaagcacttggaggcagagtgccgtcgcctcagctacgcacttcagtgctacgcagctgaaaacatggcactgcgccagagcttgctgaaggataggcctcttggtgctcccacagccacgcaggagtctgccgtactcacgggtaagacatgttatccgtcctctaatctttattcattccctaaattagatgaatcgatttgtctaccatcagtgagtcctctctggcttgaaccgtggatatgataggtcagtcataaattaccaagcaagtaaccaatcaaaagcacaagtgcaaccaattttttgaaaggctggtgaagtaattcgtgatgctaagatgaattttctttttatgtgcagaaaccctgccgctggtttccctgctttggctggtgagcatcgtctgcctgttcctgatgcccgttctgcccaaccgaagcccagctgctccaagcagcggcggaagagacctcgtgatggcagccggaaagacaagcagtgagaccccagagatactggaactcatcctccatggaaggcgttgcaagagcacgagggcgaagattaagctatgtattttaccatttcatgcaggagctgcttgctagtagttgctaggctttgagcctcttgcaagcttacctctatatgtagtgtacccgcaaatcttaccgtgctcgctatgcgcctgtcttgcagagaagcctgtcgatatccatggagtagtacctttttttttgtttaatagctcctgtgctacccagaatatgtttaaaatctggattttgtgttattttctatttcttcaccttatctgtagttgctcctgatataaagttccttcgcgcgaaaaatcttagg

SEQ ID NO: 5757 - DNA, 915 bp, Zea mays
gggaccctcgaggccggccgggccgggagcagagcaaagcatagtcacctgcctatctatctagcgagagagagagaggaaagctagctagctagcatggagtgcggcagcaagaaggcagcaggcggtgtgttggcgctgctgcttctccagctggtgttagctccgacgacggcgacggcccgcctcctgcaggcggatacctccaccgtggttggcctggacatcatcgcgagggagtttggccatccagtgagaggcatcctctgtggtgaaacctgtgtcttcctaccatgctatacggcagccatgggttgccaatgcattggccaaatctgcatgatgtgatatctggactagcgctatttgtaatttgtgttgggagaaacacaaggacggtacggtggtgttcaacttattgcatgtgtatggtgatctaataagtaaagtataataaaaagggatatgttggatgtgtacccatcgcctgctccttacatcatttttgacatatatatactcccttcgttccagtaatgtaagacgttctctctctagttatacgtacattgatgcagttgtatatagagaattaaatacatttttcgatcttcaaaccaaaaaaaaaaaaagcccacatgggccgggaagggaccatagagcctcggcccccggggccagcaccaaatagagggccagaccactaccggaatccgggcctttgccgagtaccaggctctttgccgagtgctttttatcgggcactcggcaaagaagactttgtcgagtgcctgcgctcgataaagagcttgtttaccgagtgttggacactcggtgaatactgttttgccgagcggcaaacactcggcaaagatggcgctcggcaaagggccgttagcggccgtttacaggggg

SEQ ID NO: 5758 - DNA, 533 bp, Zea mays
aattcgccccccgcgcgtcccctgcctatctatctagcgaaaaaaaaagaggaaagctagctagctagcatggagtgcggcagcaaaaaggcaccaggcggtgtgttggcgctgctgcttctccagctggtgttagctccgacgacggcgacggcccccctcctgcaggcggatacctcccccgtggttggcctggacatcatcgcgagggagtttggccatccagtgagaggcatcctctgtggtgaaacctgtgttttcctaccatgctatacggcagccatgggttgccaatgcattggccaaatttgcatgatgtgatatctggactagcgctatttgtaatttgtgttgggaaaaacccaaggacggtacggtggtgttcaacttattgcatgtgtatggtgatctaataagtaaagtataataaaaagggatatgttggatgtgtaccaaaaaaaaaaaaaaaaaaaaaaaaaaaaaaaaaaaaaaaaagtagaaaaacgccacgcgggaccgggccgcggtaccca

SEQ ID NO: 5759 - DNA, 834 bp, Zea mays
catttgtttctctctcaatctcgttaccactgagtatacttcaacacgttatcagcacgacgctccaaccaagagaagcaaccaacgcagtagaggagttcgtgaagacccagaaaggtgagatgccgaacatcaaccttgtggtttccatggtgacagcggctgtggttcgcgagttccgtcgtgggaaccgcttcggcatcctggctcgcgctcgtctccgggccgccatacggcgcagcctcctccgcagcggcgttgcagggcttcatcatcgtcgtgtgcgcgtgccgagggccacggagacggtttacgtacccgtaccgacggacttcctccagccggtgccgctgcgggtcatcccaccaccgatggcatatcctgctggtactgagtttccgccggggttttgcccggtgcacgggtggaacattccaccgccagagacgacgcctcctcctgccgcggcggtaaccactgaggtggtttccccacggagggctccgatgagcgataccgcgggcgcgacggcggctccaagccgcggctggatccgcaccgggcatgtgccgggacttcccaatggcttcgggcccgtggacgctggtgcatcgttgccggaggagggcgtggagatggcagcacatggcggcagaccgcgcggaggcgctgctgcaaggagcaaccgtggcacagttactgcagagaacggcgttggcactgctgctgcaaatggcggcggcgggcggatgctgtgaacagcaactggggtccggcaactggtgattctctggtgtggcggcggcatgtgtctagggttacccgccccgggcc

SEQ ID NO: 5760 - DNA, 719 bp, Zea mays
aggtgctgtcaggccggcgggccattgacaagaaccggccccagggtgagcacaaccttgtggagtgggctcgaccttacctcacacacaagcgcaagatattccggatcctggataccaggctggaaggccaatacaatctcgacggcgcacaagccattgccgccctttctcttgagtgcctgtcctacgaagctaagatgaggccgactatggatgccgtggtaactatcctagaggagcttcaagactctggtgaggccgacaagcgtcaaggacccaaggctggaaccaaacaggcgcctgctgctgctgccgcgagcgctagcaagagcagtcgcaagcttcgccggagaaccctgggagggacgaaggagacgactgttggtccaaatccaaaaccattattggcccgttctcgttagcgaggaaagggaaagcgttgcttggtcaggtggtttgggtaggtagactgtagcttgtgaatatgatctgtcctgtgtataatgagggtaatcggattcttttttggcaacgagtcttgtttttttttttaatcgtgagctgctcggtttctgcattgtctggatcctggatgtcgaaacccatggtatggcatcaagggaggagaggccatgttccgagtgtttaattaaccctaatcattatgtttttgctgccaaaaaaaaaaaaaaaaaaaaaaaaaaaaaactcgagaa

SEQ ID NO: 5761 - DNA, 1414 bp, Zea mays
tcaagcattaaaaacaaatacatcgtgcaaaaacattagcatctaggtgggagatgaggttactactctatggtttcctggtaatatttcagtattcctcaaagtattgaagttgcccctcgttctatagatcagcagggacctgctacaatacacgcacctagtttttcacttctcaggggatgtgtaggaactgtctgattcgaatcaaacatgaaaccaaagcctccctccctccccctctatgttcttggctggcagcaccctgcctcaacgatccatctgcccctttttaagccagaatcacccagtagcctgaaaacccaaaagtctaacccctaccagccactgctcgaaattgatgtgccttgttgtgccatcacctgaaatttcacaaatttccgtcgcctgatgtatagttgtgtttaatatagtccaaactagagaccagcattttcatataattaatccctgggacacaaatggtgctcctattcttagcactgacttgtagccccctttcccaaccccaatggcagggttgcaatgtaatttgcttcaaaaggaattaaccagtagctaaagagctccactccaatcactaccctgaaccaaaagaggttatgttcctccatttgtgaaattacgagctgtggttacttgcaaaccccaaatgaattactcaatggtagtggagcaggtaaatatactaaactcgcacataaacagatacatctgacaaactaccattctggagataactggagggtaatttgtttctaacctcgcagcaatctccctccgcttcctgccgctctcctcaagctgctttctctgcaggatctccccccacccgtctccctcccgactcgtcctcgtcgtcatcctcctgccccctcttagcgacctcagtgaccttcttcagccactccttcgtcatccgcatcttcttctcccccaccgtctcctcgtcctcctcctccctaccgcgctcgtccccatcctcatcaaatccgcccccaaacgcagccacgccatcgtcgtcgctgtcctcgctctcgatgtcctcgtcacggcctccacggcggcgcttgggctcggactcgaagaagggatcgtcgtcccctccgccgccgccacgtcgggagcccgggcggggcttggggcgcgaggcccgcttgcgggggcgtggcgccatagtggctgatggggagagcgatcgcttacgcttgggctaggacttaggtggagggccacgcggtgcttcgctgccgccgccgccgccgtgatgcgcgcgagacggcgagagtgtgggcctgtggggggaagcgaggaacgaagcgacgggcggcggaaagacgagggtttaagacagtactacagtagcggagtgaccgaaaacgcggccatcttt

SEQ ID NO: 5762 - DNA, 3101 bp, Zea mays
  misc_feature (2791)..(2791): n is a, c, g, or t
cgagaccggtagaccgcgacgcaaatccacgtcacgcaagggcttgctactagtggagaggagggatcaagaaaccaagaacgcaacaaaagtgaaagccacgtgtcagtttttttttccttaaggccttgttcgtttcagttagtttagcttatttcagatctggttccggatgagaaaaatgagccggtttaaaattcggtcgtctctctatgaacggtttgtttcgaccttaatcaaaaataaaagcgatccggtttagagtttcttcttccattattgaccgatacaaattccggtcttctacccttcgaatcgaatctgtctggaatgagtgaaagggttactggcctggatcccatccccgaacggcccctaaactaactctgatgctccgatcagtggacctcatgtagtcatgtatggtgttcaaatcctgcagcattacaaattgatcacacttttctagctgcccatatccgcactccaataattgctataataataacaatttacacacaaaagaggtcatcagcaaattacagcgacaccgacaacgaagcgctaaagcccaaacacttgtattcggccgaaactacaaggcccagcagcctacaccatctaggcctcgggcttcaggataccatttaccacggataggcccacgacgaccccgagcgcctcggcgccggcgaccaccgcggcctgcactagcccgtccccggcgagctccgcgccggccaccagctgcaggccctcgctggcgacctccttctccgcctccgtcaccgcccccttcacggcctccccgcccaccgccgcggcctcctccacctcccgcaccgcctcggccgccgcctccttcacggcttccccgcccaccgccgcggcctccgccgccgcctcctccaccgcctcctccacctccctcaccgcctcggccgccgcctcctccgcgcgctccagcttcttgcggatgccgaagagaccgatgcccgcggcgctcgctgggggagctgtcgctgccgatgctgctggaaccgccgtggacagcaggagcagggccgccgagcgccggtcgagccgggccgcggcggcggcggagaccacgctgacgcggcggcgactgggcggggcaacgtggaggcggatgctgctgccggcgatggagacggccatggtggatggcagatacctttgctagctctgctctgctctgttgtgctaggacgtgggagacgactgggcagctggcgagtggcgcggaggttgcctcgccctgctccaggatgtggtggtggtggtggttcttggcgccaacgagatccggacatgtcacacgcagacgaagcagcacatgtggctctcccttcgctgcctctttctgccctgaccaataatctctctaactccgcctacgtatggctgccgttaatcaaatctgttagctcgaatagacagaaaatcatttcatctttatactgaaaagaaatcaggccctacttcggtatacgatcaacgtagacaaggagcggcggcaagattcagaattgaataatgagggatttaaaattgaataataaggaattctactccactcagtctcctacattacacttgcttccaaataagccataaacttcatctatggtctccatgtactagttgatatattgcatgagctcctcattggcgtatatatataagagattaattatgagtgtagtagataaatataatacggttttagactaaattctaatctgtcttagaaccaaaacatctattcgattacaatttctcatattatatgctatcttttaacattctctctcaatcttaaccttcactagttaaaattatacttaaaattgtctagtagtcttaacgataaagatttagtatatccattagccacctaatgctttgaagaaccacagaagatctcaatcatttttgtaaaaactctttctcgaacaaaataacaatcaatttgtacatgctttgttctaacatgaaacatgattagatgataaatacttagctctattttagaactagggatattatgctattttaaaagaatttgcatcaacataacttcttatgtagcattttgtatagctttataatcaacttcggtactagaccttgatctagtattttgcttacgtgcactctatgaaataagattaatgcttaaataaactacaaaaccacccatagatcttctattatctatatctcatgttcaaacttcatcaaagaaggtactcacaagagtataatttgacttcttaatttctagtcctaaactagtggtctatttgatatacctcaatattctcttgattgttgtctaataaatagcagtagaagcatgcataatctgatctaccttatttactgagaacgcaatattaggtcttgtcaaagttaagcatataacttgtagtatcatttaactctagaggatatcctacatgaagcgataatttctcacttattgagagtgacatggcaagaggcttgcagccaccaacccaactcatttaaaatatcacatgcatgcttttcatgagtaagtacaatcatatttgagttcttgttacttatacaccaagaaaataaagatctcctaagtctttgagagaaaattcttttcgtgagtcctgtaacaaaatctcagacagaggacggcctcgagccagcctcaaccaaagatctcgggaactatgaagacgtacgcattaaatgcaacaatacatatatctgctccatgtgacacaangatcaacagaggacgatgggaccgcggtcccatctactttcatcgactacgatgatgcacactcacgaataccggacactgctcgtctatccggccactattcttgaataactccggatgggacatgcaaacgtctaggcacacccttacccacgggagagaacatcgcttcacctgaagacggcttcagccttgggagaaaatttcgcctcacccgagctcagcctcggtcaactaccttggcagtagccaccagtataaaccttgtgtctcagccccctttgctggaagtaggaccaactattgcccg

SEQ ID NO: 5763 - DNA, 1172 bp, Zea mays
  misc_feature (2)..(3): n is a, c, g, or t
  misc_feature (5)..(5): n is a, c, g, or t
cnngnagagccgccacccggagtcccgcggcgacttcaccatcctcctctcccacatcgtcctcggctgcaagttcgtcgccgccgcggtcaacaaggccggcctcgccaagctcatcggcctcgccggagagaccaacgtccagggcgaggagcaaaagaagctggatgtcctgtccaacgaggtcttcgtgaaggcgctcgtcagcagcggccgcacctgtgtcctcgtgtctgaagagaacgaggaggccatcttcgtcgacccggccctccgcgggaagtactgcgtctgcttcgacccgctggatggctcctccaacatcgactgtggtgtctcaatcggaacgatctttgggatttacatggtcaaagacaaggacaacgtgaccttggaggatgtgctgcagcctggaacaaacatgcttgctgctggctactgcatgtacgggagttcctgcacgcttgtgctgagcactgggaacggagtcaatggcttcactctcgatccttcccttggagagttcattttgactcatccaaatatcaagataccaaagaaagggaagatctattcagtgaacgaagggaacgcaaaaaactgggatgggcctacagctaaattcgtggagaaatgcaagtatcctgaggatggttcaccgcctagatccttgagatatatcggaagtatggttgctgatgtccatcgcaccttactatacgggggcatatttttgtacccagcagaccagaagagtccaaacgggaaactacgcgttctgtatgaagtcttcccgatgtcattcctgatggaacaagctggaggccaggctttcacaggcaaacaacgggcccttgaacttgctcccgctaaacttcacgacagatccccagtgttcctcgggagctacgatgacgttgaggagatcaaagcactgtacgcttcaatgtcaaacagcggttgacctttctgcctgaggaaacgagcgagatcaaaagcaccgtacgcttcagagtcaactgcttgatctttatagattgtaataaaataataaaagagtttgtaaaaaaaacaacaacactgcttgatctttctgcatgaggataaaaagcgcatagtttccccggttggatgaaaaaaaaaaaaaaaaattatgttgttgccttctacac

SEQ ID NO: 5764 - DNA, 1716 bp, Zea mays
  misc_feature (22)..(22): n is a, c, g, or t
gggtaccttcgagccggccggngaaaggccgcccactaccctctccggctctccgctaacaaaatctagaaccctctgaaccctccacattcctccagatcgaataataacctagctctgcacaccgcccagccaccagtggcagcaggagcaggggtcggaacaagatggtggtgacggcggccggcagcgcggaggaggctgtgcggcggtgggtggacgccgccggaggacgcctcgtcctcgacggcgggctggccacggagctcgaggccaacggcgccgacctcaacgacccgctctggagcgctaagtgcctcctctcctccccgcacctcatccgcaaggtccacatggactatctggaagctggcgcaaacattataatcacagcatcgtatcaggccactattcaagggtttgaatcaaagggtttttcaaaagaacagagtgaaaacttactaacaaagagtgtcgagattgcactggaagctcgtgagatgttcttgaaggaacatctggagaagtccactcctatacagcacccggttctggtcgcagcgtctttagggagttatggagcttatcttgccgatggctccgagtacagtggggattatggtgaagctggtacgaaagagttcctgaaagatttccatcggcggaggctccaggttcttgcggaagcaggccccgatttgattgctttcgaaacgattcccaacaaactggaagctgaggcgtatgtcgaacttctcgaggagtgcaacatcaatatccctgcatggttttccttcaactcaaaagatggagtgcatattgtgagcggtgactcgttaatcgaatgcactactattgctgacaagtgtgcaaaggttggtgcggtcgggataaactgcacacctccaagatttatccatggactgatactctccattcgaaaggtcacggacaagcccattctgatatatcccaacagtggcgaaagatacgatggtgaaaaaaaggagtgggtggaatccactggtgtgtcagatggtgattttgtttcttatgtgaacgagtggtgcaaagacggggctgtgcttatcggtggctgctgcaggacaactccaaacactatcagggccatacacagaactctgaacaaaagccccaacaagcagcagttacctgctgtagaataagagctgtgctctactctgatgcgcccgccttcctcctagcagtacctcgaggctataactccatgattccgtaaccgtacgtgttcgttctcttgcaaacgagatgtttgtaaataacgctgtatttctgggttctgagatatgcaacttggatggaggtacaaccggtgaaggggggtgaggaagcagcaacaatggtaagagttctactactgagtgggggaaaaacaacttgcggctgggttagtgaagcttagtagctaccactattcaagagttaaagggagttcgtatgacagttcctctggagatgttatcttcaaagtcttatatcactgctacttgtgagctgtgttaaaacctatatatataagttttgtttgacgtgactgcattaaagatagtacaccaagcttctccaaatctcctagctatgtatgttcttgtccattcctccgcttccacaattctaagcaataaattaagggctagcttctccagttctcctaaaaaaaaaaaaaaaaaaaaa

SEQ ID NO: 5765 - DNA, 1636 bp, Zea mays
tcggccaaaaaaaaaaaaaaaaaaaaaaaaaaaaaaaaaaaaaccccaccctggtctggtctcctctccaagcgggcagcgccgctttataactcgtcctcgggagccgggaccccaacgccgcctactccgcgctcctccaaaccgaatgaaccctatcctagcacgagtgcacgacggtggcagcaggagatggtggggacggcggaaggcggcgcggagagggcggtgcggcggtgggtggacgccgccggcgggcgcctggtcctggacggcgggctggccacggagctcgaggccaacggcgccgacctcaacgacccgctctggagcgccaagtgcctcctctcctccccgcacctcatccgcaaggtccatatggactacctagaagccggggcgaacattataatcacagcatcgtatcaggccactatccaagggtttgaatcaaagggcttttcaaaagaacaaagtgaaaacttgttaacaaagagtgttcagattgcagtggaagcccgtgagatgttcttgaaggaacatttggagaaatccactcctatacagcatcctattctggttgcagcagctctagggagttatggggcttatcttgctgatggctctgagtacagtggggattatggtgaagctggtacgaaagagttcctgaaggactttcatcggcggaggcttcaggttcttgctgaagcaggcccggatttgattgcttttgaaacgatccccaacaaattggaagctcaggcatatgttgaactcccttgaggaatgtaacatcaatatcccttcatggctttccttcaactcaaaagatggagtgcatgttgtgagtggtgattcgttaattgaatgcgctactattgctgacaagtgtgcaaaggttggtgcagtcgggataaattgcacacctccaagatttattcatggactgatactctccattcgaaaggtcacagacaagcctattctgatatatcccaacagtggtgaaagatatgatggtgaaaaaaaggagtgggtggaatccactggtgtgtcagatggtgattttgtttcttatgtaaatgaatggtgcaaagatggggctgcgcttatcgggggctgctgcaggacaactccaaacactatcagggccatacaaagaactcttaaccaaggctgccacaagcatcagttacctgtagcatagatctgtgctccactcctgacgccctcctcccagcagtaccttgagctgtatccccgagattccttaaccagcgcgaaccaatatactgttgcgtgttctcctgcaaatgagatgttctgcacctatgtttgtaatgttgtatttctgggttcttaagctatccaacttggagatacaaccggtgaggaagcagcaacaataggtagttctacttctgagtgaggaaaaacaacttgcggctgagttaatgaagcttagtagctaccaccgttgtatgacagttgctctgagatgttatcttcattaagtgcttatattaccgctacttccctgtgaaatttgttaaaccattatatgtaagttttgtttgacactataaggatctcctgaaactaaaaaaaaaaaaaaaccaaaaaaaaaaaaaaa

SEQ ID NO: 5766 - DNA, 901 bp, Zea mays
tacgcggggaaaaaaaggagtgggtgtttcatgtgctgtgcaggaatccactggtgtgtcagatggtgattttgtttcgtacgtaaatgaatggtgcaaagatggggctgcgcttagcgggggctgctgcaggacaactccaaacactatcagggccatacacagaactcttaaccaaggctgccacaagcatcagttacctgtagcatagatctgtgctccactcctgatgctctcctcccagcagtaccttgagctgtgtatccccgagattccttaaccagcgcgaaccaatatactgttgcgtgttctcctgcaaatgagatgttctgcacctatgtttgtaatgttgtatttctgggtttttaagctatccaacttggagatacaaccggtgaggaagcagcaacaataggtagttctacttctgagtgaggaaaaacaacttgcggctgagttaatgaagcttagtagctaccaccgttgtatgacagttgctcagagatgttatcttcattaagtgcttatattaccgctagttccctgtgaaatttgttaaaccattatatgtaagttttgtttgacaagactgcatctcctgaaactaagatcttagtttcctgctatttccctgtgaactgtgttaaattgtatgcaagttttctttaacgcatctcctgaaacgaaggtcttaatattttcctgctacccgccgtgtattgtattaaataatactccctgtgttttaaaatatagttctttctatcctattttttttcatccacattcatttaaatgataatatagatatagttgtaaattgcattcatatggtacttaaatggatggtgtaaattatgaccccaaaaccaaatttattttttttaagaaggccaattta

SEQ ID NO: 5767 - DNA, 1652 bp, Zea mays
ccacgcgtccgaaaaaaaaatagagtagactcgccagccaggcagccaccctcaccctggtctggtctcctcgccgccaacgccgcctactccgcgctcctccaaaccaaactgaaccctatcctagcacgagtgcacgacggtggcagcaggagatggtggggacggcggaaggcggcgcggagagggcggtgcggcggtgggtggacgccgccggcgggcgcctggtcctggacggcgggctggccacggagctcgaggccaacggcgccgacctcaacgacccgctctggagcgccaagtgcctcctctcctccccgcacctcatccgcaaggtccatatggactacctagaagccggggcgaacattataatcacagcatcgtatcaggctactatccaagggtttgaatcaaagggcttttcaaaagaacaaagtgaaaacttgttaacaaagagtgttcagattgcactggaagcccgtgagatgttcttgaaggaacatttggagaaatccactcctatacagcatcctattctggttgcagcagctctagggagttatggggcttatcttgctgatggctctgagtacagtggggattatggtgaagctggtacgaaagagttcctgaaggactttcatcggcggaggcttcaggttcttgctgaagcaggcccggatttgattgcttttgaaacgatccccaacaaattggaagctcaggcatatgttgaactccttgaggaatgtaacattaatatcccttcatggctttccttcaactcaaaagatggagtgcatgttgtgagtggtgattcgttaattgaatgcgctactattgctgacaagtgtgcaaaggttggtgcagtcgggataaattgcacacctccaagatttattcatggactgatactctccattcgaaaggtcacagacaagcctattctgatatatcccaacagtggtgaaagatatgatggtgaaaaaaaggagtgggtggaatccactggtgtgtcagatggtgattttgtttcgtacgtaaatgaatggtgcaaagatggggctgcgcttatcgggggctgctgcaggacaactccaaacactatcagggccatacacagaactcttaaccaaggctgccacaagcatcagttacctgtaggctgtagcatagatctgtgctccactcctgatgctctcctcccagcagtaccttgagctgtatccccgagattccttaaccagcgcgaaccaatatactgttgcgtgttctcctgcaaatgagatgttctgcacctatgtttgtaatgttgtatttctgggtttttaagctatccaacttggagatacaaccggtgaggaagcagcaacaataggtagttctacttctgagtgaggaaaaacaacttgcggctgagttaatgaagcttagtagctaccaccgttgtatgacagttgctcagagatgttatcttcattaagtgcttatattaccgctagttccctgtgaaatttgttaaaccattatatgtaagttttgtttgacaagactgcatctcctgaaactaagatcttagtttcctgctaatacccaaaaaaaaaaaaaaaagaaaacccggggccgcggcccgaaacccaaaaaaaaaa

SEQ ID NO: 5768 - DNA, 435 bp, Zea mays
  misc_feature (418)..(418): n is a, c, g, or t
attcagttccaatccacgctcggaccgtgcgcagtctgctgcaactgcaagatccatggccgcttccaactccagcgcgcttctccccgtgttggccctcgccggcgtggtcttcttccttgtcgcccccgccgtcgtcgccgaggcaaccgcgccgcagggcctggagttccacgtcggcggcccgcgcgggtggcgcgtccctgacgccaacaccagctacggctggtgggccatgaacaaccgattccgcgtcggcgaccacctctacttcaagtacgccaacgactcggtgctcctggtggaccgcaccgccttcgacgcctgcaacaccacggagccgctcgcgaccttcgccgacggcgccaccaagttcgttctcgaccgcccgggcttcttctgcttcatcagcggcaanccgggacactgcgagga

SEQ ID NO: 5769 - DNA, 2003 bp, Zea mays
gaattcggctcgagctcgccgctgccgcatcctcaccctcgtccgctcctccgctgccccaaaccctagcctgaggaggggtcctcctccgctaccgagacccacgatgtcgaccatcgctgcctcccgccgctcgtcctcctcgtcctcttccgcgaccgccaagcgccccgcgattgcggacggccccgggggacccaaggcgaccgccgcacaggccaagaagcgcgtggcgctcggcaacatcaccaacgttgccgcgcggggagggagggcttccgttggcggcagccttgggaacgtcatggcgcccaccagcagcgcgaagttgaatccaacggtacccttgaagaagccgtctttggcaacaagtgctcggagtgtgagttcttccatccggggttctgctgacaaaccggcttccatcaagccagctccaccagtagcacgccatggcagcgcaacacaaaggcataacaatgttcctcctcctaaagtgcctaccattgccgatgtgccaagtcgtgctcctgccttggtgtcctgcaccggcttggtgtctcctggacgctcaggagattctgtttcatccgatgagacgatgtcgacttgcgactccatgaaaagcccagactttgagtacgtagacaatcaggacacctcgatgctggcttcgttgcagcgacggacaagtgaacatctgcgaatatcagaggatagagatgttgaagaaaataagcggaagaaaaatgccgtggccccaatggaaattgaccgcatctgtgatgttgacagtgaatatgaggatccacagctgtgcgctactctggcttctgacatttacatgcacttgcgagaggctgagacgaagaaaagaccgtcaactgatttcatggaaacgattcaaaaagatgtcaacccaagcatgagagcaattttgatagactggctcgtggaagttgctgaagaatatcgtcttgttcctgatactttgtacctgacagtcaactacattgaccgttatctttctggcaacgaaatcagccgccaacggctgcaattacttggtgttgcatgcatgcttatagctgcaaaatacgaggagatatgtgcaccacaagtagaagaattctgctacataacagacaatacatatttcagagatgaggttctagatatggaagcttctgtactgaattacttgaagtttgaaatgacagcacctacagcaaagtgctttttgaggagatttgctcgtgctgcacaagcgtgtgatgaggatcctgctttgcatctggagttccttgccaattacatcgctgagctatcactactggagtacagtctactctcttaccctccatcactaatagctgcatcggctattttcttggcgagatttatactacagccaacaaagtatccttggaattccacactcgctcattacacacagtacaaaccgtccaaactgagcgaatgtgtaaaggcattgcatcgcctttgcagcgttggttctggtagcaaccttccagcaatcagagaaaagtacagtcaacataagtacaaatttgttgcaaagaagcagtgtccaccgcagatccctactgaattctttcgggacacgacatgctagactagaaacccagaagtgattccagttgcttactggattcttcttgatgtgtcttgaatgcccagtgtagcacagcacaactatgcaagtgctgataacccccaggttgtttcaggtgattacaggggtgtaatcaatgtttgtggtcatgttaggtcattggtgtggtttttcttttcctgcttccagtctttctgtatgtagatcagtgttttcaggcgcttgtaaatccgagttctgtagtagagcacaatatcttgtaagttaactgaagaaatttggtgatcaaccaagttacctacaacttatgttgagctggtgatcaggtttttgcgctagttgaattgtgcttgcattgggcggccgc

SEQ ID NO: 5770 - DNA, 2075 bp, Zea mays
gccggccgggttgggacaacggcaaacgattcgaaagttgaggggtcctttcctaaaaatccactccctctcttctcttgtcgccctctttttcttgggcgctcccccgcgggccgcgagggagccgaagccttccgcttcctcaccccgctagtctcataccctagccagggggggatcgcacctcttccgacgatgtcgacccacgccgcctcccgccgctcctcctcctcgtccgcggtcgccaagcgccccgcgatagcggagggagctaccaaggcggcgggaccgggccccaccgccgcgcaggcgaagaagcgcaccgcgctcgtcaacatcaccaacgtcgccgctccgggggcgagggtcgccgccgttgggaaggtcgcgccaccggtcaccggcgcgaagttgaatccagctacctcaggtgcacccttaaagaagccatctttggcaaatgctcgcaccatccggggttctgctgcgaagtcggcttccatcaagccagctccaccagtatcacgccatgacagcagctcagagcagaagcataatgttcctgtgcctaccactgtccatgtgccaagtcgtgctcctgccttggtaccctacagcagtttcgtgtctcctggacgttcaggagattcagtttctactgatgagacgatgtcgacttgtgactccatgaaaagcccggacttcgagtacatagacaatgggggttgctcgatgctggcttcgttgcagcgacgggcggatgaacatctgcgtacatcagaggacagagacgttgaagaaaataagtggaagaaaaatggccctgccccaatggaaatcgacagcatctgtgaagttgacagtaacttcgaggatccacagttgtgcgccgctctggcttctgacatctacatgcatctgcgagaagctgagatgaagaaaagaccatcgactgatttcatggagacgattcaaaaggatgtcaaccctagcatgagggcaattttgatagactggctcgtggaagttgctgaagaatatcgtcttgctcctgataccttgtacctgacagtcaactacatcgaccgttatctttctggcaacgagatcaatcgccaaaggctgcaattacttggtgttgcttgcatgcttatagcggcaaaatacgaggagatatgtgcaccccaggttgaagaattctgctacataacagacaatacatacttcagagacgaggttctagaaatggaagcttctgtgctgaactacttgaagtttgaaatgacagcgcctacggcaaagtgtttcttgaggagatttgctcgttctgcacaggcgtgtgatgaggatcctgctctgcatctggagttcctggccaattacatcgctgagctatccctgctggagtacagtcttctgtcttaccctccatcactaatcgctgcctcagctattttcttggcgagatttgtactccagccaacgaagtatccttggaactccacgcttgctcactacacgcagtacaagccgtccgaattgagcgagtgtgtaaagacactgcaccgcctttccagtgttggtcctgggagcaacctcccagcaatcagagaaaagtacagccagcacaaatacaaatttgtcgcgaagaagcagtgcccgccacaaatccctgccgaattcttcagggatgcggcatgctagacaatagaaagaagcccagcggttgcttacttgattgattcttctccctgatgtggccagttcctgtttgtggtcatgtatgttacaaatccagagagttcaatagcagcactccacggcatgcatatgtatctggaaccatgtttagctactacgctgatggaatctgcaagccaagtgcggctgtgccttgagatagatatatgtaacgaacagctagttcgaccttggtacagaaaagcattcttccagcgccctgtacgtatatgcagctgggtctgatctgttgtatgcctgaactgcacaacaacagatgaagaaccaaatcatgatgactaaccaatttaatttaatttattagctgtttctga

SEQ ID NO: 5771 - DNA, 521 bp, Zea mays
agctgagtctctcacctgctggcggaggcggcccccaaaagccaaattccccagcccacaccacctccacactccagttttttccggcgcaaagggttagggtttgctgtcggcgatgtcggatcggcagccgtcggaggaaccggaggagcaggtggacctggagggggacgacgacggcatggacgacgacgacgccgggtaccgtcgccgcggaagccgggacgactcggaggagcccgaggaggatgacgacaatgacgagcgccacggcgaggccgacgacgacgccgggatggagccggagccggccggaagtaaaggcggggatgacacgggcaaggggcccgacgtcgccggtggcgggcccgaggacgaggaggagaggagcaagtgggatgacatgctcgccctgccgccccatggctctgaggtcttcattggtggcctgccccgcgacatcacggaggaggacctccgtgagctgtgcgagccgttgggagaaatatatgaggtgaggt

SEQ ID NO: 5772 - DNA, 1993 bp, Zea mays
cggctcgagctcacctgctggcggaggcggcccccaaaagccaaattccccaacccacaccacctccacactccagtaagcaccccgcctcccccctcgatctccctcctccaattccttctgctgctgcgactgaatcgaattgctccactgctactaatctctatactactactgcttgctcctgtttcaatcgatcaatcatgccgcgcgtaggttttttccggcgcaaagggttagggtttgctgtcggcgatgtcggatcggcagccgtcggaggagccggaggagcaggtggacctggagggggacgacgacggcatggacgacgacgacgccgggtaccgtcgccgcggaagccgggacgactcggaggagcccgaggaggatgacgacaatgacgagcgccacggcgacgccgacgacgacgccgggatggagccggagccggccggaagtaaaggcggggatgacacgggcaaggggcccgacgtcgccggtggcgggcccgaggacgaggaggagaggagcaagtgggatgacatgctcgccctgccgccccatggctctgaggtcttcattggtggcctgccccgcgacatcacggaggaggacctccgtgagctgtgcgagccgttgggagaaatatatgaggtgaggttgaccaaggataaggacacaaaggagaacaaggggttcgcctttgtcaccttcatggacaaggaggctgcgcagcgcgccatcgaggatgtgcaagacagggagttcaaggggaggactttgcggtgctctctgtcgcaggcaaagcacaggctgtttgttgggaatgtgcccaaggggctgagcgaggaggagcttaccaacactatcaaggggaagggtccaggtgttatcaacattgagatgtttaaggatcagcatgacccaaaccgtaaccgtggcttcctctttgttgagtattacaaccatgcctgcgcagactatgccaggcagaaactttcatctccaaacttcaaggttgatgggagccagttgactgttagttgggctgaacctaagggttcaacagatgcttcatctgcagctgctcaggtgaagactatatatgtgaagaacctacctgaaaatgtttctaaagagaagataaaggacctgtttgacaaacatggagaggtcacaaaaatcgttctgcctcctgccaaggctggtcataagagagactttggctttgttcactttgcagaaagatcaagtgcattgaaggcagttaaaggaagtgaaaaatatgaaatcgatggtcaagtactggaagtgtccatggccaaaccattggcagataagaaacctgatcattcacacaggcctggaggaggccctaattatccccttcctccctatggtggtggtggctacatgggagatccatatggtgcttatggtggcggcggtcctgcatacaaccagccaatgatatatggcagaggaccagcaccggcaggaatgaggatggtgccgatggtgcttcctgatggccgccttggctatgtcctgcaacaacctggtggaatgccgcctccgcccccaccgcggaggggtagtgaccgaagagacagtggcagaggtggcgaagggcacagccggcgatatcgcccttactagcttttcccttatgggctctactcccatcatgtggtatgaagcgtttaacttatgagacgagataggagcctgtgttcttgtcccagtataagatctgcgatggcacgatgcttgtaccatctgtttacttatttttatcatgcagtgcatgtgacttgaaactgtgatggacttgtattgctttctgccttatggcacctgtagtagtgaactgatgaaggaagttcatgcggactctgaagctttgttggcttagaatggtaattttgctgtattctatttcacaggagataaaaaaaaaaacagacattagcgcctggggcgccccgcgtcc

SEQ ID NO: 5773 - DNA, 1876 bp, Zea mays
attgggacctcgaccccggccggcgctgagtctctcacctgctggcggaggcggcccccaaaagccaaattccccagcccacaccacctccacactccaggttagggtttgctgtcggcgatgtcggatcggcagccgtcggaggaaccggaggagcaggtggacctggagggggacgacgacggcatggacgacgacgacgccgggtaccgtcgccgcggaagccgggacgactcggaggagcccgaggaggatgacgacaatgacgagcgccacggcgaggccgacgacgacgccgggatggagccggagccggccggaagtaaaggcggggatgacacgggcaaggggcccgacgtcgccggtggcgggcccgaggacgaggaggagaggagcaagtgggatgacatgctcgccctgccgccccatggctctgaggtcttcattggtggcctgccccgcgacatcacggaggaggacctccgtgagctgtgcgagccgttgggagaaatatatgaggtgaggttgaccaaggataaggacacaaaggagaacaaggggttcgcctttgtcaccttcatggacaaggaggctgcgcagcgcgccatcgaggatgtgcaagacagggagttcaaggggaggactttgcggtgctctctgtcgcaggcaaagcacaggctgtttgttgggaatgtgcccaaggggctgagcgaggaggagcttaccaacactatcaaggggaagggtccaggtgttatcaacattgagatgtttaaggatcagcatgacccaaaccgtaaccgtggcttcctctttgttgagtattacaaccatgcctgcgcagactatgccaggcagaaactttcatctccaaacttcaaggttgatgggagccagttgactgttagttgggctgaacctaagggttcaacagatgcttcatctgcagctgctcaggtgaagactatatatgtgaagaacctacctgaaaatgtttctaaagagaagataaaggacctgtttgacaaacatggagaggtcacaaaaatcgttctgcctcctgccaaggctggtcataagagagactttggctttgttcactttgcagaaagatcaagtgcattgaaggcagttaaaggaagtgaaaaatatgaaatcgatggtcaagtactggaagtgtccatggccaaaccattggcagataagaaacctgatcattcacacaggcctggaggaggccctaattatccccttcctccctatggtggtggtggctacatgggagatccatatggtgcttatggtggcggcggtcctgcatacaaccagccaatgatatatggcagaggaccagcaccggcaggaatgaggatggtgccgatggtgcttcctgatggccgccttggctatgttctgcaacaacctggtggaatgccgcctccgcccccaccgcggaggggtagtgaccgaagagacagtggcagaggtggcgaagggcacagccggcgatatcgcccttactagcttttcccttatgggctctactcccatcatgtggtatgaagcgtttaacttatgagacaacgagataggagcctgtgttcttgtcccagtataagatctgcgatggcacgatgcttgtaccatctgtttcttcggtgacttatttttatcatgcagtgcatgtgacttgaaactgtgatggacttgtattgctttctgccttatggcacctgtagtagtgaactgatgaaggaagttcatgcggactctgaagctttgttggcttagaatggtaattttgctgtattctatttcacaggaaaaaaaaaaaaaaaaccttagcaattgccgttcactcgagactagctcgtgc

SEQ ID NO: 5774 - DNA, 1786 bp, Zea mays
aggcgccatgtgtcgtcggactagcagggtcctctccctcgcgctgtgcagtgtcaacaagccatggtcgacaccgtcgccggcgccaccgactaccgcggtcagccagcctcgcgggccgccaccggcggctggaaaccgtcggttttcgtcatggcgatggagatcgcggagcggttcgcgtacaagggcgtggccgcgaacctcatcacgtacctgacggggccgctggggcagccgatggcgcgcgccgccgcgtccatcgacgcctggaagggcgtctcccagatgctgcctctgccgctcgcgtgcgtcgccgacgcctggctcggccggtaccgggccatcgtcctcgcctccctcatcttcgccgtgagcatgggcgcgctgtcgctgtcgtcggcgctcccggcgctgcgcggcggccacgtggccatcttctacgtggcgctgtacctggtggccctcggcgagggcgcgcacaagccgtgcgcgcaggcgttcgcggcggaccagttcgacgagaaggaccccagggagagcgtggcgcggagctccttcttcaactggtggtacttcggcatgtgcgccggcaccgccgtcaccaccatggtctccagctacgtgcaggacaacgtcggctggggcctcggcttcggcatcccctgcatcgtcatcgtcgcctcgctcgtcctgttcctgctcgggaccaggtcgtaccgcttctacacgaccgcggcggccagccccttctctcgcgtcgggaaggcgttgctggcgttggtccagagctgggcgccgaagcatcgcaccagaaaactaggcgacagcgacggtgacgccgtcgccgtcgaggaagtgaagagcgtgctccgcctgctgcccatatgggcgtcgtgcataatctacgcgatcatcttctcccagacatcgacgttcttcacgaagcaggccgcgacgctggaccgccggatcggcgcgaggttcaaggtgccggcggcggcgctgcagacgttcatcagcgtcagcatcgtcgtcttcatcccggtgtacgaccggctcttcgtgcccctggcgcggcgctacacggggaggccgacggggatcaccatgctgcagagggtcggcgccggcctggcgctcgccctcgtcgccgtggccctgtcggcgctcgtggagatgaagcggctccgggttgcggcggaagccggcctggtgaatacccccaaggcgcagctccccatggcgctctggtggatggtcccgcagtacgtcctcatcggcgtcgccgacgtgttcgccatgatcgggctgcaggagttcttctacgaccaggtccccaacgcggtgcggagccttgggctggccctgttcctgagcatcttcggaatcggccacctcctcagcagcttcctcatctccgtcattgacaagacgacagcaaagagcgggacgagctggttctctaacaacctcaaccgcgcccacctcgactacttctactggcttctcactgggctctgcgccgtggagctcgtcgcctttgtgatcttctcgcgagtgtatgtttacaagagaaaggttggcaatgatggcggcaatggtgatttcgtataatagtatatgcaatttgagccgtactgatcacttgaggggtgccggtagctgtagttgtttgtacagtacccgtcttggaaaaaaacgtacgaagtaaggtgtgaccgtgtgactacgggattctgtgttaacgcatattttttcatcggaaaaattttaaaaaaaaagc

SEQ ID NO: 5775 - DNA, 1925 bp, Zea mays
tgggtaccgggccccccctcgagttttttttttttttttttttgtactccaccttctaaccacataatttcaatgacacatctacaacgtaagaatgaaaaaaaagaaaatgttaacttaaaatcttaactgcgggtaattgcaacaactgcacacacacacacacacacctttttcttccttttcttttccctttttgatctgatacgcaaaggacggtgagacgtgagaggtcagggacgcatatgtacagaacaagatgaagagcagagccacttcttcttccccccacccagcttaggcaagaactccaaggctccacaccggctaaacactcggacagaaagcaaaaaaaccagagcaccaggcaaaacaaaactgagcttcgtctctacaggttccgcttccgcacgccgcacaggtcgcgcacctcggagctgccgaagtttgcgaagtcagaacgcagcaagtgattcgactggctgttcttgggacctggcacagcgtcgctaggtgagtcggtaatggggccgcgtgggttagcggacggcggggctggaggcgccgggcagcagtgccggacggtgatcctgtgcgtggcggcctcggtcgaggcgctgcccgtgacgttcaccgacaggacgacctctatgtctctggtggtctcgcaccaccagctctgctgcaccccgtcgacgaactcttcttgcgtgaagaagtcttcgtggtgcacggcgacttccgttgtttctcctggtccgatgaggccggatgatggctggacctcaagccaaagtggaaagccaaaggatgcccttatgactggctcagatttagttccatcttgctttctgatcgattggccttcacacaggatttcaaatgcagccttactagtttcgcagttattagttattcggaggatgacatcttcttggttttccaatataatgttgtttgtgctgacgatagtgtccggaacaaaatgcaactcccgaagcagagagtgtactcttttgttagattcgactatttttccatactcttgccttcttatcagctcgtctactctcgcaatatcaacgctaaatgtacatctcactggtttatgatcactatctgtgacatccatgcaagcttcgtacgctgtaattgcagcgacaacagggcactccaatgagcatccaggcattgatacagaacggctatcacgatatagtattctatcgcaccaagcaggtattctcttcttctcgcttgaatcgtaccctgagagacccatctggtgtctttggaatttgtaggtcggaggaaatttgattcgaccttcacgcattccttgaaacacatttcctgcctccatttccgctctaagttggtccctttctctaagccagtcaaagctcctctgagagaccatatcccttgcttcatcataggtgatgccatcaagtcggtagttgaaatcaccaagaaagacaaccatatcagcttctgccagctcaggcctatcttcatcggcttggttttcattagcactcactgctttatgcaattggacagatgtagcagaagctgtagatccatggggtttgttgaaagtcattgtccgataaatatggtcaaaatcagcattacggcggctaacattttcttggtgtgcagcaaaatgattgtttacaaaacatatcctgcgatcaaagactcttattcttaatcctacaccacccttgttgccaatagcacgtccaaagccacatggcactgcagcagcatcaacatcaccaacatgtggcttaaggtcattccttgcccatgcagcaataagtaatcctgccaactgccttgaaccaaccctgtggaaggatatcccctcatcaagtgttgggggggggggggggggggtgagtctctctctctctctc

SEQ ID NO: 5776 - DNA, 1014 bp, Zea mays
  misc_feature (43)..(43): n is a, c, g, or t
  misc_feature (71)..(72): n is a, c, g, or t
  misc_feature (79)..(79): n is a, c, g, or t
  misc_feature (93)..(93): n is a, c, g, or t
  misc_feature (96)..(96): n is a, c, g, or t
  misc_feature (100)..(101): n is a, c, g, or t
  misc_feature (119)..(119): n is a, c, g, or t
  misc_feature (135)..(135): n is a, c, g, or t
  misc_feature (158)..(158): n is a, c, g, or t
  misc_feature (175)..(175): n is a, c, g, or t
  misc_feature (1001)..(1002): n is a, c, g, or t
  misc_feature (1004)..(1004): n is a, c, g, or t
  misc_feature (1012)..(1013): n is a, c, g, or t
accattgggtcttggaattgtagtcggaggaaattgatcgacnttcacgcattcctgaaacacattctgcnntccattncgctttaagtggtnccntctnntaagccagtcaaagctcntctgagagaccatatnccttgcttcatcataggtgatgncatcaagtcggtagtgnaatcaccaagaaagacacccatatcagcttctgccagctcaggcctatcttcatcggcttggttttcattagcactcactgctttatgcaattggacagatgtagcagaagctgtagatccatggggtttgttgaaagtcattgtccgataaatatggtcaaaatcagcattacggcggctaacattttcttggtgtgcagcaaaatgattgtttacaaaacatatcctgcgatcaaagactcttattcttaatcctacaccacccttgttgccaatagcacgtccaaagccacatggcactgcagcagcatcaacatcaccaaacatgtggcttaaggtcattccttgcccatgcagcaataagtaatcctgccaactgccttgaaccaaccctgtggaaggatatcccctcatcaagtgttttgccaatactgtctatccaccattgcccattggtactgccctcaagtcctacactttctttggctgctgccatggcaagaactccagcacccatctcgacctcttgcaaaccaaccaccaccaacccaacatcaaaaaatgcaccacccaaccatgaccttagcgcttcaggacaagctttctcttgtgcaacattccaagtcccaaccagtattttaaggttctctagccttgtgtatgacagctccctgctagccaattcatagcgtagaatatcatcaagagggctaggggaacttagagaccatcctcgaatgccaccatgatgtgccaaagaaaagatgtaagaatcgccgactgccatgcttgggggggggggggggactagtgagctccctgcanncnggggggannc

SEQ ID NO: 5777 - DNA, 1549 bp, Zea mays
  misc_feature (1496)..(1496): n is a, c, g, or t
acacccgcaccagcctcttcagcgccctgcacccaagctccagctccgatccgtaacccaaacaaacgacaccttgggcttggtgcctaccgcgccgccggcccgcccacgagacccccgcggccatgtccatcccgcggctcctcctcctcgccgtcctcgccgccgccgctgcgtccgcgcccgcgcccgcgcacgccgccggcgccggcgcctgcgcggcggagaagttctcgggcaaccgcgcgttcgcggcgtgcgccgacctggcccgcctgggcgcgtcgctgcactggtcctacgacgccgcggcggcgtccctgtccgtggcgttcctggcggccccgccttccgcgggcggctgggtcgcctggggcctcaaccccagggcgcagagcatggacggcacgcaggcgctggtcgccgtccccagctccggcggcggcggcgcgtacgaggtgcagacctacagcatctccgggacctcgctcggcgccccgggcccgctctccgcctaccggacgtcgggcctcgccgccgaggtcggcggcgacggccgcgtccgcgtgttcgcgaccctcgtgctccccaacggcacgggcgccgaggtcaaccacgtctggcaggtcgggccctactccggcgggatccagatacacgacaccaagggcgacaacatgaacgccaaggggacgctcaaccttctaaccggcgccactgccgccgccagcggagggggcagcatcatcaggaagaaaaatactcatgggatcctgaatgcggtgagctgggggcttctgctgcccatgggagccatcttcgcgagatacctcaagacgttcaggtcggctgacccggcgtggttctacctgcacgtcgcttgccagctgctcgggtacggcgtcggggtgtccggctgggcgaccggcatccatctcggaaacctgtccaaggggatcacctactcgctccacaggaacatcgggatcacagtcttcgctctcggcactctgcagatcttcgcgctcttcctgaggccgaagaaggaccacaagtaccgggtgtactggaacgcctaccaccactcggtcggctacaccgtcatcgtgctgggcgtcgtcaacatcttcaagggcatggccatcctcgacgtggagcagaggtggaagacgggctacatcgccgccatctccgtcctcggcgccgtcgccgtggccctggaggccgtcacgtggggcgtcgttctgaggcggaggaaggaggaaagcaagagctacaacggcacctcaaacggcggccgcttgccgctgtctatgtagctcgtcgtcatgtatctccatcatcgggagaggcagcaaacagccgtgcggctggcgctggcgctcgcgcgcctctttcccatcatgttttcgttacacatacctgcatgctaatctagaccggtagtagttcacatagtacttcgttagttgtatacagtttacttcaaaatttanagagagagagagagggagatgattatgatgacaatgatgttcctgtacattta

SEQ ID NO: 5778 - DNA, 5262 bp, Zea mays
  misc_feature (3437)..(3437): n is a, c, g, or t
  misc_feature (3489)..(3489): n is a, c, g, or t
  misc_feature (3628)..(3628): n is a, c, g, or t
cgtgctcagatgagatctcaaaacccacactagtttttttcttcttcaaattgaggcggtggtggagctggaacccgatgcctaactcgagagaacgtacgtacgtgccacagaggcgcggccccggaaggaaattaattagcaccaggcggccagtttgttttggtaaacggatcagggtggacatttgcaaaagctcgtggaaattatggtccgtgttcaccatgcacggggacatgtaatcaatctaatggaacttgaccaaccgttgctgtgtggacagtgaacgacctcaccatgttagagacccactggaacgatttatgcactgagtcaaaacctagtttcgttgcgttgcatccgcatggcattgctcgtttgcctatatactttggacctgtaaacatatcgatcggtcacctttagtgccacaactagaagtgataagggatcacgattcaaatatttattcacaataaattaagaaccttaaataattttagtttgaaaattttatagtgttaaatttagaacccattactatccctaaccacagcataaccgttgcataaaaaatgttgttattagcaaaatgcaacaacacacgggtctaaatataaatcgagaaaactacatattgttcacgtcgccaagatctatggcatcttagatattgttcgcgtcgtcgctaggttagaccttatggcaaacatctcagagcctgtttggttagatgtttttgtctgtgatccaattacagtggtacctattccctttcttttctgtttggtctccgtaaggattattcacaccgtaaatggatacgcatccatgtcttttcgaatatttcctttctttcgttaccactcccaagcaaatgttaatacataacattagctaaacaaacatatatcgctttatgttgcaccgggaaccaataacagtggggatccattaacgttacgttaatcactctctgaaatgaaccagacagcacctcatcatcgtaactatgacgccgagatatgaagcgtagatcgaagtcgagaccacaactcaaacaagaaatttaaaatacacaagtgtataaatatagttaaacttttttttataaaaataaaaataaaaaaaacggcggcagcgacggggcaactcagcgttgacggttgacccgtccgcgaatcccgacgaatgatgacgaacgcggtgaccattacagcagcatccacatgccaaaatctaccgagtcgggtcctactcctacgagggagggtatgtactagactagggtagggttttcttggatctggattttaattggatgaaccttgaaccagcaggctatctaggagggtttaatttcttggatctgaacttgtggaatgcgcgtgtatgatgatgatgagctagctcacagagcctcacatgcacgcatgcagagagcagaatgaagtaacgtggtgtacaggaggagatgtgcagagatatatgagctgatgattcgattgggaaacatcaaacatgtggtggtcgtcgtcgtcagtggccggatctgcaattgcgacttcattcgctcggtctttagacttgccggcccggccgacggccgtcagtggacctggaggatcgccaaaccagttaagaacacacgcggacacgcccggccggcgctagctatttccagatagacagatcgtccggagctagccagccgtctcaagcgactgccgccgccgccgggcaacagcacagctccgatgaatctttcaaaccgtcgccgcggctggattagtcaataatccaagaacggcagagaaggccggccgggcagtgtaggtcgagaaggaagagccaaaacggtcacgattaactatactgggcccctgctgtcattatacaaggcagatattaaaagctcagatcgagcgaggtccccgtctgtcgtatgtatcgtacgtcgtcgtttaattatgcatgcatgcgttttagtacgagaacgttgtgtgcaagcgacgactcaatgaccgatattatacgtagtcgcggagccgctagatgatgctgtacacacagccatgcatgcatgtgatcatggcctcgccttcgcgtacgattttggtcatggccgtgcgtgccggcaaggcaaggcaatgccttattctatgcctgctcgtcttttgcattgacagggtgtagtgttgtagcctgtgagcacatacatctctgctgggagctaggtagcttcgaagggttgcttctgaataaaacatggaacgagctagtagctcacagaaccattaggttgctattgctaggtaacggcggctctctctctctgtatatagcattatatgtattatctaccacaccgatgaatcatcgtggactggtttgaaaagacaacgttctcgcattgcatttgcatggtagtgtgtgctggccttccctgacactgatcaaaggtaggtgaaaagttggccgacgaacgatgctttcccggtggaagctcgcctgtctgtctttctgtctgtctgtcttttttttctttttcagatggaaaggattccaatcttgttgggtggttagaggtttcacgttcccctggcgttcaaacttcaaactcccttccgtgctactcctactcgcagatatgctacatacacactagctggcatggcgtggttcccagctttcaggctggctagctccagcagccaacagtgcgtgcgttttggtaggggcggcagcagtagactctcttaatttgcacgctttcaactaaggcatatattatttcctctgctactattttctcccaaggaaaacaaaaacaaaaaacaacaggcgaacaagcagcacgtccacggtcagtggctgagcgtggttgaagggcagtccgagcgccgaacctgtcctcctccaaggcacgcacgcacgccaaggccatcaaccacgtccattttcttcagagtaggggggtctttggtcagcaaactgctgctgcacaatgcaaccgaaaaggttgacactgcttcagtggtggctccacctccactgtccactcctccaatttgcgaggcttcaaccgtcagcctgcctgcctctgccttgtttggtgtgaaagatttggcaggtttctcgctactgtacgtcgacatgaaatgggatccgtctccctttcagtttcagccgtatctcgcccatctgccaacctgcgggcggattttgttggttggttcgttggttgggtcgatctgtttgactcgtttggttaggttacctgtaattatggccaccccccctcaaccaacgagcacgccaggcgagtaggcgaccgtatacgcaatgccgccgtcacggtggcgtcggtcaggagaggagggtgccccgtcgcgatccctcgccggccggctggaccaccaaagcgccgcgcgtcnttctcggggtctcagtcgggcgcatcgcacgtctacgggatccgcatccgcnggcgccggcgccaccacgcgcgccagagcccggccccccggccgtcgcgtggctgtcgtccatgcatgtccctcctcctcccggccggccgggcgcctctcatgcttatccccggcgacgtacgtgcggacgacgggancgagtttctgctccatgtcgacgacaaacccgcgtcacgggagaacgacagaagagatcgatgtgaagagaagaggcacggattcgggtcacgtcgatcgggccggcgtgtgtggacagactgccgtgtcgtagcctagcgtctgaaccgggacgcccgagcggcgacgtcgaagcgcgcgagcgcgtacactgggcgggcggccgtacccaagccaggtggtccatcgcctttcggcactcggccgccgtcgctcccaaagttcacagctgtgaccagaccagcgggcggtggaaggctccgccggaccgtgagatcctggggcgagagagagagagaggacgcgacgcgccgacgccacagttgagtccatagacggtgcaccccaccgctgcatgccaagaccagccactccctgcggcgcaggtcacgctagtttgagactgcctccaggtcctctaaaatgatcctatactctaaatttagaagaaaaaaaattatatacaacactcccgtctatgcacgtagatataaaatacagatatagagaataaatatagattaagttgatccgcaccttcagctggcatccaccgcacgtgctcggattcgtttatctgctgctaaaaggatacttcgctgtcactgggacgaccgcgtcaatctccgcccccacgtgtccaccgccatctgcggcctcgtgccctcctcctctattaaccgagcccgcctccacacccgggccacacccgcaccagcctcttcagcgccctgcgcccaagctccagctccgatccgtaacccaaacaaacgacaccttgggcttggagcctactgtgccaccggcccgcccacgagaccccgcggccatgtccatcccgcggctcctcctcctcgccgtcctcgccgccgccgctgcgtgcgcgcccgcgcacgccgccggcgccggcgcctgcgcggcggagaagttctcgggcaaccgcgcgttcgcggcgtgcgccgacctggcccgcctgggcgcgtcgctgcactggtcctacgacgccgcggcggcgtccctgtccgtggcgttcctggcggccccgccttccgcgggcggctgggtcgcctggggcctcaaccccagggcgcagagcatggacggcacgcaggcgctggtcgccgtccccagctccggcggcggcggcgcgtacgaggtgcagacctacagcatctccgggacctcgctcggcgccccgggcccgctctccgcctaccggacgtcgggcctcgccgccgaggtcggcggcgacggccgcgtccgcgtgttcgcgaccctcgtgctccccaacggcacgggcgccgaggtcaaccacgtctggcaggtcgggccctactccggcgggatccagatacacgacaccaagggcgacaacatgaacgccaaggggacgctcaaccttctaaccggcgccactgccgccgccagcggagggggcagcatcatcaggaagaaaaatgtgagttggtcggtccccactccccagacccccacccttcgtctgttcgcgttattaacatgcacattccttcgtttcttcgattctgaccccatacagggcagttcttcgatacagccaagacaatcagctggc

SEQ ID NO: 5779 - DNA, 1312 bp, Zea mays
cgaggccggccggatgactccccctcggcccccgccccgcgctccactcgaccactccagccacgcgccagcgcccacccacccatggcgtccgaggccgcgccgcgggtcgtcgtggacgagtgccggggcgtgctgttcgtgtacagcgacggcacggtggtgcggcgcgcgcagccggggttcgcgacaccggtgcgggacgacggcacggtcgactggaaggacgtgacgttcgacgaggcccgcgggctggcgctccgcctctacctcccccgggaccgcggggccggggccgggcggcgcctgccggtcttcttctactaccacggcggcggcttctgcatcgggtcccgcgcctggcccaactgccagaactactgcctgcgcctggcctccgacctgggcgcgctcgtggtggcgccggactaccgcctcgcgcccgagcaccgcctccccgccgccatcgacgacggcgcggcggcggtcctgtggctggcgaggcagggcggcggggacccctgggtcgccgaggccgccgacctcggccgcgtcttcgtgtcgggcgactcggccggcggcaccatcgcgcaccacctcgccgtgcgcttcggcggctcgcccgcggacctggcccccgtcgccgtgcggggatacgtccagctcatgccattcttcggcggcgtggcgcgcacgcggtcggaggccgagtgccccgccgacgctttcctcgaccggcccctcaacgaccgctactggcgcctgtcgctgccggagggcgccacgcccgaccaccccgtggccaacccgttcggccccggcgcgccgccgctggacgccgtcgagttcgcgcccaccctggtcgtcgtcggcggccgcgacctcctccacgaccgcgccgtcgactacgccgccaggctcagggccgccgggaagcccgtcgtggtcagggacttccacggccagcagcacggcttcttcaccatcgacccctggtccgacgcctccgccgagctcatgcgcgtcatcaagcgcttcgtcgacgccgacggccgcttcgacttcgactgacacgtcggtgtcgaactctagtattaaatccgagggagcgagcagaatggtctgcgtcgagccgtcgagtagttcccgggttgaaatcaatgtggtttggtgattgtgatatttttcttgctcgtttgtttttattatggacggttctcctgttaaaaagtagtagcccggtgtgtttagtaggaatcttgtatctagattcgctcgaggaacattctagatgacaaaaaaaaaaaaaaaa

SEQ ID NO: 5780 - DNA, 4236 bp, Zea mays
  misc_feature (54)..(54): n is a, c, g, or t
  misc_feature (340)..(340): n is a, c, g, or t
  misc_feature (494)..(494): n is a, c, g, or t
ccttcatttatctactttgcgctcccagcgatttatccatggtcatgttcatgnccagggctaacatccgttcaattttcccacttttttcctcctgtttttttcttgccttttcattttcccttttttgtatatgctgagaaattcgaccaaaataaaatacataaaaatatattggataaattttatgtacattccaaaaaaatacgttagacaattataactttcgtgtacatgctatgtcatttgtataattttattgtgtaaagaataaaatttggaaaatgaagacaagataacctaaaaaagaaaataagaaatagaggataagaagaaaaangaaaaacatgggtgtttgaaaataaaattaagaaaaccatcaattagagtaaaataaataaataaataataaaatttaaaatataagtaaactgaaaaataaagcaaaggatcaaataatataaaaaatataagaaacagagccatgctaagangagagaaggaagctatgacctgcgttgatgtctcgatgaaagaccacagcaactgcacgtgatttcgtgttggttacgtagtgggccacgcttgcacatttgaagtgggccacgctcgcgcttatttgggctgccttccgcgctgctggtcggcggacggcagggtgccgactggtcgcacaatccgacagtcgccgccgatgattcgcgtgcgatcaactgcacattgcatccccgcgaaatctctggccgatgggtccggatcttggttacaggcaggtggtccccagttatcgcgttggatccccctggccaatccgggtcccgctccggatcccatgctcccggtgcgcagagtgccacacacgctacacgaaccataacctctgctcaccccttgacgcgtgtcccggaatacctggtccctcatccatgggcctcctctccaccaccacagccccacttatacaccgcgccgggtccacatgccatcttttatttttcgttattgtagcactggtccaacctgtcagaaaagattggagtagctgggaggtcacgagtcacgcacggatgcgaatcttaaggccatgcgcatgctaatgcttgccctaatccgaatggccgctctcataatacacattaattaatcatgaatgcgctgcaaatttgaccatcatgcgtggggccacgcgcggtcccacgcgttaccaagctgggcaaacgacaacgcgccctgggccgtcggatgcgcgcccggcgcgtagattaatgcggcgggccccgttacagatcagccgggtcccccggcgcgacacgggtgggcggtggccccgcgcgttatggtcccaccgccaagtgacacaccgcctgataaatctagctctctcgtccggggcggcgagccatgtaaaaccgtccgacgcgagccccacctccgcgctcgcacgcggaaggagagggacgagcgagccaccgtcaccgagcgcggttacaagaaaatccaatctctcccccacgctcgtttcgactcgcgccatggaggcgcaggcgcaggacaatagggcggaggatggggacggcgcgcggcaacacgtagccggcggcgtcgcggcgacggggatggctatgggcgcgatccccatgcacgggttcatggtcccgaagccagagccggtggagttcttcggcgggatggccgtggtgcggagcaagccgccgccgcggaaccgcgaccggcacaccaaggtggaggggcgggggcggcggatccgcatgcccgcggcgtgcgcggccaggatcttccagctgacgcgggagctagggcacaagtccgacggcgagaccatccggtggctgctgcagcagtcggagcccgccatcatcgccgccaccggcaccggcacggtcccggcgatcgcgaccacggtcgacggcgtgctccgcatccccacgcagtcctcgtcgtcctccagcccctcgtccctcaccaccgtggtcgacggcgacgaggcgtccgccaagcgccgccgcaagctgcagccgacgcgagcggccgccggcgcgtccccgctcgccaccgccgcgcccgcggcgtactacccggtcctcgccgacccgctcctgcagggcaccggtggagcggccatctcggtgccgagcggcctcgcccccatcgccgcgtcgggcgcccctcaagggctcgtcccggtcttcgcggtccctgcggccggcagccccggcggcggcaaccgcatgattccgcaggccaccgccgtgtggatggtgccccagcctggcgccgcggccgcccagcccacgcaattctgggccatccagcccgcgccgcagctcatcaacctcggcggcgcgcaggccgccgtgttccccgcggcggtgaacgtcgccgacttccagggccagcagcccatctctagcttgtctcacaacagcaactcggagcatctgcacctggggtccgggtcccacgagcagcagcgcggcggtcgcagcgacgtcaaccatccggaggaggaagaagacgacgacgacgacgacgagccggtgtccgactccagcccagaagagtaacgcaccaccgtacgcccagaaagtccaaccccaaagcttaggttccttttgctctaatttaatcgctccccctcgttttcccccctttcgcaatcctccttatgatgaactacatgatgctttctgtcgtagctcacgttcagttcagtgacccccagtgttagtggtagagagaagaagatgatgatgaaagaggtagtggaactgtagaagcagcgtgtaatgcaaatcaaaacgagcagctgatttgttattgagttaattaattgacgaccttttgctaatataattctttttttttactgtgtcgccatttttgtttggtgagcttgagccctcctgatgaggagagtgaggagggatgggtttagcgtactctgctaatcctgctagtgtgctagggatggaggcgaggcggagcggcgagcacgtgcgtacgtggtggcaaaatttaacgcacacggccggaggtgggtccggcggagtgggttgcttttcttaggctccggcggtggggcccggagccggtggttcgtggcgcgggccccggacgcaaagcgatgtggtggtgggtcaaagcgcgcgccctcgcggaccgtgcgcgagcgcaccagcggctggggtggggtggggtgtggcgtgtggggacagccaggcagccacgagctgcccgtcacgtgactggtgggcggaggggggcccctcctcgttgccgccgcgtggtggggctccggcaggcgcggcggtaggtgtggggtcctggacccgctcgcgtcgcggctggtgggcaccggcccggacacgtgttgggtggctggtggtggggcctcgttggcccccgcgtgccgtgccgtgcccctccgctcttcccgccgtagggacccggtcctggtggggccgaggatgctggtgacgtggggccctgcgaatattccacgctggatcccaaatccagttacaggattaacataacaatgaggagggtagggttaacttcaaattaatcagtatcgttaccgtttcgacgaaagaaagaaaaaaagggcgtcggcgtcacggtatcagccgacaagctcgtggtcgtggcggctcccgggaagaaaagagcgtgatgcgcataaaagccggattactgtaaccgcatctgttgtcttgccgcagctgacagaacgagaggggcaagtaccgctgctgctagtcgtgtagcaagcagtgcggagataaaccggagagaaagcttttcccgccggcgagtggcgcacgcccgcgctggcgctgcgctttccgttaaaagcctactcgctgttcagccatgaggtcgccactagcgaggcgaacagagcaggagagcggggcgggggcaggggcccgcctgcctgttggattagcattttgctcgtgcacggaacacggtgcgccatccggcccggatgcttcctcactcgtccggtcggtcggccccgcccgcgatgtcttttcttccccatcgggcccatgcccatccacccatcgaccgcctaaacaaatcattccgggtttcgcccgcgcccgtcgggcgtccgctcttccgttggcggcaggccggcagcgcgagctggcaacgcggcgagccggcgagcggtggctgctggttggtcacgacgatctcgtg

SEQ ID NO: 5781 - DNA, 1910 bp, Zea mays
ccggccggggttccccaccatatcgtgaacccgccgccgactagcagcaggagacgcgccaaggagagcccgcaaggaggcgactatgagggccaagtggaagaagaagcgcatgaggaggctgaagaggatgcgccgaaagatgaggcagagatccaagtaggctgatggggattgtggatggtggtgacgacatggttgtgttacgattcttcgatgcgtgtgagttcatggagagatgtcacatcctatttcgtcgtcaccgtttgccatgtgtccaatagctcgtcttggaaacctgcacttcagtaggccatctatcgtggtttctagctatatccagagttttgtgctaagacaaatcagtcagtcgttttgtgaacctactatgatggagctttatttgctgctaatatcgacctacctattttgtgcacaaaaaaaaaaaaaaataaaccgatatacttaaccctttctcacacactccttcgcctcccatcccaccccgaagggcgtcgccgagctagccattgccgcctcccggctcgcgactcgcgagtcacaggcgcagccgagcgttccttggggacgaggctacatcgcgatgtggtggagggcggtgaggcgccggtgggtcgcgacggcgcggcccgcgtcctccgcggcggcgggggcggagaagagctgccgcgccgtggtggtgccgcgtttcggtgggccggaggtgctcgaggtcaggcagggcatgcctgtgcccgatctgaagccgcaggaggtgctcgtgcgcgcacgcgctgtctctatcaaccccctggacctccgaatgcgatgtggctatgggcgctccatattcgaaccactcctacctctgatcattggtcgggacattagcggtgaagttgcggccaccggaactttggcatcgtctttttctattggccaagaagtgtttggttcgttgcatccaactgctctcagagggacatatgctgattatgctatcctgtcactggacgagcttactctcaaaccatctacactcagtcatgtggaggctagtgcaatcccgtttgctgctttgactgcatggcgcgctttacatggtacggctcgtatttctgaaggacaaagagttcttgtgattggtggaggaggagcggttggattagctgctgttcaacttgcggtggctgctgggtgtgtggtttctgctacctgtggaacacaaagtattgagcgagttatgggagttggtgctgaacaagctattgactacactgctgaggatactgaagcagcaattaaaggaaagtttgatgctgttttagacaccataggagtacctgagacagaaagaattggcatcaatgttcttaggagaggtggacactatatgacccttcagggagaagcagctgccctagcagataggtatggattggctgtagggcttcctgctgctactgctgttttactaaagaaacagatgcagtatcgttattctcatggaatagagtattggtggacatacatgagagctgacgccgaaggccttcacgagatccaaaggctatctggagctgggaaactacagatacctgtggagaagacctttcccatcagccatgtaagagaagctcatgcggccaaggagaaaaagttggctcctggcaaggtggttctggaattcgattaatgttattaagattttgtccattgggacctgaagggctgtgcgtttgcaaatcatgatagttttttttgtaaaaaaataaatctgaatctctctgccgacttcaggttccattttatcgttccgtttcagtagaaatacggtaaataatcatatcagctatggcctatgggcacgattttcctgatgaaaaaaaaaaaaaaaaaaaaaaaaaaag

SEQ ID NO: 5782 - DNA, 747 bp, Zea mays
ctaccccaattctcacctttcctctccctcggtcgtcgccttcgcctcccgggaaatcgcctgccgcctcgtctcctagaaactcgccgccgccgtccgctgccatgaatcccgaatatgactacctcttcaagctgctgctcattggggactcgggcgtggggaagtcttgcctgctgctgaggtttgcggatgattcatatctggagagctatatcagtactattggtgttgacttcaaaatccgcaccgttgagcaagatgggaagacgataaagctgcaaatttgggatactgctggacaagagcgatttaggaccatcacaagcagctactaccgcggtgcccatggcatcattgttgtgtatgatgtgactgaccaggagagcttcaacaacgtcaaacagtggcttaatgaaatcgacaggtacgctagtgaaaatgtgaacaagcttttggtggggaacaagtgcgatctagctgagagcagagtggtttcttacgaggctggcaaggcccttgccgatgagattggaataccattcctggaaaccagtgccaaggatgcaacaaatgtggaaaaggcatttatgaccatggccgcagagataaagaacaggatggcaagccagccggctggaaatgccagcaagcctgccaccgtgcaaatgcggggtcagcctgttgctcagcagaatggatgctgctcgtcttgatcaacactcaagatcacagtagtgttcttgc

SEQ ID NO: 5783 - DNA, 1063 bp, Zea mays
gctcgacatcccagtcttcccctattccgccgggccgctcttttcatttcccatctctctctgcgccgtcccgtgctccctccgctagttctcccaattccttccccacctcctcggtcgtcgcctcccccagagagcaggagccgcctcgtccctgccggtcccgacccccatcccgtccgcgtccaacgccatgaatcccgagtacgactacctcttcaagctgctcctcatcggcgactccggtgttgggaagtcttgcctgctgctgaggtttgcggatgattcatatctggagagctatatcagtactattggagttgattttaaaatccgcaccgttgagcaagatgggaagacaataaagctacagatttgggatactgctggccaagaacgctttaggaccatcacaagcagctactaccgtggagctcatggcattattgttgtgtatgatgtaactgaccaggagagctttaacaatgtcaagcagtggctgaatgaaattgataggtatgccagtgaaaatgtgaacaagcttttggtggggaacaagtgtgacctggctgagaacagagtagtttcttacgaggctggcaaggcccttgctgatgacatcggaataccattccttgagactagtgccaaggatgcaacaaatgtggagaaggcattcatgaccatggcaggggagataaagaacaggatggcaagtcaaccagctgcaagtggtgctagtaggcctgcaactgtgcaaatgcggggtcagcctgtttctcagcaaagcagctgctgctcttgatcgtctgtctagatcacagtagtgtgattgtgcagcaagcaaaacttaaattggttgctccctgtacattaagcctattactgtcccaaagaactcgatgttatctatcggatactggaagtctgtctatcgactgcaacgcttaagcagatatggcctgttttatctgcctgttcttattccagtgctaatgtgatgttggatcaaaaaaaaaaaaaaaaaaaaggaaaaaagacccggtccccatttccccttagg

SEQ ID NO: 5784 - DNA, 1020 bp, Zea mays
  misc_feature (998)..(998): n is a, c, g, or t
cggggcccactgggtaccccgaggcctctcggcatttcccatctctctctgcgccgtcccgtgctccctccgctagttctcccatttccttccccacctcggtcgtcgcctcccccagagagcaggagccgcctcgtccctgccggtcccgaccccgacccccatcccgtccgcgtccaacgccatgaatcccgagtacgactacctcttcaagctgctcctcatcggggactccggtgttgggaagtcttgcctgctgctcaggtttgcggatgattcatatctggagagctatatcagtactattggagttgattttaaaatccgcaccgttgagcaagatgggaagacaataaagctacagatttgggatactgctggccaagaacgctttaggaccatcacaagcagctactaccgtggagctcatggcattattgttgtgtatgatgtaactgaccaggagagctttaacaatgtcaagcagtggctgaatgaaatcgataggtatgccagtgaaaatgtgaacaagcttttggtggggaacaagtgtgacctggctgagaacagagtagtttcttacgaggctggcaaggcccttgctgatgacatcggaataccattccttgagactagtgccaaggatgcaacaaatgtggagaaggcattcatgaccatggcaggggagataaagaacaggatggcaagtcaaccagctgcaagtggtgctagtaggcctgcaactgtgcaaatgcggggtcagcctgtttctcagcaaagcagctgctgctcttgatcgtctgtctagatcacagtagtgtgattgtgcagcaagcaaaacttaaattggttgctccctgtacattaagcctattactgtcccaaagaactcgaggttatctatcggatactggaagtctgtctatcgactgcaacgcttaagcagatatggcctgttttatctgcctgtttttaaaaaaaaaaaaaaaaaaaaaaanaaaagaaaaaaaaaaaaaaaaa

SEQ ID NO: 5785 - DNA, 1007 bp, Zea mays
ttcggcacgagatcccttccttcactggcccgccgcggtcccgggaaaagtcagtcaactcagccaacaagcgctgctgctcgggcacgggtggtttgggaggccggacgcaacgtcgggatgcagtcgctgcaggacaaggcgtcggagtggagcggggtggcggccgccgatgcctttgccatcgacgacgtcaacatattcgagtccctcggcggcactccgcagccattcgtcgacctctccaccaatttctacaccagggtttatgaggacgaggaggagtggtttcgggagatattcggggggtccaagaaggaggatgccatccagaaccagtatgagttcctgatccagcgcatgggcggcccgcctctattctcccagaggagaggacaccctgcccttataggacgacaccgaccattcttggttacccaccgagctgcagagcggtggctacaccacatgcaacaagctttggacgcaactgaaagcatagatgtggactcaaaaacgaaaatgatgaacttctttaggcacactgcttacttccttgttgctggcaatgagatgacaaggcaacagggccatggagtagcctgcaaacatgcaacaagtaaaccagctgagtaaccattttagccgtggagctggtaaccattggaataattactgataagccttttatccagtgtgcctttatagcattccgtatacaatggagttgaaacaacctccacattcaaagaaacaatggcactgactctttgtaggctttatagccattcttgagcagagagtgtactcaaagtggatagttgtagcttctgccaatatgtttatccttcttcgtctcttgtgctcaagagttattcacagcagtttttcaaatttgacctcaccctagcaaggttaccacaccacatgttaaccatgccacacttatttaaggtcatatttgcttaattttcataagtttgggagccaaaaaaaaaaaaaaaaaa

SEQ ID NO: 5786 - DNA, 4839 bp, Zea mays
  misc_feature (4548)..(4548): n is a, c, g, or t
gcgtcagccaccctccgctactcgttctatctccttctccactgggccaactccgctctactctccaatcccaggcgaatccctcgtcttcttcgaccgcgtgtcggagcttcatcttctctggcccccctgccctgatttgccgctccgctctcccccccttccgccggaaaggggggaaattgatggcgaggctagtggctctggcatcggcggtggcggttctggtactcggcctcgcctgtgcagaggcggagccacagtgcacgcggcgccgcccgcccgcgccgccgcggccgcacagcgtgacgatcaccgagttcggggccgttggtgacggcgtcaccctcaacaccgtgtccttccagaacgccgtcttctacctgcgctccttcgccgacaagggcggcgcgcagctgtacattcccaggggccggtggctcaccggcagtttcaatctcaccagccaccttaccctcttcctggagagtggcgctgtcatcgttggcacgcaggacgtttcacagtggcctgttgttgaacctttgccatcatatggacgaggaatggaccttccaggttcgaggcatcgaagcttaataaacgggcagaatctaattgatgttgtaattacgggaaacaatggaacaatcgatggccagggttctacatggtggaactggtttcgttcgaataagttgaactatagccgccctcatcttgtggagtttgtggactctgagcaaatcgtcatttcgaacataacatttttaaattcccctgcttggagtatacatccagtgtattgcagcaatgtagtggtccatagtgtcacaattcagacttcattggatgctccacttaatcatggaatcgttccagattcttgctcaaatatgtgcatcgaggacagcagtatcagtgttagccacgacgccatatcactaaaaagcgggtgggacaagcaaggcattgctttcgggaggccaacctcagacatccacataagcagactggatctgcagtcctcactgggcgccgctctcacgttcgggagcgagatgtcgggcgggatctcagacgtccatgcggaccgcctcctcatccactcttcgttcagaggcgtcttcttcaagaccgcgccgggacgcggaggctatatcagagacaccgtgatctcagacgtccagatggaagacgtcgacgtcgccatcgcattcactggtgactggccaagccacccagatgaccagttcgacccgaccgcgctcccggtggtcagccacatcaccctgaagaacatgactggaacaagaatctcggtcgctggcgttttgtcaggaatcgccggcgacccgttcaccgacatctgcctctccaacatcaacttctcactggccgattcggccagtcccacctcccactggtcttgctccaacgtctccggatactccgagctggtcttccctgagccttgcctggatctgcagacccaatcctcagatgcctccatctgctccaccctccctagcttccacgccgccgccattgcagcagcgtaaatgcacagagtacaaagtgtccatcctttttcctgttcccggtcccctgcacacttcagaggatctctcaagccgccttttcctcccccgacaattctttgaagctataggcgcgctcccgtcgttgaagaaaagaatcgttcaccgtttttctccggccgtcggcttcgagggctcagctgcatcgcctttcttgcgggaggcaagcctggcggcggacggtcgacatcgagctgttaatttgcttgtacagttatgatttcttcattcaatctgtaagaaggaatttttgtggtagtagagggttgagtcgagtccagagagttgcttcatacgattgtcgatttggtgaataaaacacatgatggattcatgatccagtggctctgtatacatcctgtcatccttgtgggtacatccatccatgatccatccaatctaacaaacaaccagtacaccaacacctcacatgttctcgtggtcctgggttccccaggctggcaggcgcctgcggaatgtagccaggccaggggccaggccctcgctcccgttgctgccaaacaaattggcgtccgtccatagagtttgttagatgaccgagcatggccatggcctactgggggcctgggggtgggggcggtttcattggcttcgctttgtcgccatgcagtgcggcgggcgggccgctgagctggcgccgtcttgggcggtcgccatttgcgcaagctccaggctccagccagcattcgcatctgctttgcggtcacttgcagttgcagtggacggtgaacagaaccatcacgggagctggcaccgatgattagctagctggtcatgctgctggcgcttgttgtatatctattacgtgttgttcggttccactcaacaaagtttagtcaatacaacatcgaatgtctaaatgataattacatatattaaatatagtttaattacaaaactaattgtagagatagagactaaaagatgagataaattcattaaacttaatcgagattatatttaatagatattcaaacattggatacatggactaaacttcagtagggtagcatgtgaaagactgaagcagcaggtgctgcatgaccccaaaatgccatgaaaggctcagtgaaccttgtcttggaacacgggctgctggtaccgaagctgctgttggtgagcaggaagcagaatgttacgcgaaaactgaacaccattggataccgtcataccgagcagcagatgctcagcctctgattaaaaaaacaaaaaaaaacaaaactgaacagagctgaccatgtcatgtgctgcaacatgtcgttgtatcagctagcgcaagatccatccatccaggctgctcagatggctgtgctgcagagtgcagcaggctttgttgaatgcagtcaaagcagggagcggacgggatgctgtggacaggggcagctgggcgtgacaggctcaatcagtccccctgacatgtgccaactgaggattactgttcctgtggatcttcagtttttacagctgatgagataagaacataactgctagtagtagtaaggatatctcctattttagacctcactttataaacacaatagtctataatgcaaaccaatgttttatacggctatatgcacgatccgctgagcacagtctaacaagttgtttcttctatctctatttaagaactccgttagagtatcttccacctagagatagcaatacgacgatggatatttactccattagacgatgtgtatagactaaatatcctatcataggtctttgttagacaaaatccttcactcaatgggtatgtagatattggaacgttcccgcattcacccatactcattatcccatgagtataaaacatcatgtatcactatatcaaacccatggatgattggttcaaaacctaccgtttttgtgtaaggcgttattttggtacaagtttaatctttgttgttacgagtgatccgacgggtgactttgacttatatgagtgtacgagagaaaatttgtacccactagtggatatggtgatccgacagatatgtttttatttgtggtggatatatgtatgagatgcagaacctagcaaggatttagccgttgtcatctctacttcagccagaaaatatgatcactttaaaaaaaacagtgtggaggtaaaaacgggtgtgcgagcgtgacctttgcaatgatatgcgtcgggccaattggacgacagacaaatacgggaccaaagagcagtacatacaggacggggggcaggcatccaagaatttcttcagaccgtaatcaatattggtcatgcataatataaatgctctcgtgagattgtagtattccagtcctctgccggcatgatgctgtaaacaccgctgcaaaccctctcgtttacagctcctcatatgatgagggcttacaagaatagaaatcggaacctgtcgcttcactgtttgatcattgtttttctctcttctttctgcaggcgtgcaatgtgagggactataaatgagaagatttgcagcaggaagcatagaattttttcccacataaaaatgcacaaatcgtcatattggtctggtcgattattcttaccctagtgttatcttaaacattaaacggtaaacagtcgatcatcctctatttaaccggactacatggacgtttaaatggactaaaaattaaattatataggattaaacggcataaatggcctaaaaggttagctaccgaatagcatttaaacgacgtttaaacggtctaggataacagtgcctgcgaaaaaaatccgtccatgatggtgtaaaattcacgttgagcaccgccccgtgccagtgacgggcatgcaagaaatttatgcgtctttccatacaatgttttttttggtattaacaatcagaactaaagagtttaattctttagtttagattggtaacaccaaccagaactaacgtagatcttttagttcagnttagtgttatcaatcagaagcaaaggttctccaacgcttaagaaccttggatacgagattaatgctcatattagtcctagctctctggccaaaaaccatatttctaggtttatcaaaatcattttttatgcaatcatatctcctctcttctatttgtatgtacttaatctcatcatatcttagttttctgcgtaggcatagtttcttctgtatagaaacaaattttctctcttttccttaattctgtgtcacacataattgccaccttcttatttaacgttcatagaaata

SEQ ID NO: 5787 - DNA, 5698 bp, Zea mays
  misc_feature (557)..(557): n is a, c, g, or t
  misc_feature (2540)..(2540): n is a, c, g, or t
gggcagaattgtcataaatggtctgttgaagcagacgtcgaaagtttatttttggaatccacacaatgaacattcatttgtggtgagtaaatgaaacttacagttgtttttcgcatacctaaactcttttacctgtctagtctaaagcatgttgtgagaagttgctgaaaaacaagaactagttgaaatctagatggatatagttagcgattccctatttgtgaaggcaaacgacatcaatatagtgtgggaaagagtttatggtgttatttggtggaccatggattcaaccaccacgttttagtgaaaatttgttcagattcatctccagtgcttatcttgcaatacacaccactattttttttcttttggaccatagagatgaattagttggttaggctggtatgcagctttttttattattattatgtacatctggtaatttaattactcctagatggtatgaaaccctgtaactgtagtatgttctgtataatctcccaggtcagtcttgaaaatgggatggttcaagccttcgataagcgaacagcttcatnaagttcttctggccagtctatgtatacccttcatgcacacgataaggctgtttcttccatctccttcaacccgtctgcccctaacgtatgtttttctttttgctatatagttctttgctaaatagggaaagaaacacatccaccggtccagattactgatgctagtttcttttcttgcagtttctcgcaacaggctcagttgataaaatggtaaggacgttccaatagtttggtggcatatagatacgtttaaacctgttgctaaaacacatctgcaaacgtaggtgaaactatgggatctatcaaacgacaaaccatcatgcattgcctcccaaaatccaaagcttgtatgttttcaaacgaactagatgtttactttttggaagaaattgttttttctgtatcgtttatacactcaaatttttccagggagctattttttcggtatcattttcaaatgacagccccttcttgttagcatgtggaggttcaaaaggcaaactgaaggtaatctcctcgctcatctcatagggtgctgatttgctgaagcaatgccttgtcttttatggacaatatttttgcatctttggcaggtttgggacacgcttacggagcctgcagtagccaacaagttcagcaaatagaactgccgctgtttgccgttataagttatttcccggcacacacatgtttgggtagattgaagtcatagtcgaagttttgcccttgtgagttgaggagcccaattgtataatgaactcatgaaatcaatccaagcattgatttatgtattagtggtgggcagaggttttggagtggaggtattaagtttatgacggtgcgagttgggttgtgacttcccaatttttttgtgaaagaagttagtgatcttcagaccagatccctttatctcgatccaatttgaacctttggacaatagttctacatggaacagttcgactgtaggaggctatctctagcagcttactcatcttttttttcttaaatctataccactgtataattcatcagtttaaactttacaaaccgcattcaactaaatcatcttgtacctataacctttactaaattcactaaaaaattgcattaggatttaacgtactagaaaaagccaaaggtatagattgttagataactccctcttagtaaaatttaatggacactaatattatttggatcatccctctatgtgacaccgcatcctcgtcgccccttgtgctaccaccgtcgacccctcccctccacggaatcatagtgttagcatgagctatatgataaagttatatttgtttccttttagattatataaaatagattatggtaaaaaagtaagagagtaaaaaatatcactttaagatcataaataagctagcttattttaacttatttacggttttaaagtgatattttacatttatacttttccgctataatccaacttatataatttggaagggaaacaaacagaccctaatagtgctaaatagtgtaattatgtaaaacagtatttacacgatccgctggctatagtctaagactctaagtaaaggcctcacgtcgtcgtgtgaagacattattatttattggtcacaattatattgtgatttgagttaagtggaactctggaaggtatacaaagacaaactgttacatctccaaacgatcttccaagttcagtcaaaaacaaaaaacaacctaaaatataagttatccaaacgattttttagacaagacaagaaacatgataaaagactaaagattttaagatgaaacaagacatatgaagtcaaacattactattttaactaattcttctagaaaacctttatagtttcataatatataaactatatagtatggaagtatttctcatggtaaatgtaaaaccgtaactattatttcatgaatctttgataatttaatttacataatttatattttgatataaatttagaactttgnatctcttatattttagcatggagaagataatttactttacaaaaagttccaattgttacattccacagtatccgcacaccctctaaaggtttactttcttttttctattcataaatatatgacactgttgattttttttaaaaaacattggtcaatcgtcttattaaaaaaaaaattatcatttattttttgatttgttttatcatttaaggtagtttgtgtttgattaaaaaatttatatttttaaataaatatttatgagtggtcaaagtttttgaaaaaaatcaaagatgttatatatttgtgaacgtactatagtacttgttatggttctaatctaaagacccttttgccacttggattattctatgagcgcacagtgcgccaatccgatcatctcaccgtagccatgcatccgtgcagacacttttgccaccattttttcaccctatcttttttaatcttttttttcccgcgcatcagctgtggtgcttactcctagactagaatagtggggccttttccgagtcgcgtcgtgcgcatgcatgcagccctgacgccgatccgattcagcagccgcaaaaggagctgggatcgagcacacaatcgcaagtggctccggctgctcgtaattattaataccaatccacattgcttcattaaactaaactagatttagtttgcagtaccttatcatttctaaaatattcgtgtgggtgtataagcgtctgtgcgtgtatatatatgatatgctatgttatgctatcgctcgacaagtctgaataagcgcggcgtatgcgtcgatctcttgcactgcacctttctccaacacatgtgccgttttcagcatatatatatactggacgtgcacaggtgcattgttgtcggttgagcaaaagcagcaatataatatacaagtggaagcagcaatatatcttgagattaacgaagttattgttaatcaggcattgccaatttaccactaaaaaaataacgtccgatggatagattaatattattctaataaaatatatgctatgctcatctcgcaaagtagaaacattttttttacgaattacacagtacaaacgtatagtatagcacacgaataattgtgaatttataagcagtttatatagagcgcataaaaaacatgtcacgaaacgctggaatttcgcaaatgtttcaagcaggtcttgcattgctattgctccatctctcccaaactaaaattcgtttggaggtgttagtgggttcatacaatatttgatgcatgtgttttgtatatatgtaggtttattatcatttatttgaacatagacataaaaaatgaaaagctaaaacaaacattattttgaaacggatgtagtattttagaaaggagcagatgcacagtgatacactctctggcctcacgctgtagggaaaaaaaaccctataactttccatggctaaaaaaaaatctatagaccattcgagttcccaacgaaaataaggttattttcaacggccattgagaattgacaaaaaaataacttcctacgactagccgatcgaagtttaaaaatttctgacagttgctgtgaatagctaatggaagtcaatattacctacatgccaatacgcctatgccacaacctcacgtcgctccgccaaacgccattgctccatcatgccgcatcgctcgatctccaacggacaacaacgtgtctagaaccaatggctagctgatgtggacacacatgacatatccacattttacttttgttggctttagtttggctcccgacgattttcaaagtcgcctagaggaggataaataggagaaatctggaatttataaacttgaacacaaaacttcactcagtgttagtgtgtgttagaacgagtataaagtcaatctgagtgagggagaggtgttctcttgctaagagttgcactaataattgaggaattacttgggtgcaactcaaattgatatgagatcaaatgcaagctagtaagagaacaagagagatgggcgagaaagaaccaaatcacaaagcaaaggttgtcacaatgaacatgagtgatttgttcgttgagaagtccacataggacgggtctcttttaaccctttccctctcgtggacggtccgcgagcctcatcttctttcaacagctattagagtttagggtctagggtttagagtttagggtggtatttatatccttcaaccacaccacatagatgttgtctcttctctgccactcgtggacggtccgcgagcctagtccgggcagttaacacctgcaggatcaaggactagatcgcaacagacagttacaatggctataatcgcattaaatgcgccgccagatatcaaataaaacatgacaaacggtcttccgcacgtttcgtgtggacgctctaattcattttaccgaacccgacaccttcggattgttctgtctttcaacgaccggacggtcctcaaatggtgacggtcgatactctccttttctttggacaatccatagtagaaatatgcattaggcatagttcctgtccgaagttcttcacggtgtcgcggccggttcaccggaagggcccgacggtctgaagtatatgtggtattttcaaaaagctcatgtccggtatatgttgttttgagcgttgatcttccttgaaattttctgagtgactgaaaccataacttagcaaactagttagattaaatgattgtgttgatcgtcaattaccaaaataattgtggaaatgatttttaggcctatttcctttttagattttgaccgtaggaagttctccacttgcctatagtgtcacctataaatgtacaatataatttaattgtaatttaggcattgaaataaatataattttaagtgaaaatgaaccatgagtctttaaaattttcccatatttttcatcggagtccataaactatcatagactgaacttagaataaaccacttgcacagttgaaggcactaccggaaccgacggctttgccgagtgtctgaagcactcagtaaagctttaaaaacactcggcaaatgctttgccgagtgtcgcactcagcaaagagggttcgacatacagtgcatcggcaaagccgtctttgccgagtactttttcttgggcactcggccgtcag

SEQ ID NO: 5788 - DNA, 1115 bp, Zea mays
ttcgcacctggggctaggaggactttcaaaaaagaagaaaaagacaaagggcaaaaaggggaagaagtataagaaaggaagccacagaagttctgtgcttggtcttgcatggaacaaggaagttaggaatgttctagctagtgcaagtgcagacacaactgttaaaatctgggatatagctgttggtaaatgtgcagtcactctagaacaccatgatgacaaggttcaagcagttgcttggagcccacagtcacctgaagttctgcttagcggatcctttgataaaacagttgccatgaatgatatgaaagatggtgggcagaattgtcataaatggtctgttgaagcagacgtcgaaagtttagcttggaatccacacaatgaacattcatttgtggtcagtcttgaaaatgggatggttcaagccttcgataagcgaacagcttcatcaagttcttctggccagtctatgtatacccttcatgcacacgataaggctgtttcttccatctccttcaacccgtctgcccctaactttctcgcaacaggctcagttgataaaatggtgaaactatgggatctatcaaacgacaaaccatcatgcattgcctcccaaaatccaaagcttggagctattttttcggtatcattttcaaatgacagccccttcttgttagcatgtggaggttcaaaaggcaaactgaaggtttgggacacgcttacggagcctgcagtagccaacaagttcagcaaatagaactgccgctgtttgccgttataagttatttcccggcacacacatgtttgggtagattgaagttatagtcgaagttttgcccttgtgagttgaggagcccaattgtataatgaactcatgaaatcaatccaagcattgatttatgtattagtggtgggcagaggttttggagtggacgtattaactttatgacggtgcgagttgggttgtgacttcccaattttttgtgaaagaagttagtgatcttcagaccagctccctttatctcgatccacccgcggcctttggacaatagttctacatggaacagttcgactgtaggaggctatctctagcagcttactcatcttttttttct

SEQ ID NO: 5789 - DNA, 4418 bp, Zea mays
  misc_feature (2884)..(2884): n is a, c, g, or t
tcggaatctctccaaatctacgtacagctacgccttggtatttgcgggatttaattgttttatatgaaacagaggcattactcctactgcttaggtgtagcggtccatgctaaataaaaataagctgagttataggaggcggaaaatcattaagggtccgtttggattgagagtggctaaattctagtttcgtcacattgatgacctaatccaaaacctctaaagcaaattattaattagctaataagttattagctagttttaagcagctaacaactaatagctattcatgaacgacaatatatagtagaaactgataagttaaacacaaattcgtctaagttaactggtaaagttatagattaggcgctggccggctggtctaaatggcacacactaccacggaaatgtgtgttgtaggctgcccaaacaccatgtctttgaatttgacactttttcgtctccctctcccgaaccaccggagaccgatcttaacggagaatcaaagttctgatgataaattaacagtgtgtttggtttgatgtaaaaggagggatggaaagaggcggccacagtttctatagtgtttagatgagagtcacgtgtaggcaagacaaatatcgaagtaatttttggtgacggcatgattaaaaaatcgagggagggtgtcgtcccgcctcatcctactttaaccttaaagcaaacgcatcctaaagtgtctagcacgtgaacggggacgcatgtttggtccgtgccgaaaagagacacgatcgcagaatgttggcgtggaaaaaagtggcgccttttcgtttggggacgtcacgtgtgtgtgagtgagtgagtgactgccaggccggccgggcaggttgatctggatttcgagatcacggtcgtttggatctgtatacctaactgctagtaggtacagccttttgttgattatgcggccgtgggtaccgtcggtacggtgtgcccacctagctactacaagtagtacaggacgtagcacagcgcctgtgctgtcgattaggctcgctactcaggtggggccgtggaggcgtgccgggccggcgccggcctgccgcacggtcatggcagtagggtagaaagaggcaggccaagtaatgaactgatcgaacgagtctgaattcacacaacaaaatctccttcaatctccacggatgggaaaggaaattagtccagtccgttcgcgtgcattgaaaataaaaaaaaagtgcttaacctaatacaatttagtactgtactcaactgaggcatgaagaaagttgacctcaaagttcaatgcctaagagccactttttcatagcttgaacttcagtttttgactctagcggtttttgtaggcttcagtttttgacttcggttccttttgccaaagaaggcatagaaattaggcatatgttctattgtaaatttagcattccacagattgtctagtttcatcaggattataaaaaaaaagaatacgtttttacgatatcaaatgatctatagtttatttactttcttcatgtgacaggtgccaataattttctacacaaatctagtcaaagttagaatactttaacttttaaaaaacagatcacatgggttaatctacattatcacagttttcaaaaaaaatgtttcgttttaatgactgtggtgttttcttgaaagcaaattttagaatttattcgccacggaaatttgttttctcttgcttttcgtttgctgtccatgtcaatccttagagatggtgacaatggagatccttgcaaaacatggttggagttctaatactagattaaaggacgcttgattcgagaacaagttcttgtcaaggatattatttttttagtgatacatgttttattaatttttaatctgtaatgccgtatgtaggaaactacaaaaggctggaatattttttgtttccattataaaaaaatgtacttactattagagcgattttgcctggcatatatatgaattcgtctcatacatacatacatgtgcacttgtgcaggcgatcggtcgggaagcccgtgcgctgttcaacgttgggcaggcggagggtctcacgatctggtccccgaacgtgaacatcttccgggacccgcgctggggccgcggccaggagacacccggcgaggacccggccgtggcgagccgctacgccgtcgccttcgtccggggcatccagggaaacagctcgtcctcgctcctgcagacatccgcgtgctgcaagcacgccacggcctacgacctggaggactggaacggcgtggcgcgctacagcttcgtggcccgcgtgacggagcaggacctggaggacaccttcaacccgcccttccgtagctgcgtcgtggaagcaaaggccagctgcgtcatgtgcgcctatacggccatcaacggcgtgccggcgtgcgccaactctgatctgctcaccgggaccgtcaggggggactggggcctcgatgggtacgtcgcctcggactgcgacgccgtggcgatcatgcgcgacgcgcagcggtacgcgcccacgccggaggacgccgtcgccgtctcgctcaaggctggtacatttctccttcttggccaatgttcctgctctgctgctcctcttctctgtttttttttcactctaatttctctatttccaggactggacatagactgcggctcctacgtccagcagcacgccgcggccgcaatccagcaggggaagctgacggagcaggacatcgacaaagccctcaccaacctgtacgcggttcggatgcggctgggacacttcgacggcgacccgaggaagaacatgtacggcgtcctcggcgccgcggatatctgcacgccggagcataggaatcttgcgctcgangcagcgcaggacggcatcgtgctgctcaagaacgacggcggcatactcccactcgaccggtccacggtgacctccgccgccgtcatcggccccaatgccaacgacggcatggcccttatcgccaactacttcggcccgccgtgcgaatccacgacgccgctcaaggggctccaaagctatgtgaacgatgtgaggttcctggccgggtgcaattcggcagccccccacgtcgccgcgaccgaaccaggctggtggcccgggcgggctcggaggactacgtgttcctgttcatggggctgagccagaaacaggagagcgaagggaaagataggacgagcctgctccttccggggatgcaacagagcctcatcactgccgttgccgacgcgtcaaagcgaccggttatccttgtgcttctctccggcggaccggtggacatcacgttcgcgcagtcgaacccaaagatcggtgccatcttgtgggctgggtaccccggacaggccggcgggctcgccatcgccaaagtgctattcggcgaccacaaccccagcgggaggctgccagtgacgtggtacccggaggagttcaccaaggtgcccatgacggacatgaggatgcgcgccgacccgaccagcggctacccaggccgcagctaccgattctaccagggcaataccgtctacaagttcggctacggcctcagctactccactttctcccgccggctagtccacggaaccagtgttcctgcgctctccagcactcttctcactggcctaagggagacgatgacaccacaggatggcgaccgtagctaccacgtcgacgccatcggcactgaaggatgcgagcagctcaagtttccggccatggtggaggtgcagaaccacggccccatggacgggaagcactcggtgctcatgttcctccgctggccaaacacgaaacaaggtcgcccggcaagccagctgattgggttcaggagccagcatctcaaggcaggggagacggctaagctcaggtttgacatcagcccgtgtaagcatttctccagggtgagggcggatggcaggaaggtgatcgatattgggtctcatttcctcatggttgacaaccatgagatggaggttaggtttgagccttgagttgtagatggagggtaacaagtatagttcaatacgacgccattgtttcttagtatgataaaaaaaaaaaacggcccgcgcccgccatagaaagtggagtagagtaaaacaataaaaaatgagacatgttccctgtggtcgatatgaatcttggaaaactttggagaaaaaccgacataacaaattgtaatgaagaacagcttgataataaccagtgaaaatgatggacaaaagtaactttgtgagtttcttctttgacggaatgtgatatcacaacacaagtagagatttatttttctagagagaaggctcgactgcaatatcaccaaaggaaaacgaacactagtgttattactgaaatccgaaaaataaccagatcatgtgaaaat

SEQ ID NO: 5790 - DNA, 2796 bp, Zea mays
taacccgatggggaattacccattaacatctctagttaaaagccaatagtaggatccaagatactttcaaaaatataccaaaaattttaactcctgtaaaaacagcataaaattagtacttcttgttagacttttagcatctaaaagcagtattttatttgttagacttttagtttttagaaaacacattttatatacgcgcggctgtcaaagtgaagatatcgactagcagtagaacatgttcggttcttaagttgaaacttgagaataagttctaatatatctttaaatctagattgcatagatgttgttaatcgtctaaaaaaatagacatccatgatttagcaactctcagaaacacattttctatcctatagtttaaacccaaagcaaacaggatgttagatatcgcttattactatgcactgacagcagacatctcaccagcctcagcctcgcttaaaaatttatggcctacgtagtctagtactcgctcagtcggtcgcttacaaatagccatgttgcgccccccggggttccatcccatccccatccagacatcgacatggagccgttttttctgttcgtagggctggcccttgttctctgcttcctcaccctgtactaccgccacttgcaatctaagaaaacgagccctttggagccgaccgaatggccaatagtcggccatctccccggcttggtcgccaacatccatcacttccacgactgggccaccggcgtcctcgccggcgcgggctacaacttcgaagcccgcgcaggtcgcaccggcgtgcggtacttcatcacctgcgacccctccaacgtgcgccacatcttcacgtccaacttcgccaactaccctaaaggcgaagagtacgccgccatcttcgacgtcctgggcggcggcatcttcaacgccgacggggagtcgtggcggcgccagcgagtgaaggcgcagatgctcatgaccggccctcggtttcgagccttcacggcgcggtgcagccgcgacaaggtggagaggagcctcctgcctttcctcgcccaccacgccgacgacgacggacgagcgccgcccgtgcgacctgcacgacgtgttcctgaggctgacgttcgacatgacatgcactctcgtcttcggcgtcgaccctgggtgcctggcgttcggcttgcccgtggtccccttcgcgcgcgccatggacgacgcgctggagacgcttttcctccggcacatcatccccatggcgtgctggaagctgatgaacgtactggaggtagggcaggagaggaagatggccgcggctcgaaggacgatcgacagcttcgtcgccgccaccgtcgcgaaacgcagggccgacaagctgaaaggatgtgaatgctgcgtcagtaactcgtatgacttgctgtcatccttcatctgccacgaggacgacgactcgagcgaaaacgacgacgtgttcttacgtgacacgacggtgaacctcctgctcgccggccgggacaccacaggcgcggctctgtcgtggttcttctacctcgtctccaagaaccctcgcgtcgagcagaaactactggacgagctcgcgcccatcgctgcttcacggcggacgaaaggtgcagaagatgctgcacacgccgccagcggcatggtgaccttcgacgcagacgagctcagcagcctggtttacctccacgcggcgctgagcgagtgtctgaggttgtacccgtccgtcccgttcgagcacaaggtcgcggccgccgccgacgttctgccgagcgggaaggagttgaaggcgggagacaaggtgctggtgttcaactactccatgggcaggatggagggcgtgtggggcaaggactgcatggagttccgccccgagagatggctcaaccaggaagggaccaagcttcggtacgagccgtcctacaagttcatctccttcaacgccgggccgcggacgtgcctcggcaaggagatggcgttcgtgcagatgaagaccgtggcggcggccgtgctgtggaacttcgccgtcgaggtggtgcccggacacgtcgtggagccgaagctgtccatcatacttcacatgaagaatgggctcgccgtcaaggttacgagaagggacgacgggacggcgccgtcgtcgtcgtgcgtgcgtcacacggcttgcttttgagttgagacttgagagactgaccacacagtgcgtctcgctcgcctatatgtgagcactgcgtggtttatatgccaacacgttgcatgacacgtttcaatatgcatgtggccgtacgtggcatatggtgtcttcttgcacactagctagcggaccaatgggcatgggcctgttggggatggtatatatttttcattcatatatggtgttgctcgttactttgtacgtttctggcagtttccatccaacactttcggttagcaagcaaacatttcatttcctggagtagttgtaaacgctggaatgctatggtaggtcaggtaggatgatcaagatcagtagaggtcgtgctagccgtgtggcgcttggacgcgtggtatgtgctggctttattatatatacattctcggtggtagagcttagtggccatgtttattgtttttatgtataaatcctaaggatatttgcttgtattttttattaataaaattagacatcaacagtgcgatttgttaaaaatatgttatttgattttctaaattaatagtttctatgtacctaaaaataatttatatctaggtacgtatcaaaagtagaaaaacttaaacaacttacaatttat

SEQ ID NO: 5791 - DNA, 3607 bp, Zea mays
  misc_feature (692)..(692): n is a, c, g, or t
  misc_feature (1464)..(1464): n is a, c, g, or t
agattgcttgttggaatttgcggctggttctgattacacgaaggaatgcaactcaattattctctgtcatattcacatggcctaaataggcattgtgagattacaaacgtggagaaggcaacgcctaacatgcacgacgagccgataagtttgaagatttaaatctataacggatagaactacaaatccatatacatagccaatactaatataagagcatctcaaaaaatgcctcaaactgatgcctcaaatttaaatatgaagttttacgtagaaaaaaaaatactacaacagtgtctcatctaataaaatttggtcaaaaaattataagacactctctcaaatgcctcaaatatactacaccagcgagctgccctataatttagatttgatgctttactgttggagcgaaatgttttgtggtgcccttagttatataaaatatattgatttttaaattatagggcattttattggtaacatttttggagatgctctaatccatattcactaaattaccaaacggtaggactaaaaccgtgactaaactgttttagtctctagtctctcaagaggtgattagcatgttcgctcttggttttaatccgtatcgacttctactgtttctacagtgtttttgtctctctgaattgtagcatcagcagtttaaacagttggctttaatccgaagngaacaaccctaaaagggattaatccatattaagtctaccttttgtccctcatttatttcaactacactaatggcgaaaaaatggtaagatatattttagccttcttataagcatttaatatattttaagtatttttagtcactggaactaaacataatagaggcaatttttgaaaggttgccggcggagatggggagcgagggtcgccccgagtcgccctgtaggacgacgcgggccggaggagccttccagcttggccggtccgagtgaattcaataggttaacaaattagatcaagccctagagacaaaatcttagttactgagctaaactttagtctctatactaaaagaaccaaacatgccctaaagtctaaaattgaaggtccgtgaatttaaaaaatcgggctaaccaatcacacccatatcctgtccactgggaaagtacaaataaaattctggattctacgtcggatagagtgggctctgtttctcctttggctccaagcctccaagtagaagtagaagacacgtgaaaacgataaggccaatcatgcgcctattctatactagacttagatatcgcttaggcctcgttcgtttacgtcggattacaccggattcgttccagctaatcaaagtttatataaattagagaagcaatccggttaggaatcattccgacccaccaatcctacacaaacgaacagggccttactgaagcactgacagcagacactcaccatcctcgctcaaaaattccatggcctacncatcctagtactcggccgctcagtcgcttacaaatagccatggtgcatcgtgctccttccatctcatccaaacatggagccgttttttctgttcatagagcttgcccttgttctctgcttcatcactctgtactaccgccacttgcaatccaagaaaacgagccctctggagccgaccgaatggccagtagtcgggcacctccccggcttggtcgccaacatccaccgcttccacgactgggccaccggcgtcctcgccggcgtgggctgcaacttcgaagcccgcggaggccgcaccggcctgcggtacttcatcacctgcgacccctccaacgtgcgccacatcttcacgtccaacttcgccaactacccaaaaggcgaggagtacgccgcgatcttcgacgttctcggcggcggcatcttcaacgccgacggggagtcgtggcggcgccagcgggtgaaggcccagatgctcatgaccggccctcggtttcgagccttcacggcgcggtgcagtcgcgacaaggtggagaggagcctcctgccattcctcgcgcaccacgccgccgccgacgacgaggggaggccgacgccgtgcgacctgcacgacgtgttcctgaggctgacgttcgacatgacgtgcgctctcgtcttcggcgtcgaccctgggtgcctggcgctcggcctgcccggggtccccttcgcgcgcgcgatggacgatgcgctggagacgctgttcctccggcacatcacccccacggcgtgctggaagctgatgagcgtgctgggagtagggcaggagaagaagatggccgcggctcggaggacgatcgactgcttcgtcgccaccaccgtcgcgaaacgcagggccgacatgctcagagaaggagaaggcgagggcgtctgcagctcgttcgacttgctgtcatccttcatctgccacgaggacgactcgagtgaaaatgacgacgacgacgacgtgttcttacgggacacgacggtgaacctcctgctcgccgggcgggacaccacgggcgcggcgctgtcgtggttcttctacctcgtctccaagaaccctcgcgtggagcagaaactactggacgaactggcgcccatcgtcgcttcacggcggagagccggcggtgctgctgcagacgcggccagcggcatggtgaccttcgacgcggacgagctcggcagcggcctggtgtatctgcacgccgccctgagcgaatgcttgaggctgtacccgtccgtgccgttcgagcacaaggtcgcggcggccgccgacgtcctgccgagcgggaaggagctgaaggcgggcgacaaggtgctggtgttcaactactccatgggcaggatggagggcgtgtggggcaaggactgcacggagttccgccccgagagatggctcaacgaggacggaaccaagctccggtacgagccgtcctacaagttcatctccttcaacgccgggccgcggacgtgcctcggcaaggagatggcgttcgtgcagatgaaggccgtggcagcggccgtgctgtggaacttcgccgtcgaggtggtaccgggacacgtggtggagccgaagctgtccatcatacttcacatgaagaatgggcttgccgtcaaggtgaggagaagggacgggacgtacggcgccgcgccgccgtcgagcgtcacgccttgcttttctgagttctagtcttgtgactgaacacagtgacgacagtgcgtctcgcctatgttatgtgagcattgcgtggttttttagtcatatcctccggccggaatatatatagtataccaataccaacacgtctatgcatgtgcatggccgtcttcttgcacaaactagtagcggaacaacgatgaaactcttacgttcaaaaaaaaagaacaacgatgaaactctgtcgtgctcccaatgttcgtcatcggcaatagtctctgaaggtatctgcgtgtattttttatatattatattaatataaatcaggatttgttagtttcggttcctcaaaaaaatataagttattttatcttttctaaatttataatctgtatgtatatctagatatacatacagattacgtatataaagttacgtatctagaaaagttaaaataaattatatataatt

SEQ ID NO: 5792 - DNA, 1109 bp, Zea mays
ggacttcatttcttgcagctgccaatccaattacaggatgctatgacgctcttaagtgatcatgaacttatacattgaaataatggtgggcctcgagaggccaggaggtggagaggagttcaacaagtactacatcttgtctgctctcctatccgtggattgggtgcctgaaatatcctatagatgtctttagtagaggatccaaataatggcctgcaaggtttattgaatcggatcgcacaaaactccatctgcttcagaattgagctaagcgcatcctaacatcttgactcctatatcgatcaattatttttgttacacatttgattctttagtttcgtagagggaggaacatcgtgggatgcaggccccacggaacaccagatattttgaggtagaccgcggcgaggtgcccaagggcagcgcctagatcttcttctggatggtcaagttctgtaacgacaatgtggcagaggagatgccctgatcttcgtacgtcagtttgcctactaagcatccacaaaatctcattataagttctgagaaggccaagtcaattgttcagtatattacaaaagtcaggttggagaactcccttgttcaggcttttgtctttcttctgcagaaggagagatgacgtgctgcatgacatgatggcatgtgaggcagcaacctcttctccgcaacccttgtcatggcctggagttggtgttctaggaaggagcacaattttattagggtagccaccagagttgaggtcccttttcaatggacgaacttggtgctgtggacgacatctgctattgtagctaggcgcatacatgttttcctataaatgctagctctgcaatcaccaaaggaaaacacaagagtactcttggaggaaagtttagcattcagtttaacaaaccttaccaactcatgccttgtttgaatgcaataatgcatgttatgttgccctgttgttgcttggacacatgcttggcatggctattttctggttatgtcacaactcacatctcccatgtaaatttatggctatgatatgcatcaaacaagcttatattttgctcttaaaaaaataaaaagatagaaaagtgacaaggtaa

SEQ ID NO: 5793 - DNA, 2407 bp, Zea mays
ctaatatgtgataataattcatatgcatcttcaactcactatctaactacctattagcaggtgagtgcaaacagcttcctgctaaaagttagcaaggaatcggttgatacttattgatgtacgtgtttgttcattattattgtaccatgtttggttggaatatttttaaaagaatgttgaattatgaacgatatgagttattttatattctatattcttttggtttatgaaagggtccccgaggccgcccggggatgtctttagtagagggtccaaataatggcctgcaaggtttattgaatcggatcgcacaaaactccatctgcttcagaattgagctaagcgcatcctaacatcttgactcctatatcgatcaattatttttgttacacatttgattctttagtttcgtagagggaggaacatcgtgggatgcaggccccacggaacaccagatattttgaggtaaatatttatgggtcatttgtatttacttatgaggtttagatcaaatgatagatgatgttccgcatgattttggaattgcatttgtattgtataaacctgaatataaatgtcattcttaaatttgtgaagtagtatgaatgtctgatagcatcaaaaattggtgaagtagtctgatagcaacagaatctataattaattgaggtcttattactcacactagatcttgtcccccacagcccaatctgagccgaattgagctgatttggtcgaaaaatttgtggcgatcatttgtaggtagaccgcggcgaggtgcccaagggcagcgcctagatcttcttctggatggtcaagttctgtaacgacaatgtggcagaggagatgccctgatcttcgtacgtatgttacttactcccactctcaacatagcagtagtaagtgcttgtttctgatgaatgtatcaatcaatgctatgcgtcactgtgaaatgttcttctcaaacattgtcatttgatctgatgtataatgtaatgtggcatgtcctccatatcagagttctccctgcttatttttgatagttttgtgtcccagttataggtgttatgcaatgacctgtctttccctaatgcaccaaagcttggatgggtccgttgaaggttgtgtggtttatgtatgcttgtttgctccaaatataggtgttatgcatgaataaagttcccgtgggatctgaagctttgttggcttaaaatggttttttttgtatttttcacatgagataatttatgacgagctgagcaattgtcgattatcttagtgcaattgatgttggagcagaagttagtgtctgtttctattttctaggtttctgtgtttcaatggcctcttgaaaattgaaaatggcctcttgtaggctgaaggatgtatgcatggaatagaagtcagataaatcttttgtgcaacaggctgaagtcattcttgttgatgggaaattaacagaggctaaggctaaccagcttgctaaggtttaaatgcaggtcagtttgcctactaagcatccacaaaatctcattataagttctgagaaggccaagtcaattgttcagtatattacaaaagtcaggttggagaactcccttgttcaggcttttgtctttcttctgcagaaggagagatgacgtggtatgacactaaattctcctttatatgctccaagaaaaatcagttacgtaatgacaatatgtgtgctaactataaaattcccattgcagctgcatgacatgatggcatgtgaggcagcaacctcttctccgcaacccttgtcatggcctggagttggtgttctaggaaggagcacaattttattagggtagccaccagagttgaggtcccttttcaatggacgaacttggtgctgtggacgacatctgctattgtagctaggcgcatacatgttttcctataaatgctagctctgcaatcaccaaaggaaaacacaagagtactcttggaggaaagtttagcattcagtttaacaaaccttaccaactcatgccttgtttgaatgcaataatgcatgttatgttgccctgttgttgcttggacacatgcttggcatggctattttctggttatgtcacaactcacatctcccatgtaaatttatggctatgatatgcatcaaacaagcttatattttgctcttaagttggttcaaacagttctaattcattttaataattatctaaaattggtttgataattggtgcaataaggaactcatttgaaaggtaagagttatgtgttgtcttgtcaatcactgattgacatgtggtccaatttgattcagtcttattggtttgagctcttgtgacatgtcgtgctcgtgcaacgctcaaagaagacgagattgtatgtcgtagcaacgcacggacatgtactatat

SEQ ID NO: 5794 - DNA, 763 bp, Zea mays
acactcctatgggcgattgggaccctcgcgcccggatcttcttctggatggtcaagttctgtaacgacaatgtggcagaggagatgccctgatcttcgtacgctgaaggatgtatgcatggaatagaagtcagataaatcttttgtgcaacaggctgaagtcattcttgttgatgggaaattaacagaggctaaggctaaccagcttgctaaggtttaaatgcagtcaggttggagaactcccttgttcaggcttttgtctttcttctgcagaaggagagatgacgtgctgcatgacatgatggcatgtgaggcagcaacctcttctccgcaacccttgtcatggcctggagttggtgttctaggaaggagcacaattttattagggtagccaccagagttgaggtcccttttcaatggacgaacttggtgctgtggacgacatctgctattgtagctaggcgcatacatgttttcctataaatgctagctctgcaatcaccaaaggaaaacacaagagtactcttggaggaaagtttagcattcagtttaacaaaccttaccaactcatgccttgtttgaatgcaataatgcatgttatgttgcccgcaacctgagcggaaacatgcttggcatggctattttctggttatgtcacaactcacatctcccatgtaaatttatggctatgatatgcatcaaacaagcttatattttgctcttaagttggttcaaacagttctaattcattttaataattatct

SEQ ID NO: 5795 - DNA, 1255 bp, Zea mays
cgcccctgcgcccctcactgcgcatccgcatcactgcgtgtcctcctcctctccccctcactgcggcgcatccacatctgccaatttctccacctcctcctcctcgcccctgtgcctcgacatctcgcatccgctccatctatggaaggccaccacgcgccatggatcgccgctctctaccgccacctcaattgaaggttcaccgctctctacgcggatccgccacctcctcctcggccgccgtcaatagaaggtcccagatctcctctcccattacttctctccccattaccgcgctcgaggtctgccatttttggaggtccgccacttccgcctctgctcgccgtcaatggaaggtcctagatctcctctccctattaccgcgctcgagtcagtgggaggtccgccatttttggaaggtccgccacctcctcctcgacccgcggcaaaaatggcgtgggagatccgccacctcctcctcggcccgcggcaaaaatggtgtgggagatccgccacctcacctcctcccattctcacgcccgcgcctgatatggaaggtccgccgaagggactcggacgtcgaggccatggctgagccgcaccccttctccccctgcctcgcgcgcggcggccgagatggtgttggctgggttgttcgggatggtggtcctacctgccctccctgctatcctcgccccaaatcgacgagaatcatgcagcccaaatctgaggtggaggcgcctgcactgtcgatggaggtgtcgagtctgtggtcgtgtatgtagatgggaaggcatggtgtggccaggtggtgtcgctgagcctgtcctcctacgggctcactggcacgctctccacggccatcggggacctcacgttcctgcgtatgctgaacctgagctccaattggttccacggggaggtcccagcgaccatagctcgccttgcgcatctgcaggcgctagacctgagctacaacgccttcactgaattccagagatgcaattcccgaggccatggagcagcagacaatatcaattgccaaagcagccattacaatagtactcattttagggacttcatttcttgcagctgccaatccaattacaggatgctatgacgctcctaagtgatcatgaacttatacattgaaataatggtgggcctcgagaggccaggaggtggagaggagttcaacaagtactacatcttgtctgctctcctaaccgtggattggtgagtgcaaacaacttcc

SEQ ID NO: 5796 - DNA, 1860 bp, Zea mays
agcacgagaccatcacctagaacatcctaatcgaaaaaaaacgttagccttttccaatcagggagagagctcaaacatggcactcgaacccgtcgctctcctgctcacggtcctcgtcgccgcgccgctcacggtcctcctcctcctcctcttcctcgtcgccggcaacaagaggcccgctcgtgctgcttctcccacgccgcgccaccgcttgaggctgccgctgccgccgtcgccgcggggcctcccgctgctgggccacctgcacctgctgggctcgctgccgcaccgcgcgctggcgtctctggcgcgcgcgcacggccccgtgctgctgctccgcctgggccgcgtgcccaccgtggtcgtgtcctccgctgccgccgccgaggaggtgatgcgggcgcgggacctggcgttcgcgaaccggcccgcgagcgccatggccgtgcgcctcctctacggccgcgacgtcgcgttcgcgccctacggcgagtactggcgccaggcgcgccgcgtctgcgtcgtccacctcctcagcgcgcgtcacgtcgggtccttccgccgtgtccgagagcaggaggccgccgcgctggtcgcacgcgtcgcccgggacagcgccggtggcgcggccgtcggcctcagcgatctcctcaccgagtacgccaacgccgtcgtgtcgcgcgccgcgttcggcgacgagagcgcgcgcgggctgttgggcgaattcgactccggccgtcggcagaggaaagtgctcaccgacttccagaagctcgtggggacgacgcccgtcggggagctgctgccgtggctgggctgggtggacgccgtcacggggctggaggggaagatcaggcggacgttcgaggcgctcgacgggttgctcgagaaggtgatcgatgaccaccggcggcggcctcgcagcggggaggagggcggtgaccgggacttcgtggacgtgttgctggacgtccacaacaaggaccaagagcacggcatccaactagagaccaacgaaatcaaggccatcatcttggacatgttcgcggcaggcacggacacgatagccacggcgatggaatgggccatggcggagctcgtcacccacccgcgtgccatgcggagagcccaggacgaggtccgcgcggcggcggccggctcaaccggcgtgaacgaggaccacgtcgcgcagctggactacctcaaggccgtgctgaaggagacgctccggttgcacgcgccgttgccactgctggtgccccgggagccggcggcggacaccgagatcctggggtaccacgtcccggcgcgcacgcgcgtgctggtcaacgcctgggctattggccgggaccccgcgacgtgggagcgcgccgaggaattcgtgccagagaggttcttgggcggcgccgccgcagctgacgtcggcttcaaggggcagcacttcgagctcctgccgttcggcggcggcaggaggatgtgccccggaatcgcgtttgcggagggaagcgccgagatggccctggcgagcctgctgtatcattttgactgggaggcggcgagccggggccagaacgggaaagggacgctgtcgctggacatgaccgagatgaacggattagccgtgcatatcaactccggtcttccgcttgtagccaagccgtggatccccttcaagaactaggagaagatattggagatatttggttttttactgcaaacaatgtgcttgattttaatgttattttagacatttttgctcttcttcgtccttctccctttttccctttttgtgtgtgtacgcttgtaaaaaaagacaaaatatcaaaataatctctactaccccgaaaaaaaaaaaaaaaa

SEQ ID NO: 5797 - DNA, 1182 bp, Zea mays
cgaggggaggccggccgcgcgcgcctctagctggctgaacgggtctacaaatatacactactactccactaatgtcacatatccacaaccaggtgatctcaagtaattaacagaaaatatattccatcattgaaaatgagttccgttgttttgggtgctactggtagggagaataagacatcatggcctgaggtggtgggcatgtccatcaaggaggcaagagagatcattcttaaagacatgcccaacgctaacattcaagttctaccggttggctcgcttgtgacccaagactttcgccctgatcgtgttcgcatcttcgttgatattgttgcccagactccaacagttggctgacaaggatatgccttatctataggccaaataaacaaagcctacttttatgtatcatggctaataaatcctacatttcttggttatccttgattggtttagcttattagctatatcgccatcaaaaggggccccaagaaattacatgtatgtctatcataaaaatctcatcccgatggaatatataataaataaataatgatatataaaaaaaaaaaaaaaaaaacctgcccgggcggccgctcgaaccagatatactaaacacaacacaacattgatgtcaaattagaggcatgggtaaactaaatgtgtctttggtaatgttgctcatgtaaacatattcgataatagcactaatcatagactagtctcatctaagcatgtctctaatgaaaggagatcttgttagtgtcatgtttcaataagagatatatttgatgtgatccccatcatatatgtgtgatctaggacaagctcatcagagacacaattatcaatatttatttcaaaaaagatcaaatatagacgtgtaaattcaataacctcattagaggcatgatctttaatacatgtttatgatgatttgaacctcataggcacaaacacatctctgatgaggtaaccatggttggcaacccaattctttctactcatttaggcatgtgcacattccacaccacctcctcctctcccctaccattccatgcgtactactttgtcaccaccccaaaaatcccatgcaatcttgcccctgttaatgagtgtgccttgccacccacaccacctgctccactccccatgacaccagtggtgctacactacgaagcc

SEQ ID NO: 5798 - DNA, 611 bp, Zea mays
  misc_feature (587)..(588): n is a, c, g, or t
  misc_feature (590)..(592): n is a, c, g, or t
  misc_feature (594)..(596): n is a, c, g, or t
cgtcctctccagtagtaagttcaccttagtgagctcaagtagtttgtatacatgtttgatcaatgttgatgtctacttctcttgctaaatcgattcccctcctatttctccacttggtgatccctactgattaactgaaaatatattccatcattgaagatgagttccattgttttgggtgctactagtagggagaataagacatcatggcctgaggtggtgggcatgtccatcaaggaggcaagagagatcattcttaaagacttgcccaacgctaacattcaagttctaccggttggctcagttgtgacccaggattttcgccctgaccgtgttcgcatcttcgttgatattgttgcccaggctccaacagttggctgacaaggagattccttatctataggccaaataaacaaagcctacttttatgtatcatggctaataaaacctacatttcttggttatccttgattggtttagcttattagctatatcaccatcaaaaggaggaccgagaaattccatgtatgtctatcatacaaatatcatcctgatggaatatataataaataagtaatgatatagtnngnnngnnngggggggggggtggg

SEQ ID NO: 5799 - DNA, 827 bp, Zea mays
cctcgaggccggccgggtcctcatccttctcctcacctatacctccttcagcaacactgcgagagcctccctcctcgttcggttcggacttttgcttcggcgacttcacgcggtaggccaccgtaaaccctagccccagaccgcgggtcgtagccaacgagatgcagctcttcgtcttgacgctgacggggaagaccatcacgctcgacgtcgagagcagcgacaccatcgataatgtcaaggccaagatccaggacaaggagggcatttcgcctgaccagcagaggctgatttttgctggcaagcaattggaggatgggaggacattagctgattacaacattcagaaggagtcaacactccctttggtcttgaggctcaagggtggaactatgatcaaggtgaagacactaactgggaaggaaatcgagattgacatcgagcccaatgacacaattgataggatcaaggagcgtgttgaggagaaagaaggcatcccacctgttcagcagaggctcatttatgctgggaagcaacttgctgatgacaaaactgccaaggattacaacattgaaggtggttcagtgctccatcttgttcttgctctgaggggtggttgctagattaaaaagttcttgtactttctgcttatgctatctgttacatggagttgttttagaattgaagccttgtattgggtggttgattgtaccatgtgattagcacactactagagtcaggtgtcatctgtactgtttaagaaatgcttgaactagttcattcagttgtcaaaaaaaaataaatctcattcttattgccccggtctg

SEQ ID NO: 5800 - DNA, 3336 bp, Zea mays
gcaaataattgtatattctgataattctgttaattctatatgtatgtatctacatatatcgctacccttatatatctaaagcaagacttttaaccgtataagtacatcggtcaaagactcgtgcgagacgcgatcaatttactagtttgaaataaatgggatattatttctctctctaaaatatactaaaagtgcacttattttggaatattaggagtactctatggttgacaataaacaaatgtgtgtgagaagtaaaacaggaaaaaaaaactactctttctagtttctatttttctattagttaaaaaaagcactttacgaaatgaagaactagtttctccgtattatgctataatagggcttgtcttttccattcaagtaatttggtggatgtaaattgaactagttttactgaaacagtttgatggagaatattatggaagccctaggactacccaaaaaaatcagggtagaatatagggaaaccattaaaaagacagtaggcagtgttcagtctctgttccttatatctagtcatctagaaaagcatatacagattttttttacgaaaaccttttttccgcatgaaaggctcgatctggcaggtgcatgttatctgaagcactttttcatgtatgtcctgctcctgtccacgttgcccaacgcttcaaaatatctaccacgccacctctaatacaggagtacacacacacaaagcaaacaagctgaaatatctgcagaaaaataaccggccagccctggagctgcttctcggctcttccaacatcccgtacctgccaccgttcagttcagtcttcagttatccgctgccactgccaggcgaccaacacgtgaccgtggatcagccatgcctgcgcttctagtgaacaccgtctcggtctcccccgccgcctcaaggctaggctcctcgcggcccgccacggcacggcgagcagcaagcgctcgccacggccacaggtgccgagccgaagcatccggcagctcgtgggtgtcggactacgacctgtacgagctgctgggcgtggagcggtcctcgccgcagtcggagatcaaggcggcgtaccggtcgctgcagaagcggtgccacccggacgtggccggcgccgccggcggccacgacatggccgtcgtcctcaacgaggtgtacgcgctgctctccgacccggacgcgcgcctggcctacgaccaggagcaggcgcgccgctccgagttcgccggctacacgggccgcccgctctactcctcctgggtcggcgccgagtccgagcgccgggcggtgttcgtcgacgaggtgcgctgcgtcggctgcctcaagtgcgcgctccacgcgtcccggaccttcgccgtcgagtccgtctacggccgcgcccgcgccgtcgcgcagtgggccgacgacgaggacaggatcgtcgacgccatcaacacctgccccgtcgactgcatctcgtacgtaaactcactcttcgtcgtccatgcgcatcccatgcatcgtcatcggcgatcggtcttctgattattccccacggccggccgtccaggatggtggagaggtcggacctggcggctctcgagttcttgatgtccaagcaaccgcgcggcagagtccgcgtctccgaaggcaacgcggtgggagctcgcgcgcccaacatcttcaacgaagtcgccaagttcaagaaaaggttcgatgagatgaagcagaaatctgcggccagagaattccaggtgatcgctcactgtttctgtcttctccgttgttcgtctgaaactgacacgaccgaacgctgcctgcgcaggagtcggaggcggcacggcagtcgaggacttcagcagtccacgccatcagatccatgtcgaactggtggtactggcggccattcgggttcgggccatcggccccggtcaccattgtcctcgcttcgcgcctcctgccgccgccgccggcggcacccgctgaccccgtgacggagaggctccaagaagcagccgccgcccggcgcaagacgggaggcgcggccacggcgcacgcagggcgcgaagactactggaccccgcagctgaacctgccgtcgtcagcttctccgccgagcattcaccagaggggaaggggcactcccactccccaaggccacggccgcaggcgaggagcagccggtgaagcgaccgtcgccgggaggaagggcataagcatcgacctgacggcgccgctgctattggggatcgtcgcggcggggttcgtgagttacaacggggagcaggtggccggaggtggcagcggcattcaggagcatgttggcggcgccatcgctcttggagtcgtcaacagctttgaaatgaaggtcgttctggccggggtgacttggtccatcatcggcgcagccattgccggtgtgattcaggtactcggaagaagggaagaggacatttggaaatgaagatacttgtcgaatccgtgtgtgtgtatatacacagaaaattgtgtacatatgtaatgtaatcctgcacaaatatgggtggctggctgttttatagaatcacttggggtagctcatgcgggcctagaaaaggtagaaaaagtcggaactccttgtcaccctacatcccaaaagaatttgcagttctaacataataatttgcggtgctaaatgactcagcatagagatatttttatttatattattttatgttataaatatctagaaaactgtatttctagggggggggggggggacaaaagatcttatactttagaaaaagacagaggaaacacgtaaagtctaaaaagcaagcaaggacagatctgcggttacgccccacctaaatcagggtcactgacgcaattgcctctagaaaaaaaggccttaaaaactgttctatgcacatgcattggaccatgaaaacatataataatagagagaacagattaacagttcatattttgtgtttagtgccgaaaaaatccattgccttggattgatcaaagacaagtttctattcaaatatgtcattgcgcctacaaaaactttaatagttcggccatggatgctcaacaattaaaaattactcgctgttgccacaattggttcctcaccgattacacctaaaccgaatgaggggaaagatgttcttgacttcgagctgaactgatgctatggctgctaatagtcactctcgccaaagcaggtgcccataacaacgaccccgccctctcctgaggccactcagattcagattttttgacaatatgtacttgtctgaggtaatagctctccaaccacttcactagcgatgacgcctcaggacctgttcttgggg

SEQ ID NO: 5801 - DNA, 1304 bp, Zea mays
cattgggacctcgagccggccgggaaaaaaactgaaatatctgcggaaaaattaaccggccagccctggagctgcttctcggctcttccaacatcccctgcttgctaccgttcagttcagtcttcagttatccgagtgaccgtggatcagccatgcctgcgcttctagtgaacaccgtctcggtctcccccgccgcctcaaggctaggctcctcgcggcccgccacggcacggcgagcagcaagcgctcgccacggccacaggtgccgagccgaagcatccggcagctcgtgggtgtcggactacgacctgtacgagctgctgggcgtggagcggtcctcgccgcagtcggagatcaaggcggcgtaccggtcgctgcagaagcggtgccacccggacgtggccggcgccgccggcggccacgacatggccgtcgtcctcaacgaggtgtacgcgctgctctccgacccggacgcgcgcctggcctacgaccaggagcaggcgcgccgctccgagttcgccggctacacgggccgcccgctctactcctcctgggtcggcgccgagtccgagcgccgggcggtgttcgtcgacgaggtgcgctgcgtcggctgcctcaagtgcgcgctccacgcgtcccggaccttcgccgtcgagtccgtctacggccgcgcccgcgccgtcgcgcagtgggccgacgacgaggacaggatcgtcgacgccatcaacacctgccccgtcgactgcatctcgatggtggagaggtcggacctggcggctctcgagttcttgatgtccaagcaaccgcgcggcagagtccgcgtctccgaaggcaacgcggtgggagctcgcgcgcccaacatcttcaacgaagtcgccaagttcaagaaaaggttcgatgagatgaagcagaaatctgcggccagagaattccaggagtcggaggcggcacggcagtcgaggacttcagcagtccacgccatcagatccatgtcgaactggtggtactggcggccattcgggttcgggccatcggccccggtcaccattgtcctcgcttcgcgcctcctgccgccgccgccggcggcacccgctgaccccgtgacggagaggctccaagaagcagccgccgcccggcgcaagacgggaggcgcggccacggccacggcgcacgcagggcgcgaagactactggaccccgcagctgaacctgccgtcgtcagcttctccgccgagcattcaccagaggggaaggggcactcccgctcaccaaggccacggccgcaggcgaggagcagccggtgaa

SEQ ID NO: 5802 - DNA, 5879 bp, Zea mays
ccgccgccaccaaaaaatcacccctgtgtttacctcgcccccacgtgactcttatccaaacactatagaaaattgtatctgtcctcttccatccctccttatacatccaaccaaacacacccttagatgacttggacgattaatcacgattagtcggacgacttggccgattaatcgcgattgctccaaaccgacttagacgattgattgcaacttatcgtgattaatcgaatgacttgaaaacattggggacaaaaaacttatttggtgtttttcatttgggttatttgagatggtagaatgttgattagctgcacaacaactagaaatgctctatcccaagatttcaaagatataaatgcattagctagtgaagccaagtctacttctaagcaaagtctacttctataatatgacgatgttttctttgtacaacatattctgctgatgagcatgaggataaaagaaacatgatgaacattttttatttttttgaaagaaggaattcaacttcttgcgctctctacgtgaatctatttgcatggtaagttttttatcgaattgtctttcgacaagattttgaaagttgtggaagacttgaaacatgctagatttgttttaaacaagtttatcaaagtgtatttactaaaatcattaataaaattgatttaatacttatttcaaccaataaattgagaggcatgtcacatagagtgaaaaagtttaagaggacaaggtgataatccctccgtccaatttataattcgtttgacttttttttaccaagtttggttggctcatattattcaatttttgtgtgaaaacaaatcaaagacatacttaaagtatattatatgttaaatgatgtcacaataaaaaaaatatggacttttttgaataagatatgtcaaaattgagctaaaaaaggcgaacgaattattagttgaaacacagataatatcatatttttatcttggtatagaagctgatgatgacttttttttacaccggtgtccggtggtagaactaaaagaacacggtatattagagcaaatgaaggatgatatgaatgagtgtgctaggaatcgattgcgggctgcaagagcacgtccaattgcacaatctgaggtcatgtttagtacccatagagctaatggttaatcaactattacattattagttgcgttgagctagctaatgatatgtatagtgaagagacattaaaacggttctccaaacaaaagagacaactaaaaagactctattatataataatagagtgtctataaatatagtctattaataaatagagaagtgaccgtgtctataaatatagtctattaataaatagagaagcgaagtcgtcttgttactaattaggttatgagtcagatacgtctctttacagagaaacgacttcacgatttttttttgcaaatatactttagacatctgaagagcatttatattaaacaccactctacatgttctagtaaactaatttgttagatgtgaccatatgagatagctacgatattagctaagtatgtttataatacatcaactaatttttaatcgtgaagtattagttttagaggtttcccaacagcgaggcagttaccgatcgattaatgctgtggctgtgctgtgtccttggcaaacatttaccagtcagccgttcagtttgctttacctgcctttcgaacgaactctcaattctttcctcccctgaggtggttgcattgcaacatggagatagatgtgcatcagagcgccgccgctgctggtgttggagtatactagtagtatatataaccacactccccgccccatctcgatctccacagccacagcacccggcagccggcagccatgcgaagccgccccctcctcctgctcctcctcctcgtcgcggcgacggcggcgcccacggcgtcgccgtcctcggcgttcgcgtgcgcgccgggcggccccgcggcgtcgctgccgttctgccggcagtcgctgccgctgcgggcgcgggcgcgggacctcgtgtccaggctgacccgcgccgagaaggtgcggctgctggtgaacaacgcggccggggtgccgcggctcggggtggccggctacgagtggtggtccgaggcgctgcacggcgtgtcggacacggggcccggggtgcggttcggcggcgccttcccgggcgccaccgcgttcccgcaggtcatcggcaccgccgcgtcgctcaacgccacgctctgggagctcgtcggacgggtacgtgccgtgccgtgccgtgcgtgttactaggagcgagctttggcttggcattgccgccgccggcgacgaacgcccctgtgggctgtgcgtcgcattgcgtgtctgtgtctgtgtgcgcccgcccgctcttggcctctggcgttggcgtcctccgccgcgcctgtctcgttgctatggttgccgaggcttggccgtggcagttggggggcttgggttcccgtgcagtcagactgatgattgctctaaactgctgcggcggctactgccacggaaccgtcggatccaaatctaccggtaactgtttctgtgccagagctggaatctttgccttttgcgaggcgagatggtcactcatgggctcatggcgacccgaccccatagccgtagtaaaagagggctcgtgatagcacagtgccgctgggggccaagcaatttgaggccacgtgattggccggaccgccagacagagatgtcaggccatcctgcctcggcagccgtgcgcaccccacccacaccacacactctccgtctccgactacgaccatggtccatccatggcgatcaactcaaggctgacaaatccattcatccattattatattattatatactgatgatgactcgtgcatgcctgcaggcggtgtccgacgaggcgcgcgccatgtacaacggcgggcgggcgggcctcaccttctggtccccgaacgtgaacatcttccgggacccgcggtggggccgcggccaggagacgcccggcgaggaccccgccgtctcggcgcgctacgccgccgcctacgtgcgcggcctccagcagccctacgccgccccgaacggcggccaccgcaaccgcctcaagctcgccgcctgctgcaagcacttcacggcgtacgacctggacaagtggggcggcacggaccggttccacttcaacgccgtggtggcggcgcaggacctggaggacaccttcaacgtccccttccgcgcctgcgtcgaggacggccgcgccgccagcgtcatgtgctcctacaaccaggtcaacggcgtgcccacctgcgccgacgcggcgttcctgcgcggcaccatccgcggccgctggggcctggacggctacgtcgtctccgactgcgactccgtcgacgtcttcttccgcgaccagcactacacgcgcacccccgaggaagccgccgccgccacgctccgggccggcctcgacctcgactgcgggccgttcctcgcgctctacgccggctccgccgtcgccgcgggcaaggtcgccgacgccgacgtcgacgccgcgctcctcaacaccgtcaccgtgcagatgcggctcggcatgttcgacggggaccccgcggccgggccgttcgggcgcctgggccccgcggacgtgtgcaccagggagcaccaggacctggcgctcgacgcggcgcgccagggcgtcgtgctcctcaagaaccggcgcggcgccaagcacaacagggacgtgctcccgctccgccccgccgcgcaccgcgtcgtcgccgtcgtcggcccgcacgccgacgccaccgtcgccatggtcgggaactacgcgggcaagccctgccgctacaccacgccgctgcagggcgtcgccgcgtacgccgcgcgggttgtgcaccaggccggctgcaccgacgtcgcgtgccgcgggaaccagcccatcgccgcggccgtcgaggcggcgcgccaagccgacgccaccgtcgtcgtcgcgggcctcgaccagagggtggaggccgagggcctggaccggaccacccttctcctccctgggcgacaggccgagctcatctccgccgtggccaaggcgtccaaggggccagtcatcctcgtgctcatgtctggcggtcccatcgacatcgcgttcgcgcagaacgaccccaggatcgatgggatcctgtgggtcggctaccccggccaggccggaggacaggcgatcgccgacgtcatcttcggacaccataatccaggtgggaagctgccggtcacatggtaccctcaagactacctgcagaaggtgccgatgacaaacatggcgatgcgcgcgaacccggcgcgcgggtaccccggccggacgtaccggttctacacgggcccgacgatctacccgttcgggcacgggctcagctacacccagttcacgcacacgctcgcgcacgcgccgacgcagctcaccgtgcgcctctccggcagcggccactccgccgcgtccgccgcctccctcctcaacgcgacgcttgcgcgccccgtccgcgccgtgcgggtggcgcacgcgcggtgcgagggcctcacggtcccggtgcacgtggacgtgagcaatgtcggcgaccgcgacggcgcgcacgccgtgctcgtgtaccacgcggcgccctcgccctcgcacgctgcccccggcgcggacgcgcccgcgcggcagctggtggcgttcgagaaggtgcacgtgcccgcgggcggcgtggcgcgcgtggagatgcgcatcggcgtgtgcgaccggctcagcgtcgcggaccggaacggcgtgcggcgggtccccgtcggcgagcacaggctgatgatcggcgagctcacgcactcggtctcgctcggcgtcgagcagctcggggtataaccggatgcttgaacggaaggtggaggatccagagtaataattgtgatgtgatgtgttgtttcgggtggggggtattattggcttctgattgccggggtgcttgctgctgtctctgcaaaggtggagatgggagatgtagaaggcaccggattactgaaaattgctggattgaaaacgaaaacgattgaaatggaaggaagacagaagaatgttgtttccctcctccatactgatgttttttttcctgatctttatctaaacaaaatcctatgctttctgacgtcaagattagtgcatttcatggagatcagattgaaatagctgtgcctcagctttgcaagaaaacctctgcttttcatggacatccgattggataatcttcaatcaggcccatgaatttgggttctggtgactccaccaaaattcagtttccactgttcatgcaccaatttctttgttgagagaaaacaaaaaagaagtcttctttgctgatgtctgatgaattgtccaaacaagacaagccacctaactagacaatgccacaagcccacaacgttcagcctcacaaagtaaagtctgaaaagttatctttcaatctatacaggagtcaggagggggaaaaataacacgaaaaaacagacaaggatagctagagaaagcaaagcattgtgtgacttgcgaactttatgcttttgtactgttggttggctccacatgtatcgaatagctctacagggccacgaatatcggaatattaatgcattatattttttctaacaaatacgaggtgacctcgagcacttgacaatgtcgtcaagataattttacctagatgccttgatagtatcatttatattttgatgtcaaattttctgtcgagcttacaacatctctaatagttcatgaaaatgttgaatcaatgagtttcctaaatcctaagcgactcaaagtcgagagaacattttttagataatggaaacag

SEQ ID NO: 5803 - DNA, 1657 bp, Zea mays
gagcgacatgaggctcagctctgtccggcctgttgacccagatgcatggtgtatttaacaagcacacaatcccgccacccaccgcccccgccgcctctccctcacgttggacatggatcatgctgcatgcatgcatctcttcttaaccacctgactaatactgcctctttgtgctttatttctccacatactactaccgcacaaacgctgtcatggcagcgcttgtggcgatactaatgcacctcctggtcccggcgctgctgctgatgagagtcgtggcagtggtggcggccggggcaccgccgttctcgtgcggcggcggcggcccgtcgctggggttgccgttctgcaacacgaagctccccgctgctcagcgcgcggcggacctagtgtcgcggatgacacccgcggagaaggcgtcgcagctcggggatgtcgccaacggggtgccgcggctgggcgtcccctcgtacaagtggtggagcgaggccctgcacggggtggccatctcgggcaaggggatccacatggaccggggcgccgtccgctccgccaccagcttcccgcaggtgctgctcaccgccgcgtccttcaacgacaacctctggttccgcatcggccaggccacaggcaaggaggctcgcgcgttctacaacatcgggcaggcggaggggctgaccatgtggtccccgaacgtgaacatcttccgggacccgcggtggggccgcggccaggagacgcccggcgaggaccccgcggtggccagccggtacgccgccgcctttgtccgcggtctgcagggcagcagcagcaacacaaaatcagtgccgccggtgctgctgacatcggcgtgctgcaagcacgccacggcgtacgacctggaggactggaagggcgtgacgcggtacagcttcagggccaccgtgacggttcaggacctggcggacaccttcaacccgccgttccggagctgcgtggtcgatggaaaggccagctgcgtcatgtgtgcctacacgtccgtcaatggcgtgccgtcctgcgccaacgccgacctgctcaccaagaccttcaggggaagctggggactcgacgggtatgtcgccgcggactgcgacgcggtgtccatcatgcgcaattcacagttctatcgcccgacggcggaggacaccgtcgcgaccacgctcaaagccggattggacatagattgcggtccctacgtccagcaacacgccatggccgccatccagaaggggaagctgacgcagcaggacgttgacaaggccgtcaagaacctcttcactacccgcatgcggctgggccacttcgatggcgaccccaaggcccacgtgtacggcaacctcggagccgcccacatctgcacgcaggagcacaagaacctagcgctcgaggcggcgttggacggcattgtcttactcaagaacagcgccggcgtcctcccgctcaagcgagggtcggtcgcctctgccgccgtcatcggccacaacgccaacgacgttctcgccctcctcggcaactactggggcccaccgtgcgcgccgaccacgcctctccaagggatccaggggtacatcaagaacgtcaggttcctggccggctgccacaaggcggcctgcaacgtcgccgcgacgccccaggc

SEQ ID NO: 5804 - DNA, 1455 bp, Zea mays
gccccacagcacgagaaggaaaataaactagggtttagccggggccacacggcaggctccacggcgtggttatgtccgcctttattctccccccactcgtctgcttcgcctccacctatccgccgcctcccaatcatcctgcccccaaactcccaccccgcagcatccccacgccgccgcacctcgtcgcgtcgcgtcgtcaccggcgtgaagatggtcgggccaggcctctacaccgagatcggcaagaagaccagggatctgctgtacaaggactaccagactgaccacaagttcaccctcactacctacacctccaatggcgtcgctgtaactgcttctagcacaaagaaagctgacctgatccttggcgagatccaatcacagataaagaacaagaacatgaccatagatgtgaaagcaaactcggagtcaaatatcattacgacaattactgttgatgagattgcaacaccagggctgaagaccatcttaagctttgctgttcctgatcagagatctggaaaggttgagctccagtatttgcatgattatgctggagttaatgcaagcatcggtctgacagccaatcctgtagtcaacctctctgctgcctttggtactaaggctgttgcagttggtgccgatatctcacttgatactgcaactgggaacttgactaaatacaatgctgcactgaggttcactcatgaagaccttgtcgcatccctgaacctgaacaacaagggagacagccttactggagcctactatcacaaggtgagcgaattgaccaacacagctgttggggcagagcttacccacagcttctcgaccaatgaaaacaccctcacctttggcgggcagcacgccctggacccactaaccgttttgaaggcccgcattaacaactctggcaaggccagtgccctgatccagcacgagtggaggccaaagtcgctggtcaccatctcggccgaggtcgacacaaagaccatcgagaagagctcgaaggttgggattgctgtggccctcaagccctgattggttatacagaccattttttccccttctaagttcctagcatgactgtttgggtcagatcagatcagctggggaaaacaaaactgttggggttcctggcatctttgtttgctgtagtcagttgatttaatgaactccgaaatgtctcatggaggaaaattttcggtcgcctgtgtagcgctctgttaaatgagcaaccttcacaataattcaagctcggtagaattctgaacttgtttacgatgattgatggtgactgtcaactgagttaggggaggttctgttttcagcaaccatttttctaccttgtggtgtcgaggactttacccaatcgattcatgtgtttttgtggtgcagtatttagttaatgtcaagcgttttttattgcaatttaaaaaaaaaaaaaaaaaa

SEQ ID NO: 5805 - DNA, 1723 bp, Zea mays
tgggaccctccacccggcccggggctcctccccactctccgtcctgctccggcaagaggcggcacaccgcgcaaggatgccacctagggctgctccggcgctgcgggtgctcccgctcgcgctcgcagcggccatcttctcggggctcaccgccatcctcttctacctctccggcgtctcctcctcacatagcggctctcggctctcggaggcggacctggcggcgctcgccgcgctgcggggtggcttcagcaagtgcgtggatgcaaatgggctaggactgaaagccgtgaccggggaggactactgtcgtgttgtgatacaatacccaagtgacacagtttctaagtggagagatccaatcacccataaggctgaaagtctgtcgtttgagttcaatctgtgtgaagctgtggcctcatgggagcacgtccggaacagtacaacagtactcacaaaggagtacattgatgctttgccaaatggctgggaggaatatgcatggagaagaatcaacaaaggaatccttctgaataagtgccagaacagaagcctctgcatggaaaagctctcactagttctacctgagacatcaccatacgttcctcgccactttggtcgatgtgctgttgttgggaactcaggtgatcttctcaaaactaaatttggggatgaaattgattcttatgatgctgtcttcagagaaaatggtgcacccacccagaattacactgaatatgttggtagaaagagtacatttcgccttctgaatagaggatccgcaaaggcactagataaagttgttgagttagatgaaacaaaaaaagaggcactgatcgttaagacgacaatacatgatatcatgaaccaaatgattcgggaacttccaataaccaatccagtatacctcatgctaggcacatcatttggttcctcagctaaaggaaccgggcttaaagctcttgaatttgccctctccatctgtgacagtgttgatatgtatggcttcaccgtagacccaggttacaaggaatggacaaggtacttctcagaggtaagaaagggacacactccactacatggtagagcatattatcagatgatggaatgtcttggtctggtgaaaatccattcaccgatgcgaggagatcctggcaggacagtgaggtggctgcctaccaaggctaccatcgaggctgctagagttgcttccgagaagttgttgaagagacctggtgctggaagtgatgatcctctggggacttgcaccatgataaagaagcgcaggaaagggaaggcgccaaacagatctggtctacgagatgctgccatgaagcacctcgaggacatgaaaggtgccgctaggtatcccttggagcggaatgcagggggtggttacctctgcatgatcaatgatagataggaccgcggctgattatggcatcagttgccccctcccccctcccctccacttgagtcgaagaaaggaatgcagtttgagggaacgaaaaggccgattctttgatttatgcagctggtgtacaacgtttgagtgtagagaaagttaggtgtaatgttttgagtgtagagaaagttatatgttgtggatggatacaaatggtcaaattgtagcacttttggtgcttataatactaatttccgcaaaaaaaaaaaaaaaacgaaaaaaaaaaaaaaaaaaaaaaaaaaaaaaaaaaaaaaaaag

SEQ ID NO: 5806 - DNA, 1298 bp, Zea mays
cgggcggtaacaagtttgaatagtccggtatcaaattttagtacggtatctgattacggttggactaaaacaaacatgatttaacgtaatgacttacccattacgttacaaatatttgaaccaaacggcacctcagtttcttctacggccgcctcgagcagcgcgtgccgacttgataccctgggaaagagtccatggcgtcctctgcccccggcagaggaggaagacagctgatcctactaccggccgcggcggcggctgtggcggtaatggtactaattggggcggaaccggcgtcggcgtgttacccgcgcgtgttcagcttcggggactcgctggccgataccggcaacttcaggttctactacggcaacagctccggcgagcccgcactccggcaaccctacggcgagaccttctttcgccgcgccacggggcgattctccaacggccgcctcatcctcgacttcatcggtaaactacaaacgcctatctgtcagtcgaccgttcgatcaaattatcctgcgtggtaccggtaatactgattcgagatttgtcgcgcgactgcagcggacacgatggggctcccgttcgtgcggccgtatctgagcggtcgccgcgcggaggacttcgcgtccggcgctaacttcgcagttggcggcgccacggcgctcggcccggacttcttccgctccaggggtttcgacatcggcgacggacgtgtgcacctaggcatggagatgaagtggtttcacgatctgcttgagctcctctgccgcagcggccgctccggtatggttgctcccttttacctcctggactccatcctctgccttcgacctgatctttggaatcccactgctatcggggggagagaggaaattctagtggcggatggggaaagtagcatatagcaaatgaacaaaaaaaagttcgatgtataaggtgtggtgtgcaggtgtttggcgatggaacgagaaaggtgcgcgtgcgatgcaaaggtgttgatagggaatgtttgaattgtccaaagttatccttctaaatctaaagagaagaaataatcgagtgaatggtgatataggcaaaatgattcatcattgatggtagcagcaataaattgacgcttgtggatggtatcggtccaatgctaatcggacagtctatacagtcattgtcaaaaccagaactgaaagttcagtccatatcatcagaagccgtggcccaacattcttctgcatcaggtttttcttttggtgtctcaaatcaccataacattgttccccaaaggtgacaac

SEQ ID NO: 5807 - DNA, 1144 bp, Zea mays
gcacgagaccattacctataacatcctaatcgaaaaaaaaatctcgccgtttctcgccgctgcctcctctcttctcctctagagaaaccggccgaacattctcggcaataattaaaaaaaaaaacagtccagcctgcctgtgcctgtttcgtgtgtctgaggatctcctgatctcctcctcccccctcccctgctccctccccatcgtcatccacctcctccacccatcccctcctcgctcgctctctcgcggcttccctctcctcctctgacctgcgcatctgaagcatagatagcaagcaaggaccctgctcagtgctcacctcgccggaggtgctgctgctacggcggcggcggcgtactactactactacgacgagactctgcgcgcgcacaagcccacaggagtgcagaattgaccgcgcgcacgacgacgacgaccaccaacagcaacaggagagaggaggagatcgataagggatggagggcggcgagacgacgctgtccgggttcggcggtgccggggcccccggcgtggacaccaaggtgctgcacgcgttccagaccagcttcgtgcaggtgcagacgctgctggaccagaaccgcctcctgatcaacgagatcaaccacaaccacgagtccaaggtgcccggcgacctctcccgcaacgtgggcctcatcagggagctcaacaacaacatccgccgcgtcgtcgacctctacgccgacctctcctcgctcttcgccgcggccgacggcggcggcggccgcgccgcgtccgagggcgggtccgtgggcaccgtccgccaccaggcgggcgccggccacaagaggatcaggtccggcctcgactgatttgttgccaggcatttcttcttcgcagagaaaaggagtagcagtactaagtacagtagctagccacgtaccaccagccgcagcgaaaccacctcccttttgtcttctgacttgagctcttcttgtatctatcgacatacgctatatatctatctatctatttatatgtctccattacgactgttaccatattcttgttgctaagagctactactacttagtatgcgattagtctgtattttcgatgcaatgcaattcatggacgatgcacgcaaaaaaaaaaaaaaaa

SEQ ID NO: 5808 - DNA, 2968 bp, Zea mays
  misc_feature (2864)..(2864): n is a, c, g, or t
  misc_feature (2924)..(2924): n is a, c, g, or t
cgttttagataattaatatatttatacaacacttgatgatgtgtgtgttttatatacatgcatccagattcattatcatctatttgaatatagtagatataaaaatcaatagctaaaccgaatactactttaggacggagagagtaaaatataagtataattttttttggtttttttttgtaattttgattacacggcgattatattatattgtacggccggggaagcagccttgattgtgcacagactgcatgccgtacaaactgcaagaataatcgtacatgcatgctgatgaactgaaagatcttgagctcgtggccctcctaatttgttaaataaaaatgcacatcggaaagcaacaaactgcaaatcacgccttacgcatgagatctcagattcccagcacgctctctctctctgtctgcacatcacgtcacgtgtccctcccctcttgtgaattgatgcccggatcagcacactactggcagcagaaggtcccaaatctaagctatgcatgggcgggctacatacatacaccacccccatgctatttctagcagtggctccaaacctcagcatccacatagtacaggctacagcgtgtggttgtgatggtgaccacaagaatcctactacatgcatgatgatgatgatgtgctgcacaactcactcactgcccatgaacagcgtctcctacctgccagccagtgtcattgtgccaagaacaaatgaatgaatgattaactggcgtcgcttgctgaatcattcccctcctccttcttcttctcgtgtgcgcatgatggtcatgcagtggcggcgtcggtggggccgcgggagtggtacttcttcagcctcaaggaccgcaagtacgcgacggggcagcggacgaaccgggccacggtgtccgggtactggaaggcgacggggaaggaccgacccgtggtggcggcgcggcgaggcgcgctggtggggatgcgcaagacgctcgtgttctaccaggggagggcgcccaagggcaggaagacggagtgggtgatgcacgagtacaggatggagccagctgctcctcttcttgatcaccaaccctcctcatccaactccaaggtaaaatcggtcgatccattattcgatgaaacgacaagttaagactccattaattcgacgaactgaccgggggtgttttaactgtttcgttgtcgtccatcgatccttctcctgtcatcatgcatgtcaccagcaggatgaagattgggtgctgtgcagagtcatctgcaagaagaaactggcagcaggaggccgcgcaggagggggaagctcaaggagcctggtcgccagcaacggcggccgcgagaccgcgccagccaccccgccgccgccgccgctgccacctcgcatggacacggacgccaccctagcacagctccaggccgccatgcacgccaccgccggcgcgctcgaacaggtgccctgcttctccagcttcaacaacaacactactgccagctctagagctgctgccgcagcagcagcagcagcagcgcagccatgctacctgcccagcatggccacaggcggcagccacggcacgacgtgctactacctggaccacgcgatgctgccgcctgagctgggtggctgcttcgatcctctccacggcgacaagaagctgctcaaggcggtgctgggccagctcggcggcgacgcggtggcgccgggcctgagcctgcagcacgagatggccgccggcgctgtcgtcgcttcatccgcttggatgaatcacttctaggggacattagttcagcagcgaacctaagtatgtgattggttgcgtatattatgggaaatacatacatacatgtatacataattgtgtggtgaaacatttgtgtgtgaggcaaggagtagagcatgcgtcatttttttgggggctgccgatcgatttggacgaaggccatgaggcaaggagtagaactctgtaatataatgatggctgctcaagtgtgtgtacacattcagatgcagaggtcgtatgtcatgagcgatgatcaggagaatttcagattggttattttactgtgcctgaactcaaccccaagatcacacttgacaccactcactcactcactcactcagagacacagtgcacattcatagaatcatcatggtaaacagacagaagacagaacagtggctgccaaacccaatcaatcatgccatttatgcaggaaagtaggcatgacagtcacatccgagcatctcttctttaccacaccatctttctttttccgatgtgtattgttgcgatgacaatcatgctaaccaagcagtcagctgagtgagggctcctgggcactggctttccactgcactgttcctgatatgctgtgcgggccagcagcacctttcagaaaagacctgtgtgcttcgttacacctttcagaaagaggcatccatcctaattcctaactgcgcttgctgcaccttttttgtcgtcaatactggtactcgtacatatagcgggctttcattttcagaaagttaggactattcgtttcagatcaaatctaactgtactgctgcacctgtgatccattaaagacaaaaaacaacggtacatattaaagtcaaacgaataagttaaaaaattgcccaattcacccctgcccgaacgaaatttcggatcaaatttaaatacatccaaaatttttaaattttctaacgcagtctttccattatctatttttttaagacatccagcattacagttacataaaaacaataaaataaaactgtattttataatactcattagatagatctattgtatcagatgttctaatatcatcctgaattatttttgggancattttagcgtggattggggcgggaggccaaatccggctgatttatttatattttttggncgaaatgtttttttctggacccagcgaaagaaaggaaatttcgg

SEQ ID NO: 5809 - DNA, 1504 bp, Zea mays
gaaaaatggcacaagcacacagctcatcagttcttcttcgtcgtcttggctagctgcctagctagctagctagttcctcactcctctccgagaaccccctttttcatctctctctctcgcctagctcctttcgcgatgttatcttctctgctggcctcacaactcgagagagactcgtgaaaagaatccagatatataaagagatcgagggcagctagcttaattattagcatgtcgatgagcttcttgagcatggtggaggcggagctgccgccggggttccggttccacccgagggacgacgagctcatctgcgactacctcgcgcccaagctcggcgccaagcccggcttctccggctgccgcccgcccatggtcgacgtcgacctcaacaaggtcgagccatgggacctccccgtggcggcgtcggtggggccgcgggagtggtacttcttcagcctcaaggaccgcaagtacgcgacggggcagcggacgaaccgggccacggtgtccgggtactggaaggcgacggggaaggaccgacccgtggtggcggcgcggcgaggcgcgctggtggggatgcgcaagacgctcgtgttctaccaggggagggcgcccaagggcaggaagacggagtgggtgatgcacgagtacaggatggagccagctgctcctcttcttgatcaccaaccctcctcatccaactccaaggatgaagattgggtgctgtgcagagtcatctgcaagaagaaactggcagcaggaggccgcgcaggagggggaagctcaaggagcctggtcgccagcaacggcggccgcgagaccgcgccagccaccccgccgccgccgccgctgccacctcgcatggacacggacgccaccctagcacagctccaggccgccatgcacgccaccgccggcgcgctcgagcaggtgccctgcttctccagcttcaataacaacactactgccagctctagagctgctgccgcagcagcagcagcagcgcagccatgctacctgcccagcatggccacaggcggcagccacggcacgacgagctactacctggaccacgcgatgctgccgcctgagctaggtggctgcttcgatcctctccacggcgacaagagctgctcaaggcggtgctgggccagctcggcggcgacgcggtggcgccgggcctgcacctgcagcacgagatggccgccggcgctgtcgtcgcttcgtccgcttggatgaatcacttctaggggacattagttcagcgaacctaagtatgtgattggttgcgtatattatgggaaatacatacatacatatatacataattgtgtggtgaaacatttgtgtgtgaggcaaggagtagagcatctgagcatgcgtcattttttctgttgctgccgatcgatttggacgagaaggccatgaggcaaggagtaaactctgtaatataatggctgctcaagtgtgtgtacattcagatgcaaaaaaaaaaaaaaaa

SEQ ID NO: 5810 - DNA, 929 bp, Zea mays
ctagtactttaaattccctgccgccagctccccagaagcaaggcgcaacaacaactttgcgtcttcccgaatcggggcctccaccatctccaactgcaaccccaccccataccgccgccgcctccgctagggttttggagtgaggatcgccgatgtcgacggctcccaggcgccccttccgaggccgcggcgccccgccccctggcaccggctacgtccgccgcggccccgcccctgccccaggccccgccgacggcgccaagaccctgcgcaagcccgtcttcaccaccgtcgaccagctgcgcccccagacgcacggccacaccctcaccgcccgcgtcatctccgcccgcaccgtcctcgacaagccctccacgcacatcggccgcacccgcgtcgcagagtgcctcgtcggagacagcaccggcaccgtcctcgtcaccgcccgcaacgaacaggttgaccttctgaagccagatacaacagtgatcttccgcaacgctaagattgacatgttcaagggtaccatgaggctggtggtggacaagtgggggcggattgaggtgactcagcctgctgatttcaaggtgaaccaagacaacaacatgtcgctggtggagtacgagctggtggatgtggacgaagaggagtgaccagaaacgaagtcgggctgtggacatatattttggttatggaggcggtagcgttaggctcctatctagctattgttatcctggaccgctggcgattgggactttgttttaagtttatcttgaagaagcatgtcgaattatgtacagcagcagcaggtctctgtctgactgatgctttacgtttccgtgacgctttgactcttaatgctagtactacctttttttttctatcaaaaaaaaaaaaaaaaaaaaaactcgtgcgagctccccggtacc

SEQ ID NO: 5811 - DNA, 1168 bp, Zea mays
acactaaccgtttggacccagccagctcatgagctcacatgcctaggcgtgaggcgtatcgtcttcgacccttcgccttcctcgtccctttctctctcccagattctgactccgtcgggctcccccgtgtctgtgtcttggtaaacatcggtctctccccatcccacctggcagttgccatctcgcaaagtcgcaataacttgtcttctcgaatcggctgcaaccccaccccagaccccaccgccgccgccgctagggttttggggtgaggatcgccgatgtcgacggctcccaggcgtcccttccgaggccgcggcgccatgccctcgggcaccggctacgtccgccgcggccccgccccaggctccgccgacgccgccaagcccctgcgcaagcccgtcttcaccaccgtcgaccagcttcgcccccagacacacggtcacactctcacagcccgcgtcattgccgtccgcaccgtcctcgacaagccctccacgcacctcggccgcacccgcgtcgccgagtgcctcgtcggagacagcaccggcaccgtcctcgtcaccgcccgcaacgaacaggttgaccttttgaagccagatacaacagtgatcttccgcaatgccaagattgatatgttcaagggcaccatgagactggcggtggacaagtggggccggattgaggtgactgattcttctgttttcaaggtgaatgaagacaacaacatgtcactggtggagtacgagctggtggatgtggatgaagaggagtgagctgaagcgatattgcattgccatctgttgggccaagtcgtgctgcggatatgtatttccagctaaaggagggcggtagcgtttaggcttctatctagttatttattattattattatcctggaaggctggcgattgggacggttagttttaagaccatcctaaagaagcacgtcaaattatgtacatcagcattaggtgttctgtctgactgatgctttctgttccgcgacgccgaagtctatcctaatgctactacttttttccctcaaaaaaaaaaaaaaaaacacgcgtgtgttgttaatcctttttgacctgtagttttggtagattaaaatctagattctcttagaaaccttaaaaaatcttataaataaaaacatatttcagagtatt

SEQ ID NO: 5812 - DNA, 1491 bp, Zea mays
ttcacgcgtcccctccctcccggccggtactcacccagcaccgcagagctctcatcctctctctctctctctttctcgcgctcgctttgcttcctcgtcgaggtccaagttcctgcattgatggcgaccgaggtggctgagactcccgcgccgttggcggaggcggtccccgagacccccgcggaggcaccggcggcgcccgccgccgaggcgaagcctaccaaggccaagaaggcctctgcgcccaagaagcgtgccaacccgacccacccgccgtacgccgagatgatctcggaggctgtcacgtcgctcaaggagcggacggggtccagccagtacgcgatcgccaagttcgtcgaggacaagcacaaggacaagctcccgcccaacttccgcaagctcctgctcggccagctcaagaagctcgtcgccggcggcaagctcaccaaggtgaagaactcctacaagctgcccgcacgcgccccggccgccgccaagccgaagcccaagtccaagaccgctgtgaagaagcccaaggccggtgccaagaagcccaaggccgccaccaagcccaagccgaagcccaaggccaagtcccccgccaaggcgaagcccgccgcaaagcccaaggcagccgcgaagcccgccgctaagccgaaacccgcagcggccaagcccaaggcggccgccaagccgaaggccaagccagctgccaaggctaagccgaaggctgccgcggccaagccgaagccagctgccaagaaggccggccgccccgccaaggccgccaagacgtcagccaaggacacgcccgggaagaaagcggcgcccgccaagaagcccgctgctgcggccaagaaggcccctgccaagaaggccgccccagccaagaaggctcccaccccgtcgcggaaggtgccgtcgcgtaaggcgaagaagtagagcggtggtcttggcaggaatctagggtttcatgctccttcgattttagatgtttactcgtttttgctctagttgtgggtggtgtgcggggtgggttactaggttgtaaatttgatgccggaggctggggtacacatgggcattctgtaccagcggtggaagggcggaggcgccggcgacgatgacgaaccagtgtgtgttattattagaagacgaagttgtatttctgtagctgaattgtggagttgcggatatcattgtgcttctaaggttaatgtgacgataaagttaatgtcgagagttaccatccttctcgtgtatgtactctgattattcaggctgtttttggctgggattaatctggtcttatctgaattccctatctgaaatagagaattgttcggtgtgcattttgtgaccaataaatatttttaatattttatttttttatttaatatttaaaaaagggcggtcgtttttgaggttccaagctttctttctctttcatgctacttattagctcttttttagtggtacttaaatttaatt

SEQ ID NO: 5813 - DNA, 1866 bp, Zea mays
ccggcctcacccagcaccgcagagctctcatctcctctctctctctctctctctctctctctcgcgctcgctttgcttcctcgtcgaggtccagttcctgcattgatggcgaccgaggtggctgagactcccgcgccgttggcggaggcggtccccgagacccccgcggaggcaccggcggcgcccgccgccgaggcgaattctaccaaggccaagaaggcctctgcgcccaagaagcgtgccaacccgacccacccgccgtacgccgagatgatctcggaggctgtcacgtcgctcaaggagcggacggggtccagccagtacgcgatcgccaagttcgtcgaggacaagcacaaggacaagctcccgcccaacttccgcaagctcctgctcggccagctcaagaagctcgtcgccgccggcaagctcaccaaggtgaagaactcctacaagctgcccgcacgcgccccggccgccgccaagccgaagcccaagtccaagaccgctgtgaagaagcccaaggccggggcgaagaagcccaaggccgccaccaagcccaagcccaaggccaaggccaagtcccccgctaaggcgaagcccgctgcaaagcccaaggcagccgcgaagccgaaacccgcagcagccaagcccaaggcggccgccaagccgaaggccaagccagctgccaaggctaagccgaaggctgtcgctgccaagccgaagccagctgccaagaaggccggccgccctgccaaggccgccaagacgtcagccaaggacacgcccgggaagaaagcggcgcccgccaagaagcccgctgctgcggccaagaaggcccctgccaagaaggccgccccagccaagaaggctcccaccccgtcgcggaaggtgccgtcgcgtaaggcgaagaagtagagcggtggtcttggcaggaatctagggtttcatgctccttcgattttagatgtttactcgtttttgctctagttgtgggtggtgtgcggggtgggttactaggttgtaaatttgatgccggaggctggggtacacatgggcattctgtaccagcggtggaagggcggaggcgccggcgacgatgacgaaccagtgtgtgttattattagaagacgaagttgtatttctgtagctgaattgtggagttgcggatatcattgtgcttctaaggttaatgtgacgataaagttaaatgtcgagagttaccatccttctcgtgtatgtattctgattattcaggctgtttttggctgggattgatctgatatctgaattcccgatctgaaatggagaattgttcggtgtgcatttcgtgaccaacctgttcatgcatttcgttgtacgtcacgtgtagtgcattctacgtggctttatgagctgtaataacggtcttatattattgtcctctggattttggtaccctttatgaaaagggtatatgcggtttgatgggctgagctgctgtggttgtttgaaaccctagcgggcctcgcgttgcatatatcttgacggcccgcggcaggctaggtctgctgggcgtttcggagccgtaacagccctaaccctaggtagctgttgatcctcttgttgctgtgaaactttcttcttttgccttgccctgccctctactgcttttccacctttgtttggtcgttcttgcatctcgtcgggttttgctggagtgagaacgagttcactcgcctttccgtgcatcgcgtcgttctggactggaggagtcggggtggacatcttcctcaacctcgtgatgtgataccggtaactggactcaaatctgctttgctgtgtcctgtctcgaatgggcacacacccgaaaccacgggaacaggggga

SEQ ID NO: 5814 - DNA, 6000 bp, Zea mays
gatgagaatgactatgtgtaagtcagaattggatatgcatgtgacgcatgcaaggcagagacaggcctaggtagagattaccgtgagaccgaccctttgtgccgtggaggaaatatatactatccaagtcggcacagatgatgtgcttgagtgtcagcgcgtgcacgtctcaccacggtttcaacctcggcttacagatgatgtacacacgcacgcagacgcagccggtagtagggtcggcctgtgtgtctacagggaccggccggtctcgcagcgttcccttcattcctcttcgtcccctgcagcgacgtcccggtcgacacaacgccaccaacacgagctggttttccgtcgccggatcatcggatatctctgtgtggttttgtacggggaagggacgcgtcgaagtcgaagtcatcaagggcaagggcgccgccgagatccaagaccccgggaacttgatccaaggcagccaggcgcaggttccacctcgaccgtcactgccctgcgccgcgccatcagcgccgtggaggtggatcggatcggggacggagatgattatcaccatttcgcaccacggtagttagctcgtccttacgatcgagctcgagagttcagactgtgatctccatggatgaaggtactctccacgactccacgtatggcgtgtccgcagctcgggtaagcaaccacggaggacgacgacgcacctgctatgcagccgtagctatcttagtacccgatcccctgacgatccgatccgatccatcatccacacgcgtgttcatccgccacgaccactcactcgcgccgattgcagttccgcagagctattggagcgtggatttgacgccgcccgtttccatcacgcgcgacgacgcccaaccacggccctgcctgctttgacctcttccaggccacctctgtaacaaaaaaaaactctccaaactcgcccagttcatctccccaacgcgagatcagatccaaccattcgaacggattcgtgcgccgtcgagcatctccaaagatttcgtggacgaaaccagttgaaggaggtagctcgtgacgcccggtacactttcttcccgcaacaccatcagcagcaagagctcgggtcactctccatcgatcatctccagagatcggatcggagcgtggcaacgcaaatgcagctacgacggcgggcctccccgtggacgggcacgccgcagggcggcggagctccgacgagccggcgcagaaggtggccgcgagtcacacaccaccaaggacggggtgctgctccgggcgtgtgtcagttgcctcgcgttccggccggccgtagcccgccgaaacgacgtcggttcggcgagacccggggctccccgccttcctctgctagcctgctacgcggccgtgccgagaaaccgcattgttcgccgccgcgcccggtgtcgccggccggaaatcccgtccaaactcacacaaacgcgccgtccggaccagtccgggttcccgagccaatatctccgcgtacactgaatggaatccatgggctgtacgctcgttcggaagctatgttccgttactacgaggctgcagagtttgagacagatatgttcatcaggcgaagagatattcgatcgcaaatcgggaggagaagcacactctgagccccagcatcgcgaccccggcggccggctgcgcctgcggggcaggaatccgcggcaccgcgtgggcgcgatctggcggccgttggatgtggatggaacggacgggccaggttcaacgtgggggcgttgatgggagcgatccgaggcgaggccgtgtggaccaatcagcgcgctgcgtgggactctgctcgtcttcgtgccgtcgccactatttaagcaccgcttcgtctactccggcctactcacccagcaccgcagagctctcatcctctctctctctctctttctcgcgctcgctttgcttcctcgtcgaggtccaagttcctgcattgatggcgaccgaggtggctgagactcccgcgccgttggcggaggcggtccccgagacccccgcggaggcaccggcggcgcccgccgccgaggcgaagcctaccaaggccaagaaggcctctgcgcccaagaagcgtgccaacccgacccacccgccgtacgccgaggtaattgcagcctttgtgccacgttagcttgcacccatgtcgtgtatgtcgcgtctggatctgacggaattgtggacggtttgctggtgcgcagatgatctcggaggctgtcacgtcgctcaaggagcggacggggtccagccagtacgcgatcgccaagttcgtcgaggacaagcacaaggacaagctcccgcccaacttccgcaagctcctgctcggccagctcaagaagctcgtcgccggcggcaagctcaccaaggtgaagaactcctacaagctgcccgcacgcgccccggccgccgccaagccgaagcccaagtccaagaccgctgtgaagaagcccaaggccggtgccaagaagcccaaggccgccaccaagcccaagccgaagcccaaggccaagtcccccgccaaggcgaagcccgccgcaaagcccaaggcagccgcgaagcccgccgctaagccgaaacccgcagcggccaagcccaaggcggccgccaagccgaaggccaagccagctgccaaggctaagccgaaggctgccgcggccaagccgaagccagctgccaagaaggccggccgccccgccaaggccgccaagacgtcagccaaggacacgcccgggaagaaagcggcgcccgccaagaagcccgccgctgcggccaagaaggcccctgccaagaaggccgccccagccaagaaggctgcgaccccgtcgcggaaggtgccgtcccgtaaggcgaagaagtagagcggtggtcttggcaggaatctagggtttcgtgctccttcgattttagatgtttactcgtttttgctctagttgtgggtggtgcgcggggtgggttactaggttgtaaatttgatgtcggaggctggggtacacatgggcattctgtaccagcggtggaaggcgccggcgacgatgacgaaccagtgtgtgttattattattagaagacaacgttgtatttctgtagctgaattgttgagttgcggatatcattgtgctgctaaggttaatgtgacgataaagttaatgtcaagagttaccttccttcgcgtgtatgtactctgattattcaggctgtttttggctgggattaatctggtcttatctgaattccctatctgaaatagagaattgttcggtgtgcattttgtgaccaacctgctcatgcaaacatgttgctttcgttgtacgtcacgtgtaaggcattctacgtggctttatgagctgtaataacggtcttatattattgttctcgggattttcgtatcttttcggatgagggtatatgcggtttgatgggctgagctgctgtggttgtttgaaaccctagcgggcctcgcgttgcatatatcttgacggcccgcggcaggctaggtctgctgggcgtttcggagccgtaacagccctaaccctaggtagctgttgatcctcttgttgctgtgaaactttcttcttttgccttgccctgccctctactgcttttccacctttgtttggtcgttcttgcatctcgtcgggttttgctggagtgagaacgagttcactcgcctttccgtgcatcgcgtcgttctggactggaggagtcggggtggacatcttcctcaacctcgtgatgtgataccggtaactggactcaaatctgctttgctgtgtcctgtctcgaatgggcacacacacgaatccacgggaccagctggcgaaacaagtttactcgacccgatccctatacgatacggcaggtggtgctttccgacctgcatcctcttacccttctgtggaatgtggtccgacttttgtgacattgtcagtccactgacgtccggtgcgttgcacgggaagcacgagctcgcctgctcgtgcgcgcggaaagctctccgtgagaccgtgacggcatctacgcctcgccatttagtagcaaactcggagctgggcgagttggcgctggtgaaccgcgaccgggcacctgacgaacggacggaacggacgcacgcggctggagcaggaacgaaacctatggttttctctactggacttcagtttgggatgggcctagcccagctgtgtgtgacgatacctggggggccctggctggtccccggttaagaatcgttagcccacgagttgctctcttgtcggtttggccggcccaacccagcgcgagaccaagcgactggcgccgctcgctgtgagtctgtgacacgactacacgagatacgagtggcggactggatgtcaaattgaaatcttgtcggtttggatttttatgcgccaaatggagtaacaagacatatgtttagagtgtatctattttatgctttgataacatcgtgaaaaaagatttgatcaaacatatggtcgaggataaaaaaaactaggcgtcaaaactttgatatactctgcgcggtagctcaagcttcaccatcaagctccttcaatttttgtgcatagtacaccgacaagaacggcttgctttaaaagaagctaaagttagcattagattgtaccataagacatgtatgatgaatggaaaacaagtagtgtaagctttgctttggtgcaaagagtcacctttttttcgtaacagtccaaggagatgagccgtcatcaaaggctaattgccactcctcacctgtgttacggtatgcggctatgcgaatcgtcgatagagcctggaaacgtatacaaagcaacgttattcagtcaggttgcaacgtcgtcatctcgacgtacgtaatgtttataaaacatcgcacttcagttgccgattgaatgaagtagtactaatttctctctcgtatcaccgtaccctcaaagaatctcatagcaggtgtcaaagaatctcatggcgttgagtcgggtctacgagtttcaacgtcgatggtgttcatgcttatgtgcactacgcacgctttagatgggatcagaagaggtgcagtggcacgactgatgatttattggcatcggctacgttgttaagcagtcgtagagttgccgtgcccccgtttccgcacctgctactgttcgatgtgagagtaaattaaaaagaagctgtcctgcaggcctgcagctgcagtccacactgtgccgagcgtaggcactcgttagcctgtgcgctcaagtagtttaatctatatcaacttctacagttctactgattgtataatattttgtatagataaattatcgttatagtagtccgaacagtttggaattaatcttctaatttaacgacgacgttctgacctgtgaaagaaaaggctagttttgctcgtgctgaaacatcttggtacctactactatactgtggcgtgctgcgcgtctaccgaacacgtcggtgggccaaacagaaatgggggtgcacgtccggaagcagagcaccgatgaattgggggtgctaccgctgcggcgaagggttacggttgactggcctaactgccggtgccagctacaagcatccgatgttgtgttgctcacagtacagtggccaacggggaccggatcggccactcccactccctacccgctgaccgagcggtcgcgactccccgtcttcctcgcggcaccgcggggctccagcatccagctttgctgggggcctgtggctgtcatggccaaggcgctgtggtgagcagcagccggcagggcatggaagacgtgcctctgccagcacagtgaagacggacactttactgctaccgtgtctgcatgtgcgtgacattttgaacaacctaacctaacctaaccaagtacacagcctacgcaagacccaacgaagtaggtaggtaccactgaccgccacttacacttgggcccgaacggtgagcacggtacactcttgg

SEQ ID NO: 5815 - DNA, 1107 bp, Zea mays
ccacagatgacagacccacacacacacactctctctcttcgcagacacaaccaaaagaccaaggtggaaaaatagtaaagaaacggagcgaggctcctccgcatttcttatctatcctgatccaaaccctccgagggggaaacaattcattccgcacggcatccgggaaggtctgcgtcgtcgccatggccaccgaggaagtcgccaagccgtccccgatcccgccctaccccgagatgatcctggcggcgatcgaggacttaggcgacaagagcgggtcgaacaagtcggccatctccaggtacatcgagggcaagtacgacggcgacctgccgcccgcgcacgcgtcgctgctggccgcgcacctggcgcgcatgaaggagtcgggtgagctggtcttcgtcaagaacaactacttccgcgccgacgcgcccgacgcgccgccgaagcgcgggcgcgggcggcccccgaaggcgcgggaccccggcgcgccggtgtcgccgccatcggggcgcgggcgcgggcgcccgcccaagcccaaggacccgctggacgccgccgtgaagcaggccaccgcgggcatgcccagggcccgcggccgcccgcccaagaaggccaagaccgagggcggcgcgtccccggcccccgccggcgacggctccacccccgtcaagcgcggccgcggccgcccccccaaggtacgccccgtcgtgcccagcgagacggccgcggcttgacggacgctgctgcatggggttagtgcgtagcgattcgtcccgccgccaccgccgcagggttgatgtttgtaggcttcgttttccttcatctaattgtcgtcgtagtcgtcgtcgtcgcgcaattaattaatggagtaagtaggaggatttgatgtgctgtgttcggttcagttcagctcacggtgctgtcttgttcgtatgtgctggatggatctgtctgttgtaagctaaactagggaggctgagtgctgtgttggtcggttcattattaagctgctaatttggatgtgtacaatacattagtggatgatgctgatgttcgtgatgttgatttgagggtttaaaaaaaaaaaaaaaaaaaaagggcggg

SEQ ID NO: 5816 - DNA, 1404 bp, Zea mays
cagtggcgctagggtttggctcgagcggctagagcagtgatcgtgtgtgtggacggtcgattcgtccatgtcggccacttgaccgcgggttgatttcaaataaatgtaaggttttttttaaaaaacatgacgtaggacgaccgttgaaactggtgctttaagtatagtatagatatagaattataacattgagcatttttatgttctttgagtctaatttttaagctaattgtaacaccgagcatttttatggcctgacggtacctacctatacgcaagttatagcagtccgtatctttgcacaatatgaaaacagagccagcctgggccgtaactaagtaccaggcctcatccatcatgggccgagccacccaaattttcgtctatataccacgtgcccacgcgtccgcccacgcgtgcgcccacgcgtccgcgtgctaaagtgtcctcactgctgctctcctccgctccgcagctcatggcttcctcggtctccctccgtggcgccatcctccagcgcccccacctcacgccccgccccgacgcccgccgcgcgcccacgacgaggcgccgcgccgtgcctgcaaagatctgctgcatcggatgggaccccgagggcatcctgggcgcgccgcagggcggccacatcgcgcgcctcgagttccgccgccgcctcgagagggactccgaggcgcgcgaggacttcgagcgccaggtgcgcgaggagaaggagcggcgccgcagcgagcgcgaggcgcgggtgatcccggacacggacgccggcctcgtcgagttcttcctcgacaccgacgcgcgcgagatcgagatcgagatcggcaggctgcggcccaggctcagccaggacttcttcggccacgtctcgcgcgagatagcgcagatcaaatttgcagtcaccaggacagcggagatggaagacagactgatcgagctggaggcgatgcagaaggttcttctcgagggagttgaggcgtacgacaagttgcagaacgaccttgttacagcgaaagaacggctcatgaagattctgcagtcaagtgacagaaaatcgacactgctggaaatggtggagcggaacgagctcaatatatccatactaacacttctcgatgagaacattgcgagcgcgaagacgagtaatcaggatgaggcggccgctttcatggaggacgtgagatcatctcttgtgaaatatataacaatatagatctgggacgcttttacataccaatggttcgttcattgcttgggcatggtttgatcgtttttagaagtgtggttgctgttcgttcattgtgaaatatataacaatataaatctggattatttccgcctgtttgtagttgggctgcaaaaaaaaaaaaaaaaccatcccaggttgcctta

SEQ ID NO: 5817 - DNA, 1290 bp, Zea mays
cattgggtaccaaatcaggataaatatactatccttttgcgagacacatggacacgcggtgcgcgtcgtcgtctagctggagctggcggaccccataaatagtgctttagaccaagctgcccccgcgtccgcccacgcgtccgcttcttcctcctcctcctccaagcagcacggagcgattagctgctgctgctgccgctgcagcgggcagagatggcaggagcagaggttgccaacggcgtgcacgacggcgccctggatttggaggaaggcagaggaggcggagtcgatggagcggggtgtgagagctcggagcaggacggagccggtcgccgccccatgttctccgtgccgttcgtgcagaagatcctggcggaggcgttggggacctacttcctgatcttcgccgggtgcgcggcggtggcggtgaacctgcggacgggcggcacggtgacgttcccgggcatctgcgccgtgtggggcctggccgtgatggtgatggtgtactccgtgggccacatctccggcgcgcacctcaacccggccgtctccctcgccttcgccacctgcggccgcttcccctggaggcaggtgccggcgtacgcggcggcgcaggtcacgggggccacggcggccagcctgacgctgcgcctcctgttcgggagcgcgcgggagcacttcttcggcacggtgcccgccggctcggacgcgcaggcgctcgtcggcgagttcatcgtctgggccttcaacctcatgttcgtcgtctccggcgtcgccacggacaacagagccatcggcgaactcgccggcctcgccgttggagccaccgtcctgctaaacgtgctctttgccgggcctatatccggagcgtccatgaacccggcgaggaccctgggcccggcgctcgtcgtgggccgctacgccggcatctgggtgtacttcgcggggcccatctgcgggacggtggccggcgcctgggcctacaatctcatacgcttcaccgacaagcccctgcgagagatcacccagacctcctccttcttgcggagtgtcaggaggagctcgagctgaactactatatatatacatatatacctcgtagctgcctgccacccaaacgactctcacgatctaaagatagcagttagcagtgttgtttctttaattttgtagccaaacaactcctctttttaatttttactgtcatttgtttacatgctgtatatgcttgccttgtgttagtttaatcgccgccgcaagattaggccgcttaactgaaaattttgattt

SEQ ID NO: 5818 - DNA, 1059 bp, Zea mays
gtgcctccccccctgccagcctatgcagcgcccgagggctcgcctttttgaccgcgtccgcctcccggccgcccgccgtactgtacccctccccccttcacagcgtcacacgcacttctcgttctcgccgatccagtgccactacactacaatactgctgcgcgctagcggtagcgctcgcgctcccactcgcaccacagcacgccaccgctgctgccggctcctccccgcgctcgcattgcgatttgcgacctagcgcgagggtaccgggggtggtgcgcgtgctccgtgatccgggaagcgccgcgagatggccgggggcggaggcggcggtgccgcgccgaagcacgacgacttcacgccgcaccccgtcaaggaccagctccctggggtctcctactgcatcaccagccctcccccgtggcctgaagccgttcttcttgggttccaacattatctggtcatgcttggtaccactgtgatcataccaactgcacttgttccacaaatgggaggaaacaatgaggacaaagcagtggttatccagacattgctgttcgttgcaggtatcaacaccctcctgcagagtttctttggtaccatgttgcctgcagtgatcggcgggtcatacacctttgttctgcctaccatttcgatcatccttgctggacgttatgctaatgaacctaatccacatattaaatttctccgcatcatgcgtgggacacaaggtgcgttgattgtggcttcagccttacagattatagttggcttcagtggcctttggcgtaatgttgccaggtatctgagtccactttcagctgctcctttggtggcactagttggatttggactgtatgagctaggatttccatcggttgccaaatgtgttgagattggtctaccctcaactcatccttcttgtgatctttacaatgtacctgccacatgctgttcacatgctgaagtctatcttcgatcgatttgctgtcctgttcactatacccatagtgtggctctatgcatatcttctcactgttggaggagcatacaggaatg

SEQ ID NO: 5819 - DNA, 5986 bp, Zea mays
tgcatatcataaaacttcactaaaatatagttctacagtataaaacaatattttacacaataactatatacgtgacctttgcggaggagatctataaagatcgtaggacggacgtggtagagtagaatgctggagacctggacaagccgagtctgccgtagcatgtagcatccacaggctgctgcggcagtgcaagagtgtgaccctcgctcgcttcgaggccacctcgtgactaatcattctagctgggagcctgggattaacggacgacaccagcgaggggagacgaggaaaaagaaaagaaaggcgctgtgctgccgaaagagcgaggagcaaaacggaggaacacaatgatagggagtagtacggccgcgcaactctgcgtacaggtcaaaagcgcccctctgcctctcttttttttcaccgcttctccctcgcaacgatacacggaaaagtggaaaaataacccatctgctgtcagctccctccccctgctactactactatacagtaaccccctacaaacaatcattcgcagctctccccgaggcccgaggacaaggggaagcgctgcagtaaccacgccatcgctccagtccatgtccactccaacccatgaaccgaccgactaccgagcgagtggaaaggcctccctcctctttcttcacgcataatccatcatcgccagccacgttcccaacgcccggagcccaatgcggcgctgcgactgcgaaggcgcgagcgtcacgggaaaaacggaccggaccggaccgaggcggcagaaaccggacgtgtcgatcaaacccaccaccacccgcggtttcgtcgccaaaacctggagaagctgcggcttcatccgttccgcggcagtagaggcgctgggggcttgctggcagccgagccggggcccggggccggggggcggcgggcgggtggcagcccccaccgcaccgcgcaagggaggccgcgtgacccaccagccagccaggcccaggcagcaggagagattcgcacggctcgctcacgcacacacgcaaaacaacgccggcataaatgcggttttggagccgtgcgggcgtgcgtgaactgtcctctcctcccgcagcggctgcggacaggagacgacgacgcgcacagaaaaacaaccgcttcccgcaccgcagtcccccgcccccgccgtgccgtgctcccccctctgccagcctatgcagcgcccgagcgctcgcctttttgaccgcgtccgcctgccgccctgtcctgtacccctccctccctcccccctcctccccttcacagtgtcacacgcacttctcgttctcgccgatccagtgccactacactacaatactgctgcgcgctagcggtagcgctcgcaccacaccacgccaccgctgctgcctgctcctcacagtcctccccgcgctcgcattgcgattcgcgacctagcgcgagggtaccgggggggtggtgcgcgcgcgtgctcggtgatccgggaagcgccgcgagatggccgggggcggaggcggcggtgccgcgccgaagcacgacgacttcacgccgcaccccgtcaaggaccagctccctggggtctcctactgcatcaccagccctcccccgtggcctgaagccgttcttcttgggttccaacattatctggtcctcctcctacctctgtgctccgcccaacttacttgccgccgctcctcaactctagccaagttttttttcccgcgttcccaagttgcctccgcgcgctggctcacgtcgttgttagggaacagcagcgaactccgtggcgcggcccgtgatttcgaagggggtttgtctggtcccggccggtactagtaggaagttggccgcgaaagcgatgcgtgctctgctaccaacgtcgcagttcaccgcgtcgctgtcaagggtctgtggtggtggtgcggtgtggccatcgcacacaccttgacgcccgcctcgcttgggtcggcgagatctgcctgcgcttcccggtctcagtcccatataattctaaaaaggcggttcagcctttccgttccgcctgtcgcctctctagtttgtttaatcggatactcgtgattctgcgaaagctttgacccgtgttgtttcaacttttcaactggcgtatatccaccaaatggactttaaaggaatcatcgaaccgaggatgtgttggcccttgatgctcaagtcgcacacagcgcccgaatccgtgatcccggttctctgtcgccttaactgcctgcaatggtatattcgtaggattgtgacttctcggttgtgtggatggaatattcaggaaatctggtgcttctttagagttctgtttagtagtaattttggtgttagtcaactctagtgttgactcttccctgttttaaagcacatgctctctgccttcatggttagtataacatggctaatccatgtttagttcttgtgtaatctgtagtacactattggattgctagactttttcctttacggtggccagcttgttgcctgcattaggccagtctctgtggggagtttcttagcacaattaacaagactgccacatcagcttttgtgttgttaacatcctgacgtgtttcatcctaatgaaactgcattaaatttgccgacatgtacgtgttacaaattaaatgcaaatgaaactccctatccaaatcagcatttgtttggctatatgccaattattgtatttgctcttgcacggctgcagctgtggctgccaaggcagtgatacagtaaattagacttctgactgcggcagctgcatctgcaactagtgcaggtgggcactctaaatgttttacagcagagggctacaaaataaattttgggtttagttcattgaattgcatatgacctgaatgggattttgcacctactggttgagtttgactcatggatggagggagtgtgaatgacatcagcatatttaggggaaaatgatccatttgttgtgcattggaattcaatgcgtttgcgaggaagttatgatgttaaaaggagaaaaacatcccaattttggatcatctgcatttgaggataggattgatgaaccgaatttatcacttcaaacttgattttgtgtgtttgtcttggattagctccatcttttttctaatatagttgaccatggtatgcatatgatactgtctactaaaaaaatcttcgttgactagcggcggactttccgctctaacttggttctatgggaatgtccttaaatgcagctgaagccgttcttcttgggttccaacattatctggtcatgcttggtaccactgtgatcataccaactgcacttgtcccacaaatgggaggaaacaatgtgagatttgaaatttcactattcatattttgttggttacatggttctaagctatcaatctaattcctactgttccttgtggtaggaggacaaagcagtggttatccagacattgctgttcgttgcaggtatcaacaccctcctgcagagtttctttggtaccatgttgcctgcagtgatcggcgggtcatacacctttgttctgcctaccatttcgatcatccttgctggacgttatgctaatgaacctaatccacatattgtatgtcggaagtaccaccatctcccatttttctgatctcacttagttgtgtacacctggacctgatgatgtgcttgttatattccgaagaaatttctccgcatcatgcgtgggacacaaggtgcgttgattgtggcttcagccttacagattatagttggcttcagtggcctttggcgtaatgttgccaggtaggaagatgaacagattagttactgtatttttaatttcagtatctgctccggggtactcaagcaagaaagaatcttgcagaagaagcattactctttctcacttgagttcgtatgtttgtatatattcgttttgtttcaggtatctgagtccactttcagctgctcctttggtggcactagttggatttggactgtatgagctaggatttccatcggtaagttttgataattggttttctattcactattcatacaaggatatttgcttatactaacttacccaggtcgccaaatgtgttgagattggtctacctcaactcatccttcttgtgatctttacaatggtatgattggatttttatgcatttgtttgttgcgcccagttagatatctaacactttctcgccatccaactaccattttcctttctgttccattttttgcagtacctgccacatgctgttcacatgctgaagtctatcttcgatcgatttgctgtcctgttcactatccccatagtgtggctctatgcatatcttctcactgttggaggagcatacaggaatgcaccaccaaagactcaatttcattgccgcactgaccgttctggattaattggtggcgcaccctggtactgtttgcagttctgaagatacaattgttcatttgtcaccatctttgctgtcgaaatgtatgatcagttcccaagtttccctcaaatgaaatggcaggataagagtaccatatcctttttcagtgggggtggctccaccttttgatgcgggtgaagctttcgcgatgatggcagcatcatttgttgctctcgtggaggtttggctcactgctctagaaaaaaatcaaatatcagcacattgttgctatatgtgggtttgtatggtgacataatattgatctcactaactggctagccattgtatttgtagtccactggggccttcattgctgtctctaggtatgctagtgctacaccaatcccaccctctgttcttagccgtggtattggctggcaggtacatgctatttttcatctaccacatgttcaggttttactgggtaattgcatattttagttaacttagagcatatatctgttcttggtttagggcatcggtattcttctggatgggctatttgggactggaaatgggtcttctgtatcagtgtaagcaccgggcagtagatttttaaggaacatatctcatttgtattttaaattttaatacaggtcttctcttcaaggaatagatctaattcggcttgatatgccaattgtttccttaactgcagtgaaaatgctggtttgctagctttgacacgcgttggtagccgaagggtagtgcagatatcagctggtttcatgatattcttttctattctcggtaagtttaattgtcatgggactagtatttgattctttgatagatctttgagatagcaaatttgagcctaacatggatgatggaacttcaaagggtgcaaaccggcctcgcgcccaaccactgctgaccgctgagcacgcaccgaagcttgccggcctgcaggatagcctgcgggagctggtgctctactcttccgacgtcgaggaggtcacagccgacgcgcacgtgcccagcctggaggtcatcaaatttgggttcctcaccaacctgcgcgtcatggagtggtccactggtcccccgccgccgggaccaccctccgcgaggtcgccatgggcgcgtgccacagcctaacgcacctgacgtgggtgcaggcgtgcagcacctcccctgcctccaatcgctgaaccttagcgggtgcaacgggctgacgaggctgctgggtggcgcggaggacggcggaagcgccgccaaggaggtggccgtgttcccgcggttgaggcttcacgatcacctccgatccaggtccagctccccgcggcagttaccgcacgtcatccttgttgcgccgccgccgcggtaggtggacgttgatctccgcgaccagaaacctcgcgtagaatatgaagttgcttgcaaatttggtagaggggattttatcaggtgtgtgctttgctttgagcgagatgagagttgagggagctggtggggggttttataggtaagtggcgatgctcgggtgcggagtggcgatgatggagcaggtgactccaggcaggggtcc

SEQ ID NO: 5820 - DNA, 2097 bp, Zea mays
gcacgagcctttttgaccgcgtccgcctgccgcccggtcctcgagcccgcccgggaccccccctcctccccttcacagcgtcacacgcacttctcgttctcgccgatccagtgccactacactacaatactgctgcgcgctagcggtagcgctcgcactcgcaccacgccaccgctgctgcctgctcctcacagtcctccccgcgctcgcattgcgattcgcgacctagcgcgagggtaccgggggggtggtgcgcgcgcgtgctcggtgatccgggaagcgccgcgagatggccgggggtggaggcggcggtgccgcgccgaagcacgacgacttcacgccgcaccccgtcaaggaccagctccctggggtctcctactgcatcaccagccctcccccgtggcctgaagccgttcttcttgggttccaacattatctggtcatgcttggtaccactgtgatcataccaactgcacttgttccacaaatgggaggaaacaatgaggacaaagcagtggttatccagacattgctgttcgttgcaggtatcaacaccctcctgcagagtttctttggtaccatgttgcctgcagtgatcggcgggtcatacacctttgttctgcctaccatttcgatcatccttgctggacgttatgctaatgaacctaatccacatattaaatttctccgcatcatgcgtgggacacaaggtgcgttgattgtggcttcagccttacagattatagttggcttcagtggcctttggcgtaatgttgccaggtatctgagtccactttcagctgctcctttggtggcactagttggatttggactgtatgagctaggatttccatcggttgccaaatgtgttgagattggtctacctcaactcatccttcttgtgatctttacaatgtacctgccacatgctgttcacatgctgaagtctatcttcgatcgatttgctgtcctgttcactatacccatagtgtggctctatgcatatcttctcactgttggaggagcatacaggaatgcaccaccaaagactcaatttcattgccgcactgaccgttctggattaattggtggcgcaccctggataagagtaccatatccctttcagtggggtgctccaacttttgatgcgggtgaagctttcgcgatgatggcagcatcatttgttgctctcgtggagtccactggggccttcattgctgtctctaggtatgctagtgctacaccaatcccaccctctgttcttagccgtggtattggctggcagggcatcggtattcttctggatgggctatttgggactggaaatggatcttctgtatcagttgaaaatgctggtttgctagctttgacacgcgttggtagccgaagggtagtgcagatatcagctggtttcatgatattcttttctattctcgggaaattcggagctgtgttcgcctcaattcctgcacccatctttgcagctatgtattgtatcttctttgcttatgccggttctgctgggatcggcttccttcagttctgtaacctcaacacctttaggaccaagttcatccttgggttctcagttttcatgggcctttctgttcctcaatacttcaatgagtacacatctattgctggttatggtcctgttcacacacattcaagatggttcaacgatatagtgaatgtgatattctcgtccaaggcgtttgttgctggcttcgtggcatatttgctggacaacactattgacaggcatgaagcttcagtcaggagagaccgaggctaccattggtgggacaaattccggtcgtacaggaccgatacaagaagcgaggagttctattccctgccattcaatctgaataagttcttcccatcggtctgagcttttgctgtggttaatgtgagatgctcttgttactctggattctggaactgcccaccccctgttctccggcggtggcaatgtgatctggattttctcggtacatgaaaaaattactgtatattaaaacccgctcagctcgggtttcacctccttcccgtgcttcacgggaatttggcgacattacaaaaaaaaaaaaaaaa

SEQ ID NO: 5821 - DNA, 885 bp, Zea mays
taccctcgaggccggccgggaacaacttgggcgcggccggattcgtataggttagcagcacacagtagcaagctcgcgatctgtgcgcccaccatcaccaccaccgccgggaggagaggaccgaccgaccgaccgaagatgcggatgagctgcaacggctgccgcgtcctgcgcaagggctgcagcgacgcctgcaccatccgcccctgcctgcagtggatcgacagccccgaggcgcaggcaaacgccaccgtcttcctcgccaagttctacggccgcgcggggctgctcaacctgctggccgccgcgcccgacgacgccgcccgcccggccgtcttccgctccctgctctacgaggcgtgcggccgcatcgtcaaccccgtctacggctccgtcggcctgctctggtcgcgccggtggcagagctgcgtcgacgccgtcgaggccgtgctcaagggggaccccgtcgtgcaggtcgacgccggctccgaggccgccgccgccccggcgccgctgctcggcgccagcaggccagccgcgccgccggccgcctacgacatccgccacgtcgccagggatcccgacgccgtcgccgccgccgacctcctccgcgtcgcgcgcggcggcggccgcaggaggttcaagcgcgccggctcgccttccaacgcctgcaaggcgaaacccctcaagggaaaggctagcagcaacgagcgcgcgtcgcccagccctactcagaggcagcatcagcaggagacggaggagctggagctggaaccggtgccgatggtcgtcgagcttgagcacggcgaggagtccgccggcagccacgaccaccaccaccaccacttgcagccgcagggatcgtctgaggacaccgacgtggag

SEQ ID NO: 5822 - DNA, 2670 bp, Zea mays
ggccgggcgtcgctccctttgggcccaataccgtttttttccctatttttatttcctttttcttttcttttgctgttattttccttttctttcttatattttaaatccaaatttcaacctagaatttgaattcaatttcacagcagaatttgtactcaatttgaatattctacttggttataccaaggcatgatgaagttatatatttataaatttattttgtattatatgatattccttccccattttcatggttttgttttcaaactagggtttgaatgttgtgggcatattaatacgttgttattgatacttttatttttattatccacatatgcacaatcaaataaactccagcatgatgcataggttatttaggtgttctttgttttagttcatctctaaattttatgtatgctctttttatgatgcaaacgaggcacatataataaggaaatcactatataatctctgtatacaattttgagtattacagtatcacactaacaacggtctagtatctgcgtcagaggaaactactaaaataaaatgcgctgcccaagaaaacaataagcaattaataaaataatgttgagtatccccttcgcccctccccacctggctcctgctctacacaagcagtcaagcgccataaagcgcagcaggatctccctctgcccaaaaccaaacctgcctccgcacctaccatttcctcccccaaaccaccatggacttctccgccggagggagtgggagcggcggaggaggcggaggcgccggcgacggccgggcgcaggcggagcgctggctggagatcgccgagaagctcctcgcggcgagcgacctcgtcggctgcaagcgcttcgcggagcgggcgttggaggcggacccgctcctccctggcgccgacgagatcctcgccgtcgccgacgtcctcctcgcctcccagtccatgggcccctcgggccaccaggacccgctcgccatcctccagctgccgcctggggtcaaccccgaccaggcctccgtctcccgcgcattccgccgcctcgcgctactcctcgggccccgcaacccgcaccatggcgccgagatggcgctccgcctcgtcaacgacgcctacgccttcctctccgatccgtctcgccgcccccctccgcccgccaatcccgccactggtaccccttcctcctcccactatgcggccgctcccgcccccgatccccgggagttctggacggcgtgccccttctgctgctacgtgcaccagtacccgcgtgacctggtcgggcgcgccctcaagtgccccaacgagggctgccgccgcggattcgtggcttctgagatcccgaccccacccaccgttgtgccaggcactgatatgtaccactgcgcctgggggttcttccccctcggatttcccaacgcggccgacctgggcgccaactggaagccattctacaaggcgttcccttggaacacggctcccagtggtcaaggtgctgatggtaggagccatggcaaccgtggtggcaggcaggcacagaatgacagtgctcgtggtggctcctctagaggtaggatcaagaagactaccgcccgcaagaaggtcggggcagggttgaggaggcgttctcttggtggtggtgtggagagtggcattgattcttcgatgctcgggcaggaaggctgggctggggatgaggacggtggagatggaaggaccgaggaggtgaggggaattaacataaatgaggcggcgcaagctacagacggcactggtagggttaatgttagcggtgctggtggagttgaagatatgggcaacttccatatcgatgttgatgcaaccgaggatatattggggaatttgcacaacctgcccttcctgagggtggacaatcttgggcggatgatttaactgttcttatggtttgctgtggctagaaaagtattgtatgattagccaggccgaaacagatgtctcagggactggcccttgctgttcaactgttcgttttattttaactgttccatctcctgttatgccatgttgtagttgtagacttgttgtctaccttgtacctgtagttacttagcatcagacatgggaaatttgtatctccattagatggagatcatgccctttgccttagcaaacaaacttgcggagttttatggtgatggaaataatgcttcaaagaggtgtggctggtgcttaccatgccacttttggtttcttcctggcatggtgacacaaatgttgctgagatcaagtaagtgaattatgttctgctttctgagttcgaaaactttcttggctacaaaagaactagtcttagttatgataacctgttgatttggtaatgatcattacattgttctgctgtgtgaattgatacttgatacctctgattttttttatagcctgcttagaattccatatgttacctaatgagatatattccattttccattgtttctgttaacaccaatcctaccacttttgtcattatatatttatttgattattgtgtagagatccattatcagatacacatgagttctcaaattgtttcttgatatgtcacagtataagttttctcctacagaagataggattcaatgatgacatgccacaaaaaatagttgtgattttgtccatcctac

SEQ ID NO: 5823 - DNA, 1418 bp, Zea mays
tccccaaaaccaaaccagctgcctccgacagcatccaccttttcctcccccaaaccatggacttctccaccggcgggagcgtgagcgggggcggcggaggcgccagcgacggccccgcgcaggcggagcgctggctggagatcgccgagaagctcctcgcggcgcgcgacctcgtcggctgcaagcgcttcgcggagcggtcggtggaggcgaacccgctcctcgccggcgttgacgagctcctcgccgtcgccgacgtcctcctcgcttcccagttcatgggcccctcgggccagccggacccgctcgccatcctccagctgccgcccggagtcagccccgaccaggccgccgtgtcccgcgccttccgccgcctcgcgctcctcctcggccccagcaacccgcacccgggagccgagatggcgctccgcctcgtcaacgacgcctacgccttcctctcggatccctctcgccgccccacgccgcccgccgatcccgccactggtaccccttactcctcccagtatcctgccgtgccgctcccgcctccgacaccccagagttctggacggcgtgccccttctgctgctacgtgcaccagtacccgcgcagcctgatcgggcgcgccctcaagtgccccaacgcgggctgccgccgcggattcgtggcttctgagctcccgaccccacccaccgttgtgccgggcactgaaatgtaccactgcgcctgggggttcttccccctcggatttcccaacgcggccgacctgggtgccaactggaagccattctacaagatgtttccttggaacacggctcccagtggccaaggtggtggtggtaggagtcacggaaaccatggtggtaggcagccacagaatgacagtgctcgtggtggctcttctagaggtaggatcaagaagacgacggcccgcaagaaggtcggggtagggctcaggagacgttctcttggtgctgacagtagtattgcttggagcatgttaaagttgggtgtttgtgtgaagctgtgagattatgtcttggatgggggttgtcttgcccttttatagctcaagggtagaagttacaatgagaacttgtattctcctaggtggagttcgacctcccgcctttgggcctcgtagcctttatggtgtcgtctgctggatcatgcgtcgtcgtaccctggtacggcgtcgagtcttgtccgcccgtcaatgggttcctatagatgttccgatatagacgtagtgatgcttggtgggtccggtcgagtcaaatcgaggtgaggtttaggggtgtctttagtatagcttcatcttccgtcatccccttagcgtcacctttcatcatttataggtgtatgcctggtacggcatattgccccgccccttctggcgtatgggtcaatgtagagac

SEQ ID NO: 5824 - DNA, 1445 bp, Zea mays
ccgggggcaacaaaaatcacgtttccatccatcctggcgcacaagaggaagcggagagctctctctctcccgcccgcaatataatggcgagagcacacctagccctggtcagcttcttcgctgcctcaattattggtgcggcgtccaagtcgttcaccatcgccaacaactgcgagcacacggtgtggccggggatcctctcgagcgccgggtccgcgggagtggacaccacaggcttcgcgctggcgccgggggagtcgcgcgctctgagcgtgccgtcggggtggtcgggccggctgtggggccgcacgctctgctccaccgacgcggccacgggccggttcgcctgcgtgaccggcgactgcggctcgggcaggcaggactgcggcggcggcggggccgccccgccggccacgctggccgagttcaccatggacggcagcgggggcatggacttctacgacgtgagcctggtggacgggtacaacctgccgatgctggtggcgccgcagggcgcggccgctgccgcggggggcagctgcgtgcccaccggctgcatggcggacctcaacggcgcgtgccccgccgacctgcgcgtggcggcttcgacgacgtcctccggcggcggcggcgtggcctgcaagagcgcgtgcgaggcgttcgggtcggcgcagtactgctgcaacggcgactacgggaaccccagcacctgcaagccgtcggcgtactcgcagttcttcaagaacgcgtgcccccgggcgtacagctacgcctacgacgacgccacctccaccttcacctgcgccggcgacaccgcgtacgccatcaccttctgccccagcacgaccagcgtcaaggcggccggaggtagcccgcaggagcaaggagccctgccgctgatgaacgccaccatggtgtacctcggcggcgaccaggtcggatccgccacagccgcggcccggctgccgtccggcctcctccaccacgtcgtggtcctcgccgttgtgtccctcgcgctagcaggggctctgtactgatggtgatggcgaaccccactgcacagtgacgacgcgacgccacgcgggacaacagcccacgagacaatcgtgctcctctacagaccgaaggaaaaaaaattaaggatagaaacgagaaatggacgcatcacctgcctgccggtgtggacggcggtggtcctcgcggtccagcgagactgcgagccccgacgacggtgtgattattcacccgtgccgaccgagagagacgtgtgtagtggcgatacaaatttgattgaagacattattgtgcgttttcttagatatttattaattacacgataatacacacatgtattattatagtaaaaaaaaaaaaaaaaatgtggtaaatgctagacatcctctttttcttcctttttccatatacaagtcagtggttacgataat

SEQ ID NO: 5825 - DNA, 6698 bp, Zea mays
  misc_feature (4936)..(4936): n is a, c, g, or t
  misc_feature (5577)..(5577): n is a, c, g, or t
aagcagcaagcagcgatcttagcccaaattttttcacccctcgtcgtcctcgcctaagccgccgcgcctccgatactcccaaggcagcgctctcctcgtgctgcgaaagcagcagcagcaagcgagtagtcaccaccatctcaaatcttcccctccacgctccctttcccttcctctacctcccctaccccgccgccccgcaatggccggcctcctccacctccagtccacgcttctaccctcggcatccgctctccgccgccgcgcgggcgcgccggtgccctgttcgtcccgccgccgatgccgggtcgaggccaagatccgggagatcttcatgccggcgctcagctccaccatgaccgagggcaagattgtctcctggaccgccgccgagggcgaccgcctctccaagggcgaccccgtcgtcgtcgtcgagtccgacaaggctgacatggacgtcgagaccttccacgacggcttcctcgccgccgtcctcgtgcccgcgggcgagtcagcgcccgtcggctccgccatcgcgctgcttgccgagtccgaggaggagatcccggtcgcgcagtcacaggcggcctccttctcctccagctccccctcgcctccgcctccgcaagaaactgctcaagaagcatcccctccgccgccgccacctcctccctcggcgccggtggcagtctctgctcccgcgctaccttcgccagcaacacaaggcgggggacgtgttgttgcttcaccctacgccaagaagctcgccaaggacctcggcgttgatcttttctctgtcacggggtcaggccccggcgggcgaattgtagccaaggatgtcgaggctgcccttgctgcgcccaagaaggccgcaccagtgactgctgcacggccggatgtgccattggggtcgacagtaccattcacgacaatgcagggtgctgtcagcaagaacatggtggagagtcttgctgtcccgaccttcagggttgggtacaccatcacgactgatgccctcgatcagctctacaaaaaaattaagtctaagggggttacaatgacagcactgttggctaaggcgacggcaatggctctggttcagcatcctgtggtgaactgcagctgcagggatggaaagagcttcacatacaacaaaagtataaacattgctgtggcagtggccatagatggtgggttgattacaccggttcttcaagatgctgataagcttgacatttattcattgtcaaggaaatggaaggagttggttgataaggcgcgagcaaagcagctgcagccccatgagtacaactctggcacctttactctttcgaatcttggtatgtttggagttgataggtttgatgcaatactgccacctggaactggcgcaatcatggccgtcggtgcatcagaaccgacagttgttggtacaaaagacggtagaatcgggatcaagagccaaatgcaggtaaatgttaccgctgatcatcgggttatttatggagctgaccttgctgcttttctgcaaacacttgctaagataattgaggatcccaaggatcttacattttaaaagtccctgagtgattgtttttaaaagttcctgagtgattgtttttccttgagccaatcacaattgggtgcttctcacccatagtagatttgtagtatgtcttattgtgaattagttgatttaagctatcatcaatgtcagcatcaggtaactttacctgctggttggttatcttaccatcattggtttgtttttcaataaattcttttcttttatctttcttcttcattcagataggtgggtaaggatgggtgtattcatcattttacctgagttttcatggacatttgattttgtttagcttaacaatgtaccatgaccttgggtacaaggaatgaaatgcaccttgtacttgtaccaccctgtggttgatttcacatgcctgtcaaacagaaatacggttgatgcccttgcaagtgtgtcaacgtgaaatcttcagggagatctgtaaaaaacgggccacacatctgtttgttttacatgtgaaggagacggaccatgattcgtcccaaccactcccatgatgccaaggctgtagagtatcggatatcctggcctgttgtacattcctgggacagctcaagatcgcgtcctccattttttccgcagaaagcattcctgtttcagctcgttgtactcttcgtcttctctacttgaaggatcctattaggtggcatgtccggcccctcgcgggccggcctgggccctcctcatatcctgtccgccattgtagtggatagcgaagcaagccacaataataaaacccctccagcagctcttgttcttgccgcctctgtcgtggccttcagcagcagcggcatggcgtcggaccgtggagaggtcgacacctcccgtgccttccggtccgtcaaggaggcggtcgctgtgttcggagagcgcatccttgtcagggaagcccagttgagggcaaacggtggtgcgcatggcggctgtcgtgttggcaaggagttcaactccagggtgaatgctgtcgccattgccgcctctgacgtgaagctgcctaaccggagcgacggcgtcatggaaagccacagcaactccaagccaagtgttgtcaatgtcacctgcaatgccaaggaagagcacagtagttgcagcagcaagcctgctgctccaagcctaccgccggtgcccgtgccaaggccgccggttgcagaagacgtgccgatgtacctggtcccctcctcgccgccgttcttcgcgtcgtcgccttcgctggccaacgacgacggcgacgacgacgagcaagagcgcaaggcagccgacctcgtcgtgattagcgccatcaggaggctggaggacgaggcggccaggacgaggcaggaggtggcgcggctcaagaggaggctggccgagatggagctgtccatggcgaccctgaacgcgaagctccaccgcgcgctctccaaggtggcgcacatggaggcggacaacgcggcggcggcgcgcgccagcatcggccgcgacatggcgctggcggtctcggccgagcgcccgcgccgcgcccccaccagcaggccgcagctgggccacctgctgaggctgggcgtgggcgagcaggccgacagggaggcgcaggcgcttgtgtccggctccggctccggcggcggctgggcggtggcgccagcgaggaggaaggcgcagaagcagaagcccatcgtgccgctggttgttccgctcgttaatggcgtgctcttctccaagaagaggaggacgaaggacaaggagagcgtgtacatgaaggagctttacagcttgcttaggctgagttgatcaaatttaaggctgccatgctaaatctgtggatgtacttgtgcacaatcgttcataatcatgtgcacggacgttatctacctacacactaatttttactatttgtttctatagtttctgtgactacatgtggatcgtgcagtgcgaggctgcaatttgtacattaataatgtaaatctagcattagtgcttatttttttaatgttgaaatcaacaacttattcctttggaaattaacaattcatattccttgaaatgcaccgatatgctatttatagggtgtatcctcaaatgccgctccctagttttcagttacatttccaacatcctcacatacatgttcacaaaaacaacgacgccaacaaagatcaaatttttttgggtaaccatttttttatttgcctttttttttgtgaacatctgcatccaaaggacagtagacacaaaatcgattgtccggtgatcatctgatcttggatgaaacagcgtccctggtcgcgcgcgcagttcatgatcaggctcttgtcattattccctgtgatctgagcggtggtgatctctatttgatcattggtcccgatcgagaggatcgatgggaccgccgcagaggcagcggccggagcaggcgcggccggcgggcagcgcgtgcgtgtgggtggtggtcgtggtcctgctcctcgccgtgctggccggcggcgggtgcctggcgctctacgtgacgctgccgccgtccgaggtgccgcagtggctgccggccgccgggctggcgctcgtcgcgctgccgtgggcgttctggatcgccacgtgcgcgtaccgctgctgccgctcggcggacgcggcggcggcggctccagcggtggccaacgtggtggagcggcggccgtcgtcgtcgagggcggcgggcgccgccttggcagcggcgcccgtgccgggcagcaagagcctcaagagcgcgcgcagcacgaggcacgccaacggcggcgggccgcccgcctccgggtcccccaccgccagcagcgccgcccgccgggtgcgattcggagacaccacggtgctcggggaggacctcgccgcgccggagtcggacgacgacggcggctcgtcgtcggtgcactcgaacgagagcgaggcgcctctcgcctacaacatgctatcctcctcgtgatggttgatgccttccgcatcgtgtagtgcaggtaatcagcaaatagatcagtaataataattgaacggatacgtgtagtggttttctgttaccgccgttgtgaaattaaaggcgaaagtttttcgttttccctgctccagaattcagaacccatcagattcagaatggtgtgcctggtttctttcggctctgttttttttggtcttatcgtgtgtattcgtgcgatttggtcgtgtttttaacactttctaaataactactagcaaatatcaaccaaatacatatccgactatgcatgtgttctataggatggctcaagagttcttaaaaaaagcttcctaaacttatgattagcaagttgctaaagagagctattggaagtaaaaaataactttagtttntaatagttcctaatatttaccgagcagttcgaatatagttttggcaccgtcggacttggctggcggcggggtcgagagcagaggacgccgaaggtagagaaggccggccgacgcgacatgtggaggagcaggtttggcggcatgacctatagggtgacggtggtcgaatgtgaaggaaaacttgtgtcacacgcgtgggacttgactatctcactgtacagaaaagaaataaaaagagcgcgctagacctggctacctcactaaacatgaaagaagaaaaatattagcacgcgagtatgaagaaatcaaagtcaattgtgtttatagagtgcctaccgggttatcaaacttggagagtaaatgaaattagatagcaactaactaaatttagcaaatctatttagagaaatattggagaatcatttttctgttcacttcttaaatttaagattatggagttgtttggagaactattagagttgcttaggcgtagagaacatgatgcaatacatcttaagctatctctagcagactacctattacactctcaatctcactctctattttaaacttcactctataaacaatatcgtctataatataaaacaatgttttgtacgtccgtttgcatggtctgctgnagttggcgtaagtatgggtcatatgactcctgagtttatttccttgtaggattataacctaatgacatgcttatgaattataataaggtagtatctagattatataatttacttaatagcttttactattgtttatttgtctcttaatttatttaagctaaattatataatctagaggataagtaaatagggccttaatatacatggcaacattggcgaagctaaaacaattttgaggtaggtacaatcaccttaggggggcataagaatatcttttataaaattacagatatcgtacaattttaagtatattttatatattttgcattttggggtgcatttgcacccttacaaagagcgtagcttggccccttcatggcaaatgacattgctagttataatcttgaactgaatgttgagcgtgcatcatgatgggtttggttttgggataactgtaatgttcacacactcaacattaccgaacgctcaacattcagttcatggctagttgtagtctcgaacttaggggctgtttggtttgctacctaatttaccatattttacctaacctttctgtctaaggttagtttttcaattcgaatgactaaccttagacaaaatatgccatagttagccacaaaccaaacgtatccttaataaatacacaagtgattgtatggcgtgatgatagtaggcgagctatagtcttgaaatcattttttaggaatagttgactaagttaacagtctctagaaatcatctttacaaatgatggatttaaaagatctgttgaagttgaattattactaatagttaacttaatagaagcattcctaacaatatcttaacgaagtcaatgaaagtgatgactcttccaaagatgaaaatagcctaattggcttgctccgtgaacaaaagaggaaataaaaagaacaataaaaatatatttattttctataacaattaaagaactcaattcgacctttgttgcgtgttatgagtaattacttaataagtgactagaaaaatgagcattttggaatgcatctacaagaatccaattaattctcgtcggctaagaaccaacgggaataagcaccaaactgacggagattacttat

SEQ ID NO: 5826 - DNA, 3058 bp, Zea mays
  misc_feature (936)..(936): n is a, c, g, or t
  misc_feature (1022)..(1022): n is a, c, g, or t
cgccttctggagcaatccccaaagccgggttagcagcaggagcgacgagcccaaaccttcctacccctcgtcgtcctcggctaatccgccgcgcctccgatactcccaaggcagcgcccgccagctgcaacaacagcatcagcaagcgaggagtagccaccagcccaccacgatctcatcagactcctctcaaatcctcccgcccactctccatttccctcccctcccccgccaccctgcaatggccggtctcctccacctccagtccacgcttctcccatcggcgtccgcgctccgccgccgtgcaggcgtgccggtgccatcctcgtcccgccgccgatgccggattgaggccaagatccgggaaatcttcatgccagcgctcagctccaccatgaccgagggcaagatcgtctcctggaccgccgctgagggcgaccgccttgccaagggcgaccccgtcgtcgtcgtcgagtccgacaaggccgacatggacgtcgagaccttctacgacggcttcctcgccgccgtcctcgtgcccgctggcgactcagcgcccgtcggctccgccatcgcgctgcttgccgagtcagaggaggacatcccagtggcccagtcacaggctgcctccttctcctccacgtcccccttaccgtcgcctccgcaagaaactgctgctcaagaagcatccccttccccgccgccacctcctcccccagggccggtgtcagtctctgctcccacgccgcctttgccagcaacacaaggcgagcgtgtggttgcttcaccctacgccaagaagctcgccaaggacctcggcgttgatcttttctcagtcacggggtcaggcccctgtgggcgaattgtggccaaggatgtcgaggctgcgcttgctgcgcccaagaaggccgcaccagtgactgctccacggccggnatgtgccatttggggtcgacggtaccattcacgacaatgcagggtgctgtcagcaagaacatggtggagagccttgccatcccganattcagggtcggatacaccatcacaactgatgctcttgatcagctctacaaaaaagtgagcatctttgcacaatgtttaggaccattgttttatgaatatgatgattggataaaggggtaagctcgcattttcgttttacagattaagtcgaagggggttacaatgacagcactgttggctaaggcgacagcaatggcgctggttcagcatcctgtggtgaactccagctgcagggatgggaagagcttcacctacagcagtagtatcaacattgccgtggcagtggccatagatggtgggttgattacaccagttcttcaagatgctgataaggtcaaacactttaccatgcacaatgagtgttgatatttttgatgattttttttaaataaatggttacttgctggtttatgcagcttgacatttattcattgtcaaggaaatggaaagagttagttgataaggcgcgagcaaagcagttgcagccccatgagtacaactctggtatttctttgcttcatacacaaatctgaatacgcagcacattgttgtgtatcttttctaatgttttgaataagattgtatacttacagagattcacttattagcagcaggataaaagaatctggtggttgctagatatttttggtacaatttaccctagctaaatctgctatacgatcaaaaaaagatgcaatcctctgtgttgtatatgctttctgactcatatcaaatatgataccagatacctgacaaactgtacaattaccagggtacaaatacagtttcattttgtataacttgagtccatagtcacaaagttcctagatcgatagggtcgaggaacgtggtatgctacatgtgagagatttttacatggtgggaaagaaaatgaccctgcgtaccgggtcgggaacgacgttcccgggtcgagggtcactaccactgtacccgttgcttgtggctatgttgagtcatttatagaaaaggtttcgccccatctgcagtaggtcgcctgattcttaaactttctgataccatcacctacattgctccgctgcaccttgccaccaattggagatttggagctctcttggactattgaatgtcacagcctaatacagctctatgcttccgcctcattacttaatacgagtgcaatcctcttcatgtggagaggaaagggattaactgctacaaactgcttatggttacttgaataagtacatatcatgttgtcataagcgttttactttgacaatattttgtaccaggtaaacatatagaacatggtgatcggtgtcaatactcaatattaaggatggtgctctttattaatgataatttctgtatcatatatatatatatatatatatatatatatatatatatatattgtgatatccattatcatggtctaattttagataatttattaccaatgtttaagttttctccatgcctctagtctaatcaatttgcattctcctaatccaatcacaattttgttatcagtctcgtaggccagaagtgtttcttctagctgtgacttagtgcttttcttggatgtggccttctcataatataatctaggagtttggccaaacaataatcttggatgtgactcaattttgttagcttgtcagcacatgctccatagtccatattagaagtgtcttttgtggagggaagttatgcactgagacatctcatctcacttgtaaggttaagaaaactaagatatcatcaagtcaattattagtttattttcttttatctaatgttgctggcttggagcgagcctcctcacagcagagcagaactttctggagtaaatatgaagatggagggtaggccatagaaacagtgaaatgatttgtattggctttaaccaattgactaaagttttttggatcatttaagccttatgtccattgatagcctcttggtgttaaccaataaccacatcaaacatgtagaatacggtgaccatgttcttttgtgtatgctaagaactgcacatgttcattctgca

SEQ ID NO: 5827 - DNA, 2102 bp, Zea mays
ggacccttttgtaaattatgtacagtaattcgttaaagatcctgacgaaccgtccacggatgggacgaccaccaaaaaacatagaggtgcatccatcagccacatgtttaggcccattttagaataaagaaaattttactagatcctgcattttcttgtgtttttaaactaatttctatagattttctatatcgttataaaattcatgtgttccctagaagctgttaggcgtggctatatatagccaataagcatgaggcctgcgagcccggcacgaagcccgctgtttgggcccggttctatgtggatccaggtcagcccggaacgaataagcagcccgggttcggacagaaaattaggcatggtgggctagtccggcatggttggtttacctctaagcccgttaaaccctgcactaaaacgtgcccgcttttctgtccgtttagacccgccctgggtcgggctctgacaaaaaatcgagcatgcggacttagacggtccgacccgattttctagccgcgcttggcaggccaggctcaaaacgggccgggcttcactggacccgggtcgggcgacccgtttggccatctctagtcgtggcgcgtgggacatataaatcagtcgtcgtggatcgatatatgccctgcttgtgcattcatattgaataataaaactcaagcaccctttagactggaggacataaaactatagatgatatgatttaatcctattttagagtatagtttaaaatatgtgataagatatgggatcggtggagataggcctacgaagacacgttaattaattgtcttatgtttgtagcacgtacaaagagttcagagcctgcccttatttcagttatttacattaagtggatgatcaatttcactcttttaatataaccaacctgtttaaaatcaaaggtccaaaccatttacttgtttctccggttctcccacacgtcccccagccctataaaaagcaagaggcgggtaggttaggttgctcagacgcgcctaggagcagctgctgggcagctatccagcgggccactgagtttaccttactcttactcttacatactaagatcgctaccagagcatggcgggaacttcgtcgtggtcgtcgtcttcatcctgcgcgtcgtcgttcgggtcgcccgaccacgacgtcgtctgcgtcaccgagccggactctgtgggcgccgcagccgtcgccgtcgccgacgccgagggaagcgtcaagttcctgtgcagctacggcggcaggatcctgccccgccgcaccgacggcacgctgcgctacgtcggcggcgacaaccgggtcctctccgtcgaccgtcccatccggttttacggtagtacatatatttgtgccggcgaatcgacacgagtccactgaacaatcctttgatttctctgacttcagttgccgtttatttctgtcggcagtgttgcagcggaagctgagggaattgtgcggcggctgggaagcgcacctgcggtgtcagctaccgacggaggacctggacgcgctcatctccgtcacctgcgacgacgacctcgccaagctgctcgaggagtacgacgaggctagcaaggaccgcctccagtcgctcaagatccgggcgttcctgttcccgactaggacgccggcgccgtccatactacagcgtaggagcccgccgtcgattgctcacctccactggcaaaacacttccccgccggccgcagccggcgtctcgctgacgtgcgcgccgcggtggtgggcagcgccccaggcctctcgccaggcgcaggcgccccaggcgcagaactacgaccgacacagcctcggtgaggagcggccgcgcctgtactattcatatatgccacggacataattagatcagatttatcattagaccctgaccaaatatggtccaaaattttgttgaagttttaatagacctacatgaacaacttattgtaacatatatatacggagtaatataaaaaaatgggcgcttacagttgagttaaaattataattcaggcacgctatagtattcatgtttaggaaaaaaaaatgttcatctgaactttagatctgaccccccgcca

SEQ ID NO: 5828 - DNA, 790 bp, Zea mays
cattgggtacctcgaggccggccgggagacgcggctaggtcggagcaagagtaagggagcagctgctgggcagctatccagcgggccactgagtttaccttactcttactcttacatactaagatcgctaccagagcatggcgggaacttcgtcgtggtcgtcgtcttcatcctgcgcgtcgtcgttcgggtcgcccgaccacgatgtcgtctgcgtcaccgagccggactctgtgggcgccgcaggcgccgtcgccgacgccgagggaagcgtcaagttcctgtgcagctacggcggcaggatcctgccccgccgcaccgacggcacgctgcgctacgtcggcggcgacaaccgggtcctctccgtcgaccgtcccatccggttttacgtgttgcagcggaagctgagggaattgtgcggcggctgggaagcgcacctgcggtgtcagctaccgacggaggacctggacgcgctcatctccgtcacctgcgacgacgacctcgccaagctgctcgaggagtacgacgaggctagcaaggaccgcctccagtcgctcaagatccgggcgttcctgttcccgactaggacgccggcgccgtccatactacagcgtaggagcccgccgtcgattgctcacctccactggcaaaacacttccccgccgccggccgcagccggcgtctcgctgacgtgcgcgccgcggtggtgggcagcgccccaggcctctcgccaggcgcaggcgccccaggcgcagaactacgaccgacacagcctcggtgaggagcggcc

SEQ ID NO: 5829 - DNA, 840 bp, Zea mays
  misc_feature (771)..(771): n is a, c, g, or t
  misc_feature (784)..(784): n is a, c, g, or t
cattggggacctcgaggccggccgggacagcgtccgttccctgccacagagaaacgaactctcttgagtaccacaaaaaaaaacattggcattctctgtagtagagcacagagcgaagccgtcaacgatggcttccgctccgctgccggcggccatcgagcccgggaagaaaggcaacgtcaagttcgccttcgcctgcgccatcctcgcctcaatgacctccatccttctcggctatgatatcggagtgatgagcggcgcgtcgttgtacatcaagaaggacctgaaaatcagcgacgtgaagctggagatcctgatgggcatcctcaacgtgtactcgctcatcggctcgttcgcggcagggcggacgtccgactggatcgggcgccgctacaccatcgtgttcgcggcggtgatcttcttcgcgggcgccttcctcatgggcttcgccgtgaactactggatgctcatgttcgggcgcttcgtggccgggatcggcgtgggctacgcgctcatgatcgcgcccgtgtacacggccgaggtgtcccccgcgtcggcccgcggcttcctgacgtcgttcccggaggtgttcatcaacttcggcatcctcctaggctacgtgtccaactacgccttctcccgcctcccgctccgcctgggctggcgcgtgatgctcggcatcggcgcggccccgtccgtggtgctcgccctcatggtgctcggcatgcccgagtcgccccggtggctcgtcatggaggggccgcctggcgngacgcaaggtggntgctggggaaagacctcgacacgccggaggaggccgcggagaggctcgctgacatc

SEQ ID NO: 5830 - DNA, 1633 bp, Zea mays
  misc_feature (1631)..(1631): n is a, c, g, or t
cccttatatatttattttaatatgtttagatcgcgtccggtcgcccttttttttttttttaaaattaaaagtctgcctgttttgaattacacatcgagttccattggacactactgaaactttcaaaatataaactataaactaacaaatctactgaaactttcaaaattaaaagtcgcctgttttgaatccacccacactggagtgttgaactttttctcattctcctgaatggaatatacactgaacctttatacagcaccaagtgggaaaaaacattaaggaaggccctttcatattcatactaacttttgttgtcagacaacccggcaaactagacgcgccaggactggctagcttcgcgatcacgctaatatttggcagcgcgaaattagcatgggaggcttgcaaaacagcgttgctgctttacagagggaactgaataataatgtccaggaattccagctcctgcggctctcttctgttcttccatgcagcttcctgacatttcggccgtcctccgatctccataagtccttttggaacaaactgatctccagtagcaatcacgagaagtggcgaatcgttgatacggccattcattccatcaggacgttttctcgtcggcctccatctgcaggatctgtcctggccttctttctaatattcagcttctcatgttcagtgatcttcttttatttattccgagtcactgtccatgtcgtgcatagctttcaatcccctggggcgcttcttggaaaccttcttctcccggacttcatatctttcaagagtcaagtcacatagccacgttcctgggcatacaaaattgacggttctctggatgaccttagcttttttcttgggtctttgaggcagcttggatcctttgaacaccaggaaatcctcttccttttccctgtttgacagggtgatttcaaacttcggccagatggacccctcactccctgatgaagagcctttcttgtcatccggacaggtctgtggacctccgttgttgttgttgttacctctaccagggcactccctgtccggtgaagcaactgcgtcgatcctgctgttctgttgttgccgtgctggcgatttcatgatcgcaaactcttctgtgttcctgaaaacacggtggtgggtgtggccgtctgggtggtgctgggcagctgtggccgcggcgcggcgctggctgatggcggctttctcggcggccacggtagcggcggcctcgacgtcacggcgctgcaccttgacgcagcgcaggcgcttccggttgccccactgtaacaccaggtcgcgctcggcagcggtgccgccgccgccgcgcgaggagccccgggtgtggtagtgattcctcgcctccttcatttcgcgacgagcttcaaaaactgcgcgtctgagagtctctgcgcccaattcaccttcctgctctgttaatcctccgcttctcgtctcatctacaacacagatcaagcagaggaacggattcttccttcaaggcaaaggtttcgcggtaaaaggaagcagaggaaattccggacgccccctctcgtcctctcttgatgcctggtgaggagaaagagcttttttttttttttttttttttttttccccggccngg

SEQ ID NO: 5831 - DNA, 993 bp, Zea mays
  misc_feature (972)..(972): n is a, c, g, or t
  misc_feature (981)..(981): n is a, c, g, or t
  misc_feature (984)..(984): n is a, c, g, or t
  misc_feature (990)..(990): n is a, c, g, or t
ggcccgccctccgccacctctataaaaacattgggtccctcgaggccggccgggagcagcagaagcaaaagccgcaggccgcaactactccgatctgagtatcacagtcacagctaatagctagccagcagcccagcacccagcaactacccgtacgtacgaacgtgcgcttccgatggcgaccacggtgatggcctccgcgaccgcgagctcccccgccttctccgcccccggcgcgcgcgccaggcgcgccgcccggcttccggcggggttccgcggccgtgtcgccgcgccgccgcgccgcctcgcgctgctcgccagggcctcccagcaggccgatgacgctgccgccgacacgagcgcgagcgcggcgccggctgctcggaagctggggctctgggacgcgctggcgttcagcgggcccgcgccggagcggatcaacgggcggctggcgatggtgggcttcgtgtccgcgctcgccgtcgaggccacccgcggcgacggcatcctctcgcaggccggcaacggcgccggcctcgcgtggttcgcgtacaccgccgccgtcctgtccgccgcgtccctggtgccgctgctccagggggagagcgccgagggcaggagcggccggttcatgaccgccgacgccgagctctggaacggccgcctcgccatgctcggcctcgtcgcgctcgccgtcaccgagtaccttaccggcgcgcccttcgtcaacgtgtaaaatacatacaagccgcaacgtacagctgtgatagactggtagactggtagtacgtttaatttgtaaaaggatagtgtagtatatggtaatacgcgtacgtatacgtatgtatgcatgcgtaattacaatagcttggaaatttactgtcttctataggattccctgaaaaaaaaacgtaataataattttttggcacctgaaaatattgtggaatggttctattaataaaaagggantgcccgctntantaaaanggt

SEQ ID NO: 5832 - DNA, 863 bp, Zea mays
aaaaggttccccgaaaccggccgcaaaggatttgcccgtagtataaaaggggccttcgaaatggggcccccgggaatgccctcggggcccggagagtccccgcctttttcggccccggggggggggccaaggcggccggccgggtttacgggggggttccggggccgttttgcagggccggccgggccgccttgtgttgctcccaagggcctccaaccaggccgatgaccctgccgccgacacgagcgcgagcgcggcgccggctgctcggaagctggggctctgggacgcgctggcgttcagcgggcccgcgccggagcggatcaacgggcggctggcgatggtgggcttcgtgtccgcgctcgccgtcgaggccacccgcggcgacggcatcctctcgcaggccggcaacggcgccggcctcgcgtggttcgcgtacaccgccgccgtcctgtccgccgcgtccctggtgccgctgctccagggggagagcgccgagggcaggagcggccggttcatgaccgccgacgccgagctctggaacggccgcctcgccatgctcggcctcgtcgcgctcgccgtcaccgagtaccttaccggcgcgcccttcgtcaacgtgtaaaatacatacaagccgcaacgtacagctgtgatagactggtagtacgtttaatttgtaaaaggatagtgtagtatatggtaattggtaatacgcgtacgtatacgtatgcatgcatgcgtaattacaatagcttggaaatttactgtcttctataggattccctgaaaaaaaacgtaataatattttttggcacctgaaaatattgtggaatggttctattaataaaaagggaatgaccgct

SEQ ID NO: 5833 - DNA, 1922 bp, Zea mays
tacattgggtacctccaggccggccgggagcgaatacgtgacttcccctccccttctcccccctctccactccatcgtcaaggaaggaacacggccctaactaaaccctagctaagggaagggaaacaagaccatggatgcctccaagctccgcgagcttcgcgacttcgtcgaggcgtgcaagaagaatccttcgctcctcgccgaccccaacctctccttcttccgggattacctccagagtttgggtgccaaaattcccgccgccgccccctctttcgaaagtcccaagagatcttccatggacgacattgatgacgacggtgatgacgacgacgatttggatatgagggatcccactcctgagcgagacgagctcgatgaagagattgttgagtctgatcttgagctcgaaggagaaattgtacagtctgaccatgatgacccaccacagaagatgggaaatccttcagtggaggtgactgaggaaaaccgtgatgcttcccaagaagcaaaaggcaaggctatggaagcaatttctgaaggaaaacttgaagatgctattgaacaccttaccaacgcaatagtgctgaatccactctcagcaatcatgtatggtactagagcatctgtgtttataaaaatgaagaaaccagctgctgccattcgtgatgccaatgctgctctagagatcaacccagactctgcaaaaggctataaaactcgtggaatggcatatgccatgcttggcaaatgggaggaagctgctcatgatctgcacacagcatctaacatggattacgacgaggagatcaatgctgtgctcaagaaggtggagcctaatgctcacaagatagtggaacatcgcaggaagtatgagaggttgagaaaagagagggaggaaaagagagcgcagcgtgatcggcttcgtcaacgtgcagaggcgcaggctgcttacgacaaggccaagaggaaggagcaatcgtcaagtcgctcatcaggaggtgcatctcccagaggctttcctggagggatgcctggtggtggtttccctagagggatgcccggtggaggtttccccgggggtggcatgcctgggggtttccctgggggtggcatgcctggaggtttccctggtggtgttcccggtaatgttgatatgagtaaaatcctgaatgaccctgacctgatggcagcattcagtgacccagaggtcatggcggctttacaagatgtgatgaacaatcctgccaactttgctaagcaccaagcgaatcctaaggtgggccctatcatcgcaaagatgatggccaagttcaatgggtcccagtgatggttatgtcgcagtcaggttttgtgagcagcaagcaaaggtttgttggacagtgaacaggtgttcttttcgtgcatctggtctgggagtgtgtttagcttgtgatgaagaacatgagtgtgtgtgttggtcgtggtgcatctggaggtgcgatgagcatgtgatgaaaaaaaaaccaaacggctctatggtgatgtatgcaaaaagttgctttcgaacttgatttctcaattcacagatggtttgacagtttcttgaattatagaatgcttgtgtgctgctagtttccctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccccttttaaagaaccaaattttacttccccggccttgcaaggtaaaattttttttttagggcccccaaaataaaatcaatggcccgggttttaaaaacggcggacttggaaaacccttgggttacccaaattaaatccctttgaaaaaattccccttt

SEQ ID NO: 5834 - DNA, 4001 bp, Zea mays
tgtgcatggaagctttggtgcttagcgctattgagttccctgaccttcttttggaaatagtactttgtttatatctgctgctcttcggattatatattcattcatctattacatgttactagtgtgcgtcaaatatttactgattccttaagactatacttaattgtttactgaatataagtggtgttcttttatttaatttgatgctatcagctcataattggttgagcttaggctagccttataagatgaaaaattggtgttcaaaatgactcatcttgtttttcctgagttgagtattttcatttgggattgctagtaaattggtacctgatttcataattgcagaggatatgtatttgcagtaagtgtacatcgggttcaactgcttctacaagttttgagtgtgaaaagatttcaccaccagcaacagcagcagcaggctcaaagcaatgctcaggaagagctagcagcagttgaaatcaatgaaatatgtgactactttagcagacgtgttgcctccgaaccatatgatgcggctagagttgcttcttttatcactttgcttacattaccaattttggttctgcgcgagtttttaaagctgattacatggaagaaaggtctttccccggttcatggggacattgctactgcacagagggctcgcatcgagctttgtttggagaatcactcaggatcagcttcgtctgataacaccgagaacagcagtttagccaagagtaatattcatcatgatagagcccacagttcagtagaatttgccctgacatttgtacttgaccatgctcttattcctcacatgaatgtagctggaggagctgcctggcttccatattgtgtatctgtgaaacttcgctattcttttggggacaacaatcatatagctttccttgctatgaatgggagccatggtgggagagcctgctggttgcagtttgaggagtgggaaagatgtaagcagaaggtttcaagagctgtggaaactgtgaatgggtctggtgtagctggagaggtaggccaaggaaggctgcgaatggttgcagagatgatccaaaagcagcttcaactctgtctacaacagctaagagatgacccactttctgcaggctcgactgcatcatgaacttgcttggaatgagctctatcaaggccattgatgtctgtcatattcagcatggcctttggctttgttaacgtgtagatgtgaaggaatacacatttggtagcagtgacagtttcgcctgaggcttgctcagatgacaattttgtacagtataaatggtggcggttgactctgatggacctttagttagcccatttgaacgtggcctgtaacatagctagggtgggtaataatgtgccaaggtggaattgctcagggatgcaaaatgatcttcgggaattggttgtctgtatcatctactgtaatcgtgtcctttttctccctttctgatggatagttcatttttggattcgttatcatctttcttctgtctgtactatgttaatctagacattggtggatctggtatatgtgttgttgtacatgatatattggcactggacttgagactgacgcatttgacgtcttagtattagcaggacatctctagttgtgttcagagtgattggacccaaaaaatattgcttggagcttttctttagggctagtttgggaacttaaatctcgaccccatagattcctggagaagatttgagttcccaaactagttcttaatgtttcttttttttttctattgcatcttcttagtaaatgatgtttttgtaactgtaaaaaccgtgccggtcaagattgatacctggatggataagatgatgttgggtcagatttcttgctcatggttaggaaattgatgtgagcactctggccagtttgtttgaaactgatattcgtgagttgtgattggaagcgtatggataggctttttaatcgtgttaaccgtcatacgggtaggcctttttagttctcgtgcttctacgtttgggacacaggtgtcagtttttgtgctttaatggactccataggtatcacgtgaagctgacataagttacttattatcttcattttactctatcttctcgtgagaggaaaaaaagggtttacccataaatctgttttttaaacatttaccgaaagacagctcacacaatatttgcaaaactgtaccaaatgggacccaaatcatggtagcggtggttccattggatggttgtatttgaatatggattgaagcttttgatgtatatatattctgaattagtaacaaacggctggtgctttcttgtggtgctttcgcgaccggaacacatttgatgacataacgaagcatgacgagatgctaacaacacaccttggtatgatacccctttaattactgccatcatgcttacataattaaccgttctcaactttttagcatagaaagaagaacaggcttcaacttcttatcataaaaaaagaagggggaaaaaggtaaggaaatggttggttacacaattcacaagtcacaaccagctgtccgggaggtcgatgttctggaacctgaacgacgagtccctcgagtccttgccatcgagccccggcccgccgctgctgtcgccgtcgagctcgtccgccgccgccacggatggaagcaggaccacaggtggcggcttctcgacgtcggcatccttagccagcgccgcggccaggtcgcggtcccacatgaggaaatgcagcgtgatggggcggagcgcgtggcggtgcagcgacagcttctggctcagcgacacggtgtcgaagcacttgacgttcccggcggtggacaccatccagggcagcaccttctcgccgccgacgcgggacacgaccagcagcttggacgccccgcgcgccgcgcggtgcagctccagcaggcccgaccgcgccgacgccacgcccggcgtgccctcctccgccaccgacgagacgtagatgaacccttcctcggtgcggctgatggcgaaccccagccgcgtgtctcccgggcacagccgcagctccagcgccgcctcgcccgccgccgccgtgtaccacagccgcacggcccgcaccacgccgatgtccacgccgtggtagtcctcgaagccgtacaggctcgcgttcgccatgccggccaggtccgacagcgacgccatgttcacggtcgacaccgccgtctcgccggagatcttggtcagcagcgcctccgtctgcacgttcatgaacaccacgggcacgcccgaggcctgcgacgacagcagccacgcgtccgcgcgcgccagggtgtcctccagcgcgttgtaccgcgtgttggacccgtccgtcgccttgggcagcagcagcagcgagaggaagctgctcgcctccggcaccggcagcagctccctcatcttcttctcccacgggaacggctcgtacgcgtggccgatcttggcgtcgcgcagcgcagagagcagcttgccgttcttagaaccttaaatcataggctcatagcatatcgatcagggcaattgttcattaatcacttgtaaaaaaaatttacttttagatgtaaaaaattcagactgcagtacgggcagtagcgtttctttttggaatcctgcgtattcaactctttgcggcaatgcccaagattatattgttgtatcgtaggagtcaatttgcaacctatagctacgtggtttatgcatgatggaaatagaaaactgtacaaagattgaaaaatgcagcgctggagcaagccttggatccaggatcaacaggtagtaaaatatatacccacaccacaagaagctgaccacatgaaaaacagatgtggtcttggtacttggttcttcgacgttcacaatgtcacagacctcaaaacacgcttgcaatttactacttaaaactctaaagatgcgaaagccagtttgccctctttcattcacagatcacagagaaagaagctgcaacc

SEQ ID NO: 5835 - DNA, 2178 bp, Zea mays
  misc_feature (2163)..(2164): n is a, c, g, or t
  misc_feature (2166)..(2170): n is a, c, g, or t
ctgttggacgcggtggacctgggcttgttcccagttcattactgccttttgatgtttcggttgtacttcgtgggccatactggatacgcattatatatcgcaagaaattttctgttgacatgcgctgctttgctggggatcaggtttggctccagccagctactcctcctaaaggtggaccttcagttggtggatcgttgccatgcccacagttccggcctttcataatggaacatgttgctcggggtctaaatgctcttgaacccaacttcatgaatgctacacaggctagtggacacttaaataacaatgcaggagttccacaaactgctcctagtgcaaatcgtttaaatgctacccctggtgtttctatggtcaggccaacatctggtgttgctaaccatgtagcagccagtttgagtcgagcaggaaatgccatgttggcttcttcggctcttgcttctggtattagtggaacttctgtgcgacttactgctggagctggtctccctgttcacatgaaaggtgaactaaacacagctttcataggactgggggatgacggtggatatggtggtggctgggttcctttggcagctcttaaaaaggtgctgagagggatcctaaagtacctcggagttctatggttgtttgcacaattgcctgaacttttgaaagaaatactaggatcaatcttaaaggacaatgaaggtgctctcttgaatttggatcaagagcagcctgcactccggttctatgtcggaggatatgtatttgcagtaagtgtacatcgggttcaactgcttctacaagttttgagtgtgaaaagatttcaccaccagcaacagcagcagcaggctcaaagcaatgctcaggaagagctagcagcagttgaaatcaatgaaatatgtgactactttagcagacgtgttgcctccgaaccatatgatgcttctagagttgcttcttttatcactttgcttacattaccaattttggttctgcgcgagtttttaaagctgattacatggaagaaaggtctttccccggttcatggggacattgctactgcacagagggctcgcatcgagctttgtttggagaatcactcaggatcagcttcgtctgataacaccgagaacagcagtttagccaagagtaatattcatcatgatagagcccacagttcagtagaatttgccctgacatttgtacttgaccatgctcttattcctcacatgaatgtagctggaggagctgcctggcttccatattgtgtatctgtgaaacttcgctattcttttggggacaacaatcatatagctttccttgctatgaatgggagccatggtgggagagcctgctggttgcagtttgaggagtgggaaagatgtaagcagaaggtttcaagagctgtggaaactgtgaatgggtctggtgtagctggagaggtaggccaaggaaggctgcgaatggttgcagagatgatccaaaagcagcttcaactctgtctacaacagctaagggatgacccactttctgcaggctcgactgcatcatgaacttgcttggaatgagctctatcaaggccattgatgtctgtcatattcagcatggcctttggctttgttaacgtgtagatgtgaaggaatacacatttggtagcagtgacagtttcgcctgaggcttgctcagatgacaattttgtacagtataaatggtggcggttgactctgatggacctttagttagcccatttgaacgtggcctgtaacatagctagggtgggtaataatgtgccaaggtggaattgctcagggatgcaaaatgatcttcgggaattggttgtctgtatcatctactgtaatcgtgtcctttttctccctttctgatggatagttcatttttggattcgttatcatctttcttctgtctgtactatgttaatctagacattggtggatctggtatatgtgttgttgtacatgatatattggcactggacttgagactgacgcatttgacgtcttagtattagcaggacatctctagttgtgttcagagtgattggaccctacccaaaaaaaaaaaaaaaaaaaaaaaaaaaaaaaaaaaaaaaaaaaaaaaaaaaaaaaaaaaaaaaaaaaaaataaaaaaaaaaannannnnnccctcaaa

SEQ ID NO: 5836 - DNA, 3473 bp, Zea mays
ccgctccaaaaaggcgtcaacagatcctaatatatttggctctcaatgattatatattcaaaaggtgaagcatcaaatctgtcacgcacacaataactatccggtgacagttttggactaaaattctttaatttttttattaccaatgaatttaatacttttaaaaatgataaatttttacttgatagagaaatttatttggacgaaataaaaatctatgttcctggctccgccctagcagtgcagtggtgtatatcccgcagtgttttagccgtcgggtcaccgatcacgcatacgtaggggggaaggggaaggaatttgccggatggagggctttcctttcgcttcaattcaatgctagctacgtgaaggccagccagttcatgaaccatccatgcatgctccgtaacgttcaggtcacttgaaccacacgcctcggcttcgcttgggtgagtgatgacaacagacgatgctgaaccgatcatattatcgatggtagcagtggtagtacgcgttacgcaaccgttgggtgttcagtccatgatacgcaaacgcaacgcaacccgccgcatcaaggtcgccccgtctgtgtctgtggtaaataaaaagaacgttgaactttctgagctgagattgctcaagacaatctactaatatcatcagagcgaacgcacgcacgccgtctgtgtctgtggccgtgccggcctggacgcttttttttttttttttttttgttgaacagccgaacacagattgtttatacaacaataaaccatacaatagtagcaccaacagtagcagttcatcaaattacaactcctggacacagctagctagctgattttacaacatacatcatacggagcactactgcttgacaagcatctcctcacatcacaccgtgctgctctttacaacctgtagagcacagcacaccatctagcacaagaaacagctaccaggacaacggacacctgaacggccgggggggtggggtcactgaccagtgtgacacgtaccggccaccaccggagaacgccggacacaaaaacgccggcttcccgtcggttgtggttctctcctcctccggagaaccaaaccctaaataacccgagatctacaactgactcaccagtgacaaggaccaaacgaatcggacggacatctacacagaaccaaccaacgaacggacggacggggattagcactaatgatccaactagtgcccgcgcaggatgtctaaaatcccatctgcgcgacggccgttaaccttctttaaccctcctcctgctgcacgacggcagtgtgggtaggatgggagccagccagccagccagccaacaaggggcgacgattaattggcgaggagggagtcccagtcgatctcgtacgacgggtacttggtgagcgcgaagccggcggcctcgtcccacggcgcctcgctgaagtccagctgctgcatctccggcaccgtcggccctggcgaggcggacggcgacggggacgggcacgaggactcggtggcggactcgaggcaggacgaggtcgcgtcgtcggacgacggcgaggagcagttgctggtgggggcggacgacgacgcggcagctgcggcggaggccggcttcttggcgcccttcttggacgcggcgatgctctggcacaggctctggagcttggcgtcgacggaggcgtggagcgggccgcgggaggcggcgttgtcggggaagttgaggcgcgccgcgtcgccgcgcaggcggtaggcggcctggtcgtaggcgagcgccgcctcctcggcggtgtcgaaggtgccgagccagagccgggtgcggttgcgcgggagccggatctccgccacccacttgccccagtgccgctgccgcacgccgcggtacagcttctgcggccgcgccggggcgggggccgcggacgccgacgccttcatgggctgggcacgcgggcccagcacggaggtctgcgcctggcgacgctgcaggtggaggcgggcctggatgtactgcatctgggaagggctcagctggcccgcctcgtcggccgcggcgaacgggtagttccctccgtaggaggaggcggcggcgacggcttggtggaaggagaacggcgacgaggggctaagtggctggtgcgggtggaggagcggactggatccgtgagcagaggcatcccggataaaaggctcgagtgctctcatcagctcctcccctgacagatctatagtagcagccatctagactgtttttttttttttttttgttttttttcctctctctctagcaaaccaagaacaaacgaagaaactggcggaacccaacagccacagtaaaaacagatggcagtggtgggtagatccactcaggacaggactcacttgcgcaagggaggtgtggaaaaagaacctctcttggctaccaacctaacgactagtactagtacactgctagaactagaaccaaaccgaagaagaaacagcagatctgaagcccgggatctaaaaggccacgggtctctcgctgtctgctcgaggaagaagacggaaccaggaagaacagaagaggatgagagagtcgaagtcgagtgaactttacctgcgacgcgcgagagaaatcgctcagatctaagcttacctcgctcgatctcactggaactgcggcggctgtggacgggcgctggatgggaggcggagctggctgtggacggacggggacgggcggggctgtgggtctgcgggagtgtttggtggggcggggccggcccgcggcggggcccccagctcttttatagcgacgcggcctcgccgcatttgattagcgcccccctaaccctcagtttcatcgcagtgtcgccgtaatttttggaggagtgagtgattcctgattacggattactatgcttcgcgcctactccgccggcgagaagccccccttttcctacagcagcgtgtcagcgatgatggtggcagtggcagagcgtggagagtgagtcactggccagtggaccagcgacctgctccctgcggactccacgcggtgccataattgcacgggcgttccgtggaatgggatcggatgcggcggggtgctgctgccgcagagcctttgaccactggccgagcgccacgtactggcgcgtatggtcctgctccacggcttggtgtcggtggtagcacacgtggcgggttctcgtttgttgcgccggtgtttggtgctcgaggctggcagacgaggagatgcacatcgaatatgctagagcgactatgtatattttttttttctcagccaggagaatgaacccatcggcaacttgaggccgatcattaggcgtttgaaccacacccaaccggcaatgaacggaacagtctttatttgggtgagcggcaatggtgatttccttcagccccgttttttgtacggcaagtttggtcaccggtgctagtgatgccagagaagagaaccatg

SEQ ID NO: 5837 - DNA, 2312 bp, Zea mays
  misc_feature (2300)..(2300): n is a, c, g, or t
  misc_feature (2307)..(2308): n is a, c, g, or t
ggccgcttttttttttttttttttctggggaacagccgaacacagattgtttatacaacaataaaccatacaatagtagcaccaacagtagcagttcatcaaattacaactcctggacacagctagctagctgattttacaacatacatcatacggagcactactgcttgacaagcatctccttcacatcacaccgtgctgctctttacaacctgtagagcacagcacaccatctagcacaagaaacagctaccagaacaacggacacctgaacggccgggggggtggggtcactgaccagtgtgacacgtaccggccaccgccggagaacgccggacacaaaaacgccggcttcccgtcggttgtggttctctcctcctccggagaaccaaaccctaataaataacccgagatctacaactgactcaccagtgacaaggaccaaacgaatcggacggacatctacacagaacgaaccaacgaacggacggacggggattagcactaatgatccaactagtgcccgcgcaggatgtctaaaatcccatctgcgcgacggccgttaaccttctttaaccctcctcctgctgcgcgacggcagtgtgggtaggaagggagccagccagccagccagccaacaaggggcgacggattaattggcgaggagggagtcccagtcgatctcgtacgacgggtacttggtgagcgcgaagccggcggcctcgtcccacggcgcctcgctgaagtccagctgctgcatctccggcaccgtcggcccgggcgaggcggacggcgacggggaccgggacgggcacgaggactcggtggcggactcgaggcaggacgaggtcgcgtcgtcggacgacggcgaggagcagcagttgctggtgggggcggacgtcgacgtagcagctgcggcggaggctggcttcttggcgcccttcttggacgcggcgatgctctggcacaggctctggagcttggcgtcgacggaggcgtggagcgggccgcgggaggcggcgttgtcggggaagttgaggcgcgccgcgtcgccgcggaggcggtaggcggcctggtcgtaggccagcgccgcctcctcggcggtgtcgaaggtgccgagccagagccgggtgcggttgcgcgggagccggatctccgccacccacttgccccagtgccgctgccgcacgccgcggtacagcttcgactgcgccggcgccggcgccagcggcggcggcgacccggactgcttcatcggctgcgcccgcgggcccaggaacgccgcgtgcaggcccctctgctgctgctgctgctgctggaacatgaactgggcctggatctgctggatctgggccgggccgagctggttcaggcccatctggccggccatgcacggcgccgcataaggcgacgagtagagcggcggaagctgcgactgcgaggaggaggcggcggcgggagtgggaagaggcgaggtggcgtagctggtgtaagagggtgtaggcatgtaagaatcttgggacatgcatggagaggacgagtagccatggtagggggaggaggacgaagaggaggaagcactcgttataaaaggctcgagtgctttcgagagctcctgatccgagggggaggaggaggggatctggtgtgcgctggtattgtagtacttgtacatgtcgatggctgcggccattaggactacagcttggatggagctagaagaaagaggctgagaggttgtctttatggaaaatcaaagtagaattttttttttttggaaaaccagctctgttcctcaataaaagtagagaaacgaggtgggtttgtgcgaagaagaaaaaaaacagagagagggtattgcaaaacaaccccctttcgaaggccaaaaggcggcaaggatccagaagagaaaaaaggttctctggatctctgttcctcctaggagaggtgtgatgaggtgagaaaaaaatcctaacccaagaacacgcttctcttgaggattctaaaaaaacccaatagaagagcctcttgaaccggaccttttcttgtgctgtgcgtccctgctgctaaaagaagaaccagagagatcagagaacaaacctgcgtcgctgcgtcgcggatgatttttttttgctcgggtcgctcaagcctcaccgtggagatggatgggatgtggctttggtgttcttgtggtgggggtgaggcgtgtcctcgtgccgccctcccgcagaaaaaaaggcatccactagttctagagcgccgcacacggacgttttataaacacttggggagagggtgtntcaaaanngtct

SEQ ID NO: 5838 - DNA, 2214 bp, Zea mays
ctttttttttttttttttttttttttttttttttttttttttttttttttttttttttttttttttttttttttttttttttttttttttttttttttttttttttttttttttttttttttttttttttttttttttttttttttttttttttttggggaacagccgaacacagattgtttatacaacaataaaccatacaatagtagcaccaacagtagcagttcatcaaattacaactcctggacacagctagctagctgattttacaacatacatcatacggagcactactgcttgacaagcatctcctcacatcacaccgtgctgctctttacaacctgtagagcacagcacaccatctagcacaacaaaaacagctaccaggacaacggacacctgaacggccgggggggtggggtcactgacccagtgtgacacgtaccggccaccaccggagaacgccgggacacaaaaacgccgggcttcccgtcggttgtggttctctcctcctccggagaaccaaaccctaataaataacccgagatctacaactgactcaccagtgacaaggaccaaacgaatcggacggacatctacacagaacgaaccaacgaacggacggacggggattagcactaatgatccaactagtgcccgcgcaggatgtctaaaatcccatctgcgcgacggccgttaaccttctttaaccctcctcctgctgcgcgacggcagtgtgggtaggaagggagccagccagccagccagccagccagccaacaaggggcgacggattaattggcgaggagggagtcccagtcgatctcgtacgacgggtacttggtgagcgcgaagccggcggcctcgtcccacggcgcctcgctgaagtccagctgctgcatctccggcaccgtcggccctggcgaggcggacggcgacggggaccgggacgggcacgaggactcggtggcggactcgaggcaggacgaggtcgcgtcgtcggacgacggcgaggagcagcagttgctggtgggggcggacgtcgacgtagcagctgcggcggaggctggcttcttggcgcccttcttggacgcggcgatgctctggcacaggctctggagcttggcgtccgacggaggcgtggagcgggccgcgggaggcggcgttgtcggggaagttgaggcgcgccgcgtcgccgcggaggcggtaggcggcctggtcgtaggccagcgccgcctcctcggcggtgtcgaaggtgccgagccagagccgggtgcggttgcgcgggagccggatctccgccacccacttgccccagtgccgctgccgcacgccgcggtacagcttctgcggccgcgccggggcgggggccgcggacgccgacgccttcatgggctgggcacgcgggcccagcacggaggtctgcgcctggcgacgctgcaggtggaggcgggcctggatgtactgcatctgggaagggctcagctggcccgcctcgtcgggcgcggcgaacgggtagtttcctccgtaggaggaggcggcggcgacggcgacagcttggtggaaggagaacggcgacgaggggctaagtggctggtgcgggtggaggagcggactggatccgtgagcagaggcatcccggataaaaggctcgagtgctctcatcagctcctcccctgacagatctatagcagcagccatctagactgttttttttgtttttttgtttttcctctctctagcaaaccaagaacaaacgaagaaactggcggaacccaacagccacagtaaaaaacagatggcagtggtgggtagatccgctcaggacaggactcacttgcgcaagggaggtgtggaaaaagaacctctcttggctaccaacctaacgactagtagtagtacactgctagaactagaaccaaaccgaagaagaaacagcagatctgaagcccgggatctaaaaggccacgggtctctcgctgtctgctcgaggaagaagacggaaccaggaagaacagaagaggatgagagagtcgaagtcgagtgaactttacctgcgacgcgcgagagaaatcgctcagatctaagcttacctcgctcgatctcactggaactgtggtggctgtggacgggcgctggatgggaggcggagctggctgtggacggacggggacgggtgggtctgcgggagtgtttggtggggcggggttttgg

SEQ ID NO: 5839 - DNA, 2050 bp, Zea mays
ttttttttttttttttgtacaacaataaaccatacaatagtagcaccaacagtagcagttcatcaaattacaactcctggacacagctagctagctgattttacaacatacatacggagtactactgcttgacaagcatctccttcacatcacaccgtgctgctctttacaacctgtagagcacagcacaccatctagcacaagaaacagctaccagaacaacggacacctgaacggccggggggggtggggtcactgaccagtgtgacacgtaccggccaccgccggagaacgccggacacaaaaacgccggcttcccgtcggttgtggttctctcctcctccggagaaccaaaccctaaataacccgagatctacaactgactcaccagtgacaaggaccaaacgaatcggacggacatctacacagaacgaacgaacgaacggacggacggggattagcactaatgatccaactagtgcccgcgcaggatgtctaaaatcccatctgcgcgacggccgttaaccttctttaaccctcctccagctgcacgacggcagtgtgggtaggaagggagccagccagccagccaacagggggcgacgattaattggcgaggagggagtcccagtcgatctcgtacgacgggtacttggtgagcgcgaagccggcggcctcgtcccacggcgcctcgctgaagtccagctgctgcatctccggcaccgtcggcccgggcgaggcggacggcgacgtggacggggacgggcacgaggactcggtggcggactcgaggcaggacgaggtcgcgtcgtcggacgacggcgaggagcagcagttgctggtgggggcggacgacgacgcggcagctgcggcggaggctggcttcttggcgcccttcttggacgcggcgatgctctggcacaggctctggagcttggcgtcgacggaggcgtggagcgggccgcgggaggcggcgttgtcggggaagttgaggcgcgccgcgtcgccgcggaggcggtaggcggcctggtcgtaggccagcgccgcctcctcggcggtgtcgaaggtgccgagccagagccgggtgcggttgcgcgggagccggatctccgccacccacttgccccagtgccgctgccgcacgccgcgggtacagcttctgcggccgcgccggggcgggggccgcggacgccgacgccttcatgggctgggcacgcgggcccagcacggaggtctgcgcctggcgacgctgcaggtggaggcgggcctggatgtactgcatctgggaagggctcagctggcccgcctcgtcgggcgcggcgaacgggtagtttcctccgtaggaggaggcggcggcgacggcgacagcttggtggaaggagaacggcgacgaggggctaagtggctggtgcgggtggaggagcggactggatccgtgagcagaggcatcccggataaaaggctcgagtgctctcatcagctcctcccctgacagatctatagcagcagccatctagactgttttttttgtttttttgtttttcctctctctagcaaaccaagaacaaacgaagaaactggcggaacccaacagccacagtaaaaacagatggcagtggtgggtagatccgctcaggacaggactcacttgcgcaagggaggtgtggaaaaagaacctctcttggctaccaacctaacgactagtagtacactgctagaactagaaccaaaccgaagaagaaacagcagatctgaagcccgggatctaaaaggccacgggtctctcgctgtctgctcgaggaagaagacggaacgaggaagaacagaagaggatgagagagtcgaagtcgagtgaactttacctgcgacgcgcgagagaaatcgctcagatctaagcttacctcgctcgatctcactggaactgcggtggctgtggacgggcgctggatcggaggcggagatggctgtggacggatggggaggggcggggctgtgggtctgtgggagtgtttggtggagcggggcccggccggcctcgaggtacccaatg

SEQ ID NO: 5840 - DNA, 1134 bp, Zea mays
aaccagagccaacagagcaacgcccaggccccaggcacacactacacgaaccaggcaaccagctgggaggaaccctagcggaacactgtgcaggtgacagcggcgcgctaccggtgacgggggatacggcggcatcgtccccctcggtccctcctccatcccccgcgcggcggcgccagcagccggcctgcagaaccatagcaacactttggtgcgcttaagatgtccatcctccgaccctttctcccaatagtagcaagatcaaatggttggagatgcttttctactgggattccttctgatatgatagcggatcttaataaggaaatggagtcagtatttggcgaacctccatcatccagtcctttgggctcaagtccgtccccccagcagccagtggaggattcaccactagtgcttacccatactgatagcagcggacaggccaatatggttgacgtctctcccaaagaagacagtaagagagtcgctatagctagctgcagggttttgctaggccaaaaggtgttcaatttggtggcatctaacgagattgcgaaaggtgatgtccttactgtcgcaaagattgctggaataactggtgcaaagcaaaccagcaatcttatacccttgtgccacaacattaatctttcacatgttcgtgttgatctcactctaaatgaagaggactctagtgtcgtgatagaaggggaagccacaaccagcggaaagacgggggttgagatggaagcattgactgctgtagccattgctggccttacagtttatgacatgtgcaaagctgcttcaaaggacatttgtataacagatgtctgtctccaacataagtctggagggaagagcggaagctgggccaggaattaaaaggttaaattgttgctctgaggatatgaactgcaagcatgattccggcatctaaagggtatgtagtccttacaccaaaaggtttctgctttgaatgtaggctccttgactctttttgaaacatcatttgagcctctgcactcctgagttgtagatacgctgttcaaggactttataataaatggccctatcaatttattttcagattaaaaaaaaaaaaaaaaaacttgaaaaaaaaaaaaaaaccca

SEQ ID NO: 5841 - DNA, 1765 bp, Zea mays
  misc_feature (22)..(22): n is a, c, g, or t
ggtcccgggtcccccccttcgngacccccgccctcggccgccgcgcgccaacagagcaacgcccaggcacacacgacgcggaccaggcaaccagctgccgagggaggaaccctagcggaacactgtgcaggtgacggcggcgcgctaccggtgacggcggcgcgctaccggtgacgggggatacggtggcatcgtccccctcggcccctcttccatccccggcgcggcggcgccagcagccggcctgcagggcttatattttacggtgagcacattcttttgctgatggagaccactgaacctctacaggatatcatgtgtgagtttcgtgctggtaagatgtctcatgagggaacacgagtggttccagacacgcgcaagggtcttgtccgcgttggtaggggtgaagagggattagtccattttcagtggcttgaccgtggacagaacatagttgaagatgatcaaatcatctttcctgatgaggcggtctttgagaaggtgacagaatctcctggaagggtttacatcttgaagtttaagcaagacagcagaaaattcttcttctggatgcaggaaccaaatgctgatggggactcccagacttgcatgcaagttaatgcctacataaatcgatcattagatgctgaggctgatcttcgagtacctattgaagcagaaatgtctgaagatacggctgatgatgatatctcttccagagctgggaatctagttgagagcatgaccgctgatttggctggtgaagtgacgtctgctgctggacctgtacgcttggaggatctgcagagaattctgagtgcaatacagtcatcaggtgctgcagctgaccctgatgctggagtaggactaggagacatcttgaagcctgatctggtcttgccattaattgaggacttgcccattgaacaattggcatcacatcttccggagggtggctcatggagtcctggtgatatcgttgagcttctccaaagtcctcctttgcgccaacaattagatgcattcacccacgttctgcggactgggcagatagatcttgctcaatttggagttgaccctgacaaatataagttcacggtggtgtcgttcctggaggcattggaagactcggttggaagaggtgcttctgaagctggagacaaggatgcagaggtcgagcgaggcagtggaaatgatgccatggacgagagttgatatccgtgtactaggtgtctgaattcatacgtgacaagtcttgtgttgttgttttgggtagaacgctagctcatagtattttgggcttctggcacacagaaagcaagtttctggacaagttttggacattattgctgctgtgagatgtagtgctaggcaacagatggtctggttggtggatcatggattccatggcattgagaagcttgcaaggctagattgattgtgttctgcgggggtaaatcttgcgtggcgttttgaacgtggattggtaaacagaatagcatcttttgaacgtcggttgttccatgtccacagctgatggtggtggcctcgaatgtcgtactgtacgtccatgtcgatgattccgtcgcaggagcctactactactatatccctgttctatgtaagatatgtgtactccagtacaaacagtatatggacagctcaggatttttttatattgttctacacatacatctttagatgatttttaaaaaaaaaaaaaaaaaaaaaaaaaaaaaaaaaaaaaaaaaaaaaaaaaacctcg

SEQ ID NO: 5842 - DNA, 2488 bp, Zea mays
  misc_feature (286)..(286): n is a, c, g, or t
aagttcacccatccgggtcaggtactttgaatccgtggacgatgtgtccacagatcgggccttctttgccttttccttggacgaatgcatcaacgtcgacagtgtgggattgatttgaaactgggttagatctctgattttgctgacccatgtgatggtccatccatttcgattcatccttcaagatagcccaacaatgcaagaaatggaacggctgcaaacctactcgctgccagagacgtctacaacagatcacatgattagcgagggacataagtcatgtagnctagtggttactaacataacattactaacaaataatgtaactagtaccttgttgcatcagagaggccactggggttttgtcgaaggacaacagtcatgtacccagagaagattgaacactgtgttttgatgctgtcccacctactcatcaaagatttagtagtcctttctggcatagttccatgtctcgagttgtaagcctcagtaattcgattccagaaaccttgacgcttctggcctgtgctaactatcgggtcacaactgactgcaagccaagcatgacaaagcctcatatcatcttctgagaagaagtttgctagcttagttggttgagttgccttcttcactgaagatggtggggtagatccctctgcgtgcctgcatgcctgcaggttattaccaaagtggtcggggtccaaattatcaagatctgcttggctgaggaagctgccatactttggcatcagatggttccagtctgatgtcattctgtaaaatgaagtggacacagcaaagagtcatgaccatttcgaatcaaaatcaacaatgcagcatttggttcacacaagcaacaataatcagtgaatctggacagccacaacatgtcacaagtaaacaatacttggaatacttcgaattgttcaacatacaaccaacaaaagctagacaacatcatctggttctttaccagctaagctagtaataataggactcgacatgacacatacttcaaattgttcaacatgcaaccaacataaacgatccttcattccatactcctacatttatttgactaccagctaagctagtaataataggagctgtcgctagagtaatcacgtccgtcgtcgtagccgacgtagccgtcatcattgtttggtgattcgtagtcaattggaagcacatcatctggatctgcggcgtcctcatcatgacatgggtctatggttcacagctcccacttggtttccagtgctagctgatcaaaggtccttggtgaggtcctcgatctcaactaaggcccagttaaattcattgaactctggtgagttaaatggttggaaggcaccgtgcatgacatctacaatgtcggcacaacgctacagctctcaccaaattagccagggcttttcgaagcatttcgttctccgaatccatggtctacatgaaacagattttgaagttagtgatcaagtcctaataagttcaatcatcaacatcgcacagggtttgaactagctacaaaattgttgtcaactaaatttaagtcagccattaaacacatccagtacgtcaacaacaaagtgaactttgtaaaatgttagaggtgaacatttaaataactcaaagtatatgaagtgtatgaggacagcagccacgaaacaaattcaagaactccaattaccaggtctgaatttctgcttgcatcctcggtaaactgaattttgtggactgtttacactaatgtgagattgaacacactaatttcatctcatcattgcaagagatcatagaagcacacactaatttcatctcaccactgcaacacatgaagcatgacaaatgattttcataggctaaataacataacagttcgttcttgtctgctttccaatctttgtattcatttcaaaggttagaactaaagtaatcagtagatccaaaaaatgaatcaacaaacaaagagtcgatctggggcaagcgcaaaatattgtgtgcagatcaaccctaaactttggatccacatacaaatacgaagtattttaccttgctcgggtcggatctagagcggacgaccggatcaacgacgatgaagatacgtgcgacggttgcgcttccttttttcggcaccaatcttgaacgaaggcagctgacgtcgaagtcgtttggtgatggcgagtctccggcgagggactgctgcggtgcctcgaacgacctcgatcgggctctcgacgccgccctcctccttccttccaagcgcatggagcggtccactgcaggccccgcccgcctatggccgcttggatcctagcttggtcgccgcctccgacaaagcgcagcgcgacaacggcactgcactgaggaacggaatcgccagggaaaggggaaaggaagtaccggactcttcaccgtggcgggaggacgatccgttgcccggatagcggatactcgagagacgccacatttagggtacgaagagcgc

SEQ ID NO: 5843 - DNA, 2412 bp, Zea mays
cggacgcgtggggtcgccgcggtgctctgcgtcgtcttcgcccccagcggggctggccctggcatccccgggatcaaggcttatctcaacggcgtcgacacgcccaacatgttcggcgcgccgcagccctgcctccagatcatcggcagcatcggcgccgtgtcgtcggggatggatctcggcaaggagggcccgctggtgcacatcggcgcgtgcctggccaacctgctcagccagggcggcgagggccggtggcgcctgcgctggcggtggctgcgctacttcaacaacgaccgcgaccgccgggacctgatcacgtgcggcgcgtcgtccggggtgtgcgcggcgttccgcgcgcccgtcggcggcgtgctgttcgcgctggaggaggtggcgacgtggtggcgcagcgcgctgctttggcgcaccttcttcagcacggccaccgtcgtggtggtgctgcgcggcttcatcgaggtgtgcagggacgggcgctgcggcatgttcggcgagggcgggctcatcctcttcgacgtcagcgacgtcaccgtccgctaccacgtcggcgacctcctccccgtcacgctcgtcggcgtcctcggcccggcccgggccgcactcgtcaaccacgtcctccaccaggcgctccggctgtacaacctgatcaacgccaagggccggctggcgaagctggcgctcgccctcgcggtgtccgtgttcacgtcggcggggctgtacctcctgccgttcgctgtgccgtgcacgccgtgcgacccggcgttcggcgacgcgtgcccgacggtgggcaagtccggcaacttcaagcagttcaactgccccaccggctactacaacgacctggcgtcgctgctccacgccaccaacgtggacgccacgcgcaacatcttctccacgggcaccgccggcgaattcaggctcgactcgctgctcatcttcttcggcatctactgcgtgctggggctcttcaccttcggcatcgctgtgccgtcggggctcttcctgcccatcatcctcatgggctccgcctacggccgcatcctggcgctcgtgctcgcgcgcttcgtgaggatcgaccacggcctctacgccgtgctcggcgccgccgcgctcatgtcgggctccatgaggatgaccgtctcgctgtgcgtcatcttcctcgagctcaccaacaacctcctcctgctccccatcaccatgttcgtgctgctcatcgccaagacggtgggcgacgctttcaaccccagcatctacgagatcatcctcgacctcaagggcctgccgttccttgagcccaagccggaaacgtggatgaaggacctcgcagtcggcgagctcgcggccgccaagccgcgggtcgtcacgctgcaggtgatcgagaaggtgtccaccgtcgtggaggtgctgaggtccacgccgcacaacgggttccccgtgctggactggccgcggccaggcgtatcggagctccacgggctggtgctccggtcccacctgatggccgtgctcaagaagcggtggttcctgacggacaagaggaggacggaggaatgggaggcccgtgagaggttctcgtcgacggagctcgcggagaagtccgggagtatcgacgaggtggcggtgcagctgacgccggaggagctggacatgtacattgacctccacccgttcaccaacaccacgccgtacaccgtcgtggagaccatgtcggtggccaaggccgtggtgctcttccgcacctgcgcgctccggcacatgcttatcatcccaaagttccaagggcctgaggtccgtgcaacatcttgtcaccttttcttcaagtccaagtactgttcttttggaaaatttcaaatgtatgtactcttcctaacaaattggtgatcaatttgtcttcagatagctccaatcgtggggatcctaacgaggcaggacctgagggcacacaacatccttggtgcattccctcatttggcaaacaaaaggaaagtacactaagctctgtcgcgccatttttggtaaatttaatgttctctgcatccaaagaaaaaggtccagctgttttgtttccccatgttctatttttctctgtaagtagattgagggtttaatttcttgtctcatgagattgtgtgaataatagcttcccatgtaaaatcacatcttcgccttcacttttctgctcgcacttcgatccttgtaatcgaaaggggcgaaacaaaacagctacgaaatatacattttttgggggccccttcgaattgctattacttgattattttgcttcgttctacattataagagataacagtgtttagtcgcaatttgctaaaggttcaggcacagactcacagtcaatttggtgggtcaaccagaaagacaactcttgagttaacg

SEQ ID NO: 5844 - DNA, 978 bp, Zea mays
tcgaggccggccgggatgatgtgtgacctcacctaccgcctccgagggaccggaccagatgccactgcccccgccaccgtaccagatgccagtgctcctgccaccgaaccgctgctctttaccaaccactcccaccaccctctcaccgttgtccgttacatatccagcggccacccgttcctcttcctcgtccgcctccacgaccaccatccatcgccatggctggccccaccaccacgctcctcctcctgctgctgtgctccgctgggctcgcgtccggcgccacggcggctgacgacagcgggttcactaccttcaaggtatacttccacgacatcgtggcggggacgagcccgacggccatccgcatcgcgcagggggcggcgtccaacacctcgtccaccagcttcggcgcgatggtggccatcgacgacccgctgacgacgggccccacgcgcgccgcgggcaccgaggtgggccgcgcccagggcacctacacgttcgcggaccagcagacgttcggcctcctcatggtgatggacttcgtgttcacggccggggagcacaagggcagcacgctctccatcctcggccgcaacgaggtgctcagcgacgtccgcgagatgagcatcgtcggcggcagcggaaagttccgcatggcgcgtgggtacgtccaggcgcacaccatcgactccggcttcaaatccggcgagaccgtcgtccagtacaccgtcaacgtcagggcctagctacccgctcgatctaccttgcttgctcctccggcccatggccgactgcccgcccggcttcttgtgcgtcgatccatctccggatgctttgtacacaccttgtcgttcttcgatgttactacatgacatgtatttagtagactgcgatttcagatatctagtctatcttcatttgctaaaaaaaaaaaacaaaagccgcccccccagccccgaatctaggtctacgcgt

SEQ ID NO: 5845 - DNA, 883 bp, Zea mays
  misc_feature (46)..(46): n is a, c, g, or t
ctacagtgaagctgctaacagatggattgttacaaccaagcgcttncgtatgcagaaaaggaggcctcaatcttcatgaaaccaaaaggtatatgcagcttgacacggcatcagcttagttacacacataaaggtataaataattcactttgtcatgctttctgaatttttacaactgtgctccagcgtgctcgattctatctcctgtccggtcctctcaaaatagtcgttgagcgcccactggtacttggactggtccagcccgaaccatctcgagatgtgcttgtccaacctcgagtgtgctttttgcacgtgtgcaaccgcgtcccagaagaacgctagcagcgatccgtctgaccctgccgacaccttcgcgaactgcaacggcggcacctgaaccgatggcaagggcggcacctgaaccgatgcaaggagccggaagagaggtttggtgcctggaccagcgagggtcgggagagcttctccgcatgaagtggcggagagaccgtcttgacaagtggcggcgtggagaccgaagccgaataaataggcgtgggcggaggggccatctgcgccggcggcgattcaggggattcctcggcgcggggactcgtcgggggcgtagagaactcggacctcgggctctcgggctccgccggtggcgtgacgaacaccattaggttgcccgacttgcggatcaccggcggcgagtgcgggacggaggccatcgccggagctggagctggagctgagagctacggaggaggagctagggtttgggagaagcgagcgctagtgcgagaggagtgagacggcgagtgagaggccattgccgacgggtaggaatgaacatttctttcccggccggcctcgaggtacccaa

SEQ ID NO: 5846 - DNA, 912 bp, Zea mays
cggggtatcgacgccattgtcccatccccgctggcgcggggggctctttaccaacaaccactcccaccccgacccaccgttacatatctccatctcacccgcgcgcccacgcgcctccaccacgccatccatcgcaatggccgccgccgccgcgctcctcctcctcctgtgcgccgcgtctctcgcgtccgcagccgccgacgacgggttgacgaccttcaaggtgtacttccacgacgtcgtggcggggacgaacccgacggcggtgcgcatcgcgcaggcggcgtcctccaacacgtcgtccaccaacttcggcgcggtggtggccatcgacgacccgctgacgacgggtcccacgcgcgccgcgggcacggaggtgggccgcgcccagggcacctacacgttcgcggaccagcagacgttcggcctcctcatggtcatgaacttcgtgttcacggccggcgagcacaacggcagcacgctctccatccttggccgcaacgaggtgctcagcgacgtccgcgagatgagcatcgtcggcggcagcggcaagttccgcatggcgcgcgggtacgtgcaggcgcacaccatcgactccggcgccacctccgggaccaccgtcgtccagtacaccgtcaacgtcaaggcctagctacctgttacgtacccttgcttgcgactccgggccgtggcttctcgtacgtccatccatatctccggctgctttgtacacaccttgtctgtcgtctttgagcgggattcggatttgcagagccgaatttactactaaagtttcaaaatttcacagagttgtagggtcgagaattaaatgtgtcgaaaacacgttagcgaccattcttatatagtttttgttggaaattttgttggcacaaaaggcaaaaaaaaaaaaaa

SEQ ID NO: 5847 - DNA, 991 bp, Zea mays
  misc_feature (1)..(1): n is a, c, g, or t
  misc_feature (33)..(33): n is a, c, g, or t
ntgatggtgagttggcgacctccacctaccggnccaactacgacagacagacgacctgcccccgagaccgaccgtatcgataccattgtcccatccccgccggtgcaggtggctctttaccaacaaccactcccaccccgacccaccgttacatatctccatctcacctcgcgcgcccacgcgcctccaccacgccatccatcgcaatggccaccgccgccgccgccgccaccgcgctcctcctcctcctgtgcgccgcatctctcgcgtccgcagccgccgacgacgggttgacgaccttcaaggtgtacttccacgacgtcgtggcggggacgaacccgacggcggtgcgcatcgcgcaggcggcgtcctccaacacgtcgtccaccaacttcggcgcggtggtggccatcgacgacccgctgacgacgggtcccacgcgcgccgcgggcacggaggtgggccgcgcccagggcacctacacgttcgcggaccagcagacgttcggcctcctcatggtcatgaacttcgtgttcacggccggcgagcacaacggcagcacgctctccatccttggccgcaacgaggtgctcagcgacgtccgcgagatgagcatcgtcggcggcagcggcaagttccgcatggcgcgcgggtacgtgcaggcgcacaccatcgactccggcgccacctccgggaccaccgtcgtccagtacaccgtcaacgtcaaggcctagctacctgttacgtacccttgcttgcgactccgggccgtggcttctcgtacgtccatccatatctccggctgctttgtacaccccttgtctgtcgtctttgagcgggattcggatttgcagagccgaatttactactaaagtttcaaaatttccacagagttgtagggtcgagaattaaatgtgtcgaaaacacgttagcgaccattcttatataaaaaaaaaaaaaaaaaaaaaagaagaaaaaaaaaaaaaaaaaa

SEQ ID NO: 5848 - DNA, 487 bp, Zea mays
gcggcacctgaaccgatggcaaggagccggaagagagtttggtgcctgcagcggcgttgagagagacttgacgggctgcggcggtacctggaccagcgagggtcgggagagcttctccgcatgaagtggcggagagaccgtcttgacaagtggcggcgtggagacgaagccgaataaataggcgtgggcggaggggccatctgcgccggcggcgattcaggggattcctcggcgcggggactcgtcgggggcgtagagaactcggacctcgggctctcgggctccgccggtggcgtgacgaacaccattaggttgcccgacttgcggatcaccggcggcgagtgcgggacggaggccatcgccggagctggagctggagctgagagctacggaggaggagctagggtttgggagaagcgagcgctagtgcgagaggagtgagacggcgagtgagaggccattgccgacgggtaggaatgaacatttc

SEQ ID NO: 5849 - DNA, 1067 bp, Zea mays
ccacgcgtccgacgaatcgataccattgtcccatccccgccggtgcaggtggctcttaatttaccaacaaccactcccaccccgacccaccgttacatatctccatctcacccgcgcgcccacgcgcctccaccacgccatccatcgcaatggccgccgccgccgccgccgccgccaccgcgctcctcctcctcctgtgcgccgcgtctttcgcgtccgcagccgccgacgacgggttgacgaccttcaaggtgtacttccacgacgtcgtggcggggacgaacccgacggcggtgcgcatcgcgcaggcggcgtcctccaacacgtcgtccaccaacttcggcgcggtggtggccatcgacgacccgctgacgacgggtcccacgcgcgccgcgggcacggaggtgggccgcgcccagggcacctacacgttcgcggaccagcagacgttcgggctcctcatggtcatgaacttcgtgttcacggccggcgagcacaacggcagcacgctctccatccttggccgcaacgaggtgctcagcgacgtccgcgagatgagcatcgtcggcggcagcggcaagttccgcatggcgcgcgggtacgtgcaggcacacaccatcgactccggcgccacctccgggaccaccgtcgtccagtacaccgtcaacgtcaaggcctagctacctattacgtacccttgcttgcgactccgggccgtggtttctcgtacgtccatccacatctccggctgctttgtacacaccttgtctgtcgtctttgaggccttgtttgggtaagaagggattgaagtggattaaagtgtattttagggattgaaagggaaattagttcatattacacttcaatacaccttataccacctcaatccactccaatccaagattacccaaacatgccctgagcgggattcggatctgcagagccgaattagtactaaagtttcaaaatttcacagagttgtagggtcgagaattaaatgtgtcgaaaacacgttagcgaccaatcttatatagtttttgttggaattttgttggcacatttggatg

SEQ ID NO: 5850 - DNA, 970 bp, Zea mays
ctcgtgccgttttttttttttttttttgaaaatgaaggtacaataaaaaaaaggtcagcaaggtttttctttatccacaacgaagctacaataaaggtgctaaatatggatttgttacaaccaagagcttccgggtgcagaaaaagagaactcagtcttcacgcaaccaaaaggattctatatgcagcttgacacggcaccagcttagttacacacataaaaactagaaataatccactttttcaagctttctgaatttttacaactgtgctgctaacgagtgccaacgttgctcaaatctatctcctgcccggtcctctcataatagtcgttgagcgcccactggtacttggactggtccagcccgaaccatctcgagatgtgctcgtccaagctcgcgtgtgcttcttgcatgcgtgcaaccgcgtcccagaagaacgcaagcagcgatccatctgatcctgccgaagccttcccgaactgcaatggcggcacctggaccggtggcaaggagcaggaagagacctttggtgcctgcagcggcgttgagaccgacttgacgggcggcgacggtacctggaccagcgagggtcgggagagcttctcggcgggaagcggcggggagaccatcttgacaagctgcggcgtggatactgagtaaacaggcgcgggcggaggggctgtctgcgccggtggtgattcaggggagtcctcggcgcgagggctcgtcgggggcgtagagaactcggaccccgggctctcgtgctccgccgatggcgtgaagaacaccgtgaggtttcccgacttgccgatgagcggcggagggtgcggggtggaggccatcgccggagctgagggggtcggaggacggaggtgctagggtttggcaggagaagcggatgctgtgcgagaggagtgagacggctgcgaatgtgacgccaatgccgaggaaggggagtgaacattttct

SEQ ID NO: 5851 - DNA, 1300 bp, Zea mays
tttttttttttttttcgcttattgcttcccaaacaatgttaaataagtacaccgagaggagagtacaccgaagaggggagattctctccgaaaataaggttgacatctaaaatccatggattggtttccaaaggatttttctctcctcactgccaaactagtcatgtcggtgaaactttttcttcaatccccgtcgttgtcgaggaatttatcccatggaaatctgtcgatgcaccagtggatggtccaggaggaaaagacagtaatttcaacgtggcagagtagctgttgtgaaagcgattaaaaaagtaggaactaggtttttttctttatcaacaacggagctacagtgaagctgctaacagatggatttgttacaaccaagcgcttccttatgcagaaaaggaggcctcaatcttcatgaaaccaaaaggtatatgcagcttgacacggcatcagcttagttacacacataaaggtataaataattcactttgtcatgctttctgaatttttacaactgtgctccagcgtgctcgaatctatctcctgtccggtcctctcaaaatagtcgttgagcgcccactggtacttggactggtccagcccgaaccatctcgagatgtgcttgtccaacctcgagtgtgctttttgcacatgtgcaaccgcgtcccagaagaacgctagcagcgatccgtccgaccctgccgacaccttcgcgaactgcaacggcggcacctgaaccgatggcaaggagccggaagagaggtttggtgcctgcagcggcgttgagagagacttgacgggctgcggcggtacctggacaagcgggggtcgggagaacttctccgcgggaagaggtggagacaccgttttgacaagcggcggcggtacctggaccagcgagggtcgggagagcttctccgcatgaagtggcggagagaccgtcttgacaagtggcggcgtggagaccgaaaccgaataaataggcgtgggcggaggggccatctgcgccggcggcgattcaggggattcctcggcgcggggactcgtcgggggcgtagagaactcggacctcgggctctcgggctccgccggtggcgtgacgaacaccattaggttgcccgacttgcggatcaccggcggcgagtgcgggacggaggccatcgccggagctggagctgagagctacggaggaggagctagggtttgggagaagcgagcgctagtgcgagaggagtgagacggcgagtgagaggccattgccgacgggtaggaatgaacatttcgagcatctatt

SEQ ID NO: 5852 - DNA, 3574 bp, Zea mays
  misc_feature (3)..(4): n is a, c, g, or t
  misc_feature (16)..(17): n is a, c, g, or t
  misc_feature (30)..(31): n is a, c, g, or t
  misc_feature (61)..(61): n is a, c, g, or t
  misc_feature (68)..(68): n is a, c, g, or t
tgnnattatatttctnngtgatgtgtgacnnttcttgaatgacaaggcactttttaatggnagttagnagtgaaaacatacaacaattgcatgataaaacgagctttggctatttctgagaggcgtgcggctgacctagctgatgaatcaggtgtaatcgaagctgctgtaattgctgctgtatctatccttagcaaaggatcaagctcaacttgcctatctgctgcatcaaatgctgcccaagcaccccctgctgctgctaggggaagttccaacctccaacctgagttggatgagtttggcagagatatcaacatgcagaagcgtatggatcttaagcgcagggaagaggacagaagacgaaggaaaactcagtcagagaccaagagattggcatctgcagcgaagaataaggacatcgagaagatcgaaggagagctaagcactgatgaaagcgacagtgagagcactgcttatgtttccagccgggatgagtttcttaaggctgctgaccatgtgttcattgatgctaaagaggaatactcgagccttaggattgtcaaggacaagtttgaaggctggaaagctcagtacccttctgcataccgagatgcccatgtagccctgagtgcaccatctgtgttcagcccttatgtgagactggagctcttgaagtgggatcccctccacgaaacgaccgatttctttgacatggattggcacaaggttctctttgactatggcgtgcaagatgacgagagcccctcaggttcgaatgattcagatgtggttccagtcttggtagaaaaggttgctcttcctatcttgcaccaccgcatcgagcgctgctgggatgtattgagtacccaagggactagaaaggctgtggaagctagcaggatggtgatcggttatttaccaacatcaagcaaggatttgcatcgactactggctgccgtgagcagccgtctaacccaggccgtcgccgatctttcagtcccagcctggggttcaatggtgacgaggaccgttccaggtgcctctcagtacgctgcatatagatttggagttgctgtacggctcctcaagaacgtgtgcctgtggaaagacatccttgcagatcatgtcgtcgagaagcttgctttagacgaactactgagagggaagattcttcctcatatgaagagcatcatcctggatgtccacgacgcgatcacccgggccgagcgagtagccgccgcgctctcagaagtctggcctaaacaaaaccaaaagctgcggcctttcgcagatctagtggctgagctgggcaacaagctggagaggaggcacgcgtcaggcatcagcgaggacgagacgcgtgggctagctcgccggttgaaaaacatactggctgttctgaacgagtacgataaagctagagccatttcgaaggcgtttcatctcagagaagccctttaggtcgtcctggatggagtcagagtgagaaatccagttttggcacaggtttctacatccttccagtttgcagagatgttgtaccacatatacatcttgaccatgatcgagtttttagtccatcgcttgatgctatcaaagaaagctgtgttgcttctaggttgttttctggttacgaacacacaaactggttataacaagatatgtattagatttattttttgcgagttcaagttatggtcccaatgtgtttatcaatggagctgggagcaaccctttggaatatgaacatagtactattatgctatttaacatatggggttactggtgatctgaaacttgtcagtatggcagccataagcgcgacccgattctgaggcgaatgctctgaactctttttcattgtattttggcaagtggtaggcatgaactagaactgtagattatgctctgagatgaatgtaatgattttagtctgagttattattgtggatgtgtgctgactgttgttgtatgtcctgcaatactcccgttggattggcaggcgcaggaggcagggtagtaaattgcaaaggacaaagtgtcatcatttgctgtctcgtctcttggactggggcccaaccaatgctaatcactcactcactcttgttcttgaccagctgccccactgaccgctgcagcaaaatacgggcgctacggcccaggggaggggacagcgggcgtagctcacgggaagcaaccgcatgaggcatgcatgacggagcttgtttcaggtctggactcgcctgccatcggcatcaaccatagtatctcctgcaaggcggagactgaatgaaccaataataaattttaaaattgatagatttactacggacatactgatcagatctaactttaattgagggcctgtttgggagggctccggctcctccgaatatgactccggctcctactcctttacaagagcagcttctgcacaagagccggtgttttttttctaaaccgtttggcaaaaatagctctctatttttttttatttggtgtaaaggctaatgtccatagtaagctcgccacccgtccgtttgtctggctcgacatgctgcttccactctgcagtcttcgcatccgccgcccggtgttccgtccaagccgctgcacaggatgaacgtgccagactgctagagaccacgtgacgaatggaacacatggagctgttaggagccagtttttatggctcctactctagacgctaaaacggctcctgctctaattcaagagctgtttttttgcatggtgtttgggagggctccagtaaagagccggagctggagccgcttaagagccctcccaaacgaccactgaatatatgaaaatattaatatttataatatctttgaatctatttttacaatacatctacttggagatataaatattgttaatattttctacaaacctagttaagctttttttttaaaaaaaacttgaccgacacaaataacataacgacaattattttagaatggatggagcaacagctaactgagttacactcgtcgtagcttcgtcctgatcagtgtttcttactgaagggagaagaaggcagagtggtgtaacgttgcaagaccagttcttctaattttttgttttgcaagctatacgatatatttcaaagttccagtaacgaagttgtgtttgtatcacacgtgcagattgttcaaacagtgtctctctacaagtccagatacaaggacaacaaatctttcccgtgtatgcattgctgaaaaatattgcagaaccaaccaaagtggcatgagaaacgcaggatgatggatgatctggaaaaaagttgcaaataaaaagcaaaagacaaacacgatttctagtcctggaatttccactcccatcattaatgagtcaagcaactgtaatcctgtcactgagaatataagggctgaggaggaaactcctaaaagacctattggtatcaaaaaaaaaatctaaagaagtagtgcggagagatggttctgattcttatattgagaggagagatttaatctggcatatgagatagagaaagagaggcttcagctcgatcaagtaagagctagcgctg

SEQ ID NO: 5853 - DNA, 772 bp, Zea mays
cgggacattctcggtctccgtactgcggcgattgaggttttgttccgctttctcagggttttctatcgtctcgtctcccatcgtcgtcgtcgcccgccgctgctaggtttggggtttccggtggccaggacccaagccagctccgtcgggcgccgtggggaactgctgggaggggcggtcgaccggcggtgcctctgcttcgggttctccgtaccggcgtcggaggggatcggatggcataagcattccaaaccaaacattacctatgggcggccttcaaagcaaaggaggataaaggtgatgcaattgtagaggaggaggttgagaagggaaattgcgtttcaaaccagccagacaaggtacagtctgataatgcttcattttcttcaaaccatggactggaccgtccaagcatggaagctccccctcaaagcagtagcagtgtctttggtattgttgtccgacaagctccaaatcttgaaccagaagtgaagcgatttatccaggagatggaacgcaaaggtggcgttggtaacggttatgaggggggaggcaattggtggagggccatagccaagcaacaccacgaccactatgcattagttgtagagagagtagagagtaaaccatgtcaaaactatgctgtagttgtatagagtctgacacataacgtcgtggacttgagctcttgttcagtttttttttgtaaggtacctacagggtttggtcatatgataatttctccggaacgcatacccttacacctgtttcc

SEQ ID NO: 5854 - DNA, 1138 bp, Zea mays
agaaggtataacgatatagatcctcgaagcggcacgtactatctccgtagtgcggcgattgaggttttgctccgctttctcagggttttctatcgtctcgtctcccatcgtcgtcgtcgcccgccgctgctaggtttggggtttccggtggccaggacccaagccagctccgtcgggcgccgtggggaactgctgggaagggcggtcgaccggcggtgcctctgcttcgggttctccgtaccggcgtcggaggggatcggatggcataagtggaacctttaagatagatggaaaggaacacatatcactggctggacatttgtcatccaaatcttgtgagaaagtgtggaaattgtcatcattgccgaaggtggttcaagtgacaaaggttcctagaatggcagtgtggcctaagatatttaaagcatcagaacccagtggtgacaatattggcctatatttcttccctcctgaaatgaggcacgatgaagaactagatcaactagttaatgaagtcatggataaagatttgatcttgcgagctattattggtgaagctgagatgctgatattcccgtctgttctactacctgaaagatatcagacattccaaaccaaacactacctatgggcggccttcaaagcaaaggaggataaaggtgatgcaattgtagaggaggaggttgagaagggaaattgcgtttcaaaccagccagacaaggtacagtctgataatgcttcatttccttcaaaccatggactggaccgtccaagcatggaagctccccctcaaagcagtagcagtgtctttggtattgttgtccgacaagctccaaatcttgaaccagaagtgaagcgatttatccaggagatggaacgcaaaggtgcgttggtaacggttatgaggggggaggcaattggtggagggccatagccaagcaacaccacgaccactatgcattagttgtagagagagtagagagtaaaccatgtcaaactatgctgtagttgtatagagagtctgacacataacgtcgtggacttgagctcttgttcagtttttttgtaaggtacctacaagtttggtcatatgataatttctccggaacggcataccttagcaaaaaaaaaaaaaaaa

SEQ ID NO: 5855 - DNA, 2209 bp, Zea mays
cacgaaagggagggagttacagtgattttggtgattatgatgacggaaggagaaggacgtccgatcttttgcagagaacagggagaggaagcgatttagatgacgatgaagatgatgatgctggtccagttgggtttgagggttccagtgtaaggcagcaaggtggcaggagaggcaaaatggcgaagagtgttggaccacatcgggttgggaggggcagcgatacggactttggtcaccgacagccaaggggtctgaaaaaaattgactttggcttgtcagaggatgatgatgagggcacgagaccattacctagaacatcctaatcgaaaatcgaagatgatctttttgaagacgagggtgataaggaggatgtgggacatataataggtaataagtctggctcatctatgttacccgaagatgagccagctaaaaatgaaagtgtacagggcagaagtgctgggggtggtgattcttatctgagccagaagaggtttgatgaatgcccgttatctcccttgtcactgaaaggtgttaaggctgctgggtatgaacagatgactgctgttcaggaggctactcttcctattatacttcaagggaaggatgtactagccaaagcaaagacaggaactggaaaaactgtagctttcttgctaccagcaattgaagttgtttcgaaattgccacctgttgatcgtgatctaaagaaacctcccatcagtgttgtagtagtgtgccctacacgtgagcttgctgatcaggctgctgcagaagctaacaagcttcttaaatttcatccatcaattggagtacagcttgtaataggcggcactagaatggcacttgaacagaagcgcatgcacactaacccttgccagattctagtagctactcctggaaggcttagggatcacatggagaacactccagggtttgctacaaggttgttgggtgtcaaagttctaattcttgatgaagctgaccgcttgttagatatgggattccgatcagatattgaaaaaattgtggctgcactaccaaaacagcgtcaaacacttctattttctgcgacagttccagatgaggttcgtcaagtatgtcatattgccatgaaaagagatcttgaattcgtcaacactgttcaagaaggaagtgaggaaacacactctcaggtgaagcaaatgcatttaattgcaccactggacaaacaattctccaacctatatggtcttctaactgatcatatttctgaaaatgttgactacaaggtgattgtattctgtacaacagcaaaagtaacaagccttgttgctgagcttctgtctgagttgaagttgaatgtacgtgagatccactccagaaaacctcaaagctacagaactaggatatcgaaagaatttaaggagtcaaagggtctcattcttgttagctctgatgtatctgccaggggtgttgattatcccaatgtcacactagttgtgcagttgggggtgccaactgacagagagcaatatattcatcgacttggtagaactggtcgcagaggcaatgaggggacaggagtcttactattggcaccatgggaagaatatttccttaggagcatcaatgacttgcctattacagaggcaacacaaccattaattgatctggatactaagaaaaaggtcgataaggctcttgcacatgtggaggttaaagacaaggaatccgcttatcaggcgtggcttggttactacaattcaaataaggtcattgggcgcgacaaataccagcttgtatcacttgccaatgagttcagcagaagcatgggtctcaacaaccctcctgcagtgtctaagcttgccctcaggaagatggggctgaacaacattccaggtctgagatcaaagtaaccaattgccatgtatactgtatacatgtcttgaagtcttttttgcacatgatctgacatatgagcactctattccatactgatcgagttgagttagtttctggtaataaatttattgtacgttttatgcttgcagaagtgcacgaatattcataatatgttctcattcgtttgttctgttactgagataacaaatgataaagatgaacgtgttttgctattaaaaaaaaaaaaaaaaaacaataaaaaaaaaaaaaaaaagtttccaagggggggggggggggggggggggggggggggggggggggt

SEQ ID NO: 5856 - DNA, 921 bp, Zea mays
aactgctttcggcccaaaacacttccctgctctctcgctctctcccagagtcccagctccctcactctactctggacgcgactcgaacttaaaccctagagccgcagccccggtcgctccaccgaccccaaatctcaaatcagcgggagggaactcgcacgcgaaggctgaactcatggctcgcgtctacgttgggaacctggatccgcgtgtcacggcgcgggagatcgaggacgagttccggatgtttggggttctgaggagtgtatgggttgctaggaaaccaccagggtttgccttcattgactttgatgaccgcagggatgcacaagatgccattcgtgaattggatggtaagaatggttggagggttgagctgtcaactaaagttggtggtggccgtggccgagaccgtaacggttctgatatgaagtgctatgagtgtggtgaagctggccactttgcacgtgaatgccgcttacggattggttcaggaggcttgggtagtggaaggcgtcgcagccgaagtcctagatatcgcagccgcagccgcagccgcagcccaagatatcgaaggagcccaagctatagcagaagcccgcgagatcgttctcctaggaggcgaagttacagcaggtcgccactgggatctcctgcacggagtctcagcaggtcaccgccgctgccgccgcctcctcccagaaataacagcaggtcaccacctggagcccgagaagtgagcaggtcgccgccgccacctcctcccagaaataacagcaggtcaccaccggcagcccgagacgtgagcaggtcaccaccggcagcccgagacgtgagcaggtcgccaccaccaccctcctgatgccagaaggagctatagtggatccccaggacagcagccacaacgcgacgagtccccat

SEQ ID NO: 5857 - DNA, 3502 bp, Zea mays
  misc_feature (747)..(747): n is a, c, g, or t
  misc_feature (2751)..(2751): n is a, c, g, or t
ccttggcctattaattactatatgtaaaaaactaattttttcttcttactggtagatttgaaaagcttataaactttaggtaatataataaaagttttcgattcacagcaattaccactctgcagtaggaagttgtgcctctaatgaagtggtagcttttgtgatgtcaagatgtgaattgtgaaagatatttgtgctgcctgttttctaagttcgcattgctggtcacttcccaataaatttgcctgtctaaacttcattatatccatcaagcgagttttgggtgcagcccggttcccctgcaagtaattaatatttttgaaaagttcaggccatatcgtttagtatgcttgaaggtatcaactgtctttgcttttattgtgttctgtgagttgagttcatgaaatgggtaaaaagctgtctttcgtaactactaactatgaaaagtttgtgcctcagcctatggttagatacatatagcagggcacttttaccaggaataggaattagtatccattatatcaactgacattaaatactaagtcatgcctatagttatagcaatgctgtgatgttggatatcttggcactgctgtgcattgtcgatgcatatgtaattatgtatactaataaacaagagtaaaataaatttctggtccttaaacttgtcatcctgtgtcaacccggtccataaacataagtgtgtcaacccagtccttaaacactcatccaaatgggtcatggctnacatatggggcccatatgtcaaccacgacctgtttggatgtaactgagacccaaacagcgtttaaggaccgggttgacatactttaaaagtttattgaccgagttgacattgggcgaaaagtttaaggaccggaaatgtattttactcaataaacaatatcttactgacaatggagcaggtactcaagtccttgtccttcaaaatgcatacagcagcaatacatcaatacaaggcttgctttgcaagaaatccattgagtttgtttcaaactgttaaaatgctcacatcttacttgataatgacactttcatccattatttatttatttatttatttatttatttattagtaattgaacgaaattttgcacttcagctactgcgaatacatatacttcagcattttgtgaatttatgcttatggatttgtgcttaataggtaagaatggttggagggttgagctgtcaactaaagttggtggtggccgtggccgagaccgtaacggttctgatatgaagtgctatgagtgtggtgaagctggccactttgcacgtgaatgccgcttacggattggttcaggaggcttgggtagtggaaggcgtcgcagccgaagtcctagatatcgcagccgcagccgcagccgcagcccaagatatcgaaggagcccaagctatagcagaaggtaatttgctaatgacaccaattcaccacatgtattcatccagtagttttaattaagggttgggaaacacgacctagaaatcctaaaacttttgagaacgaagcaaaatttcggagataacacgttccctttaaccaagtgagtatccactatccagtatggtctcagatttgttggatagtatttaaccaaacattcgactatgcatttgacttattgagtgttgttctttatcttgcattggtactatataatacaatgcattctacaccccctcccacctgttatagctttgttagcgttggcctaatatttcaggggaacatgttgagagacttcataaaatacagatcaatgtcttcttgcctagactagcgcagccgcagccgcagccgcagcccaagatatcgaaggagcccaagctatagcagaagcccgcgagatcgttctcctaggaggcgaagttacagcaggtcgccactgggatctcctgcacggagtctcagcaggtcaccgccgctgccgccgcctcctcccagaaataacagcaggtcaccacctggagcccgagaagtgagcaggtcgccgccgccacctcctcccagaaataacagcaggtcaccaccggcagcccgagacgtgagcaggtcaccaccggcagcccgagacgtgagcaggtcgccaccaccacctcctgatgccagaagaagctatagtggatccccaggacagcagccacaacgcgacgagtccccatatgccaatgacgcctgagattctcttagctgccccaagatgctggaaaatgctaggggcccccagcatgttttgcctgtccggtcggcacaactgtaattctgtaggatcgagtctgagattttgttccagtgttttgggtttcccttgacacatcgctgctgatacaattgtggaggcaggagcacaacgtttctgttttaagtattgactggatgactttgggcgcttgtagttgtcaaggcaggacctgatttgtgttaggcttgtattactagactgcattcgaatttggagaaagtgttcatcgtgctgtaaaaaaaaaaaaaaaaaagcataaaataaaacactgcattcgaatttggtctttgtcttcatcgtgctgtatgttgagatatctcactaggtcaggctctatttttatttattttaactaaatttatttaggtctctaagaaattgtgaagtaatatttaggtctctaagaaattgtgaagaaacatgtattaccacctctaggtgcgctttgcttgtcctacagtagcatgtaggcgagctggttgcngctggcaggcctcttaagcgcgaatagcgacgcaatgatgagcacgcacggagcatgaagatggtgaacttctttggcatgagcaccatgacggggaggaagagcgtgaaggtgataaaggtgaagaagatgcccgtggcggtatatgagcgccttcaccgagggaaagctggtggcgctaagggtggttgtaatggattgcgatttaaatatttctttataatataaatggtaggttattaaataaattttagttaaaaatgaatataagtaaggtttgatcataattcgatctgatccttaaattttatagtgtaaaatttagagttcattgtcacccatagctggcgctctagaagctctccggtagctcccacacgccctaggtcaccttgcggtggtcagattgaatatgatgagagggagcatggaaagaccggatgcctagatctaaagcttgtttggagcaaggatatcggagggattgcaggggctaaaatcatcttggtattcaaatttgaatagtaaagatattttaacccttccaatcccctttgtatccttgctcctaaacaagccctaagggggaagctgctggtaacgctctaaaacctccccgatagctcctgcacgcccatggtcaccttgcggcggtcaaactcttttgcactggtgccctctccctcctcccccttgcttgcatggcgtctaaaggccgacaccaaagcctgcagcggtgcacgctaaaagc

SEQ ID NO: 5858 - DNA, 1370 bp, Zea mays
ttgggtacctcgaggccggccggcctttccgcccaaaacacttcccagccctccacgcaccccgctgccgcggctcgaacataaaccctagagccgccggcccggtcgcgctagcgacacaaatctcaaatcacccggagagaactcgctcgcgaaggctgaactcatggctcgcgtcttcgttgggaacctggatccgcgtgtcacggcgcgggagattgaggacgagttccgcacgtttggggttctgaagagtgtatgggttgctaggaaaccaccagggtttgccttcattgacttcgatgaccgcagggatgcacaagatgccattcgcgatttggatggtaagaatggttggagggttgagctgtcaaccaaagatggtggtggccgtggccgagaccgtaatggttctgatatgaagtgctatgagtgtggtgaagttggccactttgcacgtgaatgtcgcttacggattggttcgggagggctgggtagtggaaggcgtcgcagccgaagtcctagatatcgcagccggagccgaagtcgcagccggagcccaagacatcgaaggagcccaagctatggcagaaggagctacagcccacgagatcgttctcctaggaggcgaagttacagcaggtcgccgccactgccaccaccgcctcctagaaataacagcatgtcaccacggggagcccgagaaatgagcagatcgtcaccaccacctcccaaaaataacagcagttcaccacgggaagcccgagaaatgagcagatcgccaccaccacctgccaaaaataaccgcagttcaccacgggaagcccgagaaatgagcagatcgccgccgccaccacctcccagaaataacagcaggtcaccaccgggagctcgagatgtgagcaggtcgccgccaccacctcctgatgccagaagaagctatagcagatccccagaacagcagccccagcacgagtccccatatgccaatgacgcctgagaatatttagctgctcaaagatgctggaaaatgctaaggggcccagcatgttttgcccatgcgcgtcggtacaacttataggatccagtctgagattttgctcgtgttttgggtttcccttggacacaccgctgctgataccattgtagagggaggagcataacgtttccgtttcgagtattgactttgggcacttatagctgtcaagacatgacctggttcttgttagatttatatcactagattgcttttgaattcggacgaagtgttaatcgtgggctatgttgagatatttgtctaccttttcaggacgctttcgaagaaacattttcctaaaaaaaaaaaaaaaaaaaaaaaaaaaaaaaaaaaa

SEQ ID NO: 5859 - DNA, 1423 bp, Zea mays
tggggccctcgcggcctcccccagagtcccagctccctcactctactctggacgcgactcgaacttaaaccctagagccgcagccccggtcgctccaccgaccccaaatctcaaatcagcgggagggaactcgcacgcgaaggcaaatacgctttagatcccccattgcttctggctactaggccagcgcgcctcgattttcttctccgttttggtctaattcgctgaactcatggctcgcgtctacgttgggaacctggatccgcgtgtcacggcgcgggagatcgaggacgagttccggatgtttggggttctgaggagtgtatgggttgctaggaaaccaccagggtttgccttcattgactttgatgaccgcagggatgcacaagatgccattcgtgaattggatggtaagaatggttggagggttgagctgtcaactaaagttggtggtggccgtggccgagaccgtaacggttctgatatgaagtgctatgagtgtggtgaagctggccactttgcacgtgaatgccgcttacggattggttcaggaggcttgggtagtggaaggcgtcgcagccgaagtcctagatatcgcagccgcagccgcagccgcagccgcagcccaagatatcgaaggagcccaagctatagcagaagcccgcgagatcgttctcctaggaggcgaagttacagcaggtcgccactgggatctcctgcacggagtctcagcaggtcaccgccgctgccgccgcctcctcccagaaataacagcaggtcaccacctggagcccgagaagtgagcaggtcgccgccgccacctcctcccagaaataacagcaggtcaccaccggcagcccgagccgtgagcaggtcaccaccggcagcccgagacgtgagcaggtcgccaccaccacctcctgatgccagaagaagctatagtggatccccaggacagcagccacaacgcgacgagtccccatatgccaatgacgcctgagattctcttagctgccccaagatgctggaaaatgctaggggcccccagcatgttttgcctgtccggtcggcacaactgtaattctgtaggatcgagtctgagattttgttccagtgttttgggtttcccttgacacatcgctgctgatacaattgtggaggcaggagcacaacgtttctgttttaagtattgactggatgactttgggcgcttgtagttgtcaaggcaggacctgatttgtgttaggcttgtattactagactgcattcgaatttggagaaagtgttcatcgtgctgtatgttgagataaaaaagaaaaaaaaaaactcgctcgtgcagtcgacgcggccgcgggaaagagctgattccattccttagtgaaaacaacgatgatgaagatgaggtgcttcttgcaatggcaga

SEQ ID NO: 5860 - DNA, 1332 bp, Zea mays
tgggaccctcgaggccggccgggccctttccgcccaaaacacttcccagccctccacgcaccccgctgccgcggctcgaacataaaccctagagccgccggcccggtcgcgctagcgacacaaatctcaaatcacccggagagaactcgctcgcgaaggctgaactcatggctcgcgtcttcgttgggaacctggatccgcgtgtcacggcgcgggagattgaggacgagttccgcacgtttggggttctgaagagtgtatgggttgctaggaaaccaccagggtttgccttcattgacttcgatgaccgcagggatgcacaagatgccattcgcgatttggatggtaagaatggttggagggttgagctgtcaaccaaagatggtggtggccgtggccgagaccgtaatggttctgatatgaagtgctatgagtgtggtgaagttggccactttgcacgtgaatgtcgcttacggattggttcgggagggctgggtagtggaaggcgtcgcagccgaagtcctagatatcgcagccggagccgaagtcgcagccggagcccaagacatcgaaggagcccaagctatggcagaaggagctacagcccacgagatcgttctcctaggaggcgaagttacagcaggtcgccaccgagatctcgtgcacggagtctcagcaggtcgccgccactgccaccaccgcctcctagaaataacagcatgtcaccacggggagcccgagaaatgagcagatcgtcaccaccacctcccaaaaataacagcagttcaccacgggaagcccgagaaatgagcagatcgccaccaccacctgccaaaaataaccgcagttcaccacgggaagcccgagaaatgagcagatcgccgccgccaccacctcccagaaataacagcaggtcaccaccgggagctcgagatgtgagcaggtcgccgccaccacctcctgatgccagaagaagctatagcagatccccagaacagcagccccagcacgagtccccatatgccaatgacgcctgagaatctttacctgctcaaagatgctggaaaatgctaaggggcccagcatgttttgcccatgcgcgtcggtacaactgcaattctataggatccagtctgagattttgctcgtgttttgggtttcccttggacaccccgctgctgataccattgtagagggaggagcataacgtttccgtttcgagtattgactttgggcacttatagctgtcaagacatgacctggttcttgttagatttgtatcactagattgcttttgaattcgaacgaagtgttaatcgtgggctatgttac

SEQ ID NO: 5861 - DNA, 1717 bp, Zea mays
ctctcccagagtcccagctccctcactctactctggacgcgactcgaacttaaaccctagagccgcagccccggtcgctccaccgaccccaaatctcaaatcagcgggagggaactcgcacgcgaaggcaaatacgctttagatcccccattgcttctggctactaggccagcgcgcctcgattttcttctccgttttggtctaattcgtgaggaatttgggttttctcggtggagcttggttccgctccgccttggagtggatttcggtgacttctttgttcagattgtttcgctcttgcaggctgaactcatggctcgcgtctacgttgggaacctggatccgcgtgtcacggcgcgggagatcgaggacgagttccggatgtttggggttctgaggagtgtatgggttgctaggaaaccaccagggtttgccttcattgactttgatgaccgcagggatgcacaagatgccattcgtgaattggatggtaagaatggttggagggttgagctgtcaactaaagttggtggtggccgtggccgagaccgtaacggttctgatatgaagtgctatgagtgtggtgaagctggccactttgcacgtgaatgccgcttacggattggttcaggaggcttgggtagtggaaggcgtcgcagccgaagtcctagatatcgcagccgaagccgcagccgcagccgcagcccaagatatcgaaggagcccaagctatagcagaaggtaatttgctaatgacaccaattcaccacatgtattcatccagtagttttaattaagggttgggaaacacgacctagaaatcctaaaacttttgagaacgaagcaaaatttcagagataacacgttccctttaaccaagtgagtatccactatccagtatggtctcagatttgttggatagtatttaaccaaacattcgactatgcattttgactttttgagtgttgttctttatcttgcattggtactatataatacaatgcattctacaccccctcccacctgttatagctttgttagcgttggcctaatatttcaggggaacatgttgagagacttcataaaatacagatcaatgtcttcttgcctaactagcagccttttcaatgcgttattttatgttcatcctgaaaacaaatgttcggtttttccggagctacagcccgcgaggtcgttctcctaggaggcgaagttacagcaggtcgccactgggatctcctgcacggagtctcagcaggtcaccgccgctgccgccgcctcctcccagaaataacagcaggtcaccacctggagcccgagaagtgagcaggtcgccgccgccacctcctcccagaaataacagcaggtcaccaccggcagcccgagacgtgagcaggtcaccaccggcagcccgagacgtgagcaggtcgccaccaccacctcctgatgccagaagaagctatagtggatccccaggacagcagccacaacgcgacgagtccccatatgccaatgacgcctgagattctcttagctgccccaagatgctggaaaatgctaggggcccccagcatgttttgcctgtccggtcggcacaactgtaattctgtaggatcgagtctgagattttgttccagtgttttgggtttcccttgacacatcgctgctgatacaattgtggaggcaggagcacaacgtttctgttttaagtattgact

SEQ ID NO: 5862 - DNA, 2796 bp, Zea mays
cattgggtacctcgaggccggccgggcaaccgcgaggccggccccgacccctccctccattccatcgtcttcgcttccactccccacgttccccgcctgcttcctccaggccccggccagatccgcgcgcccgcggggaagagggcctcctctcctcctcctcccttggctcgcgctctggtcgaggaggcggaggccggtgccggcaggcggggaggtaggtaggtagcagcttgcggttgcgggagggaagctgcgcgcgctaggctgccatggcggtggagaagacgctgcccggcgcgagtgcggggaggaccgtgctggtcacgggcggggcgggctacatcggtagccacgccgtgctgcagctcctcctcgcgggcttccgcgccgtcgtcgtcgacaacctcaacaactcctccgagctggccgtccgccgcgtcgccgcgctcgcgggggaccactcccgcaacctctctttccacaagattgacctccgtgacaagggagcactggaaatggtttttgcttctacaagatttgaagctgtcattcacttcgctggattgaaagctgtgggtgaaagtgtacagaagccattactttattatgacaacaacgtcattggcacgataaatcttctagaagttatgtctgttcacggttgcaagaagttggtgttctcatcatcagctgcagtttatggatcacccaaaaactcaccctgcacagaaaattttcctcttactccaaacaatccatatggcaaaacaaagctcgttgttgaggatatttgccgggatatctaccgttcagatcctgaatggaagatcattttacttaggtacttcaatccagttggtgctcatcctagtggatatcttggcgaggacccacgaggaattcccaacaatcttatgccctatgttcagcaagttgcggttggtaggaggccagctctaacagttttaggaaatgactatgcaacaagagatgggactggggtaattctgttgcatatgatgtgcttaattgtgtttttttggtataccattcaaattgattaatctgatgcatttgaagctgggtattccaaataaaactgttgtcaattttctgtcaaaatttaataatctgtggtaggtatagtactaacaagagttatgagaactgtcatctcttccttaaaaaacttgactaggtctgtttatatgacttgctgcctagtgtattgacccggcttgttgaagttgatctttaactacacaggacttcctataatttacttttatttcatatattggctatgttgcatagttttcacctttttctttctcttctttggcaccctgctgtttatatctctatagtttttcctctgcactttgtatggttgctatccgattctatatttaattatttataatataccacattaggggtgtactgaatttcccttataaaaagaagattgattcattgctttgtcatttccttctctatgtaagccacaagcttaacttgaattctggaacgatttataacctacaaaatcttctcattttaattcatctgactgaaagtttggaagatactcgcacaatagaacatatgatacccatgtgcttcttacttgagtcaattattttttacattgcttagggttaatgattttgaatcaaatatttagcgatatcattgtgacatctgtgattcacatgcgtcatggaatcatcccatctttaatgactaggctactagtgttgggactggggtccgagattacatccatgtggttgaccttgctgacggacatattgctgcattgcagaagctttttgagaactctagcatagggtgtgaagcgtacaaccttggaaccggaagaggtacatctgtgctggagattgttaaagcatttgagaaggcttctgggaagaaaatacctctgatttttggtgaaagacgcccaggtgatgcagagattctgttttcagagactactaaagcagagagggagcttaactggaaagcaaaatacggtattgaagagatgtgccgcgaccaatggaactgggccagcaagaacccttatggctatggatcacctgactctatcaagcagaatggtcaccaaacaaacggatccgctgactcctccaagcagaatggccaccgcacaaacggttcaactgactcacccaagcggaacggccaccatgcgtatgggtctgctgactcacccaagcgcaacgggcactgcgtttttggatcatcagacctcaagccgaatggtaatggccacctgcgctgagcagaactgtttggcctgtgagctccctgtacattcggttgcgatgtgagctccctgcacgttcggtcgaggtctatcgtgaacccactatccgagattgatgtggatcattgggttgacaggtcatacagtatagagccggtggcagaggaattcctgtttgctgtgggtaaagcttatcttctgctttcgtgttttttcttgcttctttcgattatggtgtaggaatgtggtcataatgtattagctgattatcctttccctgctaattggactttattacgcttcattaagtttggctgattactgtttaacggggaaaagttgcacctgtgtacgattatttatttgtacctgtaatatttatggagaactagcctcgccgcaaatagccctgatgaattcagctgcagtttattcccagattggactgttgtttaatgtgaatgtaaatatgatgcctctgcaaacattgagcagat

SEQ ID NO: 5863 - DNA, 2568 bp, Zea mays
tgcaggcagcacgcaggtgacaccgattggggagatgcatggcaggtggcagcatagctcttgtttttggttggcatagcggtatagcacagaagggtgacactatgggtctgggacagagtggttgaagtaaaaagtctgcatgtgggggcttgtatgtaggtggcgctgtctatgatcaaatcttttgactcacaccgacgttccgcgcgtagccatctcttgagtttgaagtcgaagttaagccgcgtcttgcagcactggtggaacgtgctttagcatcttcctaaattaaaatcaatcaactccatggctggctgggaagtcacaccaatccctatacatataataatgacaccatacgttgcgtttgtcctccagcttggcgcccatgccgttgtaggtgcacacggcagaatgcggttcggagctccaacccaaagcaaaagatccggtgcgagcgcgctccccgcgttccttttccagcgacgctgagcgcgacccgcgagtggtgcccggccaccaggccgcacggcaccaccgacaacctgtcctccggccggacacgctgctgcgcggggcccgccgcggcgccgccccagctgcacgcaacgcaactccagccgcgcataaactcggtcgcccccgcacgcgtccccacccctccctccattccatcgtcttcgcttccactccccacgttccccgcctgcttcctccaggccccggccagatccgcgcgcccgcggggaagagggcctcctctcctccctcctcccttggctcgcgctctggtcgaggaggcggaggccggtgccggcgggcgggcggggaggtaggtagcagcttgcggttgcgggagggaagctgcgcgcgctaggctgccatggcggtggagaagacgctgcccggcgcgagtgcggggaggaccgtgctggtcacgggcggggcgggctacatcggtagccacgccgtgctgcagctcctcctcgcgggcttccgcgccgtcgtcatcgacaacctcaacaactcctccgagctggccgtccgccgcgtcgccgcgctcgcgggggaccactcccgcaacctctctttccacaagattgatctccgtgacaagggagcactggaaatggtttttgcttctacaagatttgaagctgtcattcacttcgctggattgaaagctgtgggtgaaagcgtacagaagccattactttattatgacaacaacgtcattggcacgataaatcttctagaagttatgtctgttcacggttgcaagaagttggtgttctcatcatcagctgcagtttatggatcacccaaaaactcaccctgcacagaaaattttcctcttactccaaacaatccatatggcaaaacaaagctcgttgttgaagatatttgccgggatatctaccgttcagatcctgaatggaagatcattttacttaggtacttcaatccagttggtgctcatcctagtggatatcttggcgaggacccacgaggaattcccaacaatcttatgccctatgttcagcaagttgcggttggtaggaggccagctctaacagttttaggaaatgactatgcaacaagagatgggactggggtccgagattacatccatgtggttgaccttgctgacggacatattgctgcattgcagaagctttttgagaactctagcatagggtgtgaagcgtacaaccttggaaccggaagaggtacatctgtgctggagattgttaaagcatttgagaaggcttctgggaagaaaatacctctgatttttggtgaaagacgcccaggtgatgcagagattctgttttcagagactactaaagcagagagggagcttaactggaaagcaaaatacggtattgaagagatgtgccgcgaccaatggaactgggccagcaagaacccttatggctatggatcacctgactctatcaagcagaatggtcaccaaacaaacggatccgctgactcctccaagcagaatggccaccgcacaaacggttcaactgactcacccaagcggaacggccaccatgcgtatgggtctgctgactcacccaagcgcaacgggcactgcgtttttggatcatcagacctcaagccgaatggtaatggccacctgcgctgagcagaactgtttggcctgtgagctccctgtacattcggttgcgatgtgagctccctgcacgttcggtcgaggtctatcgtgaacccactatccgagattgatgtggatcattgggttgacaggtcatacagtatagagccggtggcagaggaattcctgtttgctgtgggtaaagcttatcttctgctttcgtgttttttcttgcttctttcgattatggtgtaggaatgtggtcataatgtattagctgattatcctttccctgctaattggactttattacgcttcattaagtttggctgattactgttcaacggggaaaagttgcccctgtgtacgattatttatttgtacctgtaatatttatggaaaaaagaaaaaaaaaaactcgagggggggccgggtaccca

SEQ ID NO: 5864 - DNA, 2723 bp, Zea mays
accccaccccttctgagtctactacaccaggatagtctttagttcaatcgtttcctttgactcctgctcctgggcatggtatatcacttgatagctttcctcttccaggaaaaaaaactaggatgcatttgaatccctgtggcttatgctaagtccgcccttggtcagtggtcatgcagcattagtccggtcatcttctttgacccagtcggaaatgggtttagaccagtataagcatgaccagtgtgcataccctcggcctgtacccgtaatctagagaatcacagtgtcatttagtgaaggaagctacgctccgtagtatgtaagcaggtgatacatatgctgaaccaaagtgtgttcaggtcattttaggtggcaagtcaacatttatgctaggctaggacattgtccatgatgtaaacaaaaactcagttttttttcttcttgtgattgatttacctagcattttcatatgcacagcaagaaaagagaagatactgttatcaatactagtgcccaaatttattcttgttgaaactctttttgctgctttaaatatcttttcttaaccatttagatttttcctgtatgactttcctactctactagcacaaaaacaaagtatgaaaattccctggccctaattttaattagtaagagatattcttggaggagagtgaatgagaggggtgtcttgattgattaggcagtgctgcttcctatcaaggcagaaaattgatagaggtgtgcagaagtctagtcaggctgcaatgaagaaatatattcgtgaaccttttttattttgtgtatccttattaaagtacattatgctatgtcatatgagtaagattggctagaaacttttgttgtgccatggagttttagaaccagtctcattgcttttgccatcagggggtttgcttttcccctgtcggtagtttgaacatgcttagctctgtagctcgtatggtactgctatttcagaaaccatataaatgcaacaacaacatgaacacaccttgcctgcaccttgcctgtatttcaagaaatagtaaaagggatggaagaaaagggtgatatgtttaattaccttgctggttgctgctgctgcctgtaaagccattccattggtagaggagtgccgaagtcaagtcagggtgcaaagttggatgaatgaactcttgaacctttttgtttgtgccattctttattaatatgggctttatcccatgtaataagacaagtaactcttacatgaaacttatgttctgccatggagtttccaagtaggttagttgctcctggtgtcataatctccaaataaccccatgagaatatctttgtttgccctgtccaccaggtatttcaagtttcaactgaaaaattatacatcctatagtttgcaaatgagcatgaattcgtggcgcatgaaaaaaaaagtatattctgcttgtgtatttcatttcatagactgtgaaccaggtattatcagcctggaaagaacagtcacattagcaacatgtttgtgttctgacaacctgaggcggtgtcgctattacaaatctatcgttggttccgtaatcaccttgtatgctgtttggttgacgatggtccaacaaaaagaaaataattctagtcgtcttcttttgatcttgttcttgtgactagcagaggccgcggcgcaacatggcgaagatcaagccgaaggccttgctcgcgcaaagcaaggtgaagaaggtccccggccaaatcagcgtggccacgatcgtcacctacatgatcctcggcgtcctggtcgtgtcctccgtttacgctgcctacaggtactgctgggcaggcacaggagcagcggaggcagtgggcgcccaggggaactgatcccccttccgactgcgtggctgatctcgctgttgttgtatcatccggttggggtaaaatttttggttgttgctgtctagcaaatggggttcatgggacatggataggttgtatgttgatacggttacaccgtagccgatgatatgtatgttgaatttcttcccttttattatcctttgatgatccgattgcctctgctcctggaactgctttactttgaagtctgtgcctgtgacgttagcccagaagtcagaaccgcacagcacaggcatctttttgtttatacttgaacctgaaaggcctttctttccatcaagaggggtagagtttgtctgtctgtttttcgtacagcaagcagggaatcggcaacaacaggttgaaatacgctgcgacgacatacagcatatttattaggatgagattagcctttttgttttttgcatggtggaaatggaaagaaaaatgaacgaatgtttctggtaccttttgaagcctgaaagagtgaactgtagtgtgccaagaaaaagaaaaaaaaaaggctatcgattttcgtgcagttatcagcacaaaagttagagacggtgggctgtgggcgtgcacagagacacctgtcccctgcttcagaaatcagaagacggcccccaaacccgtggtatcaatgattgatctatcatgtctcgtgattcattcagccatgcgtcgcgtcgggtgatctgatcatcccgcactatttattcccgtatcaatgattaaagccttcgattcgccctgtgattgtgatttatagtggagctgttggcttctaattaaagcagcggtaatttatagtgataaaaacgctgcag

SEQ ID NO: 5865 - DNA, 866 bp, Zea mays
gtatagcggcagtccaattaggatctaggttttacagtgaacggtctcaaaactgtaagagcagagagattttagaaagagagagagagagagaaggatctaggtcacaatatagacgaaaaccaatcggagacgaatggtcgtcgcactcgcacgagggctgattcctttccagctcgcaccgcggttgaacagcgtttcgttgtttcctccccaacttccaacacgcctcgatctagatccactcttcccccttctccttccggtcctccccccgagactattcatataggcgggtaggcgtccgaggcctcgtttgttctcggcttcttgtctccaagggtgctactccgtccgcgcttggtctgctctcgtccttccggaggccgcggcgcaacatggcgaagatcaagccgaaggccttgctcgcgcaaagcaaggtgaagaaggtccccggccaaatcagcgtggccacgatcgtcacctacatgatcctcggcgtcctggtcgtgtcctccgtttacgctgcctacaggtactgctgggcaggcacaggagcagcggaggcagtgggcgcccaggggaactgatcccccttccgactgcgtggctgatctcgctgttgttgtatcatccggttggggtaaaatttttggttgttgctgtctagcaaatggggttcatgggacatggataggttgtatgttgatacggttacaccgtagccgatgatatgtatgttgaatttcttcccttttattatcatttgacgatccaaaaaaaaaaaaaaaaaaccaacaaaagaggcccaaaaaaaaaaaaagggaggacgactcaaaaagatccaaaattaaaaaaacaagaat

SEQ ID NO: 5866 - DNA, 1205 bp, Zea mays
tttccttcgtttccgtccgtttccgttttcatcctacctgctcgagacagcccgcctgccccccatatgcacgcgtcctctcggccggcccggccctttcttctttccctaatccccatctccccttctctcgctgctggtggcctgcgaatggcgggcggaagcggcgaggcggctatgtctccgccgtcctctagtgccagcgggaagcgcgggcgggacccggaggaggacgtgtacgtggacaatctccattcccacaaacggtatctcagcgagataatggcatccagtctgaatggactgtctgttggggattcactgcctgacaacatcatggagtcccctgcaaggtcagagactgcttcctgctacagggatgagatattatcccaatactcaccgatgtcagaagactcggatgattaccggtgctatgacactcaattaaaccccagtgggaatcatcctgatgcgatgatcagcccttcaactagcccaatgtcatctcctcatcgacaccagagaccacaatcttctttgttaccttcaaacccataccctctcccaagctgctccctttcgtcagtagtctgctctcatgctcggcgtggctccgataatgaaggccggttcccgtcctcgccaaatgacatgtgccatgtagcagatttgaggcgaacagcactactgaggtcagtgcaaatgagggtgcagggaccccattcgtatgacctatcattcggcatcagacaaggacaagatcatgcacatgagcatgaaggggaacatgaccatgagcatgaacatctagaggacttggaagggacagaaggatcatcttgcaataagtcaatcgttaacgaagtcacgtacaaccagagacgtgaccatgattttggtcggtcagagcacgagatagattacatcaacaacagcacatcagatgattgtgtaagtgatctaaaatttaagcaagaagataagagccatagtaaatttgatatccctatgcacaaaaattcatagcacatggaacatatgtgttagttttttggattataactctacttaacttcattgtattcttgacggatgccttatctattgtccgtggttttagcatcagcgttctgaatagcgacattgtaatatttgagtgaaattaacctttggattgttgcaaaaaaaaaaaaaaaaaaaaa

SEQ ID NO: 5867 - DNA, 1838 bp, Zea mays
  misc_feature (1837)..(1837): n is a, c, g, or t
ttttatttttatttgatctatgaacagtgcgcggccataaattagtacacaattaattagcaaacttcgtaattagtataaataccttagtcataaatcgttggaattatatgttttttaaataataagaaattcacaatcttctagtacacgacacgagtggcttccactacacgactggcttccacgacacgccatgacctcctggcttccttgacacgccgaagccatctataaataaggtattgtgcgggcatgttcgaaaaatctagacactcatctcttctctaccatccgccattccatcaaaagtacgtagtacatactcttagttcagctcgtcatggactcattcaaaagcctagtgttgtcttcgtcatccgatgattctgacgatgagatcgataacttcttggtttctcaacatgttgaccaccttggagtaggagccacgagcacgcgtcgtaggctctcttcattgcctcgccgagttatccaaggggaccacgctgctggagaaaatctcatcaagcaccactacttcggacctaatccagtgtatccaccacatatttttcgtcgaaggtttcggatgcatcgtcctttattcctacgtatccttcgtgccgttcagcaagaagacgattatttcactattcaatgtgatgcaacaggtttagctgggctcggtccattgcaaaaagtatgtgctgctttgcgtatccttgcgtacgggttaccaaccgatgcggtcgatgagtacatacagattggccagactacggctagggactgtcttatccgtttctgtcgcgcaatcatctcttcctttagcgaacgctacctccgtatccctaaccacgaagatattgctcgcatactaagtgtaaacgtcgaaagggggtttccgggaatgctaggctccatcgattgtatgcattgggaatggcgcaactgtcctactgcatggcagggacagttttgtgggcgcaattcgaggccaacaatgatactagaggcactcgctgggtatgacctctggatttggcatgcctttttcggaatgcctggtactaacaatgatctgaacgtcctgcatcgttcaccagtgtttgatcagttacttaattggactatgccaccagtgaacttcactattaacggtacgacgtataatttcggatactacttagcggatggcatttatccaaattggccaacctttgtcaaagcaattcgtcacccatttgaggagaaaaaggttcacttcacaaccaagcaggagagttgtcgaaaggatatagagcgagcatttggagtattgcaggcgaggtgggcagttcttcatggcccagcttatggttgggatcgtactcacctcgctgagatgatgactgcttgcattattatgcataacatgattgtcgaggacgaaggagatggtgcagcaaacgtggatttcattgggcccactagccccccagaagtttgtaataatattcccgaggtacgcaacgagtggctacacaatcatatccggtctgaattaccaaacgaacccgatcaggacatcactagtcagtcgacatatttgttgttgcaacacaacctcatagaacacctgtgggcacgtcgagggtcaatgggttgaagcccttttctgcaaactgtgatggccgcatgttctgtgttccatgtctgtagtttatcatgtcatgaatctgttacaaataaagtgcacatgtgctctgcttggtctcttgtatgaatgaacctgattgtcaaatataatattatgaagttataaaaaaaaaaaaaaaaaatatcgataccgtcnt

SEQ ID NO: 5868 - DNA, 1015 bp, Zea mays
caccttgggccccccgggggcggccgggagcacacgctaatttgcattgctaaccgttgcaccggccatctccatctctcatagcctcacagtcacaagggtgaggagtggagagacgtcggtgagtttcaccatatggcggtggggaagggaggagggctgctggtcctcgtcgttgtaggtctgctcctgcacggcacccgtgtcgccgacgcgcagtctctccgggttgggtactacagccagacgtgcggcagcgccgagtccatcgtcgccgacgaggtccagaaggcgtcgtacagggataggggcgtcctggccagcctcatccggctgcacttccacgactgcttcgtcaatggctgcgacgggtcggtgctgttggaggccagtgaccggcaggcggagaagaacgccaagcccaacctgagcctgcgagggttcgacgtcatcgagaggatcaagcagaggctggaggccgcgtgcgcgctgacggtctcgtgcgcggacatcgtggccttcgccgccagggacagcgttaagctgagcggtggcctttggtacgccgttcccggcgggcggcaggacggcatggtgtcgcgggcgagcatgaccggcgacctcccgcctccgaaccagcgcaacgtggacctgctcgcgcagtacttctaccgcaagggcctgacgctggacgaaatggtcctcctctcagccgcgcacacggtgggcatcgcgcactgcagctcgttcgactaccggctgacgagcgaccaggacaagggcatggacccggccttccgcacagcctacggagccagtgccagtacaaccccagcaactacgtgcccttggacgccggcagccagtacgcgttcgacaccggctacttctccaacgtgctggccaaccgcaccgtgctcgactccgacgccgccctcgcctcgccgcgcacagcagacaaggtcaagcagtggaagaacaacccggactggttcaagaacagcttcgcggccgc

SEQ ID NO: 5869 - DNA, 903 bp, Zea mays
cctgcactgcaggtcatctgcgagggcgcctgcctgaccagatgtctggccggtggctaaaatgttggctccttcggacctgatgatttcttcgacgacgaagtgcaggagggtcgtcttgccgtcgacgcccttcacgtcgactagcttgaggagcgcgtccagcttgaaggcgtgggcgttcccacggttcgtgccggtgttcatgcggttgcccgtcttcaggaccgcgtctagtatcttgtggaacaacctgctgccctgtagctcttcgcatgctgcctcaagagttttgtaggaggtcttgaggtagtcaacctctaaatcgaagttggtgatgtacagcatcgcttccactctcttgaaagcgaatgggatcgcgagcaccgccttgaggaagctctcagcagggccaagctttgacacagcgtcctccctgcattctttcaacttgatctcctcttccctgctaggcgccatcttcagcagcatctccaagagctcagatccaaggctctctgcctgcccatctaggagtgctctgcacacttcttccttggtcgcattgagcgccctcagcattatcgcgatgttttgtgatttcttggggtcgaggaccttgttctcctggctgcacgaactggaatttggcgccttgattccactcttggaggatctccatgtcgaatttgagacgaacaacgtctcaatcatctcttcgttcactcggaaagagctcgccttcagctgatcccacaccgtcggtcggccagagctcgcgcgcaccttgtcccagtgcaacggcttcagcttcggcagagcgtccgcgtccgcgtccgctggtttctctgacgctgacgaagcgcgccctggagactcttctggggtcgtgccgaatcgatc

SEQ ID NO: 5870 - DNA, 913 bp, Zea mays
  misc_feature (144)..(144): n is a, c, g, or t
  misc_feature (169)..(169): n is a, c, g, or t
  misc_feature (178)..(178): n is a, c, g, or t
  misc_feature (183)..(183): n is a, c, g, or t
attcggctcgagggaggatcaggcgctattgtacctgtgggatgcgatcaaagaagtttgatgggttcattgaccttgatgcatatgatacaatagcaatgaagatcaaaggggatggaagatgctacatatctacagtgtgtnttctcacacaagactcactcctgcntctttaatntccanccacgcccggtcttccccccccgcaaccttcatttgttcagatatacactgagaattgggtgaattcaccctttcttcacgaagacaactcgtggcaggcttttgtgtacatacctcctcaagacagatgggaagtcttgaagatccctcttgatcgctatttacccacatggagaggaaatgtgatccaggcaaagttggaaatgaaccctgctcggatcgtggggatgtctctctctgtaaacgcagaaggcggtgttcctggcgccaagactgggcctggtgattttaggcttgatgttgcttggatcaaagcgttgagagcgttgtgacatccacatgtcatagttttatttcacatccctttccttctttatcaccctgctccagcggcgccgctgaactcatcagccgaccacaaccacaggagtaaccatagcacagattcccaactcctttatgcacttaataatggattttgttttacttctgaggtttatgaataagtggtagaaaaatggacccctgcattatattttgataaagaattcatttgaacaatccaccaaggcaaagatgtatgtatctatctattcggagggcaagagcatgctttgcttgctaccttggcagcttggccagaaacctcatgtccaccggctgcttcgggagcaccggcgtgacacgggacagcagagatgtcttcgtcgacgcggccgcgaattcggat

SEQ ID NO: 5871 - DNA, 1708 bp, Zea mays
aaaaaggggggctgccctcagttcctcaaccagcggccgaccgtcgaccgagaagcccgagcagcggtccgatcaggtgagcagcggcgcggctgctgcctgcccgcgcctgcctccgcggctccgccggccgtcgaccgagcagccgagcagaggcgcggcggctgcctgcccgcgctcgcctccgcggctccgctggccgtcgttcgccgacccgaacgccgagtcgcgcgagcgtgccggcgtgccccgcctctcgtcggctcgcgactgcgccagcgcggtcgcgccgccccaccccccggtgaccggcgtccggatccatccgtctggcaacccaaccggccaagggccaaccccgtccccggaccccgactccccgagggccaaccggccaaggcacaaccgctgaaccgcacaatgcatatttagtcgcctactcgcctaggcctattatttccctctcaaactcaaattcttcctggaatccaccaaagccctgcctcccctctactgattctgaaagtggagttccatctgcgcgtcggttgatttattctatttgctgagttggactacattacctccatgtcgagactgcgagctctgtggcaggcttcctttaacgccacaaagagagctcttgtatggagttcagatgatctaattccgccaagtgaaagatgtatcttcaatttcaactcaaaagatgagctgaaaaggtggcatttgtactcagattcagagtatggaggtttgtcttctgcatccttagaaataactgatggcgcttcagttggagatactccattaactggtgtgttttctggtaacctttctttggatatgtctgaagagtcaacatggaggatcaggcgctatggattctgtgggatgcgatcaaagaagtttgatgggttcattgaccttgatgcatatgatacaatagcaatgaagatcaaaggggatggaagatgctacatatctacaatatacacggagaattgggtgaattcacccgggcaacaagaagacaactcgtggcaggcttttgtgtacatacctcctcaagacagatgggaagtcttgaagatccctcttgatcgctatttacccacatggagaggaaatgtgatccaggcaaagttggaaatgaaccctgctcggatcgtggggatgtctctctctgtaaacgcagaaggcggtgttcctggcgccaagactgggcctggtgattttaggcttgatgttgcttggatcaaagcgttgagagctttgtgaactccacaagtcatagttttatttcacatcggccctttccttctttatcaccctgccccagtggcgccgctgaactcatcacccgaccacaaccacaggagtaaccatagcacagattgccaactcctttatgcacttaataatggattttgttttgcttctgaggtttatgaataagtggtagaaaaatggagcatttagttaaggtgccccctttggacagatgttgctttttctctctctctagtatctgatcggccgataaaacgagtgcattccacccggacgataatgcgagagtaggattcagtttaattctttgactgttaagagtactactgtttgatcgtttgaattatacacgttcatttgagtaatttttttttcaaaaaaaaaaaaaaaaaaaaaagaaaaaaaaaaaaaaaaa

SEQ ID NO: 5872 - DNA, 2004 bp, Zea mays
gtttattttataggcgaccacaaaaataatagccgacgggccccaccgtccaccgccgccctagacgtggcacatgttcttccgcctggccttgaaggcttgaagcttccagaacaacggaccggccaaaaacaacggaactttctcgtagtttcgttgtcccaccgccccgcaggcccgcacgcaacatccaccccccaaacgggaccggacgtccggacggacgccggaaactcccttttttttcgccacgagtggcgggcgggtccctcttctctccgtccccacctactactcggcgcctctggtttctctccaagtctccatgctacgcgaccggaaacttccagaatctaccagtaccaccttcctctctctctctcactcttcctgcgcgacggtgcaccctagcccgatccgcggcgccgccatggtcgccgagcaggccaccaccactgtggctgtgggcgagccgccaactgccaccccgcagccggcggcggcagcggctgcggggcagaggtccgtgcccacgccgttcctcaccaagacgtaccagctggtggacgacccggcggtggacgacgtcatctcgtggaacgacgacgggtcggccttcatcgtgtggcggccggcggagttcgcgcgcgacctcctgcccaagtacttcaagcacaacaacttctctagtttcgtgcgccagctcaacacctacgggagcgactcgtcccgttgcatccatcgtttcattcccgtcccgtctcgtctcggcttgtttgttgtgatccggggctccaacgggtgcaggggttcaggaagatcgtgccggacaggtgggagttcgcgaacgactgcttccgccgaggggagaagcggctgctctgcgacatacaccgccggaaggtgacgctgccagtcgcggcggccacgagggcggtcacggtggtggcgaccatccccatggcgctgcccgtggactcgccggtgtactccggcgaggagcaggtgctgtcgtcaagctcgtcccccgagcccccgtcgctgctgcagcagcagccgacgccgtccgcgtctggctccggtgacatgggcgaggagaacgaacggctgcggcgggagaacgcgtggctcgcgcgcgagctcgggcagatgaagaagctgtgcaacaacatcctcctcctcatgtccaagtacgccgccactaagcagccggacgccgccaaggcggcggccgccgggaactgctccggcggcgagtcgtcgggcgccgccgcggcgcctccgcttccttcgatcctggagctcctgccctcctgccgccgcgaccccgcgtccgcggccgtcgacgcagcggcagcggcagcgggaacggagcacgaggttgatgaaaaggcgggcgctaggctgttcggcgtctccatcgggcggaaacgaatgcgggacgagagcagcggtcacggcggcggcggcgaggaccccgtgggccgctcggcggaggtgaaggcggagccggtggacgcgcgtctcgaccatcagcacagcgcgacggagccgcagtcgtggcccatttaccggcccaggccagtgtaccacccgctccgggcctgcagcggcttggtcagcgctgggagcgaccacgactggtccaacaactcgaggtgacttttgcttgcaagcccaatcgtccacaggttacaggttaaacttagaatgagagatcaagtgtttatgtagcaataactttttgttagtttatctcatattaccgcaagtttcgagtatcattcatgtatagcgatccattaaactagaggttaccttactgaggacgacttgaattaaagtcagttgtttaaactgctagtcagttatttagactgttatcgttgtatttcataatgttaagtaaccctaattagggttatgtgggtaaatatctgctttgcccctaaggggtctcacatctttatataagcaacttgtacaccacctcataagatagag

SEQ ID NO: 5873 - DNA, 2670 bp, Zea mays
tttaagaactagtttgagaactcaattttcttaagaattcctattttttataagaaaaaatggactaatttctctttgaaaaaataaaaataccttataaaaataaagttctccgactagcccaaagggaattagttttacataggaagcagaaaaacaaaaccagcagtgtcgttgcatcttttttttcttctttgggaaagaaggtgttgagatgttctcctctcggaagaaagaaaaatcagctgcccatagcgggccccgggcccagcggaagaagatagtggagaaggatcagaagatagagtatggcactcctgctcctagcagtcaacctcaacagtctcttttctgcgcggacgtgcttcagcaatcaacctatccatcaaccgatcgatcaacagcacgtgttgaggaaactagtagcgctcgatgttaccgttgagaaaattaacagacaccagatgacagcagcagctagtttctggagtatgggcagagtccgcgcgggtgcggacatgtcgttcctcacggaatcgtcgtcaacctctggctgattgatgctcgatcggtacctcaagtagccggcctatcgccatcctcgtcattggagcacgtacgtatcctctcgatgttgacagacacaagataaaaatatctccccggcaccctctcggccctccctgccgtccgttcgctccctttcccccagctacggcacggccacggcgccacacactcggtgggtggcgtctgctcgtgctcgaatacgcggcggcagcgaggacgtcggaacttccagccatggacgcggcagcgacggccgtgtcgtcgagcggcgacgctcccgttctcctccttgccctcgccgtctccctgctcctcctcgcggcggccgtctggtcgtcgaggcggagtggtcaggggcacggcaacggcaacggcgcgccgagcccgccgtcgcgcccgctgctgggccacctgcacctgctcggcaagccgctgcaccgctcgctggcggcgctggctgccgcgcacggcgcagggggccagctggcgccgctcctgtccctgcgcctgggcgcgcggcgggcgctggtggtgtcggagcgcggcgcggccgaggagtgcttcaccgcgcacgacgccgcgctggcgggtcggccgcgggtgctggccggcgaccggctcgggtacgggtacacgatgctggtgtgggcgtcccacggggaccactggcgcgcgctccgccggctcctggccgccgagatcttctcggcggcccgcgtggccgcgcgcgccgccgaccgccgctccgaggtcgccccgctcgtcgccagcctggcggcgctccacctccactgcggcggcggcgcggtgagtctccgacccaggctcttcgagctggtgctcggcgtcatgctgcgggcgctcacgggagagcgcgcgcacggcggcgacgtgcgcacgttccagggcatcgtggaggagacgttcgccgtgagcggcgcgcccagcgtcggggacttcttcccggcgctgcggtgggtggaccgcctacgcggcgtcgacgcggcgctcgtgcgtcttcaggccaggcgcgacgcgttcgtcggcggcctcgtccaggaccaacggcggcgaaggcgcgacgccggtgatggccgaggccgacacgcggcggagaagcagagcatcgttgacgagctcctgtcgctgcaagaaactgatcccgagtactacacggacacgatcatcaaaggcgtcgtcttggtgagttagtagtctactgtgatctgctagttgtatcttgttgcaccagaatgctgctttggcccatggtgattaacatggtcgagatctccatgacgatcgcatacgcagatgctactcactgccggcaccgacacgtcggcgctgaccaccgagtgggcaatggcgctgctgctgacacacccggaagcaatgcggaaggctagagccgagatagagactagcgtcggcaccgcgcggctcgtggaggagtcggacatcgcgaacctcccgtacctccaatgcgtggtgaaggagaccctgcccccccgccccgtcggcccggtcatcccggcgcacgaggccatggaggactgcaccgttggcgggttccatgtcgaacgcggcacgatggtcctcgtgaacgcctgggcgatccaccaggatcccaagctctgggacgcgcccgaggagttcaggccggagaggttcctggacgccgccggtacggtgaccgcggtcaccacgcccatgctgccgtttgggcttggacggcggcgctgccctggggaggggttggcgttgcgtctgattagcttgacgctggcggcgctcgttcagtgcttcgagtgggatgttggtgaaggcggtgtcgttgacatgaccgaaggcgttgggctgacgatgccgatggccatgcccttggctgctgtctgccggccccgggagtttgtcaagggcatgctctctacttgaacatgatgagttaaacaatggtttttttataaacaaaaataaaaagttatgctatcagttattatcaaggttatgccgccatgcccttgacgctaccttttatatggatgttatacatgttagtaaaaatatttgagaccacaaaacaaaaataaagtggcc

SEQ ID NO: 5874 - DNA, 1481 bp, Zea mays
ctaacacttattacgcacgcgtaggacagtgcgtcgcaaatggtagtttaccctctgccataaaagctagtgttcatgtcgattgcactttcttaattttaacttaatttatagaaaacactaatggaatttgtatttcaaataataaaataattttaacaatctattaacgatagtaattacatattatatatattgacttcttatatataaatgatcatagtttaaaaaaccaactagcttcttgagaaactataacaacacgtgttttgttttgggaccgagggatatttagggttcctcctcccccgcgcggcgatgaatgagaccagtcgccctctgccccaggcaaagctgcagctgcagctgccacagcggtgaccacgcacgctgcaccgcaccgcaccgacgggtgagacctgctgtgtccaccaaccgtgagcccagcaggcgaccgacgacgctagcttagactaggaaccaacaatggccacgcgccacctgctcctcctcctgctcgccgcgctgctcccggcggcggccacggcggacccggacgcggtgcaggactactgcgtgccggacacgggcggcgggcgcgggcgcgggcgggccgtggatctagcgctgctcccgtcctacccgtgcaggagccccgccaacctgacggcggcggacttcgccttcgcgggcgtgcgcgccgcgggcaacttctccgcggacacggggttcgcgggggtgtcggtgacccccgcgcagttcccggcgctgcacaccctcggcgtgtccttcgcgcgcgccgacctgtccgcggcgggcggggtcaacccgccgcactaccacccgcgcgccaccgagacggcgctggtcctggccggccgcgtctacgcgggattcgtcgactcgggcggccgcgtcttcgccaaggtgctcgagaaaggggaggtcatggtgttcccgcgcgccatggtgcacttccagatgaacgtcggcgacgagccggccacggtgtacggcaccttcaacagcgagaaccccggcatcgtgcgcatcccggcgaccgtgttcgggtccgggatcaaggacgccgtcctcgagagggcgttcggcctcgagccggaggagctccgccggctccagaagaggttcgggcctcctcccaagaccaagacggcggagatggacgattgatcggaagatcaggcactcgcgatcaagggggacatgattaattgattagttatattaagagcagcagactttgtgatctctggaatatatctccttccatttgttaatgtctgtatgaattatttggcggtggacggtggttatcatggaccgataatgccggtacgtacagatgggatgggcatgtggggttaggtgtcacattcaattgtctacgagatgtttatgggtttatatatattgttaacaaaaaaaaaaaaaaaaatttgctctgaaaaaaaaaaaaaaaa

SEQ ID NO: 5875 - DNA, 2359 bp, Zea mays
agccagaaaccaagaaaagctcctaggttggagcggttgcattgtgctagatacactagattctagctagagctagtagctacttgcattaggctactagccggccatggcttgctgccgccgcaccggcgtccactgcggtgctggaccgagaagaaaccaactgcggcgatgttggggtggtgggggcttgctcgtgctgctgttgctgctggtggcggtggcggtgccggcgcgagggcagcggtcggacggcgtggtgatcgcgcaggccgacctgcaggggctgcaggccatccgccaggcgctggtggacccgcgcgggttcctggccggctggaacggcacgggcctcgacgcctgctccggcggctgggcggggatcaagtgcgcgcggggcaaggtcgtggccatccagctccctttcaagggccttgccggcgcgctctccgacaaggtcggccagctcgcggcgctccggaggctcagcttccacgacaacatcatcggcggccaggtgcccgccgcgctcggcttcctccgggagctccgcggcgtctacctccacaacaaccgcttcgccggtgccgtgcctccgacgctcggcgcctgcgcgctcctgcagacgctcgacctcagcggcaactctctctcggggagtatcccttccgccctggccaatgccactcgcctctatagggtcaacctcgcgtacaacaacctctccggtgtcgtgccggccagcctcacttccctcccgttcctcgaatcccttcagctcaacaacaacaatctcagcggcgtaattccgctcaccattggcagtctcagattgctccacgatctttctctcggtagcaatttgatcggtggaagcatcccagatgggattggcaacgccacaaagctcagaaaccttgatctctcggacaaccttttaggtggtagcctccctgagtcactctgcaacctcactttgttagtggagctcgatctcgacgggaacgacattggtggacacattccggcatgctttgacgggctcaggaatctgaccaagctgtccatgaggaggaatgtcctcgacggcgaaatcccggcgactgtcgggaacctctcggcactgtcactgttcgacgtgtctgagaacaacctcaccggagaaattccgacctccttgagtggccttgtcaatctcggttctttcaatgtgtcctacaacaatctctcgggacctgtgcctgcagctctctccaacaagttcaattctagctcgttcgttggaaaccttcagctctgtggcttcaatggctctgccatttgcacttctgtttcatctccgctcgtggcgccgtcccctccactgcctttgtcagagcggcgaacccggaagctcaacaaaaaggagctaatctttgcggtagctggcatcctcctgctcttctttctactgttctgctgcgtcttcatcttctggaggaaagacaagaaggaaagctcgccccccaagaagggcgccaaggacgtgaccaccaagactgtcgggaagaccggcactggcgcaggcaaaggcaccgacaccggcggggacggcggcggcaagctggtgcacttcgacgggccgctctcgttcacggcggacgatctgctgtgcgcgaccgcggagatcctcgggaagagcacgtacgggacggtgtacaaggcaaccatggaggacggcagctacgtcgcggtgaagcggctccgggagaagatcgccaagagccagaaggagttcgagccggaggtgaacgcactcggcaagctccggcaccccaacctcctcgcgctcagggcctattacttccggcccaagggcgagaagcttctggtgttcgactacatgcccaaaggcaaccttgcttctttcctccatgctcgtgcaccggacagcagcccggtggactggccgacgaggatgaacatcgcgatgggccttgcgcggggattgcaccacctacacaccgacgccaacatggtgcacggcaacatcaccagcaacaacatcctcctggacgaggggaacgacgccaagatcgccgactgcggcctgtcgcgcctcatgagcgcggcagccaactccagcgtgatcgccgccgcgggcgcgctcggctaccgcgcgcccgagctctccaagctgaagaaggccaacaccaaaaccgacatctacagcctcggggtggtcatgctcgagctcctgaccggcaagtcgcccggggacacgaccaacggcctcgacctgccgcagtgggtggcctcggtcgtcgaggaggagtggaccaacgaggtgttcgacctggagctcatgaaggacgcggcc

SEQ ID NO: 5876 - DNA, 1313 bp, Zea mays
cccctcccctcccctcccctccctgccaaattcgccaccatccccatctatatccagtcctctgctcccccccgttccgggaacctttgctttgcctctgcttcacttcacttcaagtccatcgcccgttgcagcggccgcggcggcaaacatatcacccagacgcggacgccatagtagattagattgatctctccgtggggaggaagaggagcaagagccatgtccagccccacgcacgtccgcaaggccatccgcttcgcctccctgcgggcaaagatcgcgcagcagggtaagaccggcctggcgctgcgcctgctcctcgccgccgcactcgccggcttcctcctcgtgttcgccgcgcgcaccctggtcacgccgtcccctgccccgacctcgtcgtcccgggcgcaggaatatcaccaggacgccgcgccggagtgcggcaaggggaacgcgggcctgccgctgccgctggcggtggcggaggcgctggtgcactacaccacctcgaacgtgacgccgcagcagaccgcggacgagatcggggtgtcgctgcgcgtgctgcagcgccgcgcgccctgcaacttcctcgtcttcgggctgggcctcgacagccctatgtgggcggcgctgaaccacggcggccgcaccgtgttcctggaggaggacgcgtcgtggatcgccagcgtgcggtccaagcacccggggctcgagtcctaccacgtcgcctacgacaccgtgctcaccgacgccgactcgctcctggggctccgcgaccacccggcctgcgtcgcgcagccagacctcgccgccgccgccgccgcgtcctgccgcctcgcgctcgccctcaagggcctcccgcccgtcttccacgaactggagtgggacctcgtcatggtcgacgcgcccacggggtggacgccgcaggcgcccggacggatggccgccatctacaccgccggcatggcggcgcgcgcgcgcaggcccggggacggacccaccgacgtcttcgtgcacgacgtcgaccgacccgtcgaggacaacttctccaaggcgttcctgtgcgagggatacctcgccgagcaggtcggccggatcaggcacttcgtcatcccgtcccaccgcgagaaggacggcacaccattctgcccttgacaaactttattttgattctttgagagtttgagtgagagccatccatccataatccatcttttttttttgcttttcatgcgctctgccttggctttatttacatacatatatataagacgaaaaaaaccctacagcaggcatatgcagcagccgtc

SEQ ID NO: 5877 - DNA, 1428 bp, Zea mays
aggcgctgtatcagagacctggtagtctcgagcatcttcaacgcgtactcaaacgtgtcagcgtcgacgcgtatcctcggaacgacgacccatcatcacgcctgggctctgctcaccgctttccttctcgactccacacggccgcgggctccagctatcgaagttgttgcaccgagaccgagggctccagctatcgttccggcgcctcggagagaaggtgctccaagacgagaccgaagggctcggcgaagccacgcagcactccccctccgcgcccgagagcttgcagtagacggcggcgatgcagcccaggatgtcctccgacagcttgcacgagatcttgggcacgtactccgagatggaggcgctcaggaagttgacgaggctggaatgcctcgcgcctgccttggcctctggtggtgcctcctcctcctcctcagagcctgagatggtcgtcgtcggcaggtcgaacgccgcggagcgctttatgtccctcagacgtagcgcgccctcgtcgatgcttttcagaaattcttggtccacctgctgctcgcttgtgaagctgcaggattcagatacgtattgatcaaacgctcttctgtagagagagagcaggtgcagttccttgcgtatgacttcctgctcgagcgctgcgatctccccaacccaaatctgcaacagactttgagctagccttttgggtccgttctgttgcttttctggagtaatgacctggcaattgctctggtaaattcagggagtgtcttctgttgaacatcttcttctctctgtcggcggcaggcttgcagtaggagaaccgtggcgacatgtccagtgcgccatcatgtggcttcagaatgctccgtgaagagtaccggcgctggagactgcaagtcgactgaaccgaccctcggcgtgccggcgcaggacgccgtctccgagagcacccctgacctcgactccctctccatcgccgaccgagccctgcctcaccctcacctagaaccttgagctgttcctgctgggaagagcgagctgcctgtccatgtgcggagagcaacaaaggcgccgtggctcagctttctccgggggagctcaactgctgctccaggctccggctgttcgaagaagtgagctccctcactcagctcgctcacgcagaggaaaaagaccaagtctttgttttcttggatatcaccgacagaacaggatcagtagccaagaacaagagggaggagacgacaggctagctagctgctgcccgaaaattcacaatggcgctcgtatgaggacgaggccgagaggtaggaggaggagaaatagcccgcgaggcgaaagaggcacaggaaagctggtggcgcggcagccgccgccgccaaaacaaatgggaatggaaaagaccccgcccgacggctcgaggtcccaatg
